United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 31

SEQ ID NO: 156183 - protein, 85 aa, Triticum aestivum
  unsure (1)..(85): unsure at all Xaa locations
  Clone ID: PAT_TA_50601.pep
YLAGRAGQKKRVRLLCRRALKDTVRWAVRSHLFXQQASXLRGRLKACRNVEYLEVVDRLIEDAEGXHSNFKRPDPSIVCWAPGCR

SEQ ID NO: 156184 - protein, 53 aa, Triticum aestivum
  Clone ID: PAT_TA_50602.pep
WSPLTPQKKTKQKPFQPIGLFDSSRSTVASRCGCFDLFSVFGCVSFSYIVLFF

SEQ ID NO: 156185 - protein, 53 aa, Triticum aestivum
  Clone ID: PAT_TA_50603.pep
DRILTCNNRSGLPLACTYTVICEDPFCACTAPIYSKLLLPKKKKKRAPLLEPP

SEQ ID NO: 156186 - protein, 113 aa, Triticum aestivum
  unsure (1)..(113): unsure at all Xaa locations
  Clone ID: PAT_TA_50604.pep
KKARAPKEGGEKKGKKKPKKSVETHKIHIFKVLKQVPRHLGISSKPMSLMNSFINHIFEKLPGESPKLAGHHKNPPLTSREINTSVRLVXLPGELPKHAVSEGPKAVPKFTSA

SEQ ID NO: 156187 - protein, 101 aa, Triticum aestivum
  Clone ID: PAT_TA_50605.pep
ATGVEDCTLSIEYTPTSNHSTAGALEIPYFITSIPNCWAVPNICTSNPGEISLIWTHFLGGLSAILAGFLGAPLDTHLGGTAWFVLTLPLTLKVKTDGIGG

SEQ ID NO: 156188 - protein, 75 aa, Triticum aestivum
  Clone ID: PAT_TA_50606.pep
RRRFFFFFFFFFFSTCRNGVRVYCDLTMGTKHLFGEPFGLNGGKRTRGNHPSQNITSRSERPFVTGVDTGGTPPI

SEQ ID NO: 156189 - protein, 143 aa, Triticum aestivum
  unsure (1)..(143): unsure at all Xaa locations
  Clone ID: PAT_TA_50607.pep
LCFSLPTNAESLIPKAQVVKVIGFSRSIKTRAQCEHYDIVPWDFPRNLELSSAGPVLTCEAVSSANFTNMVGRCGVWLQGGTECXRLKSPFSPLSLMSRTTQRQRRSYNPREQAEACGVSSRTDEKKKRWRQEKDQRGKGGRD

SEQ ID NO: 156190 - protein, 65 aa, Triticum aestivum
  Clone ID: PAT_TA_50608.pep
SYGTTAQGIKPKAQHIIQWRIHSVICSTGVNGNRRRRNTSGKTTPNTRIEQQQETPRGLPNLARG

SEQ ID NO: 156191 - protein, 97 aa, Triticum aestivum
  Clone ID: PAT_TA_50609.pep
CVYAGQYIQAEVGGGFGRDVMEFLVKKNPGVVAYPCVPPKVPFVYPFTPPMGLSGAQDQRVPPVAQELGWYAQHISSPVLDVGKYLSYVPQGLLDPL

SEQ ID NO: 156192 - protein, 87 aa, Triticum aestivum
  Clone ID: PAT_TA_50610.pep
IQTSVRLVIPGKITNRTFSEGNKWVANFTSLRIISQGLSGRGPRSSANHHCSCYGRGMLYPLPIEKQLSVSRSCTKTNVSVYASCYK

SEQ ID NO: 156193 - protein, 70 aa, Triticum aestivum
  Clone ID: PAT_TA_50611.pep
GAQFLEKFSGCPGFGGVGPAKVFGIDINDGRVVGQFDNQGARSTRHVGLFLSLNNFVPPFVSDGVVFSVF

SEQ ID NO: 156194 - protein, 93 aa, Triticum aestivum
  Clone ID: PAT_TA_50612.pep
MNTTYLDGLLAFFPLFIAYVGSPYPECGVFAGMLPRLCSFRPKMPVVVSTPPALNFYVNFAAIRSFVRNYACVNPRSEISRSLVKFVVSTWWW

SEQ ID NO: 156195 - protein, 93 aa, Triticum aestivum
  Clone ID: PAT_TA_50613.pep
LVLYCYSCRLCASCCIIALAKVRAQPLDVCSPLCECACFGWWPFSKCVSRPGPRSCMAPGSRSQRPYVFMLVPLPASIFLLQKKVAPQTIVIK

SEQ ID NO: 156196 - protein, 111 aa, Triticum aestivum
  Clone ID: PAT_TA_50614.pep
LGRTGATQVIHEVQQVKNESLKAHVRIIGFVLMPQAQWVSFGALTPQGWEESGNPYKARSARPTDKVPSQFCHLAHRFGFPSPLFFIPCLVRICVCPCLMSPHGSKQRVGM

SEQ ID NO: 156197 - protein, 106 aa, Triticum aestivum
  Clone ID: PAT_TA_50615.pep
HKGPFISTPVVDTVGKPRPRLLVSKSHLTQGPWCVDAPPRGPEYHTPHHLVSLYMETPLPGLGRTPCSNVFERFFITNNPPPILCYSPVPSRLLMSPPVCRFLNTW

SEQ ID NO: 156198 - protein, 103 aa, Triticum aestivum
  unsure (1)..(103): unsure at all Xaa locations
  Clone ID: PAT_TA_50616.pep
KSVTLSVKTCSTCPSSGIGPYLKKGQFAQRVGTGAPVYLCGVLXTSPPEFFDLHAXAVIDNKYTRIIRRHVLLSIRTNEHLRKLLAYFIILHVCFLLNIHCVS

SEQ ID NO: 156199 - protein, 96 aa, Triticum aestivum
  Clone ID: PAT_TA_50617.pep
SSRTQPTTTQSSIAPHIRSAVVSADVAVHHTQSIPMAVYIGLYPSRMGTVFVTELVQTLLKYVPVLWRLYPPTRRLIDARAHRPFILPPRAAIVEG

SEQ ID NO: 156200 - protein, 94 aa, Triticum aestivum
  Clone ID: PAT_TA_50618.pep
YSGVITTTTLFNLRCFAEETSTRTGTEALYIMRLYCVMLRPAFENLICTYIISSFRFGTIYTCDPEFLAHETSDDITIYVAYDITNFTSCWRAL

SEQ ID NO: 156201 - protein, 111 aa, Triticum aestivum
  Clone ID: PAT_TA_50619.pep
QAFKRKGGGLSIRVGAALLGMDHARARRAQHRVGLRLPCCSRTMSTSTRATPLSVLIMVAVCMLHRQRSALAMLVNQVSVVAVAKYSHLYKRLCVLASTPNRHGMERMNCT

SEQ ID NO: 156202 - protein, 173 aa, Triticum aestivum
  Clone ID: PAT_TA_50620.pep
NATSSGSGTSSECTRLLLRKFSADSYSSSSFLAMFRKDFVNGSLCFLTDSLLGELSTLEAMKSTRGLREFVALLAFSSALFVPWLEDPSVLSGVFSHASVQQATLERAMPRTNWSCQRGHCSSPCSLVLQGMALRSLMLQANQLKTKRVVQMLHLVTNPNLKVVLLTLLIMIM

SEQ ID NO: 156203 - protein, 68 aa, Triticum aestivum
  Clone ID: PAT_TA_50621.pep
YTRQTPTGGSDGAIFAHWSEILTHHYYWLIYGANVQKAMRGLSITYAEHYERLVITNINLNRLCQTYI

SEQ ID NO: 156204 - protein, 127 aa, Triticum aestivum
  Clone ID: PAT_TA_50622.pep
KGAACGRVSADTSPPPPSSSSSTGSPRGFLAGGSARGVGEKREGIQARRGNGDWRVGLRIGGDGTHQPTAATGEAIPPCDCSAFSAAAVAWWRRLIVSAASVLLPLRSDFGDSGVYLSRRALFSSRL

SEQ ID NO: 156205 - protein, 87 aa, Triticum aestivum
  unsure (1)..(87): unsure at all Xaa locations
  Clone ID: PAT_TA_50623.pep
VRXNSRXXTPRPSAPTHXKEHTQAAGHRQQRQAVENTKMAAVAILAALLLIANREPASATTAHHADSQINADAFPDGMSLWQQTNLD

SEQ ID NO: 156206 - protein, 166 aa, Triticum aestivum
  unsure (1)..(166): unsure at all Xaa locations
  Clone ID: PAT_TA_50624.pep
SPRPTDQLAASLQAAATLMPAKIGGRASSARPSSHVARAFGVDAGARITCSLQSDIREGGGKCADAAKMAGFALATSALLVSGASAEGAPKRLTFDEIQSKTYMEVKGTGTANQCPTIDGGVDSFPFKAGMYEMKKFCLEPTSFTVKAXGFHKNEPSALPYDQLMT

SEQ ID NO: 156207 - protein, 75 aa, Triticum aestivum; identical to SEQ ID NO: 106874
  Clone ID: PAT_TA_50625.pep

SEQ ID NO: 156208 - protein, 95 aa, Triticum aestivum
  Clone ID: PAT_TA_50626.pep
SAKISYISTYKVSRRLDREKKKNATFTPVEKYQISRLTNKHIGIGIQRLCPAGSRLPNTSGMKGWKACIDIHQLGLISLYHSQLQVLTHPNFIVP

SEQ ID NO: 156209 - protein, 132 aa, Triticum aestivum
  Clone ID: PAT_TA_50627.pep
RQHQHGRAPCPLPLFSEVVADASFIPEILPSELHSLQASLFRRRRGRHPESALAHERILKKLPKKQIIVMWTKNQTKILPRSGATSHLLTIFNYLLQDRKLKRYLTPFDVRLDRAPKNYSGCVDRALKNYSG

SEQ ID NO: 156210 - protein, 73 aa, Triticum aestivum
  unsure (1)..(73): unsure at all Xaa locations
  Clone ID: PAT_TA_50628.pep
DRVRTRLVLNYRAAAGYNEGRYWTKXRWLSFGATDATQVISEADEGKKDYPDAHARIIGFYNVRQVQCSSCIV

SEQ ID NO: 156211 - protein, 145 aa, Triticum aestivum
  unsure (1)..(145): unsure at all Xaa locations
  Clone ID: PAT_TA_50629.pep
MGGALSLRAPFSLRAGAPPAPRVDLAPAALSLAGVKQVRGARLHAQATYKVKLETPEGEVELEVPDDMYILDQAEEEGIDLTYSCRAGCCSSCAGKLVSGEXIDQSNQSLLXYNQMEAGWVLXTCHAYPKYDINIETHKEEELTA

SEQ ID NO: 156212 - protein, 105 aa, Triticum aestivum
  Clone ID: PAT_TA_50630.pep
EALLKQVDYLIRSKWVPCLEFSKVGFIFREHNAFPGYYDGRYWTMWKLPMFGCPDPTQVINEVEEVKKEYPNAYVRIIGFDNMRQVQCVSFIAFKPPGCEESGKA

SEQ ID NO: 156213 - protein, 130 aa, Triticum aestivum
  unsure (1)..(130): unsure at all Xaa locations
  Clone ID: PAT_TA_50631.pep
FAGLDGLAVYEMGSAAATCNDVTSAXAPCMFYPRRKLLSTVHESCSGVRTLNTKAPPEPTGRHICRCLKNLYGLGITLDNAVNITGKCGVILFYTNQHRVYCNTLYYAISQHQNHTKLASLLRVYCCCSL

SEQ ID NO: 156214 - protein, 95 aa, Triticum aestivum
  Clone ID: PAT_TA_50632.pep
MGMEESAGGAARQAKESLELAFQMSQILDTGLDRHTLSLLMALCDRGANPEALAALVRELSSTAPPSAAAPTAPASNAVAAPTAPSLFPSGFRQL

SEQ ID NO: 156215 - protein, 80 aa, Triticum aestivum
  Clone ID: PAT_TA_50633.pep
VALQNRALYVPHYKTVMLSQAIHCLPESTYTPGNECGSISLTHHSELNLRIPYLSVDCDTTETSAQSDSAHLLRRRRHEQ

SEQ ID NO: 156216 - protein, 81 aa, Triticum aestivum
  Clone ID: PAT_TA_50634.pep
LWCDHVHEPYYYKRLHNVHERSCEIYGPFGVYACKRMKNACNCYSIITLPGEDKGHAHRHLIPLRRGFKNTQTIAEGRQCL

SEQ ID NO: 156217 - protein, 141 aa, Triticum aestivum
  unsure (1)..(141): unsure at all Xaa locations
  Clone ID: PAT_TA_50635.pep
MLASPALAGATHYFPAFVSGKQGMHLPSVXAPSNSPARRTALVMLSNGKVSTPNADRIHQHNRLTKXGTGNTERPILRVLRTNKRLKLRRATRQIDALWLKPHTTHKAFSKELEYFARTTTEMVQNXGELTANICLVEKKH

SEQ ID NO: 156218 - protein, 178 aa, Triticum aestivum
  Clone ID: PAT_TA_50636.pep
PPSTPAGAHACVQGLNPAGSTLFSCYPRPLTWRNSASRRTNTSVNNLPHIRTCCHLWPYPQLPTTRTAKKADGTKDTCYYVGRATKATEGEVATTPATVVAALKATSDTLKCGGSNRDNCGWCYHGLQGCRCCARPVNIPGPHAPRGGSRLSTLDAAIRSYACIQLYMMVFATLNTSV

SEQ ID NO: 156219 - protein, 62 aa, Triticum aestivum
  Clone ID: PAT_TA_50637.pep
ERMPCSFLLTNRVPQFAAGALCTLHSYVLSLVTGLSEALPGYYMGPPPRRLFCGRSLLSSTS

SEQ ID NO: 156220 - protein, 35 aa, Triticum aestivum
  Clone ID: PAT_TA_50638.pep
DFEALKGSVRIIYPDNKTQRGINTREQGNVEGEQK

SEQ ID NO: 156221 - protein, 63 aa, Triticum aestivum
  Clone ID: PAT_TA_50639.pep
GLSTKTSEGNQCSSIYDTTNLPPATRITGPGQLGPGLLALVCPDKEELQEHLQGMPFVSRTFM

SEQ ID NO: 156222 - protein, 52 aa, Triticum aestivum
  Clone ID: PAT_TA_50640.pep
MYTLIYFLLPSTLSFTNTTMDTWWGDEHDHGPPQLHKPSLTIISGKEKTDPS

SEQ ID NO: 156223 - protein, 88 aa, Triticum aestivum
  Clone ID: PAT_TA_50641.pep
CLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 156224 - protein, 88 aa, Triticum aestivum
  Clone ID: PAT_TA_50642.pep
TFHKLQLQNYLHKSLLTDAFQNEQTPSSYLSASPSGKRPNIIIPESGAQLHMGKMNMASLKISAAVWFPSPSWDCKPSRRSKHENLVH

SEQ ID NO: 156225 - protein, 23 aa, Triticum aestivum
  Clone ID: PAT_TA_50643.pep
ITHYSVLLFHKQICGRFIGSQAK

SEQ ID NO: 156226 - protein, 183 aa, Triticum aestivum
  unsure (1)..(183): unsure at all Xaa locations
  Clone ID: PAT_TA_50644.pep
LSPSXQSFPPAEAIRSSQXDSHVRFPGQIAGGARGLPFRRAPSFRNAADCGNATGNVCDPSLVHIAITLDEGYLRGSVAAVHSVVQHAMCPESVFFHFLVSDPSLGDLVRAVFPQLRFKVYYFDPARVRGLISSSVRQALEDPLNYARNYLAHLLEPCVRRVIYLDSDLVLVDDVRQXLAHRL

SEQ ID NO: 156227 - protein, 49 aa, Triticum aestivum
  Clone ID: PAT_TA_50645.pep
VLSLVCCWWFPSSCSSIKGFSLNAWLEGTCCVLAYMLLSRRAICGVNIR

SEQ ID NO: 156228 - protein, 69 aa, Triticum aestivum
  Clone ID: PAT_TA_50646.pep
KDLVQIADPAAIEAMVDKVLAENPKHLEQYRAGKPKLQGFFAGQVMKASKGKASPVLLHKILGEKLKGN

SEQ ID NO: 156229 - protein, 55 aa, Triticum aestivum
  Clone ID: PAT_TA_50647.pep
YYTGTKMRSGNKNKHSKGRKPSGLCLIQMRAQGKNTTPYYNRPQVPGLPTPANSG

SEQ ID NO: 156230 - protein, 101 aa, Triticum aestivum
  unsure (1)..(101): unsure at all Xaa locations
  Clone ID: PAT_TA_50648.pep
WVPCLXFSKVGFSLRERKACPGSYDGRXCPMWNLRMLGCPFATQVIPEVVEVNKQYPAAYVRXIELVHMGQVQWVSLVAFKPQACEESCQGLHSSLSSALI

SEQ ID NO: 156231 - protein, 59 aa, Triticum aestivum
  unsure (1)..(59): unsure at all Xaa locations
  Clone ID: PAT_TA_50649.pep
MESQFKLAVVYKVMDRNGXRGQVSQVIVKFLDAXSSLMMRNGEGPVREGEILTLKEFER

SEQ ID NO: 156232 - protein, 67 aa, Triticum aestivum
  Clone ID: PAT_TA_50650.pep
ANTLPEKTWAPNLSLGSLLSHRAQIFSCFLFLFLFKKSSISDRHLRVPHDLHLSNGHAHNACSFTHP

SEQ ID NO: 156233 - protein, 111 aa, Triticum aestivum
  Clone ID: PAT_TA_50651.pep
VALPGFAEGAALPGRGPLPGWAVLQSGRLQQRDFGSPWVPLGVGGGPSNFCQLRQRNDEWRARVTPGLWFCMPSDVCTGLAQVCCGLKQVLIYIGDVAGSWLFVEYVPMVC

SEQ ID NO: 156234 - protein, 45 aa, Triticum aestivum
  Clone ID: PAT_TA_50652.pep
RVLVSYFRVISLVERRKPLSFLTAFSNFISLRKSSGCLLSRTPLP

SEQ ID NO: 156235 - protein, 77 aa, Triticum aestivum
  Clone ID: PAT_TA_50653.pep
ALTGHGNLRHTWGTYLKGGVNTYKRRGGGVYSKTLCKGEPGSRAYTGYVRTLFIRDHIYQELTIRTCADCKTTSPNR

SEQ ID NO: 156236 - protein, 60 aa, Triticum aestivum
  Clone ID: PAT_TA_50654.pep
GIRNKEKLGKLLAGVTIVKDGVLPNINSVVMPKKALEKPASVGIKEPKSPKKGSKSPKKG

SEQ ID NO: 156237 - protein, 56 aa, Triticum aestivum
  Clone ID: PAT_TA_50655.pep
KCSKVNRFYCPTIASTYGIGSIPTVIMFKGGEKKESVIGPVPKTTLCSIIHKYIAS

SEQ ID NO: 156238 - protein, 67 aa, Triticum aestivum
  unsure (1)..(67): unsure at all Xaa locations
  Clone ID: PAT_TA_50656.pep
VALKVGWSSTICEQVLNVLTISAAMLYRDNKPFWYCSCGFVHLVSYCDAPHSNHTCSXIQKXKKXXG

SEQ ID NO: 156239 - protein, 47 aa, Triticum aestivum
  Clone ID: PAT_TA_50657.pep
TRNRAFYYYFLGHHLVFIVIVFSSMQNIHRCILDNSVREKHFDLVGS

SEQ ID NO: 156240 - protein, 85 aa, Triticum aestivum
  unsure (1)..(85): unsure at all Xaa locations
  Clone ID: PAT_TA_50658.pep
KLTWNEPPVGKFYEEKETDRMVLSGWSAPEEKQINNNGENKXIASSSCAHATDDTIEDPSTKPWMKRKLGELLKIGETCDASSSA

SEQ ID NO: 156241 - protein, 109 aa, Triticum aestivum
  unsure (1)..(109): unsure at all Xaa locations
  Clone ID: PAT_TA_50659.pep
YPHRPVHKLVSVIITRAIAXFSAREVDPQSALPEDEWFLETAKTAINKLMLGTSGSESDLEAPIAPHDDGISEDSDSISCLSSIGSEDSFASANNDDLENPVYFTDPDS

SEQ ID NO: 156242 - protein, 116 aa, Triticum aestivum
  Clone ID: PAT_TA_50660.pep
FFFFFFFFFFFFFFFFFFFFFFFFRGDLHKKGKLQIRGPGRIETHTDPRQKPTHGGGEPLHKQHPHLLSTRKLSPQKKNPQGNTKPGPRPSLFNFGTHVTEAPPRPGGRPAPERKR

SEQ ID NO: 156243 - protein, 98 aa, Triticum aestivum
  Clone ID: PAT_TA_50661.pep
EEIIYSLFHKRSERYQREIPDAYERLLLDAMEGERRLFIRSDELDAAWAIFTPVLRELEDKRVAPELYPYGSRGPVGAHYLAAKYNVRWGDISSDGSF

SEQ ID NO: 156244 - protein, 114 aa, Triticum aestivum
  Clone ID: PAT_TA_50662.pep
NSLLRCTQAAFHIRLTTESMNLKSQTDGRSTAFIHYFRCVDLLMLKKTLLPYCPLTLEADVGACTVARGLFVLIRRHSRYLGRLLCAVPRRAWQGRGLRSRVWDPSRSNRKKMT

SEQ ID NO: 156245 - protein, 62 aa, Triticum aestivum
  Clone ID: PAT_TA_50663.pep
KHRTGWGTCLISHPGGQNEQLKAMIPTQPNFMPRQKMPRLRKSLVNSRTSCGEELGYFRHFL

SEQ ID NO: 156246 - protein, 103 aa, Triticum aestivum
  Clone ID: PAT_TA_50664.pep
VHAAGVDPSGARQFLTLNALNEFDPKITGVDWKQKLESQRGAVLATELKNNANKLARWTAQALLSGADMMKLGYVSRVHPRDHFNHSILTVMGYKPRDFALSR

SEQ ID NO: 156247 - protein, 78 aa, Triticum aestivum
  Clone ID: PAT_TA_50665.pep
AFEGASAGAATYCTDDATDAAGAGADHPPGPAPMPPDLSPGHSDTVATKPDAYGSKRTAWTVTADYTGASLDAWLLLH

SEQ ID NO: 156248 - protein, 104 aa, Triticum aestivum
  unsure (1)..(104): unsure at all Xaa locations
  Clone ID: PAT_TA_50666.pep
DYXRRPRNMIYYHSTLLYDKASSHKQNIFRTQGGSYTINLEHATDKLVEENLKDCRHYTNLKWRFLFFLRPTSWPCLGMVTGSWWPDCNEGQPLEISHQGHYCK

SEQ ID NO: 156249 - protein, 90 aa, Triticum aestivum
  Clone ID: PAT_TA_50667.pep
VAHDMAIKRDRTVFIQVIMALWVVSCIGMLFNFFTLIYIGVLLALLVPPVYERHQDVIDEKVGLVHSILSRHLNTAISKTGQPPKQKKAE

SEQ ID NO: 156250 - protein, 56 aa, Triticum aestivum
  Clone ID: PAT_TA_50668.pep
NNHMHYYVPIAGQHAVCNRSRMTQTNNMIRALHSLNKESEDSSISHMSSIAYLLST

SEQ ID NO: 156251 - protein, 95 aa, Triticum aestivum
  unsure (1)..(95): unsure at all Xaa locations
  Clone ID: PAT_TA_50669.pep
GKRIYGCPFKDEHFQLVHPGPGVLSMTNAGPSASATQLLIGPVXTPWMNGRPVVFGQVLXGMEHCKDNSSHQGLTQVAVPKKKVVISECGELPVV

SEQ ID NO: 156252 - protein, 115 aa, Triticum aestivum
  Clone ID: PAT_TA_50670.pep
SLFIRDKVLRGKSTNLVMSLQAAAHGGSVAAAAGALPGLRQGQQCLNCRRRSSAASTMAIGRRGSISRRGASDSAWHDRRRPPPIVPGHQRPPAVAVATAELGGGERKGRGVSVA

SEQ ID NO: 156253 - protein, 46 aa, Triticum aestivum
  Clone ID: PAT_TA_50671.pep
TNQQRQRLINKGGTRKGGSCSNTRDRGIQTYGTRTGGGTSFNGGAT

SEQ ID NO: 156254 - protein, 110 aa, Triticum aestivum
  Clone ID: PAT_TA_50672.pep
DPTLSPRFAAHLQAWCPPKVDPRPAVPMDTVTPRAFDNQYFKNLQGGMGLLSSDQLLFTDSRSRPTVDAWARSGAAFDRAFVAAITKLGRVGVKTDASQGNIRHDCAAFN

SEQ ID NO: 156255 - protein, 91 aa, Triticum aestivum
  Clone ID: PAT_TA_50673.pep
CSFVCVLWPRLPAGVLAWHGGAILLICQLAYSRTLHFSRPVSVAFSCPSSFSIMPYRSNCINSVLELYLLIILGHQVLYAFACLSIIVWML

SEQ ID NO: 156256 - protein, 109 aa, Triticum aestivum
  Clone ID: PAT_TA_50674.pep
MLHDQKYTSSKKDISKGMRAVDAIERLGVGYHFEEEVNKFMDVLIFTSIDENDLAGVALRFRLLRKHQYDIPCGSYTTYCSKVNCNFSPIRWLGNSKDYPIDGILLLLH

SEQ ID NO: 156257 - protein, 87 aa, Triticum aestivum
  Clone ID: PAT_TA_50675.pep
VYHTKRSGWYTRQQVLPGGQGQARWGTGFPLHPAGQHSLISTQFEETPGYVPLVRKPHPVQCFAFWVNHPGVGLASNPQHIWLCPSK

SEQ ID NO: 156258 - protein, 102 aa, Triticum aestivum
  unsure (1)..(102): unsure at all Xaa locations
  Clone ID: PAT_TA_50676.pep
XFFFFFFFFFFFFFFFFFFFFFFFFFFFIKTPFLKTHRPEGESNNKPGETPPGQQGPQTGGGKKQKRGERVKKWPRNCLGKKYYHDDGGKQGPTKKAAIKEK

SEQ ID NO: 156259 - protein, 124 aa, Triticum aestivum
  Clone ID: PAT_TA_50677.pep
DAKKGHPGAAPAYDSAGAHQRRHSACVSKAMSHGCQGVGTLVFGGARSIRWFWSYGGRLGRRACLCHLSDSCLSPSVCLKLSCVSVFCSCPLPAMCCALLWPPCSSMGDGSFWNKSEGIVKVEF

SEQ ID NO: 156260 - protein, 89 aa, Triticum aestivum
  Clone ID: PAT_TA_50678.pep
GLPWAYYVDNSVYPCSQHSSQEVGCCVLHVRMRSLLVYSCWFCTFIPQYHVAARFLRVVALKSVPRVNGELYAVYPTQLCNACYECLHL

SEQ ID NO: 156261 - protein, 52 aa, Triticum aestivum
  Clone ID: PAT_TA_50679.pep
FRHSLRFSASMLVFNLFPIICGSPCSWWSSGLGSMFARLFRLSLCRGRVASV

SEQ ID NO: 156262 - protein, 57 aa, Triticum aestivum
  Clone ID: PAT_TA_50680.pep
DTCAGFKQVCRPTLTAYLSMATTHARPQPTGPGSQNDGTCKGFRPRGKSPNIKGRDM

SEQ ID NO: 156263 - protein, 105 aa, Triticum aestivum
  Clone ID: PAT_TA_50681.pep
NASIQQVPHFHSGRDRRVSSTCTCTVFRCSVLRGLAVTIHAVGGITSRSRNRKWRLHHRSSSIAVGLRFDHLPRFSKCPPSRSDCCRGSAHVSSWARRACNSANM

SEQ ID NO: 156264 - protein, 60 aa, Triticum aestivum
  Clone ID: PAT_TA_50682.pep
HMYHHHICSDCNLNETFSMGILHNRVWYQQLTCHKETGSLNRPKYYAFNWLTTRVKAGLA

SEQ ID NO: 156265 - protein, 54 aa, Triticum aestivum
  unsure (1)..(54): unsure at all Xaa locations
  Clone ID: PAT_TA_50683.pep
NISPDRRTIXDCLNNVANGASVGPYITGGAAFPXKCNVALPFKISHSVVYNWIP

SEQ ID NO: 156266 - protein, 50 aa, Triticum aestivum
  Clone ID: PAT_TA_50684.pep
RLTRAKDYTKSLTLDHKYRILCSTIPHKDDPRTNSYGTVVPTLPLYTERG

SEQ ID NO: 156267 - protein, 71 aa, Triticum aestivum
  Clone ID: PAT_TA_50685.pep
QYWTRKRATHICGQKLVNGPLEELLLGADLHPPVDPPLHQGLDGTSRQRPAGPPALRNGRLVRPWNIHTDT

SEQ ID NO: 156268 - protein, 88 aa, Triticum aestivum
  Clone ID: PAT_TA_50686.pep
APGGALLAGYFSEVFIKMGGFNLPKEMWLNVLGLSKNAGHVYVRGPEMYPQTCANFGPCGKVPDLAPAWFLSCQKPAPIAISVTSHVF

SEQ ID NO: 156269 - protein, 44 aa, Triticum aestivum
  Clone ID: PAT_TA_50687.pep
AAGATFLVSAIPTLKTSSVGMKMAAENGVFGCTQCKCGTSCGCS

SEQ ID NO: 156270 - protein, 77 aa, Triticum aestivum
  Clone ID: PAT_TA_50688.pep
NPKQFLGKLKNGKSPSFFLETSKKTFLSPWNLITQTGVNSKTCGLGLFKFQQNPYLWAFGWPPPFKGSPLISKNFSF

SEQ ID NO: 156271 - protein, 113 aa, Triticum aestivum
  Clone ID: PAT_TA_50689.pep
GYSPIYTPQKWFEYGAPNAGVPTGLFIWTVTPLPASSGTASSSCTTRALSPLKIAFTCITGAGSAACMHVFVMQQTFPPVNVPYIRPKVNGLSRWFMCMYVTLHLIYLFFWTL

SEQ ID NO: 156272 - protein, 71 aa, Triticum aestivum
  Clone ID: PAT_TA_50690.pep
KKTLGFLFKGKGSPPPRFFLREKGNNPLCPPNFPYKVFGHHHRSFTYWFGGENQFLGPKGLKGFPQLKGKT

SEQ ID NO: 156273 - protein, 90 aa, Triticum aestivum
  Clone ID: PAT_TA_50691.pep
LPDVRQGLTWSFATGFISSAFTVLSPLSFLWVFLHPLFVLFVPTNTWMSFFMCQHVRPMHACIRILLVSHVYDRAHFLNNMSNIYVLMVT

SEQ ID NO: 156274 - protein, 145 aa, Triticum aestivum
  Clone ID: PAT_TA_50692.pep
KGQLLGDGRCVFYLGVFNNMVGQMSCNRRVRNLGLAGTDSVLVVEVRRKGVDNNPFYDGCTRWSRYKRPIVISHVTHRAWMREGILQLASICSQLQCIYAVHHHSSQAACLVSTVNHAYIVILLYNAYDSMHLRFATVEYMCLYA

SEQ ID NO: 156275 - protein, 84 aa, Triticum aestivum
  Clone ID: PAT_TA_50693.pep
QQYLEKSKLSKDLSDNKRATTSGANFACAYTVQFGSCKFPYIFSGCQALANQNKVPFITKYLEIECEGKEKFNVRDPIVLLEYG

SEQ ID NO: 156276 - protein, 108 aa, Triticum aestivum
  unsure (1)..(108): unsure at all Xaa locations
  Clone ID: PAT_TA_50694.pep
MYLKVKGTMFESXRVFMQSIXSPSLPSXRNKTLSDRFESKSSKTKASTYCQHSIMXYRLSQGPRDHSPPPAPAAPAAPPPAPNNAQPNNPRYYIELNRSWHHSGLASI

SEQ ID NO: 156277 - protein, 61 aa, Triticum aestivum
  Clone ID: PAT_TA_50695.pep
EYTKALALKVDLAKIALGLRSRGFALFVMTSRSQSQTSRKVASSQSMDQRNSSRRGRGFSV

SEQ ID NO: 156278 - protein, 94 aa, Triticum aestivum
  Clone ID: PAT_TA_50696.pep
FHRLQATRIRVVRHVLVSSLTTGHKYSANSCFVYSDMCFGFSFSIYLSCLLPKIIRCVCPCSRHASRQHARMSMRPMAMYMHMQHNIISPSCRL

SEQ ID NO: 156279 - protein, 52 aa, Triticum aestivum
  Clone ID: PAT_TA_50697.pep
GRIFHYGAPVKLIGYHDGLTEPCPCSSLSCRPQYFSIGSVSAHTEQIFPCVT

SEQ ID NO: 156280 - protein, 71 aa, Triticum aestivum
  Clone ID: PAT_TA_50698.pep
SLTQSLWNAGKYLAIAQRSGEGNAAPFVLMVGTSSKIQPPILPRDMRLLQDPSYGSDEADLEWPRCRASTS

SEQ ID NO: 156281 - protein, 91 aa, Triticum aestivum
  Clone ID: PAT_TA_50699.pep
PKKCVICCQEKDPSCSFFLSVEVSKRPVCNDCSYCHPDPPCCKLAMGPHSSRVHVAMSPCQVLWWRVRSFCKTWWLRFTSHVTGLRVVSVP

SEQ ID NO: 156282 - protein, 126 aa, Triticum aestivum
  unsure (1)..(126): unsure at all Xaa locations
  Clone ID: PAT_TA_50700.pep
KRARGRKNETQKKKKRISYRKQRXKRKGVMETQRKRKGGKNGKEREKRTKKKEQCRERKKGKGKGVWRKXKLKHGKRKKRKXRKKRNDEREEKKIKNNRKLKKTQTPSQSPPTMGKPKPPPKNHNA

SEQ ID NO: 156283 - protein, 73 aa, Triticum aestivum
  unsure (1)..(73): unsure at all Xaa locations
  Clone ID: PAT_TA_50701.pep
GGVMWAPRFDSILAHQPFVAVHKQGPPIQAVIKSLISTPVHGPYEVCREIRAPVQFRXRAIAVFVRPEIWQCP

SEQ ID NO: 156284 - protein, 66 aa, Triticum aestivum
  Clone ID: PAT_TA_50702.pep
GFLLHYPYSIVSTRFFIDLFNLRTRYCSLVCTRVSPCKIMTYTCVEITFDPSVCISRILRSVYIVV

SEQ ID NO: 156285 - protein, 57 aa, Triticum aestivum
  Clone ID: PAT_TA_50703.pep
KIKGTPPIGVGHSHQLRRLQISQADEPSQSGGLGIADADLQDVNMCLPGPWIKIIIQ

SEQ ID NO: 156286 - protein, 95 aa, Triticum aestivum
  Clone ID: PAT_TA_50704.pep
RRRKHVHDIHATDFYRTVNSLAGLVRLEEGHPDGEGGGEGDEGAGGVEAARRVAGLGRLRRRGERRRTSGVLWAAAGRHGRGRSRPARTGGSPTC

SEQ ID NO: 156287 - protein, 72 aa, Triticum aestivum
  Clone ID: PAT_TA_50705.pep
STNPNAQPAISKRMKHTAPGTFYRLYTEDNNVAASLRVLISLNLLAITSLAKHLGRPRADLNDVKGRRTSPP

SEQ ID NO: 156288 - protein, 125 aa, Triticum aestivum
  Clone ID: PAT_TA_50706.pep
GSRGQYRSTLTCTSALLDWYNMRQSHVCQIHRLHSHLSARSCARLWQITLHGPHIKSHCGFVNSDIFWVFVLHLSLVFVPDNMCMSMFMSPHVWSHHARMSFQVSGYVYAQAHNIFILSVDYVFG

SEQ ID NO: 156289 - protein, 148 aa, Triticum aestivum
  unsure (1)..(148): unsure at all Xaa locations
  Clone ID: PAT_TA_50707.pep
VSLFTRDNSSGTSDAGAGAGAARPAVQAPQPSDAVAITAEERRFAKEVMLKYLNKTKPLYVKVSRRYGERLRFAGASEGEETYAEPEPSPSPXATPSPAPSQPRAPPAPLPQPVVVACGVRAPRARVPAGMKQACKRLGKSRSASTAG

SEQ ID NO: 156290 - protein, 117 aa, Triticum aestivum
  unsure (1)..(117): unsure at all Xaa locations
  Clone ID: PAT_TA_50708.pep
PGGGAPXGGAKGAPKEARAGGAPPPAASSSPGSPPPASLSPASMGSPAFLAAAESSKSGSNALASSFPLADESKKSLPFLCRLPHLGLVRETLLNVFYPGLVWFLPGSCGASPLSPI

SEQ ID NO: 156291 - protein, 124 aa, Triticum aestivum
  unsure (1)..(124): unsure at all Xaa locations
  Clone ID: PAT_TA_50709.pep
KSVSRSVKAGLQFPVGRVARHLKVGRYXKRVGAGAPVYLCAVLEYLAAEALELAGNAARDNKKTRISPRHIQLAVRNDEELSRLLGGVTIAAGGVLPNIHSVLLPKKVGKGAGTGGSASQSQEF

SEQ ID NO: 156292 - protein, 75 aa, Triticum aestivum
  Clone ID: PAT_TA_50710.pep
AGMAKSILNARVLIRQRHFRVDRQIVNVPSYMVRVEFEKHIQFLLTSPYGVGPAGRVNRKNQKKASGAGDAGGEE

SEQ ID NO: 156293 - protein, 107 aa, Triticum aestivum
  unsure (1)..(107): unsure at all Xaa locations
  Clone ID: PAT_TA_50711.pep
AREFDQPLKNRFYLQPLPPAETAVRAKESAQDILNRKPFIDKKQWPCVMKDLRLRASYVRNDFKPVMSSETTKEGKKVLKDLTGKXLATLDGLDHAAKIESPTESQK

SEQ ID NO: 156294 - protein, 74 aa, Triticum aestivum
  Clone ID: PAT_TA_50712.pep
ERFSHHASVKDIVILWQGGRTCFFSSSEEPVSVQRQWNVVISDSVRCFSNEVNIVNIGLIYRSTNAKLRASHKE

SEQ ID NO: 156295 - protein, 81 aa, Triticum aestivum
  Clone ID: PAT_TA_50713.pep
PPPPREPTRGGRPKMEGPEPPKEPPKPKPPPGGPKKGPKIKVFRRASAWAQGPASQVKVERGPGPSCPGGLNSAQVASAGI

SEQ ID NO: 156296 - protein, 106 aa, Triticum aestivum
  Clone ID: PAT_TA_50714.pep
AREGVPTLPFDCNRDDKRELGYRNPGALPFDPRGELEVPRLEGAPDLRDVPGGRSVGPLQVLLQCLFGGGHRGEHESGAGLTACANPQSKRPKGGLRVKLSGQFWD

SEQ ID NO: 156297 - protein, 109 aa, Triticum aestivum
  Clone ID: PAT_TA_50715.pep
ITYLELVEIVNKLKDENGKLAGVDVSDLIVANSGNDLPVIDLSSVAPELAYMASDADLVILEGMGRGIETNLYAQMKCASIKIGMVKHPEVAQFLGGRLYDCVFKFNEA

SEQ ID NO: 156298 - protein, 56 aa, Triticum aestivum
  Clone ID: PAT_TA_50716.pep
GEMQLCDMDAKFISWDGIHLTEFANAIVASKLLTGDYSKPRVRIASLVNSTAPHDG

SEQ ID NO: 156299 - protein, 89 aa, Triticum aestivum
  Clone ID: PAT_TA_50717.pep
TWNIHRPWQKRATNMAAKVQDSKPPKCPGTEVWHKTNGSHGLCPNQHFKEVVLRQAITTFRQHQLLPSFNGDPQISKLPGGILAPYFEN

SEQ ID NO: 156300 - protein, 63 aa, Triticum aestivum
  Clone ID: PAT_TA_50718.pep
VFMIAWNGKSGIGLCLRKKRVQIKMHKITRGGTETQWESFHQTREISTCFFVHFEVGQRTHHV

SEQ ID NO: 156301 - protein, 71 aa, Triticum aestivum
  Clone ID: PAT_TA_50719.pep
SVKKTRKVGILFTNDCHTRIDAWKCYQPAKTTNTSHVMEDTRSYVRGISNIFFFLLQEKVSHKRAPIQKNI

SEQ ID NO: 156302 - protein, 57 aa, Triticum aestivum
  Clone ID: PAT_TA_50720.pep
RSPALRFMELFGVSSLEHLPDSHCYPRASDRSPRKSSRILGHLQVVLGRSLNEVSSE

SEQ ID NO: 156303 - protein, 87 aa, Triticum aestivum
  unsure (1)..(87): unsure at all Xaa locations
  Clone ID: PAT_TA_50721.pep
HASAGAPHVRPGRRDGGVGHVPVPQGVPPGLPHSGAGRVQAAPCAIPGVACLSSVPWAPPWSAPISRSAPLPLWHARRPEFYTEVXC

SEQ ID NO: 156304 - protein, 171 aa, Triticum aestivum
  unsure (1)..(171): unsure at all Xaa locations
  Clone ID: PAT_TA_50722.pep
RKMDNCKPCGGAXIPLCLASEFDLPLDLLDRRVTKXMKMMAASNIXLGISRTLAPHEYIGMVRLKVLXDNLTNSRATESXAEVLNGLLLXYDAPNXRNRSYTVALQPLRHFPLDGGRAXNRSLEVDAIVGSDGANSRVAXDMGAGDYQYALXFQERVKIPGYRMRYYKVSR

SEQ ID NO: 156305 - protein, 150 aa, Triticum aestivum
  Clone ID: PAT_TA_50723.pep
VSWAPATLMTDSTLRAATIGDGDRAGRRRCWWAASGAVVTQGRQTSRSKEEVKPEEVQGGNYSCVCPAGSGDVQGGRSHAGVEAGDLADGCHAARVGSWAPATLMTDSTLRAATIGDGDRAGRRRCWWVASGAVVTQGRQTSRSRAREQI

SEQ ID NO: 156306 - protein, 51 aa, Triticum aestivum
  Clone ID: PAT_TA_50724.pep
ASLDEYISNWFGVDQSKYQWALNDYYESTGKEMDSGKAAKTTELSGKMQKV

SEQ ID NO: 156307 - protein, 123 aa, Triticum aestivum
  unsure (1)..(123): unsure at all Xaa locations
  Clone ID: PAT_TA_50725.pep
KTPAGKKPKGEKKVPASKXGGENKGKKKXKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 156308 - protein, 104 aa, Triticum aestivum
  unsure (1)..(104): unsure at all Xaa locations
  Clone ID: PAT_TA_50726.pep
RGQTWTLDIPGGTSSGRIWGRTACRFXGNIGRCSTGACGGALSCTLSGQSPMALAMFPIGWWHFIDIXVICGHNLFMIFSRSTGVGISVLGXSCPWAYHHASCA

SEQ ID NO: 156309 - protein, 118 aa, Triticum aestivum
  Clone ID: PAT_TA_50727.pep
PDGPPVGAGWFVAYNSYAMGRMESVWGKDALAYRPERWLDPAEGTFRPESPFRYMAFHAGPRICLGKEMAYIQMKSIVACVLEEFEFAVDGAYRPRQVASLTLRMADGLPVAVKARVN

SEQ ID NO: 156310 - protein, 98 aa, Triticum aestivum
  unsure (1)..(98): unsure at all Xaa locations
  Clone ID: PAT_TA_50728.pep
QDIVALSXGGHTLGRCHKERSGFEGPWTRNPLKFDHSYFTELLSGDKEGLLQLPSDKTLLTDPVFRPLVEKYAADEKAFFEDYKEAHLRLSELGYAEA

SEQ ID NO: 156311 - protein, 149 aa, Triticum aestivum
  Clone ID: PAT_TA_50729.pep
FPAPPPGWVPPSRAPRLLFSAWVVGEHLPMHVCAGHFPGHALGGLAPRPRRHIMVGAPEGVPVLLRSAQRLPRLKVKATQLCPALKAGRPLDASLDTRVCARCMDAGPPGDVYEKPRQLSLDPSAVQEEFKNAWPLFLFINESMGTHWR

SEQ ID NO: 156312 - protein, 94 aa, Triticum aestivum
  Clone ID: PAT_TA_50730.pep
SARLGSWGPISTVGCPEQPLICGTSCGARHRVSRAGEAGIQMSSMSNSPLGGQVLEGRRLLGRKHPVLGRWFKFDAPHARAVVWLACIEAYAPA

SEQ ID NO: 156313 - protein, 94 aa, Triticum aestivum
  unsure (1)..(94): unsure at all Xaa locations
  Clone ID: PAT_TA_50731.pep
RRSWGRRPTKGRARRSASPCRTPQPSGRREELLEIEPVQLAAASGEGXGRSRRGSWISXAQFPHRSWLGRPLGRATQKVTSSKEMPVYIKHRRP

SEQ ID NO: 156314 - protein, 63 aa, Triticum aestivum
  Clone ID: PAT_TA_50732.pep
SSSSRRHKRQLVSTIISLDVRIAVNVFVICHSARHSILVSASVSDRRPSVLFGSSRSSVVRSS

SEQ ID NO: 156315 - protein, 176 aa, Triticum aestivum
  unsure (1)..(176): unsure at all Xaa locations
  Clone ID: PAT_TA_50733.pep
PTEQASSDTTDAPFQXGLKSTAGLPVSRRSCSAGLSSVSTGGRIRCMHVSPMEGIKXFKTLSYLPPLSTEALLKQDNYLIRSKWVPCHRFSKAGFVFREHNSSTGYYDGXRYWTMWKLXMLGRTDATQVLNEVEEVNNDYPDAHVRVIGLDNMRQVQCVSFIAFKPPGXCEESGKA

SEQ ID NO: 156316 - protein, 133 aa, Triticum aestivum
  unsure (1)..(133): unsure at all Xaa locations
  Clone ID: PAT_TA_50734.pep
GYSVQRFKPYRCSFVCVWELSYLGEVSYMVLFIXILATAITEARWARAAADDWGRNEQFWVIGGVCDHLFVAFXQGLLTVISCVDTNFXVSSKARTYQEYXELCTFKWTILLITATTLLLMNFIVVDAGLYKA

SEQ ID NO: 156317 - protein, 86 aa, Triticum aestivum
  unsure (1)..(86): unsure at all Xaa locations
  Clone ID: PAT_TA_50735.pep
AXARLPIPYRDQCAHLLIPLNKCRVAEFYLPWKCEPERHSYEKCQYELVMERMLQMQKIREAQAGAKVKGSVTIGVPLAPSTAKLA

SEQ ID NO: 156318 - protein, 91 aa, Triticum aestivum
  unsure (1)..(91): unsure at all Xaa locations
  Clone ID: PAT_TA_50736.pep
PNSLFQNFPTLNWKWDPPFYGPLNPGGWGVSPKGTXLIFQALYPPSFGFFPXFFPNFAGFSRKILNWGPLLGFPFKVLRALTPKKFFRGMV

SEQ ID NO: 156319 - protein, 134 aa, Triticum aestivum
  Clone ID: PAT_TA_50737.pep
PASDYLLMHGVVGLAMGTMWRLETDWIASIIICSIIRAVGACGYVLVSSFLIRENILQLITVNVHASLTYILAAAGVNAIPSMDAIYVIFGTLLLLNCGFFVFILHIIYTIFLTKLGIKPSLRPPRWLGKTTFS

SEQ ID NO: 156320 - protein, 193 aa, Triticum aestivum
  Clone ID: PAT_TA_50738.pep
MDAAVQEAKLLRQVNALIVAHLRDQNLTQAATAVAAATMTPRADASVPNHLLRLVAKGLAVEQEEAARGGGAPAAAGLARPLGTNAVDFRGPSKTFPKHETRHISDHKNVARCAKFSPDGKYFATGSGDTSIKFFEVSKIKQTMLGDSKESSGRPVVRTFYDHVQPINDLDFHPISPILISGAKDNTIKFFDF

SEQ ID NO: 156321 - protein, 129 aa, Triticum aestivum
  Clone ID: PAT_TA_50739.pep
SAPGRRCPTSASVRRTPPSSGARRTSCATPSGEAAAPEASEPRLEHTPTCCAASRAAQVAATAKTSRRSPLLRSPIQHRRSPHPAAPVSNPAPPSSSRCSSMDQAPPPTDRPPRPTDRAPPPTDRAARR

SEQ ID NO: 156322 - protein, 57 aa, Triticum aestivum
  Clone ID: PAT_TA_50740.pep
ESDIVYLACIAVHNDRLLCITHKIATSYTSLKDQRFWTLTDTQDDVLLVLPRALQLL

SEQ ID NO: 156323 - protein, 192 aa, Triticum aestivum
  unsure (1)..(192): unsure at all Xaa locations
  Clone ID: PAT_TA_50741.pep
RRPTPSVPGSRSNNTLPWSPAVMASSATTGAPFQGXKSTAGLPVGRRSSGSLGSASHGGWIMCMQVWPIXGIKKFETLSYLPPLSTEALLKQVDYLIRSKWVPCLKFNKVAFLFREHNSFPGYYDGRYWTMWKLPMFWCTDTTQVLNXEVEDVKKEYPDSYIRVIRLDNLRQLQCVIFIAFRPSGCEEYDKA

SEQ ID NO: 156324 - protein, 77 aa, Triticum aestivum
  Clone ID: PAT_TA_50742.pep
PGMDRVVLQFDELGEDHALSLCWRQQHVIDGYCVSHDHTIKKISMTFKAILQTNDKTSKGCDGTGCCFRRTDCRTMK

SEQ ID NO: 156325 - protein, 64 aa, Triticum aestivum
  unsure (1)..(64): unsure at all Xaa locations
  Clone ID: PAT_TA_50743.pep
WRDXXYPXILLLIIPFISITSYQTFNKKYLKKSLYIFFSQYILIFHITFLIINNNYLQTFLPFI

SEQ ID NO: 156326 - protein, 65 aa, Triticum aestivum
  Clone ID: PAT_TA_50744.pep
MANGGPNTNGSQFFICPVPCNWLDGKHVVFGEVVEGMDVVKNIEKVGSRRGTCSKQVVIADWGQL

SEQ ID NO: 156327 - protein, 77 aa, Triticum aestivum
  unsure (1)..(77): unsure at all Xaa locations
  Clone ID: PAT_TA_50745.pep
ACGKRNRIPVFTEGVDPVVVPXNAKVKTFPVIVSSKCXLVSSKGGGKAFVVGFLSQLVQGNRIKYGVKSGSPSANVI

SEQ ID NO: 156328 - protein, 93 aa, Triticum aestivum
  Clone ID: PAT_TA_50746.pep
YHNYYRALLSIMSPYPAHGGGGGGNLITPPLRSFRGTQNVCQTEFTKKKMLPGVADLTKIPVVVHINGRRQQATQKNGGGTYGVTIHPGWGYV

SEQ ID NO: 156329 - protein, 68 aa, Triticum aestivum
  unsure (1)..(68): unsure at all Xaa locations
  Clone ID: PAT_TA_50747.pep
GVKGVGPSGVVMLSQEPFFYLLTLVLLEGKKCPRLPPSXRFGEVLDPVRWDSDAAQVTELLVRAIDES

SEQ ID NO: 156330 - protein, 162 aa, Triticum aestivum
  unsure (1)..(162): unsure at all Xaa locations
  Clone ID: PAT_TA_50748.pep
GDVRLVNCRCNGIDKWLEFRVXNKAHMVFWIDLQARCRVYKDGLDPCKVVGIHDISINESPTHXGFSMYPDSSLELNLXHYVGPTPHAPFLLYPGYLIATPASLDELNTPWANNMVISDGIKSPPPPRRRFEQMLVHIIRMMRLLYQIIIVLKSMWVLEWYR

SEQ ID NO: 156331 - protein, 91 aa, Triticum aestivum
  unsure (1)..(91): unsure at all Xaa locations
  Clone ID: PAT_TA_50749.pep
YVLVSSFLTPKNXLQFITVNVHPSLTYFWXPAGVNAIPSMDPIYVIFGPLLLLNCGFFVFILHIIYPLFLPKLGINPSLTPPRWLGKTTFS

SEQ ID NO: 156332 - protein, 75 aa, Triticum aestivum
  unsure (1)..(75): unsure at all Xaa locations
  Clone ID: PAT_TA_50750.pep
KIFFCFFFFFFGNNFALIFHFIHSQGGRDREHGTVAGSHLTVGVAGGDLLNRXRSXGLGGGAITLLGDREKRGGN

SEQ ID NO: 156333 - protein, 64 aa, Triticum aestivum
  Clone ID: PAT_TA_50751.pep
TTSKCTSIEGAILYCRINSSQSPPLVTFRWGVGATRVSPTHGRNLIRDATLFPAQAPPNAPTLP

SEQ ID NO: 156334 - protein, 116 aa, Triticum aestivum
  Clone ID: PAT_TA_50752.pep
VEATSAIFTKDERYILSSGKDSCIKLWEVGTGRLVKQYPGAVNTQFRCQAVFNETEEFVLSTDEQNNEVVVWDALTSERVARLPSGHTGAPRWLEHSPVEPVFVTCGNDRSVRFWK

SEQ ID NO: 156335 - protein, 79 aa, Triticum aestivum
  unsure (1)..(79): unsure at all Xaa locations
  Clone ID: PAT_TA_50753.pep
PGQGIAFKGFFLLCKEGGIQPSPIYTLGFGPSVDXPFRTPQGLQYGQKNPNEVCPAGWKPGGKSIKPAPKGSKGDFAAL

SEQ ID NO: 156336 - protein, 68 aa, Triticum aestivum
  unsure (1)..(68): unsure at all Xaa locations
  Clone ID: PAT_TA_50754.pep
TKVAAEAPPVPKKTVREEPPPPEAAAAAATAAAAAAPAAATGGSEWWGRSLASYPSPRPFFXCXXKVL

SEQ ID NO: 156337 - protein, 61 aa, Triticum aestivum
  Clone ID: PAT_TA_50755.pep
SIIQQRPNYPSYLRNAPLPEIGPSWTGRALPPVNCGTTPERIPPFPIERIHSAGGNHRYRC

SEQ ID NO: 156338 - protein, 89 aa, Triticum aestivum
  unsure (1)..(89): unsure at all Xaa locations
  Clone ID: PAT_TA_50756.pep
MNVQQPADVAGPSEGVAAISKGGKVGPNRCSACRKRVGLTGFNCRCGNLXCALHRYSDKXDCKLHYRTAARDAIAKANPVVKADKLDKI

SEQ ID NO: 156339 - protein, 99 aa, Triticum aestivum
  Clone ID: PAT_TA_50757.pep
RTEQAKELLGKYGGAYLATSITLSLISFTACYLLINAGVDVQQLLGKIGIATDETGGKVGTFALAYAAHKAASPIRFPPTVALTPVVANWIGKITKGGD

SEQ ID NO: 156340 - protein, 78 aa, Triticum aestivum
  Clone ID: PAT_TA_50758.pep
SNYRDTCTHIHTRTPRSDHTPIAIFGDDGRMHTHPSSTPLDERLVIDVYFDTITRAYDGTSACSLTVAGGVLAVGDVA

SEQ ID NO: 156341 - protein, 86 aa, Triticum aestivum
  Clone ID: PAT_TA_50759.pep
KNTGSAKNVRGLLITLITLTGGGGCIYKNTTAIPGAERLLDSFQLINKTGLADFLNEGAGIYTPFYFHATKTKPHYVGSKHPIYSG

SEQ ID NO: 156342 - protein, 87 aa, Triticum aestivum
  unsure (1)..(87): unsure at all Xaa locations
  Clone ID: PAT_TA_50760.pep
KGGSRVARYAGEATGEHMGGVAIKIGLKSVVVKVKXISFFRKNKKVLMGFRDGFRGERVRTPSPIXMCQHVTELAHNGCRLPKKVRK

SEQ ID NO: 156343 - protein, 42 aa, Triticum aestivum
  Clone ID: PAT_TA_50761.pep
GVKKKKSILLSKSSVKVTTTAEPKTSLSCPKNVFEHQVYIFG

SEQ ID NO: 156344 - protein, 60 aa, Triticum aestivum
  Clone ID: PAT_TA_50762.pep
VNYQRLVQISKVNLCLHLPKFFGKDQSFSFLVLFLDLYICMFPFCSIYYYTNLEHFLDFR

SEQ ID NO: 156345 - protein, 75 aa, Triticum aestivum; identical to SEQ ID NO: 106874
  Clone ID: PAT_TA_50763.pep

SEQ ID NO: 156346 - protein, 99 aa, Triticum aestivum
  Clone ID: PAT_TA_50764.pep
VDYLIRSKWVPCLEFSKVGFIFREHNASPGYYDGRYWPMWKLPMFGCTDATQVINEVEEVKKEYPDAYVRIIGFDNMRQVQCVSFIAFKPPGCEESGKA

SEQ ID NO: 156347 - protein, 127 aa, Triticum aestivum
  Clone ID: PAT_TA_50765.pep
WGLQPPQPYPSSFFVRWVLAKFLAFDLHNLIPKGKQDFFFKGPDGATPNAFSVVNYGSPLLPLSVVDTGDLQIGFRRMVKSLANQSFFPSSKVFSSSMAPVFLFTPNFGRFSPHRRRGLDRPPFFFL

SEQ ID NO: 156348 - protein, 52 aa, Triticum aestivum
  Clone ID: PAT_TA_50766.pep
CELTTSLSYSNGSRLETRTSISNSTNKFTGGQSFLSHASLTPSICYPNILRY

SEQ ID NO: 156349 - protein, 65 aa, Triticum aestivum
  Clone ID: PAT_TA_50767.pep
PSPPPPSPHPAPPPPPPHPPPNPPPAPPPPPNPPPRIPNYARSPPPPPRPFVMGVVKISPPPPPM

SEQ ID NO: 156350 - protein, 89 aa, Triticum aestivum
  Clone ID: PAT_TA_50768.pep
SDKMMRGFMSPWSWQIEGGCSRGNTQCAPGLHLNAIQPARNHVGVAPCTVPSTSTNASNNLAVAQEQACPSLPFLQRQYCRHHKSRTRR

SEQ ID NO: 156351 - protein, 94 aa, Triticum aestivum
  Clone ID: PAT_TA_50769.pep
VACMIGPVRPTFWLSRFFADMWMLFPTEEEYIEWFERAGFKDVELTRIGPRWYRGARRHGLVIGCCVTGIKTQNGDSPLRVLPLIQTSTYALVL

SEQ ID NO: 156352 - protein, 96 aa, Triticum aestivum
  unsure (1)..(96): unsure at all Xaa locations
  Clone ID: PAT_TA_50770.pep
KKTYVNQEVPLEEPVKRCAHCLSHKAPQWRTXPLGPKPLXKASGVRYKSGRVLLESRPVNSXNFVSFILSNSLKKVMQMRKSVQIEQSQEYSHRYM

SEQ ID NO: 156353 - protein, 133 aa, Triticum aestivum
  unsure (1)..(133): unsure at all Xaa locations
  Clone ID: PAT_TA_50771.pep
KKQVTDMYCIKFRQMPRAHMILSLRSPLSLALSPFFFPXLXHGGGGGXLIKKKKKKXXXPIRETKTPPFPXTPXSYPXNSLPLPSXLPPFPILXLIKPFPNGGIPISCFFLVSAHSSTHHTSRELNVLRPGGP

SEQ ID NO: 156354 - protein, 80 aa, Triticum aestivum
  unsure (1)..(80): unsure at all Xaa locations
  Clone ID: PAT_TA_50772.pep
FKMGMSSLPGGSITWEVAVNLYKIFNLLFGGGGGLFTQIIKIKPKKLPYKXKTHXXXQXKIXXKTKPXXLXTHXKTTXTS

SEQ ID NO: 156355 - protein, 134 aa, Triticum aestivum
  Clone ID: PAT_TA_50773.pep
YINIALKRLKTFRTLAVGIKAIINLGLEKVPVPGEPGFPFPGLFPLPPFGEEAELFRNYFKQIREGTPRRVLNWAYRANGPPNKWWLAFAKRKFMNVVLPLERKHIRPRLKGVHVNPDWTPPPPPPGDVKILFF

SEQ ID NO: 156356 - protein, 58 aa, Triticum aestivum
  unsure (1)..(58): unsure at all Xaa locations
  Clone ID: PAT_TA_50774.pep
TIGSIPAGRIKMELFADVVPKTAENFRQFCTGXYRKSALGEGXKGCQFHRVIKDFMDS

SEQ ID NO: 156357 - protein, 92 aa, Triticum aestivum
  Clone ID: PAT_TA_50775.pep
TIKTYIVDILYNIMRPFIYIATDSILIRACFLEPCWYMNMDIHIFLGTNKKDKWRRKTQSNVRVDKTAMALYIWPVVSELFRPCRTPRSPVA

SEQ ID NO: 156358 - protein, 65 aa, Triticum aestivum
  unsure (1)..(65): unsure at all Xaa locations
  Clone ID: PAT_TA_50776.pep
STMVSQKHKFLPELVFLISNSLNXVDRXXQQDXXPIRXLTXVELXXRWKSRKQQLXPSWVXPVRX

SEQ ID NO: 156359 - protein, 97 aa, Triticum aestivum
  Clone ID: PAT_TA_50777.pep
GLKALLTLLGQPGTGRGDHRRAEHRREPSLAIGHGDQRRRLASVRAIPASCHSAPTYGGSRRDEGGLLVHPRLPCSAPPGGCCTRSRGLTGNPSLTS

SEQ ID NO: 156360 - protein, 168 aa, Triticum aestivum; identical to SEQ ID NO: 124109
  Clone ID: PAT_TA_50778.pep

SEQ ID NO: 156361 - protein, 206 aa, Triticum aestivum
  Clone ID: PAT_TA_50779.pep
HFSPPPPATDPEPGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTC

SEQ ID NO: 156362 - protein, 59 aa, Triticum aestivum
  unsure (1)..(59): unsure at all Xaa locations
  Clone ID: PAT_TA_50780.pep
RSRXRGXKKKKKKKKKKKKKKKKKKKKKKKKKKKKKKKKKKKKKKKKKKKKKKKGGGPF

SEQ ID NO: 156363 - protein, 82 aa, Triticum aestivum
  unsure (1)..(82): unsure at all Xaa locations
  Clone ID: PAT_TA_50781.pep
RYLILGPLPPQLSXLXPPFYLXXKSVXXXXXXPTPLXXXXRLKNVLAPVKCNPAPVPVLPVPSPVGYEXNEKSEQSLFSPXK

SEQ ID NO: 156364 - protein, 74 aa, Triticum aestivum
  unsure (1)..(74): unsure at all Xaa locations
  Clone ID: PAT_TA_50782.pep
ALQFYSVMSAILLLTHKKKGEEIIKGGKNXNGGGGGVKYRAXXNACMRKRKGITLGHTNKGSQDTNLKTGNNQN

SEQ ID NO: 156365 - protein, 66 aa, Triticum aestivum
  unsure (1)..(66): unsure at all Xaa locations
  Clone ID: PAT_TA_50783.pep
NHIKKHXLFLHPLLVLLFFIKMTVFIXYXLLFLGGGGGALYFXNFXFNQANWITLHRAVXCLSNRG

SEQ ID NO: 156366 - protein, 97 aa, Triticum aestivum
  unsure (1)..(97): unsure at all Xaa locations
  Clone ID: PAT_TA_50784.pep
PHPHAMTIATSGIDNVVKLWTPSAVERAQVVNVXELNPRKRKAKLWQFPFPEELVWHVLASRGRHPGVEEDSSEVFEAPPKLFNLVLGAPNKDNLFF

SEQ ID NO: 156367 - protein, 98 aa, Triticum aestivum
  Clone ID: PAT_TA_50785.pep
YFYHPWGGGGYYPIYPIFQFPPKTNDLLPFFSKPPPGFLILITLNKQVIFFFNSQYKIKQFGVVFKTLFLIFFNPLFPTWECQHFPNQFLPQGKLPKL

SEQ ID NO: 156368 - protein, 55 aa, Triticum aestivum
  Clone ID: PAT_TA_50786.pep
LERKKGMHTHASCKGISNGNTLLGRRSSKWMDGSFFVVPRDPTHPTPHHQCPPRA

SEQ ID NO: 156369 - protein, 118 aa, Triticum aestivum
  unsure (1)..(118): unsure at all Xaa locations
  Clone ID: PAT_TA_50787.pep
PPISGQGKGAKALGKGGSKRPNKVLPXNLQGIIKPAFLRLARLVGVKPISGLIFKETPGVLKIFLKNLILXPLPYPEHPPPKTVPPMEVVFALKRQGRPLFGFGGLTRVVPPVGFKCG

SEQ ID NO: 156370 - protein, 110 aa, Triticum aestivum
  Clone ID: PAT_TA_50788.pep
VFPHAQKYLISSQIQPFKKKKAPLNNPWLVFSKFLTFSNSLVFWEIIIVNSTIFLLSHFANFGQHIFFNKLNKLPGFPHGKCSGTGHCVYVLSMLWHKIGPLLFSPPPPL

SEQ ID NO: 156371 - protein, 85 aa, Triticum aestivum
  Clone ID: PAT_TA_50789.pep
ASSDSTTCARCSASASSPSSHRAARSPARPKQLTHDRPYIKCHCSFVNSDIALGFPSPFIFLIRSSTICVCPCSCTNMARESMLV

SEQ ID NO: 156372 - protein, 95 aa, Triticum aestivum
  Clone ID: PAT_TA_50790.pep
GGFVGFKNFFFFFFFFFFFFFFFFFLDQGMREKGQGRQHGYKGSKKSQSRGGGVKRTILPLLLLLLLGLLGLLLVLLRNRGYLLATANKVGQQQH

SEQ ID NO: 156373 - protein, 89 aa, Triticum aestivum
  Clone ID: PAT_TA_50791.pep
RCSPPPRYNTFTQKTAPSMLPPPSKTTLYTYSRYAPRSRSAIPPPTQASGNIIGLRSPPPPLMGRPDHQYRTRDPLELSYSPGVLPGFS

SEQ ID NO: 156374 - protein, 61 aa, Triticum aestivum
  Clone ID: PAT_TA_50792.pep
WGGLLKISYVWRCYPLKPGIYLRALKHDSYLQPKGIVFSLSTLQPKLTGGGVLYGALPISY

SEQ ID NO: 156375 - protein, 57 aa, Triticum aestivum
  Clone ID: PAT_TA_50793.pep
ALNPQQYILKLGEGAPSQCISGFSAMDISPPCGPLCILGHFFFAHSYTMFRYDKLPL

SEQ ID NO: 156376 - protein, 107 aa, Triticum aestivum
  unsure (1)..(107): unsure at all Xaa locations
  Clone ID: PAT_TA_50794.pep
LRRDIPPLEENRMPYMKLAVELGLANWGTDTGLGCTYMLHDGISVTLTGENIPSGSXMATRKVKDTESDMDMMHYLTNMNCGXSLVLFLLLSQRLACAFTEHSYLSC

SEQ ID NO: 156377 - protein, 73 aa, Triticum aestivum
  Clone ID: PAT_TA_50795.pep
RGHCRLRKLYTLICACLLHKSLLLVTNNIRMYTVNVTSWLAKACFIVNAFMSYLYAHALKIYKQETGCRMADS

SEQ ID NO: 156378 - protein, 206 aa, Triticum aestivum
  Clone ID: PAT_TA_50796.pep
GRVGAPLLPPSPPSGSPRLLKSSSGSEWNVVVQRNVKSSLLLLLAISTVVAFSILYSSRSLTVARTAGEALTQSPLLAALDLSSRMPEDDDDQSDEPAEVVSLTAAASSTDDGPSEAAMQLEEKCDISRGKWVREPNGPVYTNLTCPMLPDFKNCQKFGKDDGHLYWRWQPDGCELPRFVPERFLDVVRGKRLAFIGDSLARNQID

SEQ ID NO: 156379 - protein, 158 aa, Triticum aestivum
  Clone ID: PAT_TA_50797.pep
QRHTKEHSSTNTAKEENKTTADPKPAAPPPPTTTQGLQDDASMEVATYTTSSSPDPAKPDHGPSPRDRDLSDLDSLATRLQGGGRHQKAPCVTGINRGLCKVFTGNQTQRLASKSEDRVTSGRRRSPGEGRGAPPLCHEKRAAIAVAMKPGPPPPPSP

SEQ ID NO: 156380 - protein, 187 aa, Triticum aestivum
  Clone ID: PAT_TA_50798.pep
MCPPRSDHRKEKSLGLLTQNFVKLFLTMEVETVSLDEAARLLLGERHAESNMRTKVRRLYDIANVLSSLNLIEKTQQVDSRKPAFRWLGQAKRKEGATVTVALPPSRKIMSSKRAFGTDITNIDNKRGKLVLETENKPKLMQGGSSMLKTFESQLGQGKSSGFVYGPFHPAGARKHEVDDQTVRENE

SEQ ID NO: 156381 - protein, 63 aa, Triticum aestivum
  Clone ID: PAT_TA_50799.pep
PFHTLIPCMELRVHHNSKKPDFFVEHNRDHIKFKLNSTYKTVVRRGVSLVKLYQGKETKKFYY

SEQ ID NO: 156382 - protein, 129 aa, Triticum aestivum
  unsure (1)..(129): unsure at all Xaa locations
  Clone ID: PAT_TA_50800.pep
PHPGDRVGGGVGLETAWRACLKDPLEDQLPXISMFVLPLSVLVARLMFFLFALXXNLVGXGALFISXLXTSFTLHNRTSHYLNEVLLLLCYIAIGACFFVTRQPSSHANGNGMLLDVPTSSMIVQVAQH

SEQ ID NO: 156383 - protein, 165 aa, Triticum aestivum
  unsure (1)..(165): unsure at all Xaa locations
  Clone ID: PAT_TA_50801.pep
MGDSGGSVVSIDVERISFGGKEHHIETKHGPVSVAVYGDHDKHALITYPDVALNHMSCFQGLLFCPEAASLLLHNFCIYHISPPGHELGATPILPNSPVASVDELADQVAEVLDFFGLGSVMCLGVSAGAYILTLFATKYXRERVLGLILVSPLCRTPSWTEWFY

SEQ ID NO: 156384 - protein, 195 aa, Triticum aestivum
  Clone ID: PAT_TA_50802.pep
VRRVGQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLPRAQLTGVRLSSTQRAVVSTGYDNAVALPA

SEQ ID NO: 156385 - protein, 84 aa, Triticum aestivum
  Clone ID: PAT_TA_50803.pep
QVALLEGLFLWWRWPLPRRPRNSSNTNAVGFAFMRLCYRQRRIDDTGCSLGQSCVARTKCHVDGYIDSSVIYPPSSIRPTDLTV

SEQ ID NO: 156386 - protein, 72 aa, Triticum aestivum
  Clone ID: PAT_TA_50804.pep
TKYLYLHSQGMFTIIKKWLYNIHWSHCRDTRARRLTGTPWRLHGGGGGITCVTLSAISLTDYTPEHGANRAK

SEQ ID NO: 156387 - protein, 81 aa, Triticum aestivum
  unsure (1)..(81): unsure at all Xaa locations
  Clone ID: PAT_TA_50805.pep
RDNIQGIPKPAIRSLPRRGGVKRISGLIYEETPRLLKIFLEKVIXRDAVPYTEHAPRKTVPPMDVVYALKPQARPLYGLGG

SEQ ID NO: 156388 - protein, 67 aa, Triticum aestivum
  Clone ID: PAT_TA_50806.pep
SVKVSGGFYLGVRALTAAAGRGFFSPGALRWGVLPGVKGASNYGGIMVWDRYKNVQNSSTPQVKDRV

SEQ ID NO: 156389 - protein, 121 aa, Triticum aestivum
  Clone ID: PAT_TA_50807.pep
SPPPPQRGVPAGFQIARREARGFRLPPLKVGHGVGPFFFKVKFTGAPGARPAGRPLGLEGLLYKYPPPRLPPSLSLAWAGRGARLLKSPASLSFTLVLVRRFFSPRGALVLPSIFKKGPPL

SEQ ID NO: 156390 - protein, 90 aa, Triticum aestivum
  unsure (1)..(90): unsure at all Xaa locations
  Clone ID: PAT_TA_50808.pep
RGKLLSSDWAVPALRFRLLPKGPPLDPPIHNIGFHLFPVVVLGVVXXXLAPKKNPPPPRVCCYGVSLYWAVVLGCWVRPLYIKRGETFFG

SEQ ID NO: 156391 - protein, 88 aa, Triticum aestivum
  Clone ID: PAT_TA_50809.pep
GGGGGLKIFFFFFFFFFSKKSHLFKGEQRQGPPLNNIKAYLPVIKSFLFGGGGEASTSPQPFPQGGGDHWDIMASNPLNPSFCGSPSQ

SEQ ID NO: 156392 - protein, 68 aa, Triticum aestivum
  unsure (1)..(68): unsure at all Xaa locations
  Clone ID: PAT_TA_50810.pep
GKPFPLGGGSSAPLANVKGKFPAKGGFPPGQQGLFFFGNQLXDGPPLGGFTLQKGSPLPLVPRLRGGQ

SEQ ID NO: 156393 - protein, 119 aa, Triticum aestivum
  unsure (1)..(119): unsure at all Xaa locations
  Clone ID: PAT_TA_50811.pep
ARKSAPATGGVKKPHRFRPGTVALREIRKYQKSTELLIRKLPFQRLVREIAQDFKTDXRFQSPPLRLQEAXEAYLVGXFEDTNFAPSAKRVTIMQGHQLAPARGERARCNPCAALVPVR

SEQ ID NO: 156394 - protein, 111 aa, Triticum aestivum
  Clone ID: PAT_TA_50812.pep
DTLVFSYVSKVHPVTEVSQGGYTSCSGSNALAKDDSGATTVTLATPGTHYYMCNIPGHCASGMKLAVTVAGGGSSAGGSTPSGASAGGSLAPAMGPVVTAAAGALLKVALF

SEQ ID NO: 156395 - protein, 122 aa, Triticum aestivum
  Clone ID: PAT_TA_50813.pep
GWGVFKNFFFFFFFFFFFFFFFFFFFFFFFFFFFFFFFLKKNPPNKKQGGGGGQNKKKPPLFFPTKKTNLFSNKFPGRATRIKGPKPTPPQFIFTPKKFEAGLLGFIPRGGFHWGGKGKKRS

SEQ ID NO: 156396 - protein, 122 aa, Triticum aestivum
  unsure (1)..(122): unsure at all Xaa locations
  Clone ID: PAT_TA_50814.pep
GANGGWAPAASSATVSAGAKCSPRWRPPLGPPPWSCPPPPPRGAPAGLKRPGRPAASTAPPASGAPGAAAPFAAATXPGPRRPAGKGEPEDXRASKQAPSPPVFPPPGDYHQPPHGLAGARA

SEQ ID NO: 156397 - protein, 88 aa, Triticum aestivum
  unsure (1)..(88): unsure at all Xaa locations
  Clone ID: PAT_TA_50815.pep
KSXNKQFALSNLXXPNPPHYXXHKKIXKXTLPPYSSVVKTTIMLPHLQDFKNXNXFTLNIFQPLHQSAPPTQSQLXHERQDEPNEPSX

SEQ ID NO: 156398 - protein, 75 aa, Triticum aestivum
  Clone ID: PAT_TA_50816.pep
GVPLEGGASVNPLDKTKTPPLLYVVGFGRKKCVVFLFRPGVFVLFQNLVGKTPFEVAKFTTRGGVLKLLGKEGFL

SEQ ID NO: 156399 - protein, 102 aa, Triticum aestivum
  Clone ID: PAT_TA_50817.pep
IFVGENSQFHTEAVHMTAKLDKRYSALVEVQACGSVVTEEQPHAMLIPMEYFLMGYGLFRPSHVSSSPRSPLNPFCISPELLSPESMGVKLKPIKTRANLRV

SEQ ID NO: 156400 - protein, 158 aa, Triticum aestivum
  unsure (1)..(158): unsure at all Xaa locations
  Clone ID: PAT_TA_50818.pep
GGGGGGKQFPLVEVPNNNLPMGGQHREKHFYLAATWTSTLFFLHTXSNEGGGGGAFFNINXXTXGGGGGTSPWSDNIRDMWAGSCSHHFGGWITLVFFGYNLLIWGGVKIRVFFLCVXSYCFLCMCLWFGFLCLCCLSFLCLYLFIVSLLHLPGTRGG

SEQ ID NO: 156401 - protein, 112 aa, Triticum aestivum
  unsure (1)..(112): unsure at all Xaa locations
  Clone ID: PAT_TA_50819.pep
GRRLVGPRVLSSYWVNEDSTYKFFEVRLVDVEQSAVSLVLRIKRFCEPVDKHRXLSGMESAVYRFSGMSGKGLRPPKNRAWRRATWKCNRTVSLGRYGKLPHEHGDSIGLRN

SEQ ID NO: 156402 - protein, 104 aa, Triticum aestivum
  unsure (1)..(104): unsure at all Xaa locations
  Clone ID: PAT_TA_50820.pep
VTRVHAGSGLLGKPPSLLAVHALRGQEDAASAGCSPIPKFSQYDAETLTAGDQVPTSQTKLNEPLLQFTXTATAWNSKACMRGLIIAFIGELRLNKGGLPIFTL

SEQ ID NO: 156403 - protein, 75 aa, Triticum aestivum
  unsure (1)..(75): unsure at all Xaa locations
  Clone ID: PAT_TA_50821.pep
QLVHLQSKYVXTGHADLTRXWAVNIQRXSYASYVGHYPMLAYFSIAENESIGRERYEFMQKMLLPCGLPPERDED

SEQ ID NO: 156404 - protein, 139 aa, Triticum aestivum
  unsure (1)..(139): unsure at all Xaa locations
  Clone ID: PAT_TA_50822.pep
MAALYYAAVSVPCFAGCAKXAAPRDSRKEVRASLGNKADSAGAAMAASAIADGXGRHIAQDVLLGTNDSVLSDRAQDFNNKDRETINLKNNAXYPHNGVXDEDAVPXGLHCSKIFEQEYLKNPTENFFVTLTILGTYRL

SEQ ID NO: 156405 - protein, 153 aa, Triticum aestivum
  unsure (1)..(153): unsure at all Xaa locations
  Clone ID: PAT_TA_50823.pep
LXTYAYKFVIXNGGIDTEDDYPFREADGTCNKNKLKKHVVTIDGYKEVPPSKEDLLLXAVAQQPISVGICGSARAFQLYSQGIFDGPCPTSLDHAVCCSDNRSCCPHDYPICDTARGRCLKGNGNFSSIEGIKRKQAFSKVPSWNGLLELLDQ

SEQ ID NO: 156406 - protein, 47 aa, Triticum aestivum
  Clone ID: PAT_TA_50824.pep
ICWWTYEVWNSLMCVEQLTCLINLLRTWMALEMASNTAVLWYSAMSL

SEQ ID NO: 156407 - protein, 149 aa, Triticum aestivum
  Clone ID: PAT_TA_50825.pep
VHLNKLAGPAAPAHYQSVTGDVFDGPRDSRTSASPDLFDASRCPRRSVFTNGSPASNAELATVQAHRCVMRARLTLQNGTAAQVSSRRVVAWPRPPASARGVHGPGAANLSISRASFACRPRQTSAATHGPDNAASARLLAERRKPSAR

SEQ ID NO: 156408 - protein, 154 aa, Triticum aestivum
  unsure (1)..(154): unsure at all Xaa locations
  Clone ID: PAT_TA_50826.pep
MEETKPRLALGSEPRRSSRREWSWGSALAGAVTTVAGADVLXLQPGTRASSLMSMNLFTFHFRPPAALDIGLTLTVHATNPNVVPVRYGAYNVYILYGGTLLVTARLDAGQQTGTXCRLLYLPARLNTMELAHHTGAILADSTRRHMELDAASD

SEQ ID NO: 156409 - protein, 83 aa, Triticum aestivum
  Clone ID: PAT_TA_50827.pep
QGFWSLGTLASQLLFFSIVFFFFFFFFFFFFFFFFFFFFVLTELPHNFSPLPVLMQCTSVLMSRGHRDSYPYQDGKRMLELAK

SEQ ID NO: 156410 - protein, 58 aa, Triticum aestivum
  unsure (1)..(58): unsure at all Xaa locations
  Clone ID: PAT_TA_50828.pep
LXRTAYIDVDAAGAAAANSVSSLARLLDQQPCRQLDLFVPTFVSVCFTLLLGDELKIK

SEQ ID NO: 156411 - protein, 191 aa, Triticum aestivum
  unsure (1)..(191): unsure at all Xaa locations
  Clone ID: PAT_TA_50829.pep
WQRATTGKQPLPARQQRGLRPLFGGGGPTSDALRRPARPAATPDGVSSGTDSHWRLEWRSVLHDDVGIRPRSLSLSPNNGGAHGRGAQPAMALSPERDASASSRDFPEVEVGRRPPLASAWRGGARGPARGSLLHGLDHVRTWSGSSRRSGWLRWRRKPATSARPKLKRPARVAMRVXACRTPSAVHLGKX

SEQ ID NO: 156412 - protein, 113 aa, Triticum aestivum
  unsure (1)..(113): unsure at all Xaa locations
  Clone ID: PAT_TA_50830.pep
TSQGIKKFQTMSYLSPISTEVQFKDXDYLTRCKGXPCLDLTKAGCIIREYNQFAEYYNRPVXTMFKIAMHAYSETTHAINEVQXVKKSTVYPXVRMIQLHNMYHAQFVIFIVF

SEQ ID NO: 156413 - protein, 99 aa, Triticum aestivum
  Clone ID: PAT_TA_50831.pep
GTWVDPEPQTRTADPELTFQRLARETRMIKDRPPIARPRRAGPTGGRIDAYLDCLYKAHQPVRHPRQARDHHAQDIHLGTQIRGQRAYTVLSVNDSIAS

SEQ ID NO: 156414 - protein, 79 aa, Triticum aestivum
  unsure (1)..(79): unsure at all Xaa locations
  Clone ID: PAT_TA_50832.pep
AVSNLPVLHQPQTAIAVADSAGPAADVHYXLKLVVSHLQYSTVAALLRSERRVLHLXTTTLPLEDDMPAIMYSFKRHND

SEQ ID NO: 156415 - protein, 67 aa, Triticum aestivum
  Clone ID: PAT_TA_50833.pep
EMGESFNCGFESNRATVCNLIRNYEEVRANHTLQRNFGCCNPSLILQRMWLLFTQWVGPSGRRSVHL

SEQ ID NO: 156416 - protein, 101 aa, Triticum aestivum
  Clone ID: PAT_TA_50834.pep
WCTNFMVDNGRHPCSPSGSEAAFIYNIISFLALGDTPCQRVLPVVADGWPCHILAPLTDRPQRLRHHSSSALKIWEKETRGAAIPVLPDLFPGSSDPPPPH

SEQ ID NO: 156417 - protein, 139 aa, Triticum aestivum
  unsure (1)..(139): unsure at all Xaa locations
  Clone ID: PAT_TA_50835.pep
MLIGSCSRTKAGSLVCAVPSMDTDVLPDKIEATGKXEAKPEVPVEEKKGFLEKXIKEILSGGHXMPEDTNAGPDTHAGHHPDTHAGTHRRTAPAXPDAQEGSLCDYXEKKVLMRKIIYKLTGYHMTLEEDKAAARFGKH

SEQ ID NO: 156418 - protein, 170 aa, Triticum aestivum
  unsure (1)..(170): unsure at all Xaa locations
  Clone ID: PAT_TA_50836.pep
APARGGPRWLRPQELARYSHDGATCNGRIDGAIQIFNRRVXGLGYHMNTLPGXAHFTLHXDAYNILNDILGNAGCYDLTESTGECCGRCRNNCEGTCLSYHAPCANTDQNMLWDSYNPIEANXIIAGRRDYRSHYANYAYTKGHEDARILVDSIYKDVQASTGYRSDRGM

SEQ ID NO: 156419 - protein, 57 aa, Triticum aestivum
  Clone ID: PAT_TA_50837.pep
VPFLADYHSPILFSKMFLPQVLTHACWILSQYYMLLDVPHCFSVPCLPSQVVIHTFQ

SEQ ID NO: 156420 - protein, 114 aa, Triticum aestivum
  Clone ID: PAT_TA_50838.pep
TNPNLALGTVQTRLVRKAEELGLGPRRHQNHAGWSKRPALHGRGTLLLIYFHEPAHLQLPVSGVPGHPPHPQGHTPISTNGPCATGAITSGSILLWRHSSWAPDTLTPVSDPDT

SEQ ID NO: 156421 - protein, 143 aa, Triticum aestivum
  unsure (1)..(143): unsure at all Xaa locations
  Clone ID: PAT_TA_50839.pep
SEVSTACRWRSLQIIYLYHSFQFLQKTSSHYCISLRAHDKYIWGASGDPWRARLHDLTRGGLLGRGKHHSGVAKYPAPYVHQDVEMSKIPFLLASFLFHDTSVGSTVRKTTGNMLKIISPCIMLHSQRRXXFXCIANYFAGXP

SEQ ID NO: 156422 - protein, 64 aa, Triticum aestivum
  unsure (1)..(64): unsure at all Xaa locations
  Clone ID: PAT_TA_50840.pep
PASAPRPVDDFKNPKXSGSMDAFKKILAADGARGLYRGFGPAMARSVPANGACFLAYEVTRSLL

SEQ ID NO: 156423 - protein, 76 aa, Triticum aestivum
  unsure (1)..(76): unsure at all Xaa locations
  Clone ID: PAT_TA_50841.pep
TVPTTPAATRCTNDPRALCCDWQSCIGXTVHANVKTDCKKMGTGNIITLIFLMIRYSVDCWALTNNRCYNSNPSCK

SEQ ID NO: 156424 - protein, 170 aa, Triticum aestivum
  unsure (1)..(170): unsure at all Xaa locations
  Clone ID: PAT_TA_50842.pep
MANPRVFFDMTVGGAPAVRIVMELYXDAVPRTVENLRALCTGEKGVGKSCKPLHYKGSAFHRCVSPTSCARAGDFTTGIRDLRXFIYSEKFGYQKFVHMHTKSGILYMGNAGPNTXGSQFFICTVPCNWLDCMHVVFCEVVEGMSVVKNIDKVGSCRCTCFNAVVITYCG

SEQ ID NO: 156425 - protein, 130 aa, Triticum aestivum
  unsure (1)..(130): unsure at all Xaa locations
  Clone ID: PAT_TA_50843.pep
MLTLLRADETAPFFRFFGASATLVFLCMASSYCTVTNLVXVSSMALMHAELVMXXIAPGAMAEVLHVYKLFFCCIITSAINHTSKPYYLFDXYDHLSYGLXCGLTFLDVDINIDIIGHYLAKVSISLQPS

SEQ ID NO: 156426 - protein, 113 aa, Triticum aestivum
  Clone ID: PAT_TA_50844.pep
MPSKTDRLKYIRANAQSSQECKLAIRLRLQQHALCLLSNRDSCVCVLSAETVSSSPTILGWARHSSLQVQTPCNVAQAVQADEPPGQQVRQVSTALLRNRLSLVRRVQRQPIT

SEQ ID NO: 156427 - protein, 92 aa, Triticum aestivum
  Clone ID: PAT_TA_50845.pep
IGGGISGLLPKWWGEHQRRPPDQRHVSLGRRLRTYILLTPSRPPPRTPTSDPAGATAGISPAADSSGAAAAVSMTPPHMGDGYVLFQVRGFP

SEQ ID NO: 156428 - protein, 57 aa, Triticum aestivum
  unsure (1)..(57): unsure at all Xaa locations
  Clone ID: PAT_TA_50846.pep
VYSTLVPGLQYVHXGGSPARRWCTGVQNLLAGANNIPDRRTIWGCLEQRRQGTSGLP

SEQ ID NO: 156429 - protein, 79 aa, Triticum aestivum
  Clone ID: PAT_TA_50847.pep
CLMCVSHSPFNVGHLRCSPIVFSPTTGINTVWACANVVQANELGDMRGFFPGLTLLHRVLVRLEVAPPIVYLGVAGPSP

SEQ ID NO: 156430 - protein, 69 aa, Triticum aestivum
  Clone ID: PAT_TA_50848.pep
RTYLQRIQVVAADGQNCLVLDFEAKSPVLSHLRRAGKLHLLFLSCINAEFGNGGDDLYEVRLISVYHRR

SEQ ID NO: 156431 - protein, 65 aa, Triticum aestivum
  Clone ID: PAT_TA_50849.pep
AQSPRRSTQHNVRYRLMQSITWIAIKSLIKKLSCPKAHTTSALYISNFTSILPQRDYKPDVLFLT

SEQ ID NO: 156432 - protein, 95 aa, Triticum aestivum
  unsure (1)..(95): unsure at all Xaa locations
  Clone ID: PAT_TA_50850.pep
GEVPFGSPSEEKHHKHKDHLRQMGAVAVGAFALYQKHNAKKDPEHAHKHKIEEEVAXAAAFVGAGGFVFHEHHEKKQDHKEATEASGEKKHHHFG

SEQ ID NO: 156433 - protein, 122 aa, Triticum aestivum
  unsure (1)..(122): unsure at all Xaa locations
  Clone ID: PAT_TA_50851.pep
QTATDNTRHADNTDASWRRSTPCASMTGLTRTRGPQARPGRPPACSPEERPRRLRLPPDAXSLLLVLDGAWQVVRASFVSASSLDGTALTYVGWYYTHVAAIRLFNITNRLSLAPDNFLKCK

SEQ ID NO: 156434 - protein, 43 aa, Triticum aestivum
  Clone ID: PAT_TA_50852.pep
NKHQAPGATVLSSVLVSLSVSPTTDELNCATPGRVPLAMQNDP

SEQ ID NO: 156435 - protein, 50 aa, Triticum aestivum
  Clone ID: PAT_TA_50853.pep
HLTLYCSLIFTYLMEDSGPLTYADHEQDRAPDCPRPHTANVQYQEHDERR

SEQ ID NO: 156436 - protein, 112 aa, Triticum aestivum
  Clone ID: PAT_TA_50854.pep
CCPPEASVLALGLQSSRFASHSITMKGTQAHHHILRQARISQQGALALIVARYGRAWAGKASLYYVHQSSKLVQPRLIHPLSVDGNADVQDSLAWSQLAVCVPWVAVPALKA

SEQ ID NO: 156437 - protein, 77 aa, Triticum aestivum
  Clone ID: PAT_TA_50855.pep
LRSSDFSCSVLKKERRKERKEAVSVCLSASPTILLLPLLFLLTIPSLASACDRCARHSKAAYYTSSLTLAAGSCGYG

SEQ ID NO: 156438 - protein, 75 aa, Triticum aestivum; identical to SEQ ID NO: 106874
  Clone ID: PAT_TA_50856.pep

SEQ ID NO: 156439 - protein, 51 aa, Triticum aestivum
  unsure (1)..(51): unsure at all Xaa locations
  Clone ID: PAT_TA_50857.pep
TCVQARNEGXDLAREXNEIIRAACKWSPELAAACEVWKAIKFEFEPVDTID

SEQ ID NO: 156440 - protein, 140 aa, Triticum aestivum
  Clone ID: PAT_TA_50858.pep
MSAAGQGCDGHKVTVQNLCGHDLNLGINAVSNSKMLFPNGWLLPNGKHESFDVCAWSGSVSAQGAAVAKFHIGHEGGAYYEVSTDQASMPIRVSVTPHGSPLQGHCPTAGCNSGNHCFEHSVPGGNCHGVTEIKIIYYNP

SEQ ID NO: 156441 - protein, 198 aa, Triticum aestivum
  unsure (1)..(198): unsure at all Xaa locations
  Clone ID: PAT_TA_50859.pep
PGRPSVRRPRVRPASAQRPSSSRRQQLPRDNNGMLKHKNSTSPRLPQXKXDMERRSRLPVPSPEANKNQRQSVDKSHLDTVSPRSKVRRKLAQGEDGHQNVAKSRTRSLNQQGDDMSLMSDGSMSVVSELDIEVTSADRSAEVNASNFQQGNQTPLGRNPQKVKTSYDANKDLSSVDHAAAVPERPSPVSVLDYSFDQ

SEQ ID NO: 156442 - protein, 128 aa, Triticum aestivum
  unsure (1)..(128): unsure at all Xaa locations
  Clone ID: PAT_TA_50860.pep
SSYYRGAHGIILVYDVTKRQSFTNLADVWAKEIEMHSTNKECVKMLXGNKVDKDEDRMVTTEEGLAFAQQCGCLFLESSAKTRENVEKCFEELALKILEVPSLSEEGSSVVKRNSLKQKHEKSGGCCQ

SEQ ID NO: 156443 - protein, 105 aa, Triticum aestivum
  unsure (1)..(105): unsure at all Xaa locations
  Clone ID: PAT_TA_50861.pep
PAXSRFALXNYKNLANRSLVDDTLRKXNGLKPIASELGVSMAQLGIAWCASNPNVSSVITGATKESQIVXENMKALEVVPLLTPEVLEKIEAVVQSKPKRLESYR

SEQ ID NO: 156444 - protein, 158 aa, Triticum aestivum
  unsure (1)..(158): unsure at all Xaa locations
  Clone ID: PAT_TA_50862.pep
PYLMTFLALMPVLWVGIWLNSTDCITYLLRSLMMIILIIMLASLXGFLMACYRHYYLLTLFLFIXLFIMFLMVFLLVFFFAFTYRGAGPGGDEPPLDPVLALLLHLIVPQLGPQPGVLPQHLGLPPRLPPLRLHVPLRAPPRQRPAHHRARRHALRPV

SEQ ID NO: 156445 - protein, 63 aa, Triticum aestivum
  Clone ID: PAT_TA_50863.pep
FNGHLVKDRKVEVVVLRNQQVHIGGSAQVLVAVENSRSVCAVHIYASVSPAVVKARAPAFAAK

SEQ ID NO: 156446 - protein, 84 aa, Triticum aestivum
  unsure (1)..(84): unsure at all Xaa locations
  Clone ID: PAT_TA_50864.pep
QXVVPLSRLSLIISFDNMRQVHSVSSIAFKAPACAGSPARCYTVHSLRATYKEALRLCHTLYIDLGFPLSFTIHLFVPKIRICV

SEQ ID NO: 156447 - protein, 150 aa, Triticum aestivum
  Clone ID: PAT_TA_50865.pep
GPPMSVAVLSRLCHARVKPHKGAFPVGPAPGSRGTDVGRVSSWSNSPTRNGIGTWTTEPSRSMPSKFSEAIAISLVVELLFAWHCVHLRHKGDAPCIRQRVMSTSLASAVRCPLFIHGQPEAHRTPPYVWYTRGPWTAPAIAPFERVVSP

SEQ ID NO: 156448 - protein, 36 aa, Triticum aestivum
  Clone ID: PAT_TA_50866.pep
IKGWSMGNSMMLAFFIIQCPSQYRPSLIVRSCQFWH

SEQ ID NO: 156449 - protein, 89 aa, Triticum aestivum
  Clone ID: PAT_TA_50867.pep
VDKPHQQDIMSQDQVEFLLPVCDAQLFERTHVYSAFLCKTSTVQKGMGSTPCKFGQSRVIPHPMGSIFSVSKIDLQAPKTRVLLRSPCK

SEQ ID NO: 156450 - protein, 164 aa, Triticum aestivum
  unsure (1)..(164): unsure at all Xaa locations
  Clone ID: PAT_TA_50868.pep
QNPHALPWIKATIGLPVRQRYRGRLGRLSXNGGSDMGMNVXSMRGTSQNSEHVGYLLPFSKGGLLNXADYLIRXQWASCLELNKGVSVLREHNRXSGYYDRRYWTMSKLAMFRCTDPTHVLNQVKEVNNDNPDAYVRVIGXFDNLRQMHCFKLIKFRPTGYRGV

SEQ ID NO: 156451 - protein, 98 aa, Triticum aestivum
  Clone ID: PAT_TA_50869.pep
EHNNSSTRAAQSTNERVQSSHSLSREEPNQQSGSDNFIILQQSSLVVSLPHFESSPSFAPREATRDHPACPQSPNTGQTSQSMAYSQRDAVAEGRART

SEQ ID NO: 156452 - protein, 119 aa, Triticum aestivum
  unsure (1)..(119): unsure at all Xaa locations
  Clone ID: PAT_TA_50870.pep
SRRQGSQYGVQLESSVRXRLVAADKYEDDEEEALEKVSDFFQSKYFRPGSVVTFHFPATVTAAPEISFVTEGKEEAKVAVENAAVAEMIQRWYLGGDSAVSQTTVRSIADSFAAMLTSP

SEQ ID NO: 156453 - protein, 77 aa, Triticum aestivum
  unsure (1)..(77): unsure at all Xaa locations
  Clone ID: PAT_TA_50871.pep
KKRNSMQAFLXQEEDMDHFPSITQLHSCNFVAVLFFQHLGEFWRMQIKLVCDCSVQSLVLEIINRLVVCLLLSLYLI

SEQ ID NO: 156454 - protein, 92 aa, Triticum aestivum
  unsure (1)..(92): unsure at all Xaa locations
  Clone ID: PAT_TA_50872.pep
TPKQLYDPVLLXTSFARILGPPKLPQQEDTSSFSHIKFFHDLVAQVNXKIRGFQAKVSELWYVEEYDVLALALNGKMRVRRLHLGCNEGQDN

SEQ ID NO: 156455 - protein, 179 aa, Triticum aestivum
  Clone ID: PAT_TA_50873.pep
KQQKSSSKKLHPGSKSGGRLKQNQKNASSKNKLRCQQKRHEHLRALHPMKQKIILVPAKKYTGSNKNKKLVQQKMHQQKMAILSCSSPSNRLELRRARLQLPTFEQRWIQHSLLLDVASLARHQPCSTYTSLFQQSPSVPAQTRRRCRGRVQLGHGDRSTLVATAWRGRVSSCRRRRTR

SEQ ID NO: 156456 - protein, 66 aa, Triticum aestivum
  unsure (1)..(66): unsure at all Xaa locations
  Clone ID: PAT_TA_50874.pep
APSHQPFQKPALGYESCHQALAQAEAMARADMLRFQPESGLXLSSEGILGPLSSDTAQEEGLPADE

SEQ ID NO: 156457 - protein, 68 aa, Triticum aestivum
  unsure (1)..(68): unsure at all Xaa locations
  Clone ID: PAT_TA_50875.pep
KTPXKGAPQSPXRQRNRRERRTXRALSLXTQPAKRGRXAKRIRWVTPRVSQERXCKXXAPPPQQRGPI

SEQ ID NO: 156458 - protein, 69 aa, Triticum aestivum
  unsure (1)..(69): unsure at all Xaa locations
  Clone ID: PAT_TA_50876.pep
MDAVDSVVDPLREFAKDSVRLVKLFFXPDRKEFTGGGGRTAIGFVVMGFVGFFLKLIFIPINNIIVGSG

SEQ ID NO: 156459 - protein, 83 aa, Triticum aestivum
  unsure (1)..(83): unsure at all Xaa locations
  Clone ID: PAT_TA_50877.pep
TSEAADLSSWNGERTTFIYQAAKLKHSRTFSLSTPKKSLEQISAAKFSIKGNQMSQVEHGPSSKSQSSSFLSLXRSSSALVDR

SEQ ID NO: 156460 - protein, 126 aa, Triticum aestivum
  Clone ID: PAT_TA_50878.pep
KKKKKKKKGGKKKKKKKKKKKKKKKKKKKKKKKKKKKGAALFRGTQFYFPVFCKLILFFWGPGGGFPGPPFNTFFLGKPLASPILFPLKKFPFSPVGLLPKGPPPFPFPKFCPPCLGMGPPLVGAL

SEQ ID NO: 156461 - protein, 43 aa, Triticum aestivum
  unsure (1)..(43): unsure at all Xaa locations
  Clone ID: PAT_TA_50879.pep
RLTRESWTPQDGPESRATTRRSCXCSSHYTLIXSNMNGRGATG

SEQ ID NO: 156462 - protein, 96 aa, Triticum aestivum
  unsure (1)..(96): unsure at all Xaa locations
  Clone ID: PAT_TA_50880.pep
GTSSTIPRRVAAGYAXRGSSPSRXVNPGELAIISKEPVAPYERPALSKGYLFPQNAARLPGFHTCVGSGGERLLSEWYSEKGIELILSTEIVKADL

SEQ ID NO: 156463 - protein, 174 aa, Triticum aestivum
  unsure (1)..(174): unsure at all Xaa locations
  Clone ID: PAT_TA_50881.pep
MAPAVMASSATTVAPFXGLKSTAGLPVSRRSSGSLGSVSNGGRIRCMQVWPIEGIKKFETLSYLPPLSTEALXNQVDYLIRSKWVPCLEFSKVGFVFREHNSCPGYYDGRYWTMWKLPMFGCTDATQVLNEVEEVKKEYPDAYVRVIGFHNLRQVQCVSFIAFRPPGCEESGKA

SEQ ID NO: 156464 - protein, 174 aa, Triticum aestivum
  unsure (1)..(174): unsure at all Xaa locations
  Clone ID: PAT_TA_50882.pep
YTYIVHPWAPTVMASSATSVAPFQGLKSTAGLPVSRRSTALASAASASVXRIRCMQVWGGEGIKKFETLSYLPPVSTEALLKQVDYLIRSKWVPCLEFSKVGFIFREHNASPGYYDGRYWTMWKLPMFGCTDATQVINEVEEVKKEYPDAFVRFIGFDNLRQVQGRRFLAFKPP

SEQ ID NO: 156465 - protein, 117 aa, Triticum aestivum
  Clone ID: PAT_TA_50883.pep
AGHTSSVRSNNSWSYDSLLYFHQASSSFKNNFQRATKFESTTPVRSPVAALPAGRRRRRRPQSLPPAAVMVEAKTKAGSSKNRTWWKQNLKLVLVKNYGGSKIICWIQTSNDACASS

SEQ ID NO: 156466 - protein, 93 aa, Triticum aestivum
  Clone ID: PAT_TA_50884.pep
MDATAEASSGEGACHAHGAKDDRPEKKVPLLGMFRYADRLDMLLMVVGSLGAVGNGVSEPLISVLFGDVINSFGESTTSTVLRAVTKVRLGLW

SEQ ID NO: 156467 - protein, 105 aa, Triticum aestivum
  unsure (1)..(105): unsure at all Xaa locations
  Clone ID: PAT_TA_50885.pep
PRPXRTGERTTKGRKGRRTNKAEHKRDDKAERTNXQKRAEAAADKXKGSQQXXRERXRPPPKKRXXATRRKRSPXRERAPGRNGPQGRSRPGAQEKHGRPPSXXL

SEQ ID NO: 156468 - protein, 93 aa, Triticum aestivum
  Clone ID: PAT_TA_50886.pep
DYLPYFYSRSFDLAWQFYGDNVGDDVLFGDNDPASAKPKFGSYWVKDGKVVGVFLEGGSAEENQAIARVARAQPPVADVQALKQEGIDFASKI

SEQ ID NO: 156469 - protein, 93 aa, Triticum aestivum
  Clone ID: PAT_TA_50887.pep
TFLFGRLSLQLVDRFSPITRKPHQPRKTNPTCQSNANPASIPYHLPKIAKYHHHFYSRHSRSDKNPCSHSVIRRRCAASAGQRFLQLPVLGYC

SEQ ID NO: 156470 - protein, 154 aa, Triticum aestivum
  Clone ID: PAT_TA_50888.pep
STAGLPVSRRSSGSLGSVSNGVRIRCMQVWPIEGIKKFETLYYLPPLSAEALLKQVDYLIRSKWVPCLQFSKVGFVFREHNSSPGYCCGRYWTMWKLPMFGCTGATQVLNEVEEVKKEYPGAHARVIGLGNLRQVQCVSFIAFRPPGCEESGKA

SEQ ID NO: 156471 - protein, 122 aa, Triticum aestivum
  Clone ID: PAT_TA_50889.pep
GRYWPIWNLPLFGCPAPPQVITQVGGVKKGSPYGFVPLFGFATMRQVQWVSFFPFKPPGFEESGKALTAPSRRAIFKVPFQFCQLCPCFGFSFPLYLFYLFLRICVCPCSCPPMAPKSMLVF

SEQ ID NO: 156472 - protein, 80 aa, Triticum aestivum
  Clone ID: PAT_TA_50890.pep
RYSVIKEMRICLGTLTVSGTQIQDFTTRTRMFWRMQRVILLDSFRNRSTRQKINLLVTSNTNKPKLLRRFSKFSYASILS

SEQ ID NO: 156473 - protein, 91 aa, Triticum aestivum
  Clone ID: PAT_TA_50891.pep
WVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 156474 - protein, 156 aa, Triticum aestivum
  unsure (1)..(156): unsure at all Xaa locations
  Clone ID: PAT_TA_50892.pep
KKKGXRAHHRRSKAGRDAWEGXIARWRHPRCFQSRRYXRXATTYTHAPVEKKSXMVRARSEPLKVIPERHVFFLPEYMERHXDLRIPPPPTKXFXTLKKKRFTXXTQXHPSLNPKNNQTIKIHSHFXHHPHFXWFHHHNPTPILGGGGGSGRGVDR

SEQ ID NO: 156475 - protein, 199 aa, Triticum aestivum
  Clone ID: PAT_TA_50893.pep
RFDPAFCLCCGSHFAGPVYEMKDILNGPERKGLWASSTPSPLLPTLRALVQAGICMGLYLYLSPMFALSRFSEPLYYEWGFWHRLFFQYMSGFTARWKYYFIWSVSEAAIIISGLGFTGWSDSSPPKAKWDRAINVDILGVELAGSAAQLPLKWNIQVSTWLRYYVYERLIQKGKKPGFLQLLGTQTVSAIWHGLYPGY

SEQ ID NO: 156476 - protein, 68 aa, Triticum aestivum
  Clone ID: PAT_TA_50894.pep
PQNMFLIFLSFPFFSISFFIYFYVSLISSFLLFFLLKVLYNARCLAEVPEEINQAFLSIGAYLYRADA

SEQ ID NO: 156477 - protein, 66 aa, Triticum aestivum
  Clone ID: PAT_TA_50895.pep
STAFLMRCCLKFSVLFCHPWLTLPFIYEQAFSIVSARFVMNIMLHRNCLMCSTFVVMLTSEYYVAS

SEQ ID NO: 156478 - protein, 44 aa, Triticum aestivum
  Clone ID: PAT_TA_50896.pep
FPIEEAYNSSQQFFPERKTPSRQFASTVSAKNLRHIWCNQISIT

SEQ ID NO: 156479 - protein, 88 aa, Triticum aestivum
  Clone ID: PAT_TA_50897.pep
NGSKVIYRWHQAVSNSGLRTILSLLNCAYPMMVLNYSCIGFQVLSFQEPLASYKSVYYVGTIVPILCVLLGYVIKPARPVKPKAPKAE

SEQ ID NO: 156480 - protein, 66 aa, Triticum aestivum
  Clone ID: PAT_TA_50898.pep
LPDDPLGDEKGCFYPWGGRGGLSHNFYSTFTEKEKKTAWPHLQPQSKSCTVDITPWRDWHYFLLAF

SEQ ID NO: 156481 - protein, 155 aa, Triticum aestivum
  Clone ID: PAT_TA_50899.pep
VMCYSVIAPLILPFGVAYFALGWLIAKNQVLRVYVPIYESNGRMWPHMHTRIIAALMIYQATMLGIIGLKRFYYSTILAPLLAISLIFAYTCHTRFYPAFAKTPLEVASQQLKETPNMSTIYTAYIPACLKPEKLEDVEVFEDAQSRTTSRAPSF

SEQ ID NO: 156482 - protein, 117 aa, Triticum aestivum
  unsure (1)..(117): unsure at all Xaa locations
  Clone ID: PAT_TA_50900.pep
AKNLYIFSVKGIKGRLNPLPSAWVGEMVLAPLKKGKPPPRKKVMPPVFFPQGKPWAPKEGVFFFFXNNVGGFVNPQGEIKGFWIPGPLGKECFSLWPRVPPNPKPLVLKLFSTCGAG

SEQ ID NO: 156483 - protein, 104 aa, Triticum aestivum
  Clone ID: PAT_TA_50901.pep
QPFIGPVPFINMALNHFVSLCLRASPLFFWIHCFSSGSNSTILPAAMHMSTYKLKVKVANSMQRSSGSSTRILRHVLSPGLGSTCTASSSRSRLICLPALPGIL

SEQ ID NO: 156484 - protein, 49 aa, Triticum aestivum
  Clone ID: PAT_TA_50902.pep
SVIAPSLVFVYYRCVYYVCFCTMITMGACFSRHSYDSGTSTTGRIRSVL

SEQ ID NO: 156485 - protein, 111 aa, Triticum aestivum
  unsure (1)..(111): unsure at all Xaa locations
  Clone ID: PAT_TA_50903.pep
KPVSDTFAFFGVQTAIVFYIRREMTVXCGGFLFLKKHGLVAFRTVSGRKDRCETTYFKPFSVYYFSGDGCLRDEXGYYWLTGRVDDVINAGGHPIGTSLVESVLVSHPKSA

SEQ ID NO: 156486 - protein, 96 aa, Triticum aestivum
  Clone ID: PAT_TA_50904.pep
RKAVVKLRRKCSCGTACKCRNGCRSCPCTPSLVASQPAHSTPPPQGSSHGMLMAFIERLLWLHPAHVRDHLHLLLMQLLEHRSSIMHAPTPAASII

SEQ ID NO: 156487 - protein, 169 aa, Triticum aestivum
  unsure (1)..(169): unsure at all Xaa locations
  Clone ID: PAT_TA_50905.pep
AVKVLPIRTQLPSKNPSLDTRPRRARWPTRGCSFDMTVCCPPAARIEMELYKDAVPKTVENFRALWTDXNGVGKSRKPMHYKGSAFHRVITDLMYHGGDFTMGIRTGGESIYGXKFTDKIFVHKHTKPEILFMGNAGPNTNSXQLFICTARCNWFDGQAPASSSMLLRA

SEQ ID NO: 156488 - protein, 55 aa, Triticum aestivum
  unsure (1)..(55): unsure at all Xaa locations
  Clone ID: PAT_TA_50906.pep
YGAAASHIYSFPVTCTGGEWTXVQGLPIDEXSRKKMDATVQELPQEKVLAYLCLH

SEQ ID NO: 156489 - protein, 137 aa, Triticum aestivum
  unsure (1)..(137): unsure at all Xaa locations
  Clone ID: PAT_TA_50907.pep
HRCGTXGQVWNGSVIGTAITDSNDRILYTMGGALQHKPHRRSKARRYHSLLDTEPKKATCTNKSSSKSIHLPRKYTNTDVAQNITTTIRNKLTPYPPRKKTLAQTRTPGLCANTITPYLTRRKHTPCRHTYSKILYT

SEQ ID NO: 156490 - protein, 52 aa, Triticum aestivum
  Clone ID: PAT_TA_50908.pep
ARPHQHGAMSAQISTRARSSTEAHLAGSAPPLFNRRKMHPPISALDCRIIWV

SEQ ID NO: 156491 - protein, 79 aa, Triticum aestivum
  unsure (1)..(79): unsure at all Xaa locations
  Clone ID: PAT_TA_50909.pep
GPPCQEDLEPCGGQRHDRALAMGFQPARQLGLSMSSPYHQLPSCQMHLAYEEVMRLGVRIVEVLETXRWVNREKEDKSG

SEQ ID NO: 156492 - protein, 175 aa, Triticum aestivum
  unsure (1)..(175): unsure at all Xaa locations
  Clone ID: PAT_TA_50910.pep
MAPTVMASSATSVAPFXGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 156493 - protein, 104 aa, Triticum aestivum
  unsure (1)..(104): unsure at all Xaa locations
  Clone ID: PAT_TA_50911.pep
TIHQVDVPQLVHAIPEHPQVXPGVHSPTVQAIITPHFELTTSSEIHTPGPIFDMDMKPEVSLKNEYXNILIVAKEKXIQYTVFPAIYCGXIFRYPPNEASNIAI

SEQ ID NO: 156494 - protein, 121 aa, Triticum aestivum
  Clone ID: PAT_TA_50912.pep
MSNYHDDHVEDMEDDYDMDDPAEDMVDAHHERGLRDSDSEDDEYAHSNDKIPDTSAADARKGKDIQGIPWERLAITRENYRQTRLEQYKNYENIPNSGEAAAKECKPTVKGGMYYEFRQNT

SEQ ID NO: 156495 - protein, 92 aa, Triticum aestivum
  unsure (1)..(92): unsure at all Xaa locations
  Clone ID: PAT_TA_50913.pep
RWFSIGRAATLDVNKQAEAAGYCCPFLVVKXLCHAPSARLLPSSVHXLEKRSXLLGWQRYQTSLEPPHSGWGRSLYATFRSLPNXFCPLCLV

SEQ ID NO: 156496 - protein, 190 aa, Triticum aestivum
  unsure (1)..(190): unsure at all Xaa locations
  Clone ID: PAT_TA_50914.pep
AGPPRGARGAANGALAXRQRCSNGXKGXQVHAXVWPXSRAFKXSSRTLCLXXATASCTXGPFXSSRLRRGAGVRXXKXXCXXAFXXFXARGVXXHXXPXSHQXASXXGYLXDGXGIWXPMWXXLPMXXGCTLXXHTXVXXTRXXRXGQEKGVXPXXAYXXRIHFXXSTQHXXQVPSXXSAFIXAFKXXPG

SEQ ID NO: 156497 - protein, 169 aa, Triticum aestivum
  Clone ID: PAT_TA_50915.pep
MREGMKERDRGGSPDASGPPPFRGPAYKTKLCALWRGRGGCPRPNCGFAHGEAELRRPPPRASFQPRPRPGRRDYRDNDFRVRPERRHSPYGRFSPERDIRRRSFRDKRQRASSEDRGSSHSRSPIRKSERKHSKSPDGGKTDSSVSFRSSDNEDKGKDERYLSSDEKK

SEQ ID NO: 156498 - protein, 86 aa, Triticum aestivum
  unsure (1)..(86): unsure at all Xaa locations
  Clone ID: PAT_TA_50916.pep
LTARVELSPTSFSYQRRCPSCRCPPSTYRWAFVXSCLDILSQMPGGVDGPLPPCRQRGGRCPRYSVREGHAGWGHMRPRQDVAPAV

SEQ ID NO: 156499 - protein, 96 aa, Triticum aestivum
  unsure (1)..(96): unsure at all Xaa locations
  Clone ID: PAT_TA_50917.pep
TIDDDCVSRPRHPSGEDINAVEQHIKNLLRAGTQFFFNTLHDPYRERADICPXYPLRLTEVAPTEGFNGLWLKIRDYDAHTLLLTSSRDEHYLCGS

SEQ ID NO: 156500 - protein, 148 aa, Triticum aestivum
  unsure (1)..(148): unsure at all Xaa locations
  Clone ID: PAT_TA_50918.pep
MADVEYRCFVGGLAWATDDQSLRNAFFKYGYAIDSKIITDRETGRSRCFGFPTLASDDAMLHAIEALNGQDLNXATSPATRRSPVPPMPDALSAFYGGGGGYWGHTRRGRKKLHVPLHDSTCPWLPLINMLLYAASRTLLTLAAKVFI

SEQ ID NO: 156501 - protein, 74 aa, Triticum aestivum
  Clone ID: PAT_TA_50919.pep
TSRHGLRRAGYITFAQLEPSMDAIGLFRIHAHTSQAAEWVSGGNTAVAAYGVEVTLWEERELASHTTAQMVLMH

SEQ ID NO: 156502 - protein, 119 aa, Triticum aestivum
  unsure (1)..(119): unsure at all Xaa locations
  Clone ID: PAT_TA_50920.pep
FPRSRHAMETPARRHGGSSSSSSLTVVLAPPWVYYYDGGGVPXRTDYDHHRLGTDANLPRLLAFLGLDNFEADARHMLYRANTDRDGRLCVEELLDVINSCELWLDSLGGAPVSPRPSS

SEQ ID NO: 156503 - protein, 72 aa, Triticum aestivum
  unsure (1)..(72): unsure at all Xaa locations
  Clone ID: PAT_TA_50921.pep
RHGVILSQICAFAAPSKIHWPPGFQYIRSGKVISTMLRKMASSQMDEFGYPSXLADPCVAVQLISLTTQLAC

SEQ ID NO: 156504 - protein, 69 aa, Triticum aestivum
  unsure (1)..(69): unsure at all Xaa locations
  Clone ID: PAT_TA_50922.pep
TVQVVLMCLIEEYRVGGGAPRQVASTSMXHGGMFEXLSLAGAPFFVSELKVKKVKSGGLDMLSKFGFFV

SEQ ID NO: 156505 - protein, 66 aa, Triticum aestivum
  Clone ID: PAT_TA_50923.pep
LGRNEGRVDDNIETIRKRFKVFVESSLPVIEYYDAKDKVKKIDAAKPIPEVFEDVKAIFAPYAKAT

SEQ ID NO: 156506 - protein, 64 aa, Triticum aestivum
  unsure (1)..(64): unsure at all Xaa locations
  Clone ID: PAT_TA_50924.pep
ANAGVNPNGWQIFICTVHCNWLYGKHRSRXQVVQGMIVVKNMEKVGFSSGTCFKQVINARFGQL

SEQ ID NO: 156507 - protein, 53 aa, Triticum aestivum
  unsure (1)..(53): unsure at all Xaa locations
  Clone ID: PAT_TA_50925.pep
SHWVLGTPKGSIVSMGVCSDGXIRWTGGFIDSFPETSNGSEWLIVQGVPIDKF

SEQ ID NO: 156508 - protein, 113 aa, Triticum aestivum
  unsure (1)..(113): unsure at all Xaa locations
  Clone ID: PAT_TA_50926.pep
RISTNVRYKLDQYQIYKXPITTESVIKNIQFLVPLVFMVVLKAARKNIKADVYQNAVLLGQQVLSPSSECDGKKKVLVELTTVCDALYVACKRGLHISQRQGLRSRRMCRGLL

SEQ ID NO: 156509 - protein, 83 aa, Triticum aestivum
  Clone ID: PAT_TA_50927.pep
IKGMITWPPCLAEKHTSLTHRRIHITQVLQRKHGVWRKTSCFVLKWRSCFTVYLSSASCELICSWGSTMLLRAGLHTSWLNST

SEQ ID NO: 156510 - protein, 109 aa, Triticum aestivum
  unsure (1)..(109): unsure at all Xaa locations
  Clone ID: PAT_TA_50928.pep
VKAKIQNKEGIPXDQQSFIFICKQLEDGWTLADYNIQKXSPRHLVFMLQRWSVIALEFNWLVYPGWSGRWCPTVHLNCVLVRVSLMCWFDNHRVPLLCWLGPLQAKQYH

SEQ ID NO: 156511 - protein, 87 aa, Triticum aestivum
  Clone ID: PAT_TA_50929.pep
DEGEESQEQARHSPETVVEKHLLRRGPAPYDGRFRVKQCYIIVRLSPASVHKMFIRFQRRFCCSPGADGRCRPYPEESSGWIFIPCC

SEQ ID NO: 156512 - protein, 77 aa, Triticum aestivum
  unsure (1)..(77): unsure at all Xaa locations
  Clone ID: PAT_TA_50930.pep
VKLRVRFPTGIGILCPGFELSVSCVIHPVGPIYDMHXSTKVSLKYAFENTLKVSKXMCFQFVALPAISCGFIRSPPK

SEQ ID NO: 156513 - protein, 187 aa, Triticum aestivum
  Clone ID: PAT_TA_50931.pep
QPVTCTMNIRVLMPVLGRAAQMTLALNKLEKLKPSDSTKRIRTLFSIRDCSWTRRGATAHRKIACLFRLRLHPLVGNIAGAELWCRLCYPCTERLFARHVFLAKLLPRQCDFGCYVPNPARYSVRSLDTTLATSVLNVTVSRRMLCCFLVTATMFGAVFSVAFGAPSTLVWTYRKSMVYFVRLLFIS

SEQ ID NO: 156514 - protein, 66 aa, Triticum aestivum
  Clone ID: PAT_TA_50932.pep
ARYWPMWNLPIFGCPTPPQVFNEVEGVKKESPYGFVPIIGFATMRQVQWVSFFPFKPPGCEESGKA

SEQ ID NO: 156515 - protein, 63 aa, Triticum aestivum
  Clone ID: PAT_TA_50933.pep
ATAVFCPQNGHSFLVKDLYNTDHSDRTLEPGGYHCIWPVQRLRRRQKQTFTHFKTKHLKAHVA

SEQ ID NO: 156516 - protein, 78 aa, Triticum aestivum
  Clone ID: PAT_TA_50934.pep
KTGKRQRENGDDMIPTPENYRPEDALEHVQDSKGTDRLESFTVKKLRVGDYDDEGNIVSSSNIFADRYKGDDEEVDVD

SEQ ID NO: 156517 - protein, 49 aa, Triticum aestivum
  unsure (1)..(49): unsure at all Xaa locations
  Clone ID: PAT_TA_50935.pep
KKNVQYSTKYLLTXLKHGQLFVGQSIHDHIGVVCSFCKQQGTNQASLVL

SEQ ID NO: 156518 - protein, 78 aa, Triticum aestivum
  Clone ID: PAT_TA_50936.pep
IFLTWSSHFQESVKEDPQPRSACASVQILDTQFVASLIQGQTCCSLCAVFKIRVVFRCTGTMIHALVFLALKCPWLVL

SEQ ID NO: 156519 - protein, 132 aa, Triticum aestivum
  Clone ID: PAT_TA_50937.pep
PVGPMPLPRADGHISYGGALRPGEGDAIAQYVQQGKRIPRRGEVGLSADEIQKFEDLGYVMSGSRHQRMNAIRIRKENQVYSAEDKRALAMFNYEEKSKREHKVMADLQRLVSRTIGQETGPSHDPFATTDD

SEQ ID NO: 156520 - protein, 93 aa, Triticum aestivum
  unsure (1)..(93): unsure at all Xaa locations
  Clone ID: PAT_TA_50938.pep
MAHDWMAYSDTTVXPWHGLKYTSGLPVRRRSSCSLGRVNSGSRIKCMHVMXIDGFKKNXTLSYLPXIYTEVDPKGGSTTLIRSKWVHMPRFSN

SEQ ID NO: 156521 - protein, 162 aa, Triticum aestivum
  unsure (1)..(162): unsure at all Xaa locations
  Clone ID: PAT_TA_50939.pep
MGWDDVPVDLSIFKDIDHRVYKXLLAKRHQGTHLTKTSNEXSYYGRKPYNXSNRMSTSWKHFMIFLFQRSAAMHXTKPRTHAFKLQKKXLFFRLNIIYFTRTAYTKLXMLKDLQFPTHKTKNILHFIKLMDDTKKILLIDVSNIDKNLKLNTKNLDYVNVIP

SEQ ID NO: 156522 - protein, 131 aa, Triticum aestivum
  Clone ID: PAT_TA_50940.pep
SRWRSAVQIPAARIYNLPTARMYTLICSSDSPPGGGRTAPRTVSRTALREDLRNSNGHSDSPSGGPSKLGRSHAQPSGGTHELRQKLRYLYRVAHIRCHLSGRASPSRTSSHRNPDNLRLYETIRGREREA

SEQ ID NO: 156523 - protein, 66 aa, Triticum aestivum
  Clone ID: PAT_TA_50941.pep
MMGSNNPSGAGGGMAPGMGAGSSDGRHDDEAVLTEFLSSLMDYNPMIPDELVEHYLGRSGFHCPDL

SEQ ID NO: 156524 - protein, 166 aa, Triticum aestivum
  unsure (1)..(166): unsure at all Xaa locations
  Clone ID: PAT_TA_50942.pep
AXFQPGVKAYKLTYYTPSSMITKDTDLLAAFRVSSHPGVPARRTGXAVAAESSTATWTTVXTDGLTTLDRYKGRCYHIEPXLGEDNQWICYVAYPLDLFEEGSGTNMFTSIVSNVLGYKALLSLRLEDLRMPPTYSKTFQGPPHGIQVERDKLNNXGRPLLGCTIK

SEQ ID NO: 156525 - protein, 85 aa, Triticum aestivum
  Clone ID: PAT_TA_50943.pep
AHTHLCNCFTYCAVSSKQAEALNPRWLAWNCSPSSPLYCDWLVAKMACSAVTYTNTTDDIFPYMRYSTDKGFAHPTLSLTLQQRP

SEQ ID NO: 156526 - protein, 63 aa, Triticum aestivum
  Clone ID: PAT_TA_50944.pep
WRRNSGIPGLSSSTCYEVNSYMGPRIIKLTNRGWDYGSCTDGQRSLYKPWCRELLPIVQAHPI

SEQ ID NO: 156527 - protein, 106 aa, Triticum aestivum
  Clone ID: PAT_TA_50945.pep
RTKEACNYVEQVHNASNKIQDLAGVFLDPAASMCVSNMKQAIMEIHISVVALQSSTITTSQFLEEKGMYSDDEVPEQGYSGYSDENSADDIHQDMDEDYAHYVRSP

SEQ ID NO: 156528 - protein, 77 aa, Triticum aestivum
  unsure (1)..(77): unsure at all Xaa locations
  Clone ID: PAT_TA_50946.pep
XRLSFSXMXLXKIKQFTVDLTSVETNMVFFDISDPRITSDKLCQLLERRMCLRCQEAPRASDLSFTTKFQIVTSSIL

SEQ ID NO: 156529 - protein, 71 aa, Triticum aestivum
  Clone ID: PAT_TA_50947.pep
VMLSFILEGVVPHEHARALVHGAGTLHVDVDLPVDRASECSSIVGALSLPSSSSLASWRTVNRWFTQQVAL

SEQ ID NO: 156530 - protein, 79 aa, Triticum aestivum
  Clone ID: PAT_TA_50948.pep
LKKEFLVQGPYYNSSHALTKINSMMSIVWKQLFSVLFGGDRRHKHLNDIWGDACSLLVDMIEFLLLFLPLILLYVRSRV

SEQ ID NO: 156531 - protein, 50 aa, Triticum aestivum
  Clone ID: PAT_TA_50949.pep
PYSSSIALMSVNRQTNIYAGLWMLPERSCMNLNTPFRFSEHRSSCMHIQR

SEQ ID NO: 156532 - protein, 95 aa, Triticum aestivum
  Clone ID: PAT_TA_50950.pep
IARFPASPPSGLVILMVTMTVPAITCYLFALGCKGQARAISPARCYTVLVLVHSFAGRQRRPEWMDRAVRFRPCRREGAPECYSRRTPLSGPAVP

SEQ ID NO: 156533 - protein, 48 aa, Triticum aestivum
  Clone ID: PAT_TA_50951.pep
RVSDLDCMPFSKTPRMRFPSPSAQNIMLRFSFLLLSQVKFTVYVVDTV

SEQ ID NO: 156534 - protein, 63 aa, Triticum aestivum
  Clone ID: PAT_TA_50952.pep
VIVFSLTVGEGSRLSSVLQCMSTPCGLHDACCRLVGPVQWSMSFWPFAHQHVIDSCLRRQGGS

SEQ ID NO: 156535 - protein, 146 aa, Triticum aestivum
  unsure (1)..(146): unsure at all Xaa locations
  Clone ID: PAT_TA_50953.pep
VVGKLEGDTXMTVGFVDXLRDDFIEKVRAHGXFFSQAWVSMPGVSPVASGGIHVWHMPALRXIFGGDSVAQGGGGALGHRGDQHLVHAALRLALSACAXARNEGRXLIAEGNGIIRAASKRSPVLPSDLCSMKGVXFEFEPVHALD

SEQ ID NO: 156536 - protein, 96 aa, Triticum aestivum
  Clone ID: PAT_TA_50954.pep
VVITPNHTQKRHFAAPDWPTGRLDHHACLNNIRNKTLASEPGSTTHTNCVRLHSQTRYQHVRLHFGLLTITYLNLDAPKLYIRCSMYRMGLRIPIC

SEQ ID NO: 156537 - protein, 61 aa, Triticum aestivum
  Clone ID: PAT_TA_50955.pep
NCIYHEPCQERSCLVLYPIDGSDLLNRIGQHVMALNPNHYVHSGTQAMEWQASRPVYRRYT

SEQ ID NO: 156538 - protein, 94 aa, Triticum aestivum
  Clone ID: PAT_TA_50956.pep
MALLTPGKARPAGPRGPGQLQLQQEQAHPGAHLQEGGNPSPRPPGGQFETGGTPPGGRGGQKPGGGPRKGPKGGEKFAPHGTGTPTSSGRQNQK

SEQ ID NO: 156539 - protein, 46 aa, Triticum aestivum
  Clone ID: PAT_TA_50957.pep
TVQTKVRLAAVAAQDDRRSAQTLFPFTRDKSVDPQLDGSMIEDVGH

SEQ ID NO: 156540 - protein, 127 aa, Triticum aestivum
  unsure (1)..(127): unsure at all Xaa locations
  Clone ID: PAT_TA_50958.pep
DRARGXFFSQDWVSMPGVIPVASGGIHVWHMTALPEIFEVDCVXRFGGGLLGHPWVKAPGAAHYXVTLEACVQAXTKGLDSAREGNEXIRAACKWSPELSAACQVCKAIKLEFDPVHTIDELDKTSR

SEQ ID NO: 156541 - protein, 110 aa, Triticum aestivum
  Clone ID: PAT_TA_50959.pep
IRQAAFCCFNTLVGSFRWRQHGQLGHHLWQVRGLSLFPNLPQRHLQHHSLSYLSASSHQALYVQLAHTVCQLAPLRHVLVSAFHMCSCLHLVPRVPEGIAIKKCVEITFA

SEQ ID NO: 156542 - protein, 47 aa, Triticum aestivum
  Clone ID: PAT_TA_50960.pep
KAPPPGGPKKPPPRKGPPKRSPPVKKAAPPKKAAPPKKAPPPKKAKK

SEQ ID NO: 156543 - protein, 82 aa, Triticum aestivum
  Clone ID: PAT_TA_50961.pep
IFTYFAALPLILVTAQVVTKAIINDVLILKGPCPNCGTENLSFYGTILSIESGGATNNVKCANCKTVMVYDSKTRLITLPDS

SEQ ID NO: 156544 - protein, 83 aa, Triticum aestivum
  unsure (1)..(83): unsure at all Xaa locations
  Clone ID: PAT_TA_50962.pep
NCDRRHEDECTDSREFTFTLPLGKRLREGLKTLNTLTVSXRRNIKRQAMLTKDSGRNDSENTGNGGANLQEQDTASTNFFNKT

SEQ ID NO: 156545 - protein, 95 aa, Triticum aestivum
  Clone ID: PAT_TA_50963.pep
PGWVPSSPGLLLMDPGGETGFGLPGLAGCRVFSQLNAPGGGGWSFHPPLHAAFVVCLFVPLVFGRSCFLFPPRTTFFSFFLGATNKMNPLLMLLP

SEQ ID NO: 156546 - protein, 67 aa, Triticum aestivum
  Clone ID: PAT_TA_50964.pep
RGIAEYRAQMKAKFQRKVAKSSGDSGANVKRLKEESSLKIEQVNRQPASISPDVIQMLLRHVPSVKN

SEQ ID NO: 156547 - protein, 86 aa, Triticum aestivum
  Clone ID: PAT_TA_50965.pep
VRYFVVIHSHVAPILVCTKPRINRLGQSVSRLSRLLGIMLKRKRYSSMLAKAGRHHKTWIMRKPIWRPSMTVFGLICSLIAPSTLC

SEQ ID NO: 156548 - protein, 117 aa, Triticum aestivum
  Clone ID: PAT_TA_50966.pep
PLIDEQLTSWNWTAEAYPVPSMKWFEKSRQVPMYVRRNERMADEIFIFSTKTARMLALLRLRCNSHGFLFTSVRGHSSPVKVFGLVSECMIRVWLANFAERRSSRLRRSSEDCRCLR

SEQ ID NO: 156549 - protein, 90 aa, Triticum aestivum
  Clone ID: PAT_TA_50967.pep
ICTELLYPHAGSFYTNTVQWLLLLTKYIPTGSFHFLSDKHQTPIQAAAGYNFNRRRYLSSLHLLHCLNNTITLRLLTEELPAPPQKTTPG

SEQ ID NO: 156550 - protein, 118 aa, Triticum aestivum
  unsure (1)..(118): unsure at all Xaa locations
  Clone ID: PAT_TA_50968.pep
GWDHKIQRASKHGKIVVAVLSAXSGVGRYRVKRLVYVEMSKMWPQXMFLTIDVNDKMDIQLNMGHRCEPSRYLYSKNGHQIGELGGATXPKLEKRVQALGDAQLWPRYRIRLSRPACQ

SEQ ID NO: 156551 - protein, 71 aa, Triticum aestivum
  Clone ID: PAT_TA_50969.pep
GSFHSIVHSPDDNKGTLLCYRGARTLHRGILLTCGWRRASLLIPGGCYPALGGDKIRTLGGESFGGASSRP

SEQ ID NO: 156552 - protein, 93 aa, Triticum aestivum
  Clone ID: PAT_TA_50970.pep
PVLKHTKLDRFVCHDTNIRGSGEQNSNCVGEPRTTHVPLVLSSPGAGSYLARILRRRLRSFVSSGPTETVQRMIGSTRHLQTRACRQTNFTYS

SEQ ID NO: 156553 - protein, 109 aa, Triticum aestivum
  unsure (1)..(109): unsure at all Xaa locations
  Clone ID: PAT_TA_50971.pep
SAPKWVSLPTSYSKVWLMSSRERQLALAGYYDGRILDKCGSSPYVQGSTRQPQQSARTKVERGQRKEVXLMHYVACHRTSHNTATSVQVQSGYHRPSRPYQRSRGKXRA

SEQ ID NO: 156554 - protein, 107 aa, Triticum aestivum
  Clone ID: PAT_TA_50972.pep
MEPSSQPQPATGDVVAGGSQVYPASAYPPAATIAVAPGIIPAASQPASPFPANPAQLTAQNQLIYEQAQQFHQQLQQQQQRQLQQFWAERLSEIDQATDFKNHTLPL

SEQ ID NO: 156555 - protein, 160 aa, Triticum aestivum
  unsure (1)..(160): unsure at all Xaa locations
  Clone ID: PAT_TA_50973.pep
SYSHLGFRLVALVLREEPKNKGKGGKNRKRGKXEADDDKRELVFKEDGQEYAQVTRMLGNGRCEAICVDGTRRLCHIRGKMHKKVWIAAGDIVLVGLRDYQDDKADVILKYMNDEARLLKAYGELPDTLRLNEGVDVDGPEEGEEGSDYIQFEDEDIDKI

SEQ ID NO: 156556 - protein, 191 aa, Triticum aestivum
  unsure (1)..(191): unsure at all Xaa locations
  Clone ID: PAT_TA_50974.pep
XRAAARDLXTRLVLDRERRPFFFFFFFRLLKKSHWMHVVLKTFSRIRISNVSVSYPGAADKSSRPEWEQPHMYGRINQAIKAPMETDSKRARTFLDHPFAKSINLEVHKLVRQAPPTTCSSPVLEGLEHELVMPMPRTFLGHLLAQLTTRVAMDPAESSDSTYVPDSSWGKLCSDYILGQREYYLAHQIFR

SEQ ID NO: 156557 - protein, 90 aa, Triticum aestivum
  Clone ID: PAT_TA_50975.pep
MAGPAKASWMVAMSVGAVEALKDQAGLCRWNYALKSIHRAAKAKANVRAGGSQSTKQLPASTAALVERRRAEKAEEALRTVMYLSCWGPN

SEQ ID NO: 156558 - protein, 203 aa, Triticum aestivum
  Clone ID: PAT_TA_50976.pep
PFIDGAITRGFSPSSTAPSPAASPLHRRRHRPRPLPFIDGAISSEYELEEHVYVGDAARPARHRSRLPWFLAERHEEEERMVKEKGNEKGKGAGKENGKPKGAGKENGKAKAKEKSLNYLIRQDSALPPLVPRKKSKPKVQIKKAKDFPNAPMGELIYDYRSSLKPVMVEALVCGASYIKGAHVDLNLVPRDENEEDDVETTK

SEQ ID NO: 156559 - protein, 198 aa, Triticum aestivum
  unsure (1)..(198): unsure at all Xaa locations
  Clone ID: PAT_TA_50977.pep
GFYVXEEEGEEVGTEELRELEEALSDASSIGAASSDSSSIGEDSXSEKEEGEEEEVESEAKAPVDEVLAMGLGTLESLEDALPSKRGLSNFYAGKSKSFTSLAEAAAKAAAKEIAKPENPFNKRRRVLAAWSRRRASCSSLVTTYLPPLLSLDHTVVEGDEEEEEERSDDGDDEDNGSGNGRREKAPASPRFPPRSLH

SEQ ID NO: 156560 - protein, 123 aa, Triticum aestivum
  Clone ID: PAT_TA_50978.pep
CEIFILELTLRSWMHTEENKRRTLQKNDIAAAITRTDVYDFLVDIIPRDEMREEGVGLPRAGQPPLLGAPADASYPYYYPQQVPGAVMGYGGQQGHLPYVWQDPQEQQQHQGHPGEQQQSESG

SEQ ID NO: 156561 - protein, 63 aa, Triticum aestivum
  Clone ID: PAT_TA_50979.pep
PGPTYSLKSTQICCTTAASSNPPRHNPRPQPGATKKQPKRGPPANPIEGHKKTTDLGPQKQKQ

SEQ ID NO: 156562 - protein, 135 aa, Triticum aestivum
  Clone ID: PAT_TA_50980.pep
AAVVPSVAPAPVDGGPAPAGLCPGRSPGRRWWGSPGGFRGSNCPGGPPWRLPRGSGAFDPPGAPPGGGGGRKEPGLFFQGGKRMRFFFFFAKNPKPFFGRRGGVLCLDDPALARVKFGYLFGPETGSFFLKGTGP

SEQ ID NO: 156563 - protein, 148 aa, Triticum aestivum
  Clone ID: PAT_TA_50981.pep
RGGSFCSPEGGFSHPICPSFLFFWGRGGGFCPPEKGLPHPVGPNFLVFWKKGGIFCPGEKSPAHPIFPSFLFFLKFLRGVFFCGPPSEGFSFSCGEFRPGLVDPVFTCLLPCWFLMIYRGGSPPLGSCFGVLFFLDFTPPPFFLGGGL

SEQ ID NO: 156564 - protein, 76 aa, Triticum aestivum
  Clone ID: PAT_TA_50982.pep
FFFFFFFFFFFFFFFFFFFWPKKDPRLSTGSKRPRGGRFHNPQGLRGRSLQLKKGAPHPKRGGPGPRPHPLGPKPK

SEQ ID NO: 156565 - protein, 77 aa, Triticum aestivum
  unsure (1)..(77): unsure at all Xaa locations
  Clone ID: PAT_TA_50983.pep
IAGPTKGARETPKGPSRGSPFKKRVGLAGFQXRWGNLFCGAPRFWDKHEGKFDYRPRAMGALPKANPVVKAEKLPKI

SEQ ID NO: 156566 - protein, 92 aa, Triticum aestivum
  Clone ID: PAT_TA_50984.pep
QHRPKHAAGTKGPPTAGAWARVEPSHHHEGISRWLTRELVGGNGPGRPFSIWDLLSAEMPADKDLSGPFRFHVIRVFSLERFGAQILRPGKR

SEQ ID NO: 156567 - protein, 100 aa, Triticum aestivum
  Clone ID: PAT_TA_50985.pep
NDDGQDGKPDEQGVQSVPRPRNAQYYDEGLEKTRQTLGDKISQLNLAIDKAAARLKRVTGSVEKEAVKDETEIEISTLDDNGVLEGNSSEQGFVQGESAT

SEQ ID NO: 156568 - protein, 125 aa, Triticum aestivum
  Clone ID: PAT_TA_50986.pep
KRRMGGKGFFDCLPREKKKKTFEKSQPRGDQKQKKPNRGGEKSFLATKTPLNKKKIFQWVKKKKNKGKKTDTPTERMFYLKKKITNKKNDQDLEGEKNHGGKSPAERRGGPKGRDDNWAERPYNR

SEQ ID NO: 156569 - protein, 50 aa, Triticum aestivum
  Clone ID: PAT_TA_50987.pep
PINQKCKSKASREPRSSLLRVGSKYVWLPLKCNADYRCRVTCYRAPLAMN

SEQ ID NO: 156570 - protein, 102 aa, Triticum aestivum
  Clone ID: PAT_TA_50988.pep
FPDYFQPKTKKIFWKVLTGGKKKKKPRCTHLLGQKAYQLVIGEKRTPLKRNFGLFAWGGVDLLKKGKKPFLKHLLKYSTSLGSFKKKIPQSFGFKRVDQNFG

SEQ ID NO: 156571 - protein, 71 aa, Triticum aestivum
  Clone ID: PAT_TA_50989.pep
RVQGMPCRGRRATLTDAMLDPLSPIYSVRFSFSLYEPRYTFYLLLAFRKWNGISSLLLLPKKILTADVHFD

SEQ ID NO: 156572 - protein, 129 aa, Triticum aestivum
  Clone ID: PAT_TA_50990.pep
RHCTCIASASRQKSVTTFTYFLPCFLVSHPSLFIILHAYYSNFVHINTSNMFIAQTQGGGRQAKGSTIFLVALSLQRPLPPTSSLTHASLEESPWRHLWRSPHVYGCMLYEIFGRSAIVRVFRRASFDT

SEQ ID NO: 156573 - protein, 206 aa, Triticum aestivum
  unsure (1)..(206): unsure at all Xaa locations
  Clone ID: PAT_TA_50991.pep
PSTHAVRTHAVRNXSEVTISLEENESVVLTPHQGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVXETLRGLYPVETISTVGRICAEAEKVFNQDLYFKRTVKYVGEPMTHLESIASSAVRAAIK

SEQ ID NO: 156574 - protein, 76 aa, Triticum aestivum
  Clone ID: PAT_TA_50992.pep
DRNTFQNIRLSCEFAVFCDNYSSSLQCIHSSCVMFVFNVLVGHPLYDAVPGYSFNNGGYLVRAQNIRCNYNFVFSI

SEQ ID NO: 156575 - protein, 156 aa, Triticum aestivum
  unsure (1)..(156): unsure at all Xaa locations
  Clone ID: PAT_TA_50993.pep
MDPLADVAGTSGENEGSKKVKKKNKKKGNLCGFKTRFNSKRLGELGKQISPEKQRIIREGPFEDLLDIRSFKVPHELIEFVVMNTNHMLSEFKHKNKXINFSKLMVKRNFNVTSGDRLVKLLNKSDEHDLCTIYKEGNRAPITHVVKLLITYSDED

SEQ ID NO: 156576 - protein, 198 aa, Triticum aestivum
  Clone ID: PAT_TA_50994.pep
NSYSRSCRDWKNSCLVSDITNGALESIGTFCKNLHDFRLVLLDRQETITDLPLDNGARALLRGCTKLRRFALYLRPGGLSDVGLGYIGQHSGTIQYMLLGNVGQTDGGLISFAAGCRNLRKLELRSCCFSERALALAIRQMPSLRYVWVQGYRASQTGRDLMLMARPFWNIEFTPPSTETAGRLMEDGEPCVDRQAQV

SEQ ID NO: 156577 - protein, 75 aa, Triticum aestivum
  Clone ID: PAT_TA_50995.pep
MSGSAAAGGEDHGAGQLYGNHRHAADGGDVLGNNVFFQSHSACAGGDDGGVIPSTYSSITDYLQGLLDPAELARH

SEQ ID NO: 156578 - protein, 150 aa, Triticum aestivum
  unsure (1)..(150): unsure at all Xaa locations
  Clone ID: PAT_TA_50996.pep
VEVLVVLCIAVLLVVREDDASPSTPRFASTKSLRSSTTSSWYLRWRSAMYSLSAASDAMRSLSSRSSVPIAPVTTPRGGGGCKGPSTNAKFRKGSGAVQPELPPIVLLCGEHDGVKRAHTMLXVGLLIHDFGHPRPQRLLSDAKVXXLRR

SEQ ID NO: 156579 - protein, 93 aa, Triticum aestivum
  Clone ID: PAT_TA_50997.pep
MLCKIALFGYQRSIFLLYKVQRRSCPKFKKKKKKKKKKKKKKKKKKKKKKKKKKKKKKKKKKKKKKKKKKKKKKKKKKKKKKKKKILKKKKKK

SEQ ID NO: 156580 - protein, 115 aa, Triticum aestivum
  Clone ID: PAT_TA_50998.pep
KVCHDGHRHGYHYRHHARPPPPRPPPPLKPAPPRPPPSKPPPPKLPLCQIGVTGVEEAGVEPPVPGLSLPSATHSSNMGMCGGSPAGGGGGPICGGSVRLLQDANIACMLVKQAN

SEQ ID NO: 156581 - protein, 69 aa, Triticum aestivum
  Clone ID: PAT_TA_50999.pep
KKKTRRKREENKKKKNKKKKGMRGQRGPKKNKKKKKKRKKQKGKKITEEKKNKKKAFWQKSGKRVKSNM

SEQ ID NO: 156582 - protein, 96 aa, Triticum aestivum
  Clone ID: PAT_TA_51000.pep
DQGRPPPPKKLVVNAPPAPGGGPSPIRAPIFPDPPKKFPAAVFPKVDVEERKPLAEQFSVGAMPPPLFRKEGDAKARVAGATKEEPPPKVGLPPAP

SEQ ID NO: 156583 - protein, 85 aa, Triticum aestivum
  unsure (1)..(85): unsure at all Xaa locations
  Clone ID: PAT_TA_51001.pep
GKEGEERSPNQEGRGXAARRNXSAEEEQGRQQGVGVSRHHHQGGRNPPDLXXQGPLKECTFLLLXSMLILNLQASMPLEMVRVLS

SEQ ID NO: 156584 - protein, 137 aa, Triticum aestivum
  Clone ID: PAT_TA_51002.pep
VYGGRSHGGYFVYSPGFSPPVCWCAPFVCTSRPIRLHGTTILPSRIDHGATDERTKLEQLYVGLCITQMKPTAIRRWTHLSRWSLKRRESSMILEKSAEHILPQGIPAGRLVYMYLLTNLDNHLLERYFNQFRYILW

SEQ ID NO: 156585 - protein, 79 aa, Triticum aestivum
  Clone ID: PAT_TA_51003.pep
KRAGKGREPKTITGEKKTGSPGAYCPMATPTHKPGPFVPMKTPNFCIGSGRKKSNTEQNINPRPQTNALPKGSCAAYTP

SEQ ID NO: 156586 - protein, 91 aa, Triticum aestivum
  unsure (1)..(91): unsure at all Xaa locations
  Clone ID: PAT_TA_51004.pep
ADDRGEQPKKGKEVDEARLAGNKEMGGDLSTXGASTYFSIMRNLTXTEHAAVLPVNPHVKAWWQALLARPSVKKVIAGMPTDLRFGSGRKP

SEQ ID NO: 156587 - protein, 79 aa, Triticum aestivum
  unsure (1)..(79): unsure at all Xaa locations
  Clone ID: PAT_TA_51005.pep
XPXXXRPARXSXNLAQXTPPREHRQFVIAGAGVAGLAVALGLHRARAPVRGAGVVAGAPDFRVRYRRMANAFRALVPFV

SEQ ID NO: 156588 - protein, 122 aa, Triticum aestivum
  Clone ID: PAT_TA_51006.pep
RSYYRCTAAQCGVKKLVERSQQDPSTVVTTYEGRHAHPSPIATHRGSRMLMATGVDTVYSLDVLQHQHHGFFPAGTDVYGRMYALPSTDASVVAHRSSEYGGMQVHAGVLPDAVMSYEHVHR

SEQ ID NO: 156589 - protein, 44 aa, Triticum aestivum
  Clone ID: PAT_TA_51007.pep
LCTWAERGTSANRHCMHKIYSCLPVIFALYTMRCQNDSPYVGVR

SEQ ID NO: 156590 - protein, 97 aa, Triticum aestivum
  Clone ID: PAT_TA_51008.pep
PARQATIDGPHKQGNPPNYECMVGELSPALVLFGTWCVPQYWSPTMHQGFILVLQGRVYRSPVCSDWVVKTAVATQGSCVYPYFRRFQRNALCLAYK

SEQ ID NO: 156591 - protein, 65 aa, Triticum aestivum
  unsure (1)..(65): unsure at all Xaa locations
  Clone ID: PAT_TA_51009.pep
RXVLYASFPLSSVSNQMPRLASGLYLPSLVPTCPRVSPSSSCSXELFIFQAAVGLGALFAVSSRP

SEQ ID NO: 156592 - protein, 159 aa, Triticum aestivum
  Clone ID: PAT_TA_51010.pep
VWLHFAEIDNGITAEEQRVFDVLINGDTAFKDIDIIRMTGERFTALVLNKTVAVSGTTLKITLQPVEGTHAIVSAIEVFDIIPAEMKTLTQEVTALRTLKGSLGLPLRFGWNGDPCIPQQHPWSGVDCQFDNTKRQWVIDGLYALYLIPLYITSICSLL

SEQ ID NO: 156593 - protein, 58 aa, Triticum aestivum
  Clone ID: PAT_TA_51011.pep
GIMESVRRASSAWTAITVLPLWLFSCTLPLIRYRVFIVRCNASTRQYIYGLCLKKKKR

SEQ ID NO: 156594 - protein, 85 aa, Triticum aestivum
  unsure (1)..(85): unsure at all Xaa locations
  Clone ID: PAT_TA_51012.pep
LKNLLEVXRANLPTTRSLAGDLVSFAALTLFSFMPILKATEPSVWAQGEPHXKARWEALLAKPLVKKVKKGTPPXFFGFGSGKIP

SEQ ID NO: 156595 - protein, 131 aa, Triticum aestivum
  unsure (1)..(131): unsure at all Xaa locations
  Clone ID: PAT_TA_51013.pep
PARGPPPPPPGNXTPPPAPGARPLGGVPPAPPLWGFCPNCVLAVGPLPPSEQEGGGVPGREAPPPGPRLPPGAFFLPGHFFFPRPLVRPAPFLPPGPFFPPVRFLNPPLFLGGPAQHINNSQENAFEFGPI

SEQ ID NO: 156596 - protein, 146 aa, Triticum aestivum
  unsure (1)..(146): unsure at all Xaa locations
  Clone ID: PAT_TA_51014.pep
CNSFIYLLRVDQQSTDGENNRAFPNKPRPKSLAPERRVDINLGSSRSLAVLSSRWSCCRCRSPSLFPSSRGRWCNGIPSIGRSRWSSSPRSTTGGLGGNSWSCRSWPFEHRPGMPPVAARVLCNWSGCRSTQSFCCRELLAFXGFL

SEQ ID NO: 156597 - protein, 88 aa, Triticum aestivum
  unsure (1)..(88): unsure at all Xaa locations
  Clone ID: PAT_TA_51015.pep
CASILSMAARNILTNGRRGPPSDSYNGLHALVRKVQGHRITTRKAINVGVRQAQRMISFLSTMHLSPRTARSITSCCPXPGQPVGLSR

SEQ ID NO: 156598 - protein, 185 aa, Triticum aestivum
  Clone ID: PAT_TA_51016.pep
IRNCLEKQSCNAYLSQSTRGMRSLLRKQGVCFSMPLCKAEMEQATEDDLIEFSKIRTLNLGQTLHIDALSEVDNTTQSLLSFTGNKSVHGLYDVLLNYKFFLNSLSAADVPVLYSPVPFQNGSLHSPEVICREMRKADSGLAPSSVFDDAGEPGSEVSDPPLAAGSMCYSMEIKDAALPPWVVSG

SEQ ID NO: 156599 - protein, 72 aa, Triticum aestivum
  Clone ID: PAT_TA_51017.pep
PLNPNDVVGFLLLLGPARGGGGMGEVGDLTETSANAGEEQACAPPGATVVLPSELDDGPCWQDHYLQIRLLI

SEQ ID NO: 156600 - protein, 123 aa, Triticum aestivum
  Clone ID: PAT_TA_51018.pep
CIFGFTSNLSSSHTRAVYGWASMVVRRLRKQGTRRLRKQGRLRLRKQGLRRLRKQGHMSVKEAPLPPLHAMWNPSAVTFPFLTFRPSILMSAIVISHRPLHLASHYSLASCFPCNRVNARSTP

SEQ ID NO: 156601 - protein, 73 aa, Triticum aestivum
  unsure (1)..(73): unsure at all Xaa locations
  Clone ID: PAT_TA_51019.pep
SEKICTIPFPSILSLTSCPRSGLQLCLTLVQIDSDNADLLPQILEPTSCVESHLPIALDXFQGSKIASMAMQL

SEQ ID NO: 156602 - protein, 160 aa, Triticum aestivum
  Clone ID: PAT_TA_51020.pep
MAKPRCQETCGNLTIPYPFGIGQGCFYSEGFDVSCENNRVFMHNSSSQMEIYNISLAGGQTRVSTLIASKCFYSNSNNTDGWVSSNTADFFKISTKANKLTAVGCNTLAFLGGYNEHSVGAGCFSMCADKQSVDHSGQCSGMGCCQTSMHQTSVPPIYHR

SEQ ID NO: 156603 - protein, 95 aa, Triticum aestivum
  Clone ID: PAT_TA_51021.pep
MASGSGKATASSWAAAMSVGAGTVEAITERHAGLCRWNHQALPCVFQQRAGTSAAGNGACGKGKAATTAGGATARQEQEEELRTVMYLSNWGPNN

SEQ ID NO: 156604 - protein, 71 aa, Triticum aestivum
  Clone ID: PAT_TA_51022.pep
KNSSHCSMGENSCNPQITVVPIHQLTQLPPRSLFSFFFRFSTSRISYLWSGATKISIEEICRSTEYIPYAV

SEQ ID NO: 156605 - protein, 120 aa, Triticum aestivum
  unsure (1)..(120): unsure at all Xaa locations
  Clone ID: PAT_TA_51023.pep
LLLGQVYRLITSQEXTKAVQTRKQERMRGCDEAIEQEWPRLHWRRQPPRPRGDNAATAAANGEQRQPAEHQERKRLEKDRHHRSMAAARGRGRHWRPALQSITESSSSGHADCEDILLSK

SEQ ID NO: 156606 - protein, 78 aa, Triticum aestivum
  unsure (1)..(78): unsure at all Xaa locations
  Clone ID: PAT_TA_51024.pep
MMSSCGGNCSCSTNCKYTNRCGGCYMHPEAKAAXGATLLKCITDTHNGSCGIMKMAXAHNGTCASCTXCKCRTSCDYS

SEQ ID NO: 156607 - protein, 137 aa, Triticum aestivum
  Clone ID: PAT_TA_51025.pep
CLITFLCIRKKKKKKKKKKKKKKKKKKKKKKKKKKKKKKKKKKKKKKKKKKKGGAPFKKPNFTTRGLKVKIFFMGPPNSIHRPGVKKRGVMGKNPGLPKLIGFEKNPLFTSGGIRKKPPPIALPKNWPLLIGKEHPP

SEQ ID NO: 156608 - protein, 151 aa, Triticum aestivum
  Clone ID: PAT_TA_51026.pep
TMKWADGPHRHGWHDLLHSLAAVSYCYPHARDPCSHANGDYHSAHGTPSADALCLKMQLYMTGIGHYTILYPLQGILSSCTRCPYLTTLNGPRRKLESNGTMGLALCGLRTEILWEELGLEICYLEVHKPRPHVLQLLHDQPCCWVPTTAH

SEQ ID NO: 156609 - protein, 109 aa, Triticum aestivum
  unsure (1)..(109): unsure at all Xaa locations
  Clone ID: PAT_TA_51027.pep
FLVSRLLVQLGRGIREDRTFLFISVRSCFHLASRSGTCFPCVGLVGAAPPLLRAPLVLPLRVIAXSACGASVSASGVSFRVICLASLLGFPTPSGPGRVLLFSRGGLWG

SEQ ID NO: 156610 - protein, 91 aa, Triticum aestivum
  unsure (1)..(91): unsure at all Xaa locations
  Clone ID: PAT_TA_51028.pep
EQPAFYKKQFIFHMKRYIKNLPAKLXGDALNVFKKNVEFPPKFFLXKLKALQFFVGESMHYYGGVVFAYSKEGAADPTFLYFAHGLKKVKC

SEQ ID NO: 156611 - protein, 150 aa, Triticum aestivum
  Clone ID: PAT_TA_51029.pep
HVQKFRHVNNDTVLRYRYPTLPTAQKLSSWNLDIPPPPTSLSFHPSRFYFYSRSTSWRGVEEPSASSAHTGTPKNGGSVQAQAHAPPFPSPEAPAGGSSRGRAREVLAAFVAQSPEHRRAQREDQDSAGDAQGLADAFRHCRRFRQAVRA

SEQ ID NO: 156612 - protein, 91 aa, Triticum aestivum
  unsure (1)..(91): unsure at all Xaa locations
  Clone ID: PAT_TA_51030.pep
AGGRERTRGRQVAAATPGGRRKRNEERAANPRDEANVGGRRTKAHRPETVMGNPQVMVAQKHCWEQGRTXVRWERIGREELDYDLELFIKX

SEQ ID NO: 156613 - protein, 129 aa, Triticum aestivum
  Clone ID: PAT_TA_51031.pep
FSLDIKTFQLKRVCSSKTWIPNPLAYSNFPPSILASPTIASGTQEGEKEMLEQGAKTLQAEEQGAKTGAPVMVLMLEVTLACRGSEMALIEFVLQLRQLTTCWSVIGGSVWSIIIDLEFTFIPCAFDLT

SEQ ID NO: 156614 - protein, 109 aa, Triticum aestivum
  Clone ID: PAT_TA_51032.pep
SRSRTSAGRRRGDRQFVIAGAGVAGLAVALGLHRKGVRCVVLESSPVLRTSGFAIAAWTNAFRALDALGVGDTIRRKHLQIKGACVMSSTTGEVAREIDLRVLGKWGPH

SEQ ID NO: 156615 - protein, 92 aa, Triticum aestivum
  Clone ID: PAT_TA_51033.pep
GYNRWDASTPFYNYSKGRSLAFELNETKTYYFICSFGYCPGGMRLAIKSQKLPPPSPPPSAQHHRSAALAGPRAGVALYAAVAVLAALLRAV

SEQ ID NO: 156616 - protein, 119 aa, Triticum aestivum
  Clone ID: PAT_TA_51034.pep
SYYNSCRPCRATSAASLSFSLTWRSDQSTNSYCVRDLNTLSGYGWRYGTEPVVGRGLLVYFKSHHPSPVCMRHASAALGGASCGLTTVEPTVAALDALPPPSLAPGASGSPRPSPAPAA

SEQ ID NO: 156617 - protein, 149 aa, Triticum aestivum
  Clone ID: PAT_TA_51035.pep
TVKVSAYFDVAAGSLLVLSTPSSYSLTRILAIPPLPISDSVRPPALNFLIACLPPSAPLVGSTCGFGICAGPCSRPLAVRLEDRRLMAVKPLNLRAGSFGLAVYNCPPPHASCVCAPFVPRRPRRGASRQAVLWCGYTGWPFFAGSKWR

SEQ ID NO: 156618 - protein, 54 aa, Triticum aestivum
  Clone ID: PAT_TA_51036.pep
LENTLMSICKGPLDAEVHISVGFFHTLKERRSTVELTAKLSELGEVITRGPTNS

SEQ ID NO: 156619 - protein, 197 aa, Triticum aestivum
  unsure (1)..(197): unsure at all Xaa locations
  Clone ID: PAT_TA_51037.pep
NCVTYSDGNIIGDDGDGTEPICAICDEGGELLSCKGRCKRAFHPTIEAGXKSKCVTLGYTAVQVKEMNKFICENCRYEQHQCFKCGELDSSHEPNAKVFQCCKLFCGHFYHPKCAAELLQSHSNGACELENKIAAGMPFPCPVHWCSRPDCKIMEEGTERAMWLAGCRRCPRSYHLDCLPREICFKYGNGRIRAWFL

SEQ ID NO: 156620 - protein, 41 aa, Triticum aestivum
  Clone ID: PAT_TA_51038.pep
NDSAAKRKDTNPSLRDRHVLERRIVHHHDTRDGTKRTLVDR

SEQ ID NO: 156621 - protein, 209 aa, Triticum aestivum
  unsure (1)..(209): unsure at all Xaa locations
  Clone ID: PAT_TA_51039.pep
RFDPAFGTQXPSKHTSTWPVRTAARRTWANPIDSGRLPAPCADLGETSHRSAPGETEVEPSLTGPHRSAPKQSKNQAKNLTCSHRRAQGPDLRAGSGLPELPQAPTGWTAPLLQELGVHTLARGNHQHPPAPPLPPLQSRRHRPSRSGRRTAQNQIGLGAPHRRVAPNSAWLAPPLQRATHRAPSRAAASPRAVASARAPAPPWPRPAP

SEQ ID NO: 156622 - protein, 208 aa, Triticum aestivum
  unsure (1)..(208): unsure at all Xaa locations
  Clone ID: PAT_TA_51040.pep
SLHIDLKDKWRNLSFSASGLGSRDKQRVPRPKAPSSSPSPSPQLLLLPATNNVAEASPPEDCEKSPQDDKTPSPKLYSSMILEALGELKEPNGSEVTTICNFIEQRHEVQPNFRRLLCAKLRRLIGVNKVEKIDKSYKLTDSYAKRALAPMKDPSLKKKDSAKSSKAAKGQGLFTAASPALXAAEAAATKVADAEAKSHLANEHMMEV

SEQ ID NO: 156623 - protein, 162 aa, Triticum aestivum
  unsure (1)..(162): unsure at all Xaa locations
  Clone ID: PAT_TA_51041.pep
RIPPPTTAAWLLLPRRRRTLQRPEVMGVFTLRCRECGAEWSAKQHKGELEACAATPXDLQCQLVSADCAEDKXAAFQTSLTMVSPNSAILQVVIAGASGAPIAGGAGRWLRRLLAVHDDLQRLKQKKEDEKEDSEDDLGFSLWDKSLFTLLLARNDIGLLPQ

SEQ ID NO: 156624 - protein, 74 aa, Triticum aestivum
  Clone ID: PAT_TA_51042.pep
LKPGPVNFILGGPKKKTFIFRCPRYVKFGSFKRAPPLFFFFFFFFFFLIFFFFFFFFFFFFFFFFFFFFFFFFF

SEQ ID NO: 156625 - protein, 115 aa, Triticum aestivum
  Clone ID: PAT_TA_51043.pep
VAAVSAGSSQHPTPQGYSLITNHMYLSSFSPPDHDTVYGLPEDGLDVEQLHLDNKLHSTWPLRVSSSLHLRAPGQDKVGPPLNQFTPQLSLLSSSPFCAQDNKLVPLLAYKLMSL

SEQ ID NO: 156626 - protein, 105 aa, Triticum aestivum
  unsure (1)..(105): unsure at all Xaa locations
  Clone ID: PAT_TA_51044.pep
IHHCNEWVKFTKFWLRAKLVCRANAFCCVLLLYRSLPLRLAALAAESTLAEHACMRKHDLGPCEDLLASVVGXTCFNELLPSASYAAEGLLPRLWCLGCLACLSA

SEQ ID NO: 156627 - protein, 137 aa, Triticum aestivum
  Clone ID: PAT_TA_51045.pep
IALPSLLTPVNFLGSWGGFEPFFLHLIRGGSGVPNGFFPVAFPAPPLSYLLVGSWEGASKFSGVPGTFFVPLAAFPILNPCGWARRVSLPFAIALGFFVSILLRFSFSSLSFVGSPNACDWPPHLGDAVAHLSRVVP

SEQ ID NO: 156628 - protein, 69 aa, Triticum aestivum
  Clone ID: PAT_TA_51046.pep
WWRQTYSRRSSCWWPKIVAAGAPAAVEGQVMGQVEESWGRSSLVLPPEQGWELIRKAPFKRICGGQLTF

SEQ ID NO: 156629 - protein, 49 aa, Triticum aestivum
  Clone ID: PAT_TA_51047.pep
GGGVLILLGPMVVIYMLTGKLPAPPWGQSQNKYPSVLFEAIEMNTSRDL

SEQ ID NO: 156630 - protein, 72 aa, Triticum aestivum
  Clone ID: PAT_TA_51048.pep
STTRPRRTQTCIGWSVPILHPGPTRSHDYVPKGESLPMGPQLTNVKSNSVLGTGCFDPGPIPHTARAETTCG

SEQ ID NO: 156631 - protein, 115 aa, Triticum aestivum
  unsure (1)..(115): unsure at all Xaa locations
  Clone ID: PAT_TA_51049.pep
MVSHNSAIFQVVIGGPSGGPIGGGAGGGRPPAAGGAAAGPPKPEXNKQQDKQESEDPLGFPSPIRSSFPCCSPEITLPPPRSNFVAMPTGFVTQPSLIVKECMCPFCSGEDLVMF

SEQ ID NO: 156632 - protein, 133 aa, Triticum aestivum
  Clone ID: PAT_TA_51050.pep
RTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACISSRPGQCGRADGYILEGKELEFYMRKLQKKKGKGATA

SEQ ID NO: 156633 - protein, 76 aa, Triticum aestivum
  Clone ID: PAT_TA_51051.pep
GPPRPFWGGPQGGDPGPPKGVPNRCFTNKGFPPPTGGGLQPVPFLKPPFSPALPWPFPLRSFSPPIPSFKLLKDST

SEQ ID NO: 156634 - protein, 85 aa, Triticum aestivum
  Clone ID: PAT_TA_51052.pep
LLKLIKPYTRIRIPFISQELNVPEKDVEQLLVSLILDNRVQGHIDQVNKLLECGDRSKGMRKYQAIDKWNTQLKSIYQTVSNRVG

SEQ ID NO: 156635 - protein, 104 aa, Triticum aestivum
  Clone ID: PAT_TA_51053.pep
YLGFARLPLWLQLLRGSSGGSIQELSVSIGQHTKPLVCFPEQWGWCLQLQRVRDGSFLCCRALPQLVLVKKGAVMNMMLMLMLMMLLLSSRSWAHVLDWILSPD

SEQ ID NO: 156636 - protein, 201 aa, Triticum aestivum
  Clone ID: PAT_TA_51054.pep
RQVREEEESGGEEVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHA

SEQ ID NO: 156637 - protein, 199 aa, Triticum aestivum
  unsure (1)..(199): unsure at all Xaa locations
  Clone ID: PAT_TA_51055.pep
PXGAPAXVMSFDTFNPXVRALRRMTLEPDGNLRAYYWDGSRWVLDYTTITDSCELPTTCGAYSVCVPPSGRCACLANATDGPGCAAPSVGSGLCGTTGGEVGGLYSEVRGHGVEPANKELLGFEHAASAGDCEALCARNCSCWGAVYSNGTGYCYLIDYPAQLMVAADEKKLGYFKVRSVEEAAGRGGRATGVKAALLA

SEQ ID NO: 156638 - protein, 201 aa, Triticum aestivum
  unsure (1)..(201): unsure at all Xaa locations
  Clone ID: PAT_TA_51056.pep
DGLRGFYRGFGASLAGTVPARALXMAALEATKSSVGXASAAAGVSAAVAAQVVWTPVDVISQRLMVQTSAACRYAGGADAFRKILAADGVRGLYRGFGLSIITYAPSNAVWWASYAMAQRFAWRVVGADRSESYPALMAVQGASAAVXGGAAALVTMPLDTVKTRLQVMETDAAVARPTLGSTVRXLLKEGGWGPCYRGLG

SEQ ID NO: 156639 - protein, 86 aa, Triticum aestivum
  Clone ID: PAT_TA_51057.pep
MPTMLILQQMCHRRGLITLCVCSVQPLHHAARGEHMDTVKLLLEAGACPKKENAYGQAAAEMADQDTEVRALLTAKQVEASIHMAD

SEQ ID NO: 156640 - protein, 127 aa, Triticum aestivum
  Clone ID: PAT_TA_51058.pep
RNRILGCKPAGLGRRTLASFSLRLPVRRAPSASPEAQLLVLLLILVRIPLAPVPPPDPAEERQVLPLLLLLLLTHSGSVHAGVKVLLGLMAAALVAGRSASNSSSCFCTSLSPWAPSASRATPKTSA

SEQ ID NO: 156641 - protein, 197 aa, Triticum aestivum
  Clone ID: PAT_TA_51059.pep
MSSSPTPAPDAGAAAMAVDDSSETDQLDSMSTEDIVRATRLLDNEVRVLKDELQRNNLELENVKDKIKENQEKIKLNKQLPYLVGNIVEILEMNPEDEAEEDGANIDLDSQRKGKCVVLKTSTRQTIFLPVIGLVDPDNLKPGDLVGVNKDSYLILDTLPSEYDSRVKAMEVDEKPTEDYNDIGGLEKEELVEAIVL

SEQ ID NO: 156642 - protein, 119 aa, Triticum aestivum
  unsure (1)..(119): unsure at all Xaa locations
  Clone ID: PAT_TA_51060.pep
MADVEYRCFVGGLAWATDDQSLQNAFSKYGDVIDSKIITDRETGRSRGFGFVTFASDEAMRQAIEAMNGQDLDGRNITGNEAQARRSGGGGGGFRGGGGSRCYGGQRXEGGGELHLPGR

SEQ ID NO: 156643 - protein, 182 aa, Triticum aestivum
  unsure (1)..(182): unsure at all Xaa locations
  Clone ID: PAT_TA_51061.pep
MLGASRRSLCAGAAARRHAAAFAVSGDAAAAASSSPSLSPSAPPRSVTNPEPGVSRLGGKRLFSVLAAPKLNGAESLSSLKLRESALVGRRYESSAAAVDSSDAPPAEKFEYQAEVNRLMDLIVHSLYSNKEVFLRELVSNASDALDKLRYLSVTDPDLLKDGPELDIRIQTDKXNGIITIT

SEQ ID NO: 156644 - protein, 122 aa, Triticum aestivum
  Clone ID: PAT_TA_51062.pep
ETCALLRRGAASSAPGALLGALALLFLVGSASLAIGAMASHVLGGGSENPAAANSLETDGLARFAVVEHIKRENALVEFVRLAEAKDHTVVGAVHDLTLAALGAGRQDLYRAQGWVAPGPYF

SEQ ID NO: 156645 - protein, 83 aa, Triticum aestivum
  unsure (1)..(83): unsure at all Xaa locations
  Clone ID: PAT_TA_51063.pep
ERKKTPKKKTPHPKKTKKKKKKNNNKKQNKXKQKXKKKKXXXNKXFXXLXFXXFFFFFFFFFFFFXNHRIVVMTFPFCQYDLI

SEQ ID NO: 156646 - protein, 137 aa, Triticum aestivum
  Clone ID: PAT_TA_51064.pep
PLPPKAAAARNLVLRHLRLAAAPASSVALRPAAALQGALSGRRWMSSEDAKGSFLDKDEVTERTIKVVKNFQKIDDPSKVKADAHFKDDLGLDSLDAVEVVMSLEEEFGSEIPDNEADKIDSIKAAVDFIASHPKAK

SEQ ID NO: 156647 - protein, 36 aa, Triticum aestivum
  unsure (1)..(36): unsure at all Xaa locations
  Clone ID: PAT_TA_51065.pep
GSLVLGTARSXLRVRVLEPDEHFRARAPRPDPRXPS

SEQ ID NO: 156648 - protein, 150 aa, Triticum aestivum
  Clone ID: PAT_TA_51066.pep
LASAAARKERRVSPWLLLVVLLVAAASGRNARADPQVPCYFVFGDSLVDNGNNNDIASLARANYPPYGIDFPGGATGRFSNGLTTVDAISRLLGFDDYIPAYAGANNDQLLSGVNFASAAAGIRDETGQQLARTHKPFFSFSRGSAKNVA

SEQ ID NO: 156649 - protein, 104 aa, Triticum aestivum
  Clone ID: PAT_TA_51067.pep
LPQTRQIFHDANRTANHLMFTRLHHHMMIVTVKFPDLYKLAHCSLMMDKSPASLYSLSIKGHVSIYIRVNSRRHTILLDQQSLTQKIKKTVEGAHLIWHRPNHY

SEQ ID NO: 156650 - protein, 53 aa, Triticum aestivum
  unsure (1)..(53): unsure at all Xaa locations
  Clone ID: PAT_TA_51068.pep
LADLLLGPIVIVSGGLAMSYPACAQAPXASTEQGNMGKGRVDCDSSYAETVLN

SEQ ID NO: 156651 - protein, 167 aa, Triticum aestivum
  unsure (1)..(167): unsure at all Xaa locations
  Clone ID: PAT_TA_51069.pep
EKLMPVSYAGKLRYMTENFHDAVAVSRVHGLLDIFTDFTYDPNWPEIVQGLEHGQQAVDEADFTAQVYQLKLLEYVXKIKTGQVFGPVVTVLHCVDFQKRTLPHAHVLVWLKKIMGRDLRPLMLMMMLLRLHMIMPWRLHFAALDLITKALSTKTSENCFAIAVFTR

SEQ ID NO: 156652 - protein, 123 aa, Triticum aestivum
  unsure (1)..(123): unsure at all Xaa locations
  Clone ID: PAT_TA_51070.pep
MDGGAATVCSMCGDIXFPDKLFRCARCRYRFQHSYCTNYYGDGAPASAGADMCDWCLGDVSGKARRSASTSGKQQASVCQDSATTGYSGRIDKAATGGDQESGRRGSTKVGGRTYKLLKDVLC

SEQ ID NO: 156653 - protein, 81 aa, Triticum aestivum
  Clone ID: PAT_TA_51071.pep
SEIYNPCVWDGNMHMYPVANLPLMMLRRELNLVQWCLPPVTKNIVYTIGQMVPVRTLEVNGTAQKKKKEKKRAAAREPTLQ

SEQ ID NO: 156654 - protein, 196 aa, Triticum aestivum
  unsure (1)..(196): unsure at all Xaa locations
  Clone ID: PAT_TA_51072.pep
HPLPQXFENFQIILRGKPVEQINIANELKFKKVVTYKPQVAYDSQVVSVRVDIGFAKEAPVLGIFGINVYHKNRLIMPFWKVLQEASSRGRSVIGVLEANFIEPAHDKQDFERTPLFIRLETKLKQIIVDYWKEKCHLIGYQPIDPKLRSQYKAALKDSGGPSVKIRHEASTAQKTGGHLSNLLPQTYDDEAAFRL

SEQ ID NO: 156655 - protein, 103 aa, Triticum aestivum
  Clone ID: PAT_TA_51073.pep
YSSHPLQRNTRLRLACKKRRRRRSSQEGELGDCRSRKRGLDERKAKEQTQVGLMDYYRKREHSTPEGEKQRENIEREGAIKEMLDSEGDWYYIGDWIVGRKTK

SEQ ID NO: 156656 - protein, 150 aa, Triticum aestivum
  unsure (1)..(150): unsure at all Xaa locations
  Clone ID: PAT_TA_51074.pep
PCSSPPPRPRPRRPPRCPRPXAPVSPPPTMPPPTPAPVSPPPAVAPATPPPAPAPAAPAPAPMVPAPTPSTMAPTPEISSPPEPSMXRPRPPRPWTRPPPRPAPPAPSTPPPCGPPPPSWPPPPPFTGRSAHRSRFNLSEGPRPLSFCGG

SEQ ID NO: 156657 - protein, 124 aa, Triticum aestivum
  Clone ID: PAT_TA_51075.pep
PPGPPHRPGVRGPAPGAAVRGGAPPPPLPGGPAALVAFRLPASPGGPRHEAALSPVPRAKPPPSQWPPPPPPLPPLPPSPPPPPFFFFSFFFFLPPFCFVGFPLVLGGPLGGSALVGGSDSSKH

SEQ ID NO: 156658 - protein, 77 aa, Triticum aestivum
  Clone ID: PAT_TA_51076.pep
RTTQERLATLANSRRRCAESSPRQGTLAQAMTRRLDGHLFATRNSSFLRQLYLWLQRCSLDSDNDLITAAMMDHPRG

SEQ ID NO: 156659 - protein, 73 aa, Triticum aestivum
  Clone ID: PAT_TA_51077.pep
PSVRSRLGGRVGTESNKESDGIMTVRVYEGMNCADEVMELAKSCSWCWRSRGKSGAIMDRGGHTCEGSDERLL

SEQ ID NO: 156660 - protein, 88 aa, Triticum aestivum
  Clone ID: PAT_TA_51078.pep
MEAAEVHMETQASARSNWPRCSSSRSSNSSQSPMQDTTGHQSYQDQSVLKKRKIMSPTAQRSTLPFENNDPVRKHGKGKGLMTVWHAM

SEQ ID NO: 156661 - protein, 175 aa, Triticum aestivum
  unsure (1)..(175): unsure at all Xaa locations
  Clone ID: PAT_TA_51079.pep
MADLPAAIVASSEGSSYVIKIDGYSRIKGQTXMXNYVQSTPFSVGGHDWAVEYYPNGXXAEKYEAGFISVFLSLYSVVSNDVKAKVGFSLLDKDGEPVESNSMITHEHVFCSKDSDWGFSNFIKAADLEGSVHLRDDSFSIRCDVTVMKPVHKVNRFIVVPPSNLHQHLGDLLVS

SEQ ID NO: 156662 - protein, 177 aa, Triticum aestivum
  unsure (1)..(177): unsure at all Xaa locations
  Clone ID: PAT_TA_51080.pep
HPSAPLGSFFFLGALGKEKTHINIEVIVHVISREYSTTGHMIYKLVCIDKRVNERFKKEADKMNNSXFQDACKLDKLMAKRERGLTMDIALWKVQTTKYYCTVFDAAGDGDFINNMITGTFNADCDALIIDFITGCTEAGIYNDGHTGEHTLLAFTLAVNHMIRXWNKMDATTHNYS

SEQ ID NO: 156663 - protein, 99 aa, Triticum aestivum
  Clone ID: PAT_TA_51081.pep
ARGETHKIMHLTHGSGTWIASFHAPLSMASSLMVHQFFISLFTDSSHVKFVLPRSLLTISARFSHLLCMSASGGLALETSAMMKHMMCLEDELTCFLAS

SEQ ID NO: 156664 - protein, 71 aa, Triticum aestivum
  unsure (1)..(71): unsure at all Xaa locations
  Clone ID: PAT_TA_51082.pep
RLPRGVGRATANXLIFTGRRLDATEGVKYGGSDSSVTGAKACAKADEHARNINQKGPRTIRMVNKATKRGV

SEQ ID NO: 156665 - protein, 107 aa, Triticum aestivum
  unsure (1)..(107): unsure at all Xaa locations
  Clone ID: PAT_TA_51083.pep
KXNILMRCWXKHVKXQESMELLXGLADLAKKCLDMCGDSRPSMKELXNELGRLRKLPMYPWVRVGVETDGESLLGGDSTGVQEVESDYSMGENENQHINLGSSYYAR

SEQ ID NO: 156666 - protein, 73 aa, Triticum aestivum
  Clone ID: PAT_TA_51084.pep
RAATLGSARCAVNTGGESKSLQLHDAWSQLDAKTKLCLIRRCRSVSKRSAQHIPVLPGAMNRHEKSRNVKAAQ

SEQ ID NO: 156667 - protein, 88 aa, Triticum aestivum
  Clone ID: PAT_TA_51085.pep
EVLVVLIMVFSKVEVNLRRLLQEAPRQQNQAKLAHYVSTARELLEQLGTEITTEGVSRVSKTKLSEYSEKIEALAATLAASASTFSKT

SEQ ID NO: 156668 - protein, 168 aa, Triticum aestivum
  unsure (1)..(168): unsure at all Xaa locations
  Clone ID: PAT_TA_51086.pep
RLKTRXSSDDAAGTVNEIGSTIRKVMGGTSGILYDILCKAAYASLKQNKNITAYEWADALEASIAAVSKYGGARAGYRTMLDALIPASTVLKQSLKAGDDPVTAFIASSEAALAGAESTKQMQAKAGRSSYISPDHLVSIPDPGAMAAAAWYRAAALSVKNKLHASES

SEQ ID NO: 156669 - protein, 135 aa, Triticum aestivum
  Clone ID: PAT_TA_51087.pep
SPSAIVSLGLRRTRLAGTAVLPNPYSRRVLWAACERSVSLARLLDRSGEDRRGETAGSALKVPCDAQGASGAPFGGTLGSSLGWVLFLVGVAAAGGAVSPGGADLPLGGRLGRGPVRRCAWVASWGVQPTGFSKW

SEQ ID NO: 156670 - protein, 73 aa, Triticum aestivum
  Clone ID: PAT_TA_51088.pep
DDGEPGDLKFRIRTAPHDRFRREGNDLHATVTISLLQALVGFEKNLKHLDNHLVQIGSQVSHQILNSKGLFDS

SEQ ID NO: 156671 - protein, 188 aa, Triticum aestivum
  Clone ID: PAT_TA_51089.pep
FVSAFCQSNCGDVSPNVLGAFCTDTNRPCDFNHSTCNGQNELCYGRGPGYPDEFESTRIIGNRQFLKAVDLFNSASEEIQGKVDYRHTYLDFSQLEVNVSSSTGGQHQTVKTCPAAMGFAFAAGTTDGPGAFDFKQGDVKGNPFWRLVRNVLRPPGPEQVKCQAPKPILLDTGEMKVPYDWAPSILPI

SEQ ID NO: 156672 - protein, 173 aa, Triticum aestivum
  Clone ID: PAT_TA_51090.pep
PASGPPPEPCRSGPTLEPILPTPPPPGFGPTAQPCWSRPTVAPPPTPPPGFGSRQVAPPPPHLSWGLPLRPTSDPGAPTFTQNVQPAGPAPLWRSAMSPSYPAPCWGAPSGPPPAQAPWSWPHPPSSWAPPHMLRPPPTPWDCMRPIAPPMPAKHPWHFEMQDTPPAPGACSG

SEQ ID NO: 156673 - protein, 118 aa, Triticum aestivum
  unsure (1)..(118): unsure at all Xaa locations
  Clone ID: PAT_TA_51091.pep
EDQTTPGEKHRKENGPERTPTRTRRHERRHEQTPPGATQQGPPGRRPRPGRPRPAAPPTRQGGTXRPQKKPRRHRGRGRRAQRRRDRPRAPRPTRAAPSPGRXARPPPQPGDCRRPTE

SEQ ID NO: 156674 - protein, 103 aa, Triticum aestivum
  unsure (1)..(103): unsure at all Xaa locations
  Clone ID: PAT_TA_51092.pep
MATKIYIVYYSTWGHVTTLAEEIKKGADSVPGLKVXRLCGCRQTLPEEVLWKMHAEPGREDHSVITARXLAHAYCGLIWFPTQVGMMAAHMKGFFHSTGGLWH

SEQ ID NO: 156675 - protein, 117 aa, Triticum aestivum
  Clone ID: PAT_TA_51093.pep
NRVLVLNTANFFDDEGMKALSSSPHLETLELILCHAVTDAGMRFIAHTPCLSNLTLRACHNVTDVGMAELGRAHKLGSLVIEYCGEVSLQAAQGVAKSVHYSEDFPDSLMKAIGHGA

SEQ ID NO: 156676 - protein, 82 aa, Triticum aestivum
  Clone ID: PAT_TA_51094.pep
SMNCHALEDMPMLNSIVFSGCWCENLCNVSENCNACLWHSPCHRIWSNIPLGLRHQTSNTCQELWWSVESVLLMMLLALVVI

SEQ ID NO: 156677 - protein, 182 aa, Triticum aestivum
  Clone ID: PAT_TA_51095.pep
MAAAAGGGVAGVAGSPCGACKFLRRRCVAECVFAPYFSSEQGAARFAAIHKVFGASNAAKLLAHLPLADRCEAVVTITYEAQSRLRDPVYGCVAQIFALQQQVAILQAQLMQARAQIACGVQSTASPVSHQWPDSSSSSIASLLRQQEVNSGSFATGGPLLPELMGGRVHAAAALRRQGGRR

SEQ ID NO: 156678 - protein, 90 aa, Triticum aestivum
  Clone ID: PAT_TA_51096.pep
NLFHSKPSINQIVMPNLNQNTYQTSYIEGEKSEGRGSRPRSRSANQGRSRAPKAYMRQPVQNKLSGNSWMPYNLEMMPEMERLDKEARII

SEQ ID NO: 156679 - protein, 60 aa, Triticum aestivum
  Clone ID: PAT_TA_51097.pep
FKNARPKSGMVIVNWLRECEPYNLESAIYNSITEDYHKIHNCQPLVLYRHSCAHSKNHQI

SEQ ID NO: 156680 - protein, 34 aa, Triticum aestivum
  Clone ID: PAT_TA_51098.pep
PRVRLQSSSKNSLLLKLHGDGVFPDPSIPAGSRR

SEQ ID NO: 156681 - protein, 199 aa, Triticum aestivum
  unsure (1)..(199): unsure at all Xaa locations
  Clone ID: PAT_TA_51099.pep
QPHRSARRLIEREWRRRRPSPPPTSPASPPPPRRRSTTTRTTSSASAAPAAXAQRLVAMAGSGKFFVGGNWKCNGTKESITKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTF

SEQ ID NO: 156682 - protein, 202 aa, Triticum aestivum
  Clone ID: PAT_TA_51100.pep
PKSSRPRAANGGAAMDRSWLLAAATGGGGPPLLAGLLLDRDRPIRAAVAFGYGDGSWDTTVTRVDDAAAGVVAVDFVDRGGERRARAFLNIDRDGVLLRLVAVFDTVDHATRENTRNVFVVSSARRPDPAAPPPAPLLLGLPPAPAIQVDYIVIDIPDNFPVPDVSEHGSYDGDDGQYVPPLGADPSAAGGGHNIADDGDAQ

SEQ ID NO: 156683 - protein, 185 aa, Triticum aestivum
  Clone ID: PAT_TA_51101.pep
HAQHSWRWSPAKLPANCSSSPSPIPLQSPPPPIPTPTGNIVSPSPAPSPPPADLPPHLVHPPMKTSFSTDPPTLPRPPMDGWMDGAHQFRRRRRRIRTHLRDGGRPHRDPPPALGLVRHTGPHLRLLLRWPSTTAHLRRDLDAQGMHPWLVTSCAAIAGGWLAGSTDVRGAGVCSLTSQIPAVPG

SEQ ID NO: 156684 - protein, 169 aa, Triticum aestivum
  unsure (1)..(169): unsure at all Xaa locations
  Clone ID: PAT_TA_51102.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHXXLKEVKC

SEQ ID NO: 156685 - protein, 98 aa, Triticum aestivum
  Clone ID: PAT_TA_51103.pep
HPGLALTPKQRVFAPPGGLCPPLFRTFCFDGNFFLPRQRLHNPAFGFFGPPIFCQASSINPATFALLRYICGAPPPRKVFFSVWPWPRSLFFCPPFVS

SEQ ID NO: 156686 - protein, 41 aa, Triticum aestivum
  Clone ID: PAT_TA_51104.pep
KKSWEKNKKEQFRFKNKQKKRGSKKSAEANEKDPNVPIVLL

SEQ ID NO: 156687 - protein, 129 aa, Triticum aestivum
  unsure (1)..(129): unsure at all Xaa locations
  Clone ID: PAT_TA_51105.pep
LATKLAGTTAPPPFDQITHPLQEGSRSHVRSRQGREGAGQGGAKRHGGAAGQHPGITKPTIRGLARRGGVKRIWGLIYEETRGGLKXFLENVIRDAVTYTEHARRRTDTALGVSYALKRQGRTLYGFRG

SEQ ID NO: 156688 - protein, 99 aa, Triticum aestivum
  Clone ID: PAT_TA_51106.pep
PPHTPRTKTPGKGPNPPADPGPPTADGTPPPPQRPDPHPPPKRREKKPGGPNPPAPGDKLKGVKQKPPPRGVLLEFIRVFPPAGIPPPPPELSPPGKLI

SEQ ID NO: 156689 - protein, 123 aa, Triticum aestivum
  Clone ID: PAT_TA_51107.pep
GQQQQRHRHPGPATGGQKRQARHRRAATAKAQGRGRAQAATATRRQGGGRRRRRPRGPPVPGSGHDEKPQLLPVEEEYHDQDQTMHFASFQQPQRRSIRVLLAGGIGSAAAPDRARRTQDTGN

SEQ ID NO: 156690 - protein, 88 aa, Triticum aestivum
  unsure (1)..(88): unsure at all Xaa locations
  Clone ID: PAT_TA_51108.pep
PTVRGAFIXPFYYTFLGLPGPGPLDGGGNYFRGPFLLYPXLRFTLHYYSVAFFWGLCTSVGFLDASGQFLGRCFFFRLLGSSVPVRPG

SEQ ID NO: 156691 - protein, 65 aa, Triticum aestivum
  Clone ID: PAT_TA_51109.pep
PRPATAPKPAPTPPKRATAHRLAGQGRQQAESPQAREDRAALEKAHEEDGAESAEGEDGDEGDEY

SEQ ID NO: 156692 - protein, 131 aa, Triticum aestivum
  unsure (1)..(131): unsure at all Xaa locations
  Clone ID: PAT_TA_51110.pep
QISPRKGGPRHSEKEXVNGVGSEFKKPGARNPQRRVDGRKNSSIPGVRQGVLAYAKKPSMNLRGGCLLAVVAAPIQAGRREAGVAGTIGRPLGMNPTPLYSLSFRNQFFGADMWVQLHSLKIVCFFWLVQI

SEQ ID NO: 156693 - protein, 94 aa, Triticum aestivum
  Clone ID: PAT_TA_51111.pep
SRAGFPHMCKGFPDPTLNGGVEQMFPEMGSRPRGGAPCIQIIKTAPVGFQLGKRGPPKPFPHSKIKFPLVFPKVCPPPRKVKAPFKGAGPPLFL

SEQ ID NO: 156694 - protein, 138 aa, Triticum aestivum
  unsure (1)..(138): unsure at all Xaa locations
  Clone ID: PAT_TA_51112.pep
NKNIILTRLMPHSVTYTRSTXWCKQNPSGSSGPLPVHSHLGKAPLLXDLLLRVVAEPVGHGGRDLLCVGPVLLPVLRAVPVAVGAREPAVVGLCELVGSPGAGLFGPVAPSRGLGGWCVCWRSPASRLVGGWWVPFAT

SEQ ID NO: 156695 - protein, 148 aa, Triticum aestivum
  Clone ID: PAT_TA_51113.pep
GLGPKDLVVLSGAHTLGTAHCPSFADRLYNTTGNGLVDPSLDSEYADKLRLKCKSVDDKSMLSEMDPGSYRTFDTSYYRHVAKRRGLFRSDAALLTDATTEEYVRRVATGKFDDAFFRDFSESMIKMGTVGVLTGGDGGIRKKCYVLN

SEQ ID NO: 156696 - protein, 116 aa, Triticum aestivum
  unsure (1)..(116): unsure at all Xaa locations
  Clone ID: PAT_TA_51114.pep
GGGGRGRFGGGGGGFRDEGPPAXVVVVSPFLRACEGDAVSXFLXXXXPTWGGGGGLXXXTXIGLVGEGFGPLRESYFSVLMFGGVLAPSYPAGVLSLLXPLSLLPLCRFLPLPWAR

SEQ ID NO: 156697 - protein, 100 aa, Triticum aestivum
  Clone ID: PAT_TA_51115.pep
DWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 156698 - protein, 135 aa, Triticum aestivum
  unsure (1)..(135): unsure at all Xaa locations
  Clone ID: PAT_TA_51116.pep
TNTWAFIFSLAQTQYDRTIFFTPPPIRGFAGEVHYPFLFRAPPPRGRIQFMRPPPWLGRPQPGGGSDWFPPPXPLRARLNLGPGCPFLPGXPRPPGPRLSPRGPGFLGFPGPQGALPPAAGGNGLAWPGAGPGFS

SEQ ID NO: 156699 - protein, 116 aa, Triticum aestivum
  unsure (1)..(116): unsure at all Xaa locations
  Clone ID: PAT_TA_51117.pep
AATGGATRRTPRPARERRTERTRRXKGKKKKSXASNETESNQPQGKLLRPSTRLTERVSSDLATAQAPSAAAPAPPNAREPNQYLIWGVEKIAAPPPDDVHGLGCENHLLSGKNLI

SEQ ID NO: 156700 - protein, 76 aa, Triticum aestivum
  unsure (1)..(76): unsure at all Xaa locations
  Clone ID: PAT_TA_51118.pep
FGPPTGPPEAPPGPPGAKQPAPPXGAFAPPVFKGRPPHPFRGXPPPGGPSGFPPRGLPPTPFGQKRPRGGSLPWGG

SEQ ID NO: 156701 - protein, 151 aa, Triticum aestivum
  unsure (1)..(151): unsure at all Xaa locations
  Clone ID: PAT_TA_51119.pep
TNNKTWHGTRRKKKQKGQGLIPPKKGGGQKPGSPAQNPKKGPGQQINPPPDQTKGKPRGTDKXKRSRHFPPPGKAPFQPPWPPPRGGSFRRQRPREREHPGGGPSKRKTSPGNGEPRPPPGGSRSSKTQTPRAGATPPRRPGPRGPPKKFF

SEQ ID NO: 156702 - protein, 150 aa, Triticum aestivum
  unsure (1)..(150): unsure at all Xaa locations
  Clone ID: PAT_TA_51120.pep
KSSQQSFLFPATPFNNGAKRGSRRKHRPHDQKGHPPPIKFPSKGGPPPKKPPTQKVPVGFPWGGFSGLRGPSPPGPPWRGPFSPXLEPPPGRPPXGPSGPTPWRVPPGGFGPPSGGRGSHPSPGPLFPLARGPPQNQGSFVPKAGPKQGP

SEQ ID NO: 156703 - protein, 57 aa, Triticum aestivum
  Clone ID: PAT_TA_51121.pep
APSGGLQRFEHQKRGLKDVPRADRQGQRHGSPVKVGKAGKKHSGIPRVGRAGDWCIH

SEQ ID NO: 156704 - protein, 133 aa, Triticum aestivum
  unsure (1)..(133): unsure at all Xaa locations
  Clone ID: PAT_TA_51122.pep
MAMVLLVALFVVLSAADVVGEVGRAHWLGTYPKRHPTKHVINNANNQWNAGHTAELKNYTMEHTMDKLKEXPTAKASPAGVRTKAHTKTDQISKEFQNGFKCSGXRTIGKTLDKRHCECCWAFCGAYGAQDRL

SEQ ID NO: 156705 - protein, 194 aa, Triticum aestivum
  Clone ID: PAT_TA_51123.pep
MPRRDTVSWNSAMAAMVRQGELASARRMFDEMPEKDTVSWNTVLDGYTKAGKMEEAFELFQCMPERNVVSWSTVVSGYCKKGDMEMARVIFDKMPTKNLVTWTIMVSACAQNGLVEEAGRLFTQMKEAAVELDVAAVVSILAACAESGSLALGKRIHRYVRTRQLGRSTHVCNAMIDMFCKCGCVNRADYVFDT

SEQ ID NO: 156706 - protein, 163 aa, Triticum aestivum
  Clone ID: PAT_TA_51124.pep
SNPVYHEVPVLIHDGKPICESLAIVQYVDEVWAATGPSILPADPYDRAAARIWAAYADSKLLPAWVGIMWAATEEERAEKVEDTLAAIGQLEEAFGKCSKGKAFFAGDSVGYLDLVVGSQLLWFEALQKMFGVVVVEVGRAPLLAAWVKQFGETDTAKEVVPD

SEQ ID NO: 156707 - protein, 115 aa, Triticum aestivum
  Clone ID: PAT_TA_51125.pep
GRDGVRRSGSGPEAGPAARKRDGGGGLDEAALAAMPVFRFKAEPRGAGGGEECAVCLGAMQDGDAVRALPGCSHAFHAGCVDVWLGAHATCPVCRARPALPVPAAKDGGDRRTGA

SEQ ID NO: 156708 - protein, 69 aa, Triticum aestivum
  Clone ID: PAT_TA_51126.pep
PGATGFAPQVITIQGGEDVAAKVMSYCGNGWAVFILSAEGAVRNVTLKQPASSRGTVIYEGYFDIVCLS

SEQ ID NO: 156709 - protein, 138 aa, Triticum aestivum
  Clone ID: PAT_TA_51127.pep
ARSNTVRALAMARRLRVVLAVAAAALLLVTATGARSDKLKAPKEDKPKGPAERPPKAQGPKLKEPKEDKPKGLLRGRPRPKGRSRRRSRCTLSAARTARRTSKSLVNAYACKSNIPPAHYMCATCRNLVDFFSYLYFQ

SEQ ID NO: 156710 - protein, 102 aa, Triticum aestivum
  unsure (1)..(102): unsure at all Xaa locations
  Clone ID: PAT_TA_51128.pep
RYPAFCIVNXRITGECFKHCTGHGHPVKLVPYNPAYQDXSVLRTESRDLGKRLPXLRMVNNIXLNFNTFHGDKVHGRVHDSTXVVLWNWCKGDNQCWKILPW

SEQ ID NO: 156711 - protein, 89 aa, Triticum aestivum
  unsure (1)..(89): unsure at all Xaa locations
  Clone ID: PAT_TA_51129.pep
MLTCIACSRQLGGGVPPLHEPPEDEDVVDAGAGVGGAATPSTRQAIKALTAQIKDMALKASGAYRHCKPCAGSSAXASGRHHPYHHRGG

SEQ ID NO: 156712 - protein, 88 aa, Triticum aestivum
  Clone ID: PAT_TA_51130.pep
HMEAAGVIHIGQWVSWQELSLFHKDSCYCRPVIVSNPVYSGLLFKPYELSHECLRVMVRGVIIAFVIPFKIVVRVLCTVSTWWYVILS

SEQ ID NO: 156713 - protein, 87 aa, Triticum aestivum
  Clone ID: PAT_TA_51131.pep
DLGFYFFFLIATMPDWGGGCSVLCVITWLNWVDFACGLRCTFRSRPPGFPVPACPSSAPLPCLAGGGPFSGSSFPSPRFGWLRSFFG

SEQ ID NO: 156714 - protein, 57 aa, Triticum aestivum
  Clone ID: PAT_TA_51132.pep
MAEDTETRPASAGAEEREEGEIADDGDGSSAAAAGRISAHPLENAWTFWFDNPQGKS

SEQ ID NO: 156715 - protein, 137 aa, Triticum aestivum
  unsure (1)..(137): unsure at all Xaa locations
  Clone ID: PAT_TA_51133.pep
AAPPQAQRRRRHGGTAAATAPRQGGERGPGSARGRRGAKGRQRTGRRTRGDPGQPRPKEPAGKSARGEERRGAPCPPARLDNPPPPPRXKRADSQSRGPEFVSWPLAIKVAARAHQKKKKKKKKKEKKKREKDLVKR

SEQ ID NO: 156716 - protein, 89 aa, Triticum aestivum
  Clone ID: PAT_TA_51134.pep
FLVRKMWSKASALFKTAPWHCWGVGVYTRLVHIIVINRRPRRRSFCVTSESSFQPLVGYFCMPFPRLYQLEVHAPYLSLVSVCMPQQKP

SEQ ID NO: 156717 - protein, 139 aa, Triticum aestivum
  Clone ID: PAT_TA_51135.pep
KRDPPKKGGKRRENPQLFYFPKKTPYGHKGTTKTPFNFLKGGAPPPLKFKKTPPQGGVGVQKTRGGKPQKAHPRNHSKNPPRERGGFGNPPQHQVWVKKKGRFQKNKPGGKKTPAEKRLEPRGGVTAPRGKIGTTEKNF

SEQ ID NO: 156718 - protein, 72 aa, Triticum aestivum
  unsure (1)..(72): unsure at all Xaa locations
  Clone ID: PAT_TA_51136.pep
REGSARPQGGAPRPKPGRRKXRGRPPPPPPPNGRGXETKTNDXKTRRGKIRXRGARXPRTTESQPQVARIRP

SEQ ID NO: 156719 - protein, 87 aa, Triticum aestivum
  Clone ID: PAT_TA_51137.pep
TITKTITGYNKLRLFAPPHLTILLFLFTSKTCFSLLLIYYKVAASSDFTNLAFSSAFSLCNRSSSDFRTALSRRSLSTSTSAFTFPP

SEQ ID NO: 156720 - protein, 161 aa, Triticum aestivum
  Clone ID: PAT_TA_51138.pep
MYIVFFYFLCFFFLRRREGGPNERGSEHKHGRKKGEGGTRLKKETAPPRRGRRRDRNVKRKRTGPHQGSKFFCSRPRGPKSGRLQANAGEGGGTAELGSGDALPSKVFPRGGDAPPRFARARGGELTTGGGLPRAGGSDQGGGDVVYLAGPLRSSAPRGGG

SEQ ID NO: 156721 - protein, 68 aa, Triticum aestivum
  Clone ID: PAT_TA_51139.pep
EKNTGGFFLGKPALINPGQRDPRARDQKPHGTQRPTRRLKRTDTGTENNWLTKTTRGEIDRKRGGPAA

SEQ ID NO: 156722 - protein, 75 aa, Triticum aestivum
  unsure (1)..(75): unsure at all Xaa locations
  Clone ID: PAT_TA_51140.pep
STSHIXLDTSSLSGEMELGSTYILFCLDRAISPAGGGGFSSSXGRRPPFVLCGAAAGPLPLPAAAPPAGCRVLFP

SEQ ID NO: 156723 - protein, 179 aa, Triticum aestivum
  Clone ID: PAT_TA_51141.pep
SFFFFFFFFSLYQPLFQFLLSNFLCISKHIARTNCRHASNHSTVQATGKRPRIKVEGIGPYIQKANTSVLPDALTNSKGPLSKMRGIILMQHAVSHGTCQCRSCQRLEVNDLGLILGAKRHTQRPPFCILNLNMGLEKEAELAGFSLSLLLGWSITERPSSGSTIDPGKAFCPPGSICR

SEQ ID NO: 156724 - protein, 98 aa, Triticum aestivum
  unsure (1)..(98): unsure at all Xaa locations
  Clone ID: PAT_TA_51142.pep
QNAGRAGLCXXXLLTFTLLXXCSSPFAALRQHFFFFLXXXXXRVGGGGXVFFFCLXFGWGRWALLLPRVAVGRGLGFGVARFGPGGRPVCWLGLSGLA

SEQ ID NO: 156725 - protein, 97 aa, Triticum aestivum
  unsure (1)..(97): unsure at all Xaa locations
  Clone ID: PAT_TA_51143.pep
PARTPPAPPPARAXAPPAAPAKDGGGRRTGAPPPQPXXAGGRAPSPPPPPGXRHSKKKKYMFVVACFDAENSQGSVILDCAPLVMISEEHPPPRAAV

SEQ ID NO: 156726 - protein, 90 aa, Triticum aestivum
  unsure (1)..(90): unsure at all Xaa locations
  Clone ID: PAT_TA_51144.pep
GLAGPLRAASPVQVVIGSFLTEEKEIKPDXASERFAADEKEEIKQDVASGRLAADEKEEMKQDVASETPGATGPTAAPNESSSGPGSPSN

SEQ ID NO: 156727 - protein, 50 aa, Triticum aestivum
  Clone ID: PAT_TA_51145.pep
GCKDYSPQHHAGKIRDLSRKTTIQGCSREALVCASRRPDPEDQIPRRNRK

SEQ ID NO: 156728 - protein, 75 aa, Triticum aestivum
  Clone ID: PAT_TA_51146.pep
SGRFHASARDNQQERGGPTTTHTLGSGPYPVRALAMTRRLRVVLVVSAVVLKPSRGHRRPVGQAQGPPGRQAVGA

SEQ ID NO: 156729 - protein, 50 aa, Triticum aestivum
  Clone ID: PAT_TA_51147.pep
NRTRAWVRAGGQDPILALKFRVPPVGFFLEEFACFLMAICPGELVNFVLC

SEQ ID NO: 156730 - protein, 77 aa, Triticum aestivum
  unsure (1)..(77): unsure at all Xaa locations
  Clone ID: PAT_TA_51148.pep
GSSWGPIKFGVAPMVNPGGRQGGSIPPALFLXPFVSQKGPWVPLAQAGPVWDAKKGAPPGFGGSPLGGGGLQNFFSS

SEQ ID NO: 156731 - protein, 135 aa, Triticum aestivum
  Clone ID: PAT_TA_51149.pep
VELKRDHESHTDANDDHSEAVMPEPKRIKKQIAEARFRKERQQPKAQANIKEAHLMRGTPLIKMKNCGSGKVKRRWKYDVVSKNQALGQTNSPKRFIINAIISESRRKFMHRDRDSLCCTRYDVETVSTLGKGGM

SEQ ID NO: 156732 - protein, 87 aa, Triticum aestivum
  unsure (1)..(87): unsure at all Xaa locations
  Clone ID: PAT_TA_51150.pep
GGGFFFFLTGAKAGLPVNSTRGFNTGVKHNNLDXLXXAXIFLGGAXXXXXXPSMWGGEDPIXLKKKXXXXCLMLSMLGXGGGVRLPG

SEQ ID NO: 156733 - protein, 122 aa, Triticum aestivum
  unsure (1)..(122): unsure at all Xaa locations
  Clone ID: PAT_TA_51151.pep
PFPQGPGFVFLGGFAKPAPNVGGAFFXGGGPISQEIPGGGFGGFNGAPGIKVGFAVPHAFGGGGGLSFPAGGCCRLASFRPSPFLWGWNPLPRVVSFLPPLAGLSVGQCFPMGVVFPGPFFC

SEQ ID NO: 156734 - protein, 187 aa, Triticum aestivum
  unsure (1)..(187): unsure at all Xaa locations
  Clone ID: PAT_TA_51152.pep
HISLLHGACQGEGPRLKVPNAIARHPRRLRLSLGGRKKHPRTLSEAPHCLLYKMAVIYVLKSLSAAXKGRQCLHMLLILNNRLKYAXLTYREVHAILMHLHILADGKVRTDNTYPAGLMDIIAHSAMTXENYTLQSDTKVRTGLHFVTDDDATIKLYMGSSVHLVQKGILYLDTYDGRTIRYTDPLI

SEQ ID NO: 156735 - protein, 67 aa, Triticum aestivum
  unsure (1)..(67): unsure at all Xaa locations
  Clone ID: PAT_TA_51153.pep
PASAAWVPLXNSTRTRIVIADTKIHILGSFVNIKVARDSLCSLILGSPAGXVYSKLRAVSARMAERY

SEQ ID NO: 156736 - protein, 64 aa, Triticum aestivum
  Clone ID: PAT_TA_51154.pep
LPCFRLFLCALCSLSILGIISQLFGVQFYKCLDVLVRPSVNLQMIGEAGKLILWFLMILLKSIA

SEQ ID NO: 156737 - protein, 142 aa, Triticum aestivum
  unsure (1)..(142): unsure at all Xaa locations
  Clone ID: PAT_TA_51155.pep
MACTTQTRIQNTGSRAXPRNQVATRAEGTLPPDTSRLSKSQTRSHEPLHHRALAHRSHGTIRPRHLVLRTLTFQTLGETDSRKYFTTDLTWHHVSTXSLQYASEAXLAGIFKDTKLCALPANGVTMMTDDIHLARRIRAERA

SEQ ID NO: 156738 - protein, 61 aa, Triticum aestivum
  unsure (1)..(61): unsure at all Xaa locations
  Clone ID: PAT_TA_51156.pep
ADKSPQSPSAATSGSFRRAQVDTGSDKEQPLALIATGPIDYRKAIXPEPAQSHSAEXRERP

SEQ ID NO: 156739 - protein, 198 aa, Triticum aestivum
  Clone ID: PAT_TA_51157.pep
VLHQQNSIDGGRSGLASDIKLPFISDKLESVKSLRRHLLGSVRDEKLSFQYTGEIYVGQGCSVTQTVFNGINVLAGVGLLSAPFTIHEAGWAGLAVLSVFAIICCYTGVLLKHCFESKDGIATYPDIGEAAFGRIGRLIISIILYTELYSYCVEFIILEGDNMTSIFPDVNINLFGIHVDSKHFFGVLTALVVLPTVW

SEQ ID NO: 156740 - protein, 82 aa, Triticum aestivum
  Clone ID: PAT_TA_51158.pep
TPARGFNFGGPIKKIFPCQPGLVKFGFFKTAPPFFFFFFFFFFFFFFFFFFFFFFFFFFFFFFFFFFFFFFFLTQQHCITKY

SEQ ID NO: 156741 - protein, 91 aa, Triticum aestivum
  Clone ID: PAT_TA_51159.pep
ASTTTATRLRAGHRSDPRVDVAIMLNNLEVDPFERLKIFQIACACTADVTFGEKPTRGRGQLQVGLLPGVATLRPGQLIWTQADFADGGLA

SEQ ID NO: 156742 - protein, 145 aa, Triticum aestivum
  unsure (1)..(145): unsure at all Xaa locations
  Clone ID: PAT_TA_51160.pep
LCDRLTLNILLCKEYSEFITLGTARFLLFYISYGNIYFHNRFMPANLLWTVMYRKQHKKDINAEASKISAFHQXPYSKLIVCASLEVIQNKRADKPDVRDAASEAALRDIXERIKKTTAESELXVKVTKSHNTTVLGNAPKPVKA

SEQ ID NO: 156743 - protein, 166 aa, Triticum aestivum
  Clone ID: PAT_TA_51161.pep
GRLDSFEPAPLRFVEELPPPTFSIGQLIAAFKSRSLDEKDLVVLSGAHTIGKAHCATFSDRFPNSDSDDFVRRLQDNCTADVNRRQDLDVTTPEKFDNKYYINLKQGKGVLTSDVQLLLNETTRGYVNDFADNEWWFWNQFGSSMSKMGMLQGPQGNVGRIRQQCY

SEQ ID NO: 156744 - protein, 54 aa, Triticum aestivum
  Clone ID: PAT_TA_51162.pep
LLKIHQSRPRTRADSITKSVSSCLNIVPTKQQIRSCKVEPQVHSSYTKQNPGRK

SEQ ID NO: 156745 - protein, 172 aa, Triticum aestivum
  Clone ID: PAT_TA_51163.pep
MELELGLAPPNHAGSCGKRGVAEAFGIKKPTLPLFLGDDDDDGGHGHGEDGTGDTRDWEMGSKRRRLVGWPPVKIGHRPRSNGHVKVKMEGVPIGRKVDLSRHASYHQLHHTLRLMFPSSTSHHGDPYAVTYEDGDGDWMLVGDVPWEEFSKSARRLNILMSPPTTTLGTAG

SEQ ID NO: 156746 - protein, 153 aa, Triticum aestivum
  unsure (1)..(153): unsure at all Xaa locations
  Clone ID: PAT_TA_51164.pep
TSLPVIYELRVYSLLRRXXFGEILTSRAIRAAHCLTSIQFSPTSEHILLAYGRRHSSLLRSIVMDAETTGIPVYTILEVYRVSDMELVRVLPSAEDEVNVACFHPSPGGGLVYGTKEGKLRILQHNGADAASMGLNCFIEESMLEVQRYALEG

SEQ ID NO: 156747 - protein, 35 aa, Triticum aestivum
  Clone ID: PAT_TA_51165.pep
WALVCTRGRPHPGKRGPAPSKATPPSRTLNRRHSL

SEQ ID NO: 156748 - protein, 54 aa, Triticum aestivum
  Clone ID: PAT_TA_51166.pep
SALVAIRCLQLCAMVFMDGSTLRDSAAIHEVTVYPLRSLSVFLQNCILAKTSKS

SEQ ID NO: 156749 - protein, 80 aa, Triticum aestivum
  Clone ID: PAT_TA_51167.pep
TPPPPPPRRPPPPPPPPPPPTPPPPPGTPPPTPPAQRQPAPQAPPAPPKKPHPQHEDPPPGSPRQTLGPHVPRGPKPAPA

SEQ ID NO: 156750 - protein, 154 aa, Triticum aestivum
  Clone ID: PAT_TA_51168.pep
GGGSLWGAPWSGPPPRKSLGAWPKPKLGGPKGPQGPPRGPWKKKKGFFCRRWWCDPPGGFFWPREKKGAPQTQSSSRGPFFLFLLRFSPSPPVFSPRFFLVWGVWGGLFVFSISFFGAKKTFFWGGVFPPGCYVSQLFCSLVPIKLPKNFFPSP

SEQ ID NO: 156751 - protein, 92 aa, Triticum aestivum
  Clone ID: PAT_TA_51169.pep
LWPSTYTALHPFQNHSFLNHAIGLHIFQRSLYTIGDDQMTQAHTSLLPSIRIDDSLEQREDTIKARYLVPPYAPNDHGDKSIHNFLSPTLHS

SEQ ID NO: 156752 - protein, 76 aa, Triticum aestivum
  Clone ID: PAT_TA_51170.pep
KWRAIGSAPRVKTTDSPVPGARYIRKSKEHGLVILKLPLDAPSDGHSSELQVRPQDSVCLRLLNTSRPPRLYAGAV

SEQ ID NO: 156753 - protein, 98 aa, Triticum aestivum
  Clone ID: PAT_TA_51171.pep
KVGAQNATFDDLAAAMPADDCRYAVYDLDFVSEDSAGETPRSKIFFIHWSPESADARNKMLYASSTEGLKKELDGVQIDVQATDASELTLDILKDYTT

SEQ ID NO: 156754 - protein, 63 aa, Triticum aestivum
  Clone ID: PAT_TA_51172.pep
PARKKGEEGRGKKPPPTPKKGEEGGKKKKGDSGPVKPQSGNSDSYVHNRVLYWFAPRKKCSFC

SEQ ID NO: 156755 - protein, 99 aa, Triticum aestivum
  Clone ID: PAT_TA_51173.pep
KGPRREGARAAPRGGTGTRKGPGGPSEAPATRAKRGARPRRRGRRPRPPSRSPPTPGRPSREGPRAGSVRRRRNSPDPGINGPPPPGCVLLIKKKKRIG

SEQ ID NO: 156756 - protein, 87 aa, Triticum aestivum
  unsure (1)..(87): unsure at all Xaa locations
  Clone ID: PAT_TA_51174.pep
KELXLLGQXXXXISREXXLXEAVCVLCCYLRELFFFLXRXHFCLGGGWVPPVRIGSFXSGDLGSFLGVGWGLSAGVGGGSVGRGGAA

SEQ ID NO: 156757 - protein, 117 aa, Triticum aestivum
  unsure (1)..(117): unsure at all Xaa locations
  Clone ID: PAT_TA_51175.pep
VFCWRTNNKDTKQVQGKHTLGNATETTICRQNNGLQKKSTTEQELQQLSAHHHLRRKKNNAKAASNKQTATHTHKKGRYHRIYLCAGMRNWGCGELPVLEXMDALLRXWLLHPXAFT

SEQ ID NO: 156758 - protein, 67 aa, Triticum aestivum
  unsure (1)..(67): unsure at all Xaa locations
  Clone ID: PAT_TA_51176.pep
ALCFVCLYMRYYWGSDPVKRFSMHSCYSAHYNLLVEAIPGLFFAPXIPLSLGGGGLFSXXPFYCPPV

SEQ ID NO: 156759 - protein, 79 aa, Triticum aestivum
  unsure (1)..(79): unsure at all Xaa locations
  Clone ID: PAT_TA_51177.pep
NRERPPGKTGGAESARRSPQRATRRPEPGACPPPPQXEKXMRSNQRSLSECSIWVHKPVVEQCERWFLGCSPYVRVIYG

SEQ ID NO: 156760 - protein, 75 aa, Triticum aestivum
  Clone ID: PAT_TA_51178.pep
IFGFLGGRKLVTPASACPPLYILPPRYLAGLPGQSVLGLAVAPTPGTLGGSFFPGPACSRAFGPFLLGPPWGGRA

SEQ ID NO: 156761 - protein, 52 aa, Triticum aestivum
  Clone ID: PAT_TA_51179.pep
NTTRTDCQDLGRNTLSKTFPSCSQYSCPPRTNNILQGEPQAHPTHKTESCSK

SEQ ID NO: 156762 - protein, 30 aa, Triticum aestivum
  Clone ID: PAT_TA_51180.pep
RWLKCCPYYRISFGVFLCSSGYMLSFPVGC

SEQ ID NO: 156763 - protein, 126 aa, Triticum aestivum
  Clone ID: PAT_TA_51181.pep
TVSVPCKNPKLRGRALDKGKKKPGVQKFTEGRGDQEGSKKGRGPPDPQKNNTRWQEAQRNGGNEQRKGGDEQPPKHLQGPGGDTYSLVNLLTQGADLETLPNARGTHKAPVKTHLGFMRADPRLVT

SEQ ID NO: 156764 - protein, 58 aa, Triticum aestivum
  Clone ID: PAT_TA_51182.pep
ARVRRKAFCPWPPGEGSDESRLPEAESNMNGLGGQPTQHREATADEEEEYGEEEEEDA

SEQ ID NO: 156765 - protein, 77 aa, Triticum aestivum
  Clone ID: PAT_TA_51183.pep
DRHRVVRLTASLLSLPSTRGAICRQIFYVAGPRLPLGGGGAVPRSWGGREPPGGPSLLARRPPSRGPCPPGPAFFLP

SEQ ID NO: 156766 - protein, 184 aa, Triticum aestivum
  Clone ID: PAT_TA_51184.pep
FFVHSLFFVSFFLSCLFFFFFLFPDRKRVVSAPPPFVLYPGRPVNTGGGGGGLFPSGPALARGGPRAASSKRNRLLARRPPLRPRPPPASPPPARRGARGRRGGARRPRCPPGRAPAAPGGPGAAPVPPPPACAEPRAPLGAGPRGPGRPRVPRGGAPGGLPGPRGPLGPPGSRPPLGPRPAPP

SEQ ID NO: 156767 - protein, 153 aa, Triticum aestivum
  Clone ID: PAT_TA_51185.pep
VVTMDAASGTAKRKRSSAEAPAPVGVDDVSDTEVEEFYAILRRMRDASRRLASGGVAAARARAPAPAPRAPAWCPSFSWEDFAPPAPTPPPAPQQQLPADERVAENATPPRRPVPRGLDLNAEPEPEVTPSRREDYEPWDGRTDVGRAGRRRY

SEQ ID NO: 156768 - protein, 167 aa, Triticum aestivum
  unsure (1)..(167): unsure at all Xaa locations
  Clone ID: PAT_TA_51186.pep
MATMVALSSFPVVGRSAIRSPVAAPRRRTLVVRAQTEVSFHVTHLTVSHAGXSRLDLNVRLLVYVQPGMESTKETTSASTSSSPSTSATPTPIPAAPKPMTKKANPSVWDALAFSGPAPERINGRLAMVGFVAALSVEAARGGGLLDQAGSGAGLGWXLXTAGVFSV

SEQ ID NO: 156769 - protein, 200 aa, Triticum aestivum
  unsure (1)..(200): unsure at all Xaa locations
  Clone ID: PAT_TA_51187.pep
KLKIAVFSRXWPVATAPGGMERHAHTLHTALAARGHRVHVFTSPPPHTEAAPSPSADGPQLHFLDGTPGQWRCDEAWKLYEAEGDNDPFDVIHSESVAVFHRYARGVPNLVVSWHGISLEALHSGIYQDLARGEDEPMSPAFNQSLSQSVHRVLSEVRFFRSYAHQVAISDSTGEMLRDVYQIPGRRVHVILNGVDEAQF

SEQ ID NO: 156770 - protein, 63 aa, Triticum aestivum
  Clone ID: PAT_TA_51188.pep
YYPHADRRFRLVRDPKLHHPRRSDHIRTAAEPQPMNQNNHEKRSNLHLCRTSAPSGFLCIYIG

SEQ ID NO: 156771 - protein, 181 aa, Triticum aestivum
  unsure (1)..(181): unsure at all Xaa locations
  Clone ID: PAT_TA_51189.pep
KQXKSHDEKRPRARKLMEFHNIKISQVELLVTYEGSRLAINDLRLLMDTFHRVEFTGTWRRLFSRVKKHIIWGVLKSVTGMQGKKFKAQNQRETLDGVVPENDLNFSDSDGSHHGKPDQFPVSWLKRPGDGAGDGFVTSIRGLFNSQRRRAKAFVVRAMRGDGDNEYHDQGSESDGEYPFA

SEQ ID NO: 156772 - protein, 128 aa, Triticum aestivum
  unsure (1)..(128): unsure at all Xaa locations
  Clone ID: PAT_TA_51190.pep
GRDDPRRQESMAEKRLSASNSAKEGGHKNGRKKNKMSVETYKIYIFKVLNQVHPDIGIXSMSMFIMNFFINDIFXKLAGDAAKLSRYNKKPTIIFREIQTCVRLVLPGDADKHAVSYGTKAVSKFTSY

SEQ ID NO: 156773 - protein, 54 aa, Triticum aestivum
  Clone ID: PAT_TA_51191.pep
FCAWRAQGSIVMILGEAWRAPCRSLGHQATSTASHLHHRIQNALHRKPNQKNTD

SEQ ID NO: 156774 - protein, 165 aa, Triticum aestivum
  Clone ID: PAT_TA_51192.pep
MDTSLAAAAVTAEASAPAAASTEPSAAPDASPAASSSSAAAAAAEDLAGGVAALSLDERFDLLMSIGEECIQPDELKRLLQNKPVPICYDGFEPSGRMHIAQGVVKTINVNKMIRAGCKVKIWIADWFAQLNNKMGGDLKKIQTVGRYMIEIWKAAGMNLDGVEF

SEQ ID NO: 156775 - protein, 134 aa, Triticum aestivum
  unsure (1)..(134): unsure at all Xaa locations
  Clone ID: PAT_TA_51193.pep
KAMVTAKLSSPATARLAPVRSAQPARRASLVQVRASGGYYADELVSTDENRSSPLGRXIIAIDHCQCNXGKRLASIGLGQXTKVNQQAYRQXLLTTDGLGEYISGANIXEETLYQYNTDGKXFEDVKKDHIIMQ

SEQ ID NO: 156776 - protein, 127 aa, Triticum aestivum
  Clone ID: PAT_TA_51194.pep
GEIFGPPPERCSGTGFCSRQPGAAPKVGGLPHQGCPAPSLTKEFQFPGGELPCSLARSPSKFRHNPGAVDFEGGAPFLASPSPENFSPWGPRCVPPFQNGPPRWVFVHCAVNALRCVALSFVCPGAC

SEQ ID NO: 156777 - protein, 81 aa, Triticum aestivum
  unsure (1)..(81): unsure at all Xaa locations
  Clone ID: PAT_TA_51195.pep
FSDAGLKRLPGDPRIMEWFFIACPVAELPFFASKVRLGRSGVQEVLPLGPLNEFXRAGLEKAQGELAQSIPKGVAFAPQLS

SEQ ID NO: 156778 - protein, 141 aa, Triticum aestivum
  Clone ID: PAT_TA_51196.pep
KKAGGPGTPQKKPKRGTRGTRPTNKRGTERDERGGAKKKNPRENPPKGPHPWLEGPNQGGEGPPPPVPNPRPPKGPRKPPLDRLKKKKPGPPKGAPPPPEFKGRPPHPFKGGPPDGKPPGFPQGPKTPPRLKKNRTRGPPR

SEQ ID NO: 156779 - protein, 133 aa, Triticum aestivum
  unsure (1)..(133): unsure at all Xaa locations
  Clone ID: PAT_TA_51197.pep
FPRMEPRMAFGPHXPDMVLLPPQVEVGFPPGRPPEKPPAPLLEFGKTQNGRPPPPMALPVGVPAPIGALLLFPNKVPRKGVVRPLEPGIFLPALEILEASGLQLVERVGPLGCPDGVRIFRVFFLPPPRPWVN

SEQ ID NO: 156780 - protein, 86 aa, Triticum aestivum
  Clone ID: PAT_TA_51198.pep
RGHLIIQTQMLLPAPALLGNPNYSSGGPTDFGSDLPLSWGPPGNLVWGGIFYFFPPPVRGFRLVGVPGLAPPGGSAPFGPAGGPAP

SEQ ID NO: 156781 - protein, 165 aa, Triticum aestivum
  Clone ID: PAT_TA_51199.pep
ATTDSIHEEKEVYQVQGVEHSQTLAHQWGVHETLEPLDYLPLLQNPSYMNKSGAGVDVHINTGEIAMQSSQSIRIIFQWAGTTRKGESGRRFRSHFSLHSQSQKEWERKEHTVHDPGSYRSVDAILIYRGAGQGIYEDTSKSLKYSGSRAVRALILRVGSKQSIL

SEQ ID NO: 156782 - protein, 154 aa, Triticum aestivum
  Clone ID: PAT_TA_51200.pep
KVPSGFWARGAHEATQKGRPFGFGKGRGPRGVGLPPQFFWIRGMGVLRALLGKSRGAQKFSKPLSPAMSLRVKGTLFKTKGVLLGGFPRSQVGKAKEKPLFAPFGAQGPQSKATRGGKFSRGGGGLARGPRVFAPPPPGAVPARAPGAPKRAQK

SEQ ID NO: 156783 - protein, 126 aa, Triticum aestivum
  unsure (1)..(126): unsure at all Xaa locations
  Clone ID: PAT_TA_51201.pep
GVPGQTYGIKKAATEEARAEKAKEALVVLPNLEKALPQXSKGKPFFPGDSVGYPALPVGCNLFGLEAIPKKFGGTFFDVGKTPLLAAWAERFPGTQMAREVVPDPDPPVVFAKKLQARFGSNTSAK

SEQ ID NO: 156784 - protein, 42 aa, Triticum aestivum
  unsure (1)..(42): unsure at all Xaa locations
  Clone ID: PAT_TA_51202.pep
KKKKMVXAANPDVQNRRTPLEIRMDPKQIYIHPLLLETHPTP

SEQ ID NO: 156785 - protein, 155 aa, Triticum aestivum
  unsure (1)..(155): unsure at all Xaa locations
  Clone ID: PAT_TA_51203.pep
NKKKKGPFLRPQTSKHRGKNKTPIYQPTAQRGGKQNPPPNRGAKTKPWPQAKKPKLQGPKNKAGPGGAGPPPQNPGKTEGRGEEPTGLIKQTEPQGXKKNFPFLKPSPPXGPKRGGGGPPKGRRGGPHRRGPPPGRPRGKLPPSKSKHFGEAPAL

SEQ ID NO: 156786 - protein, 97 aa, Triticum aestivum
  unsure (1)..(97): unsure at all Xaa locations
  Clone ID: PAT_TA_51204.pep
GGSKSIKNLVYGGEQKGGCTNRGIPPGKPTYIWPYSIINRNPLGFXQIESPNNKRGNRKTLAGCFSRWAHFRGAWXWPPGLRVGRVAFGPLFWGPVV

SEQ ID NO: 156787 - protein, 168 aa, Triticum aestivum
  Clone ID: PAT_TA_51205.pep
FCFLFIIFYFVYVFFSFLFFFFFFLRAKTQRYFNSNWGPGKPPDNNKNPRPAGGPQPKTHPAPQKRLGRPFKGPPPNRGRGTFFRGPTPPFGPGGGPRGAPWKDLFLGTGGATPAQSSPTHFFKGPPSPGPKSGPGPLPFGAPSPPPGGGGNPPSPAPFFGNFAGRPP

SEQ ID NO: 156788 - protein, 86 aa, Triticum aestivum
  unsure (1)..(86): unsure at all Xaa locations
  Clone ID: PAT_TA_51206.pep
QXSXIFVGGWELGTXTHEPFYCWFYNCYLVIGRLYLLVRHSSFCLRAACVCRLPRIPMTMFRVXWXPXPPLLRIFSFGGNFGSAVR

SEQ ID NO: 156789 - protein, 109 aa, Triticum aestivum
  Clone ID: PAT_TA_51207.pep
GGFPPPKMVSSRFFLRGKGSCPPRLTRAQLASFFKRFLGKFWPSGARAKQTSSRPPFMSPPNEGDAGPGRGICLGALFVKKIEWAPLGPGVKVIGWFLVRGGGPPRRNF

SEQ ID NO: 156790 - protein, 126 aa, Triticum aestivum
  unsure (1)..(126): unsure at all Xaa locations
  Clone ID: PAT_TA_51208.pep
SPGLLQGGPQPESKKRDGALDSRRPNGPPPRXGDNPLGPTKPPGKHPRVAIPSGPPRERPPFGPPGRGEYGPPPSGXKKTGPLREPGALGGPRPPPKGTSGGWPDPPXKLEGSGTYPGSLPPPGEP

SEQ ID NO: 156791 - protein, 185 aa, Triticum aestivum
  unsure (1)..(185): unsure at all Xaa locations
  Clone ID: PAT_TA_51209.pep
TFSKGVHCALVPLXSSSDNVVSVQLLESAPVYSMLTQMYVVRFLRALGSELDGVLSRTVRELGTASETVLAVAIRTKVIEAIRTMRSASLPSVPVVDAXSDAYILQYGTGKKVVETFSSSDLRVCPVAQLRSWLGASVAEFKDKVAEYRREASRPLHAASGVQSPDEGDTNSAVYAGTGIEEEKP

SEQ ID NO: 156792 - protein, 45 aa, Triticum aestivum
  Clone ID: PAT_TA_51210.pep
VNPSTMIHELSLTPLSTMNSALNVALTHFVNRQFWGATNAHCTFL

SEQ ID NO: 156793 - protein, 106 aa, Triticum aestivum
  unsure (1)..(106): unsure at all Xaa locations
  Clone ID: PAT_TA_51211.pep
CLATDKCSPANRRGQKAKQQTPGKKPARDKGKEEDPQGGERGKTGGATPEAGGGDPGTPSRGXERGPLDLGARXGELGPVPNRDPAWMRGTTGPVAPTGQTGGLTE

SEQ ID NO: 156794 - protein, 110 aa, Triticum aestivum
  unsure (1)..(110): unsure at all Xaa locations
  Clone ID: PAT_TA_51212.pep
PQVSSEALLKQVKNMTAREWVPCIEFSKVGFIFRKHNASTGFSNGRCXTMXKQLMVGCSLARQVIXRCXEVKKEYPDAYVRIIVFXSMRQVQCVSFIAFKPPDWEKSGKA

SEQ ID NO: 156795 - protein, 81 aa, Triticum aestivum
  unsure (1)..(81): unsure at all Xaa locations
  Clone ID: PAT_TA_51213.pep
TRGETDHPKLKQDYAYKNQNRRCFCPQKCSSCCRVFLLFNAPLIKEALLRXXLFYQLPLGFSPRILYSKPGLVLPFYAFIT

SEQ ID NO: 156796 - protein, 84 aa, Triticum aestivum
  Clone ID: PAT_TA_51214.pep
LERLEVQIGQYLNEAPRLAGHTCVLFFKNKEKVCLFCVFKINNLCPMFTKCVKFMHKNIQLRLLHPWGQGLNCPFRDLTVVDRG

SEQ ID NO: 156797 - protein, 98 aa, Triticum aestivum
  unsure (1)..(98): unsure at all Xaa locations
  Clone ID: PAT_TA_51215.pep
VCNFTXGSYVSLPQSRLPQRAYGCTXALSTARSVSSSLEGVKDPGISSVGGSGLGQIQELFHIRELIMPKQQFKPVVMXIFKKFNASFMFQNQTLLGL

SEQ ID NO: 156798 - protein, 82 aa, Triticum aestivum
  Clone ID: PAT_TA_51216.pep
RGALLPSQSCLFALDATPSNPIPKARELTTSPPLPCPIGYWNRSLNLLRPAFKPPSGHPHQYCSRSLTMPGTADILPRSCKP

SEQ ID NO: 156799 - protein, 47 aa, Triticum aestivum
  Clone ID: PAT_TA_51217.pep
VGLLFMQWLSTPHVSVCSVVPVSVSIRPAPCICISIYYTSTSQNFVA

SEQ ID NO: 156800 - protein, 83 aa, Triticum aestivum
  Clone ID: PAT_TA_51218.pep
RWLWQCQVQDQASSDLSISTAVTVHLNRAVCFWEVLAGPCGWYLVHLFHWIKKPFFNKPLAQALKAMQVCNFGTSHLSCMGPV

SEQ ID NO: 156801 - protein, 87 aa, Triticum aestivum
  Clone ID: PAT_TA_51219.pep
GVGFSSPVNLHAVLKFLAALVLKFFCSATKDLKVQGIAPRRVFFSIPGFEGVGTLFKGTINGGGVIPLILNFFISGAFKHCFFGDNG

SEQ ID NO: 156802 - protein, 72 aa, Triticum aestivum
  Clone ID: PAT_TA_51220.pep
YQSDIPPFDNDLENIDLDIKLNKPASSMDTYSVNNISDQHRYHFLGENITIVIYIIGIGKTSIISGSRCAVL

SEQ ID NO: 156803 - protein, 84 aa, Triticum aestivum
  Clone ID: PAT_TA_51221.pep
QNAVLELTYNYGVTEYDKGSAYAQIAIGTDDVYKTAEVVKLSGGKVVREAGPLPGIGTKITAILDPDGWKSVFVDNIDFAKELE

SEQ ID NO: 156804 - protein, 79 aa, Triticum aestivum
  Clone ID: PAT_TA_51222.pep
DENLYSSISVGGRVCDLKVLSVDPATVAQGTMATEMAASARSANVRASDRRANGIRDANPALCERCQQTSQSRGQQWSS

SEQ ID NO: 156805 - protein, 73 aa, Triticum aestivum
  Clone ID: PAT_TA_51223.pep
NGGAGGGGKLKPWECSSKCSSRCSGTQYKKACLTYCNKCCATCLCVPPGTYGNKGACPCYNNWKTKEGGPKCP

SEQ ID NO: 156806 - protein, 84 aa, Triticum aestivum
  Clone ID: PAT_TA_51224.pep
SSCSSSSQPLSYRFSVECSNPQVGSLSPPRQMLSGQSLKDCAYLTSQNLSSGRIIRGPSEYHWQSCKFGVLSNVKNDWKKIATV

SEQ ID NO: 156807 - protein, 135 aa, Triticum aestivum
  Clone ID: PAT_TA_51225.pep
NLEPVRPHPGMIIGVVGKIGSRASVHQAKPFVGVIINLIMTEPLALEGLIAGIHLSSGRAGSGPNQCMLVPPWPCEPSCLYFADSSSALQVAVPRIRFPGCGPSYTSGARVGLPIMFRSAPSSVLGGGCDFLVHR

SEQ ID NO: 156808 - protein, 41 aa, Triticum aestivum
  Clone ID: PAT_TA_51226.pep
DLLILTDPIPVEPLTATIHVLGVYYAIRCFRSTLNPGEESS

SEQ ID NO: 156809 - protein, 86 aa, Triticum aestivum
  Clone ID: PAT_TA_51227.pep
NVVTPRYLNLLKPMKGVLRPPCVSETQGRLPKEELGHPVGPLDVTHPKGSAPPPHGKGCPFKKNIGTCILVGIPPPAIFARRDLAT

SEQ ID NO: 156810 - protein, 64 aa, Triticum aestivum
  Clone ID: PAT_TA_51228.pep
ENPTVMAPVYFNKAEIPTANEHNICRSTQTNMLTLAGDKLWQLCNMVPSRVSLMTHICWNSTWT

SEQ ID NO: 156811 - protein, 72 aa, Triticum aestivum
  Clone ID: PAT_TA_51229.pep
LNGPTSHEAELALAAQARVVPPTNKVWFQGLWVCEQAVPVCFALGVGRLLQAEQSGDCFIVRVVLSRVSYVM

SEQ ID NO: 156812 - protein, 72 aa, Triticum aestivum
  Clone ID: PAT_TA_51230.pep
WWREHHPNELQVKSLTSLYLPPAGIELHRPCRPPLFRRLERHEAALWLWRMYDNPMMHTVPVGVLGECDTGT

SEQ ID NO: 156813 - protein, 66 aa, Triticum aestivum
  Clone ID: PAT_TA_51231.pep
ALLADSSFVWVIKVPYSWTFRSAFTSECVRSLEHQFLAYNGGSLPVSHPWRIHRQGQWYQMADGSC

SEQ ID NO: 156814 - protein, 113 aa, Triticum aestivum
  unsure (1)..(113): unsure at all Xaa locations
  Clone ID: PAT_TA_51232.pep
WKNKNKPGAKHMIKVQTKNSSYYSQCIKTTVKSRVWASRKTGLCMESTFVGESTSVQQMXGRVSHQLGAMFCSKDLSCWSTADRIERCSSKRARSDLKXLVSKSPQSQDALRT

SEQ ID NO: 156815 - protein, 82 aa, Triticum aestivum
  Clone ID: PAT_TA_51233.pep
EHKTRFRIEMPFSCGGDAIPLHDIGSDGSSLGQGHKFPIIGPRPLSKRVFLSPWQNLIKWSHHSKCPLKTLVGSTAPAIGSF

SEQ ID NO: 156816 - protein, 92 aa, Triticum aestivum
  Clone ID: PAT_TA_51234.pep
RGSTRHTEKRSSDISASYTYYMNMIQLSTSFLYTNTRIYKYYICMHCMLTSCHPACICTSCLVLLESPLYLYRRLTVSKLGPQLARWRLEFV

SEQ ID NO: 156817 - protein, 75 aa, Triticum aestivum
  Clone ID: PAT_TA_51235.pep
ENRESQAVGIKEGSKSGCLLWHQAATSREGTCTTRLNRATSQLGQRPEEACIFALEYSKCHRLILLLKARPGQAS

SEQ ID NO: 156818 - protein, 84 aa, Triticum aestivum
  Clone ID: PAT_TA_51236.pep
PDCLKWSNDQQTLCFQCDSCKAGVLAGIKKSWRKVAIINIVVPIILIIVYVAGCAAFRNAKRDDNDESYGMARMTKSRPSRFQF

SEQ ID NO: 156819 - protein, 83 aa, Triticum aestivum
  Clone ID: PAT_TA_51237.pep
VKNFRLLVPLSLGSLMHSIRHSLCMPLPCRQSHRSIGSVPWRSLSGLPLSARRTVPRSRRRATSPACSSSSHRGSFSMSLVSP

SEQ ID NO: 156820 - protein, 109 aa, Triticum aestivum
  Clone ID: PAT_TA_51238.pep
PLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 156821 - protein, 97 aa, Triticum aestivum
  Clone ID: PAT_TA_51239.pep
RGLARLIASRRLEGYEKETLYLQHGAEYNTSDIRCWAQTITKPGPTREHLTMATRRSRCPYTERNRMDCPARSIAHYFMKRERPHTLTQYSNHTQKI

SEQ ID NO: 156822 - protein, 111 aa, Triticum aestivum
  unsure (1)..(111): unsure at all Xaa locations
  Clone ID: PAT_TA_51240.pep
RVIPLGFVFLVKDDFGKQAGARWIFFSQNRVSAPGVKPVASGGCHVWDIPGSSGFLGPIRXIQFGEVIIGQPWGYAPRAVSXRWSLGACGAAGNARRFLAGQGDVPFLAPS

SEQ ID NO: 156823 - protein, 86 aa, Triticum aestivum
  Clone ID: PAT_TA_51241.pep
GEHGTWSGVVVQSSVPNVEAAHVGVHPVRAGADLRGAGQQGAAYSTMSGVFGVRIPAAVALGQLSRQFRFQGCGTSGKPSSLSYSK

SEQ ID NO: 156824 - protein, 38 aa, Triticum aestivum
  Clone ID: PAT_TA_51242.pep
IILGKSNWASHYEILKLELITTIFSEDLNYLILHTLLA

SEQ ID NO: 156825 - protein, 58 aa, Triticum aestivum
  Clone ID: PAT_TA_51243.pep
KGPGARAQAQDRGGGGPPPNRGGRGFFFPRAPREKAGPQGGQGGQRRKKAPPLRLDCR

SEQ ID NO: 156826 - protein, 109 aa, Triticum aestivum
  Clone ID: PAT_TA_51244.pep
KTRGGGGGPRKTRRQKRRTPRPGTPVLGRRRKGTPFPPPGPLGRGEPGHRGRGRALSPGTFGRRRPRRPPGRRPPWGTPRRWSWSPPPGPGGAMHKRDPPGFFCRRGAR

SEQ ID NO: 156827 - protein, 113 aa, Triticum aestivum
  unsure (1)..(113): unsure at all Xaa locations
  Clone ID: PAT_TA_51245.pep
PPAAVSQSASIPSXPSLLVAMARTSSPSTRDPLLPSLEGHRLVSLQAVPRLPSFPPRKDAQRDLVTPRYQQQSTPTKLNYLLHIQKKATPVDNQGTMTGSSSLRCKHLKEWSC

SEQ ID NO: 156828 - protein, 71 aa, Triticum aestivum
  Clone ID: PAT_TA_51246.pep
PGFYAGRFWPMWKLPMFGCPDPPQVFTELEEVKKEYPDGYVRIMGFANMRQVQWVSFIAFKPPGCEESGKA

SEQ ID NO: 156829 - protein, 45 aa, Triticum aestivum
  Clone ID: PAT_TA_51247.pep
NFVIILDVWEQKANDCLFAPWGILLINSCPSPGFFVHPLEFMFPF

SEQ ID NO: 156830 - protein, 117 aa, Triticum aestivum
  unsure (1)..(117): unsure at all Xaa locations
  Clone ID: PAT_TA_51248.pep
GAAACRAKGGTPPFNVEAVGPAXGIGQSVVAAXKMRPTRVADYTCYNVTNTPEVTRRXVHMDTMTAARGYLAQXQFEAALSGVYFVMIPAWLTRQPLMTRYDLFTRNAGTVLSICAR

SEQ ID NO: 156831 - protein, 37 aa, Triticum aestivum
  Clone ID: PAT_TA_51249.pep
FFCRPNSCALQMFHDAVSHVLDIASMLNTRCLIYTYA

SEQ ID NO: 156832 - protein, 96 aa, Triticum aestivum
  Clone ID: PAT_TA_51250.pep
EAKAMHMVRRWSAAPCCCCCCCSSRATDRLEGARRTPARRGGPQSSTAARTRSPTPGAGHAPPRSRAHGSRLGVCARVQQDSSRVCHGRVCGWVMT

SEQ ID NO: 156833 - protein, 197 aa, Triticum aestivum
  Clone ID: PAT_TA_51251.pep
LKSPISDTWWQTETGGFMITPLPGAWPQKPGSATFPFFGVQPVIVDEKGREMTGECSGYLCIKKSWPGAFRTLYGDKDRYETTYFKPFSGYYFSGDGCRRDEDGYHWLTGRVDDVINASGHRIGTAEVESALVSHPKCAEAAVVGIDHEVKGQGIYAFVTLVDGVPYSDDLRKSLIMAVRSQVFSSDSFLKCWLLLT

SEQ ID NO: 156834 - protein, 78 aa, Triticum aestivum
  unsure (1)..(78): unsure at all Xaa locations
  Clone ID: PAT_TA_51252.pep
MSCCGTNCGCGTACKCGNGCRGCNMYXAAEAAGATLLDSAXGTHKASSGGMEMAADNGGCGCTQCKCGTSCGCSCCSC

SEQ ID NO: 156835 - protein, 118 aa, Triticum aestivum
  unsure (1)..(118): unsure at all Xaa locations
  Clone ID: PAT_TA_51253.pep
ISGRRDGMVYVLYRTYFVVTLCSSLPKMLGMKEYIMCMAMKQINILGWTNSAPRYQISRFSMLILAXSLQLACPPSQGGGTMFCMCWLDVLTRVFLLRLLGAAVAASCTSNLCLKQHR

SEQ ID NO: 156836 - protein, 81 aa, Triticum aestivum
  unsure (1)..(81): unsure at all Xaa locations
  Clone ID: PAT_TA_51254.pep
TCPSRRVLHAIRSGMSARLSLVSLSPCRATTDVPGGGSADPYRPCQGGARGAPRFLCKRKNVQCXLMEADENNRDNMEIAG

SEQ ID NO: 156837 - protein, 177 aa, Triticum aestivum
  unsure (1)..(177): unsure at all Xaa locations
  Clone ID: PAT_TA_51255.pep
MAPTVMAXSGPPAPLLCQGLKSTAGLPVSRRSXGASLGSVSNGWKRXRCMQVWPIQGIKKLETLSYLPPLSTEALLKQVDYLIRSKWVPCLQFSKVGFILREHNASAGYYDGRHWTMWKLPMLGCTDATQVINEVEEVKKEYPDAYVRIIGFDNMRQVQCVSFIAFKPPSXEESGKA

SEQ ID NO: 156838 - protein, 93 aa, Triticum aestivum
  Clone ID: PAT_TA_51256.pep
MQSLYHLSEAPTEPRMSCCGRNCRCRTACKCGNGCGGCNMYPEAEDAGATLLVCGTATHKASSRRMEMAADNGGCGCTQCKCDTSCGCSCYSC

SEQ ID NO: 156839 - protein, 154 aa, Triticum aestivum
  Clone ID: PAT_TA_51257.pep
MSSGTSFASSQGTRSSRSAEDCPDLRAQMEKRRKRRKESNRESARRSRVRKQQHLDDLSSQVDQLKNQSQQMNMVLGMTTQNLVALQAQNSVMQTQKMELESRLCALGEIICCMNSITNTVNPTAAMGATASRSYDVFGAGSAWSQPIDLYQCF

SEQ ID NO: 156840 - protein, 91 aa, Triticum aestivum
  unsure (1)..(91): unsure at all Xaa locations
  Clone ID: PAT_TA_51258.pep
KHITIHSCTEMYRKIKSNGIKTLYLATLNIEKTGLSILINLRLIEERKLSXNITLNXPTNVLHVKQDVHSIYCANTPNSYISRTTGWDQYP

SEQ ID NO: 156841 - protein, 97 aa, Triticum aestivum
  Clone ID: PAT_TA_51259.pep
FTRTADGATSASSTTPSSPSIALRAHQVLQGPLQVVLSIEKQWMDATCTAILLSPLCPLKTVHSMSYLACNLCRASSYRWTLLLYPYNNNICRSDVC

SEQ ID NO: 156842 - protein, 58 aa, Triticum aestivum
  Clone ID: PAT_TA_51260.pep
CDHQEATRHNAGGQGAQLLLLHRKSCESRSSTAVRRCHITTSRLSTIYLHICSSFVLF

SEQ ID NO: 156843 - protein, 47 aa, Triticum aestivum
  Clone ID: PAT_TA_51261.pep
FIAREMENPIHKTHVYITIALIDNDINRMYVYMLRSILLRCSFLNSP

SEQ ID NO: 156844 - protein, 137 aa, Triticum aestivum
  unsure (1)..(137): unsure at all Xaa locations
  Clone ID: PAT_TA_51262.pep
AARPKPRHPAAAAAPPKGHRRTDRSCRPPRHLPDPRARSHQNAANRQIYSTMVRQRNHHDAAGPSTTILSGQATRTTPDPLLAAPTRSSMMPGKTAAAREQSHRRRHRKGFARRRTPAAAGEEREGGARCLVLLGRX

SEQ ID NO: 156845 - protein, 135 aa, Triticum aestivum
  Clone ID: PAT_TA_51263.pep
PWIKMSPYRASNQAEQIQGTEGTPSAWTGGGRGTPTSTRRTSTLAGPCRTMRGGTLPSSAAWSTEADNSCTASAFCMVGPVIYRGATPSDPQMLTEINLWDGAGVQDVITLRAAVHGERHPMLPPRRNGCAPRGA

SEQ ID NO: 156846 - protein, 84 aa, Triticum aestivum
  Clone ID: PAT_TA_51264.pep
REGIGEQAHPSRVILPTSTLGGSYVRRRHEIAGSRYSHMLVDCQIRGGDQLQAVISISYARLGTTGRLCSVLFCTNARMMMSSA

SEQ ID NO: 156847 - protein, 63 aa, Triticum aestivum
  Clone ID: PAT_TA_51265.pep
PHMTMREVRSLAQNIRSGRSICTAKQCIQRPPLRDQDGMRCLLRSTHSKREVYVFLQSLCVVC

SEQ ID NO: 156848 - protein, 74 aa, Triticum aestivum
  Clone ID: PAT_TA_51266.pep
NECKDIHGVILWQIGAFAAPDKIHWAPGLPKTRSGKFIRRILRKIASRQLDELGDTSTLADPGVVDQLISLSDS

SEQ ID NO: 156849 - protein, 86 aa, Triticum aestivum
  unsure (1)..(86): unsure at all Xaa locations
  Clone ID: PAT_TA_51267.pep
CGQTGENVGPLPGSLEXAVNSAYSRXMAFLGSFGPEELYLWKKVXTSWGQKFFSWKCXSGGIGSEWEKLTVIGASGMSGSYVEMRA

SEQ ID NO: 156850 - protein, 122 aa, Triticum aestivum
  Clone ID: PAT_TA_51268.pep
EFSKVGFIFRELNASLGYYDGRYWTMCKLPMFGCTHATQVINEVEEVKKEFPDAYVRIMGFNNMRQVQCVSFIAFNTTGMRGVPARPKQLTHDRQYIKSHCSFVTSHIALGFPSPFIFIICS

SEQ ID NO: 156851 - protein, 77 aa, Triticum aestivum
  unsure (1)..(77): unsure at all Xaa locations
  Clone ID: PAT_TA_51269.pep
YCCGGNCGWGTAXKCSNSCXGCNMLPEVEAAGATLLVLVSATHKASSGGMEMXALEQWLGXTQFKCGTRCGCSCCIC

SEQ ID NO: 156852 - protein, 128 aa, Triticum aestivum
  Clone ID: PAT_TA_51270.pep
CTTTCLTEVTMQQAIQGSVHGQKWPEKSRKRRFKHQIAPSQPNRQTHRLSKEKKNRRHSISFFSLEQRNIRMCVSWSLCVVLCAHCMQYVHSPTTAYADTPLFCSPIMKPSDLTARRSRSTGSLFSVG

SEQ ID NO: 156853 - protein, 54 aa, Triticum aestivum
  Clone ID: PAT_TA_51271.pep
GCPDTTQVISELKKVKMESLDAYVRIIVFNNMRQVQCFSFITFKPPAWEESGKP

SEQ ID NO: 156854 - protein, 81 aa, Triticum aestivum
  unsure (1)..(81): unsure at all Xaa locations
  Clone ID: PAT_TA_51272.pep
QKNQLFPVKPXTKVFKAIPLISDQGFGPLPVISGPQIIGMVSLGPLVGAVVTEPKEEFNRVNAFIQGGVLGPPVFQGVPFS

SEQ ID NO: 156855 - protein, 70 aa, Triticum aestivum
  Clone ID: PAT_TA_51273.pep
NNKRAQHDRCTGFARVLSAKDQKHMQSVGKSMENLCYISVEFTDYCIVTFLGPSWKLYDPADTGINHRRL

SEQ ID NO: 156856 - protein, 80 aa, Triticum aestivum
  Clone ID: PAT_TA_51274.pep
SAVCELRVLRRTTSASSPTRSSPDMPLVPHKESKVPYGVCLITSINVCMPLDLYFFLLTMAIGACSWQASLAVTSVGFPF

SEQ ID NO: 156857 - protein, 77 aa, Triticum aestivum
  Clone ID: PAT_TA_51275.pep
RPDNLCWHHGSRESQEEGRWRQSPRLFLVSRDSCHKCRTSDRCDSMLSHNINAVYFLARDPIQLLIRYVETQVNKQT

SEQ ID NO: 156858 - protein, 47 aa, Triticum aestivum; identical to SEQ ID NO: 156843
  Clone ID: PAT_TA_51276.pep

SEQ ID NO: 156859 - protein, 78 aa, Triticum aestivum
  Clone ID: PAT_TA_51277.pep
YNGRYWPMWNLPMFGCTNPPQVINEVEEVKKEFPHVYVPIIGFGNMRQVQWVSFIPFKPPGSQKYRQGLYSFLLPGHI

SEQ ID NO: 156860 - protein, 88 aa, Triticum aestivum
  Clone ID: PAT_TA_51278.pep
SHNGILFKTNQGRPGSLHPGTPLPAPEIIRTMSATTGHTKHHTAGHPGTPILSSLVTSARRRPPRRPGHRNYMVEHHDAEAVVHQRAH

SEQ ID NO: 156861 - protein, 73 aa, Triticum aestivum
  Clone ID: PAT_TA_51279.pep
AHLLSELACDQAGPCCWHEQSCIVGDCEVRAKVHQPKLYVGMIVILIFAQALSWNGLCMGIILSSPVDQSSTC

SEQ ID NO: 156862 - protein, 51 aa, Triticum aestivum
  Clone ID: PAT_TA_51280.pep
DPLDKTQDLHITPSPQPKAESPLQTFAPAVVAHVTKASFSCTTTDAQYASL

SEQ ID NO: 156863 - protein, 53 aa, Triticum aestivum
  Clone ID: PAT_TA_51281.pep
IFFCVGSNTSFIQYCTFSNHDLFICTGSVIKTYITMKPFVCDHAHLDTFAPSI

SEQ ID NO: 156864 - protein, 132 aa, Triticum aestivum
  unsure (1)..(132): unsure at all Xaa locations
  Clone ID: PAT_TA_51282.pep
SGGDQRGWGYAMTPGALFLCMAGWIGRVXQNYLIRRQAPSKKPAIREIMIDGELAARIIRRGFMXPVTTYRXLINGDLCGYNPTHWILRSVPYHARLDQQRQLTQPADDRGLVAVICVRLEYELKGSLRNGS

SEQ ID NO: 156865 - protein, 175 aa, Triticum aestivum
  unsure (1)..(175): unsure at all Xaa locations
  Clone ID: PAT_TA_51283.pep
HHARDTDSERDRCSNNRGWAPPPPPTPPTWQLPSNGLDXARSCFLGADGKEAAASRASFVERAEDPKTPIWFPGSTPPPXARGSLHRDLGFDPWGLRSYPKSLRWNMQAELVHCLWTILGTAMIFIPELLTKIRILNTPQRYTAGEQECLTDTTTPLIVELILIRXAEGRRLADI

SEQ ID NO: 156866 - protein, 95 aa, Triticum aestivum
  Clone ID: PAT_TA_51284.pep
HMRSVMPPSDVPGMLMCPHGGLGMEQQVFYGHSPTTIVNTQTWMILTATYDVWNENWGACNAKLCIAYAAARLADTSLISMARKSYGNETTNANG

SEQ ID NO: 156867 - protein, 139 aa, Triticum aestivum
  Clone ID: PAT_TA_51285.pep
TAAPGRRWPRRGSRTPPTRRARPGPARRAPSRWRRPAPTSRAPRRGPPRRGGARGGPPWRRPARWTAARRRRRRSPRSRGSRCTSPPPCRRPARRRWERLGLGWPALAQGGGRGGGMSRGRSWLAGGGCSPDADYTPRV

SEQ ID NO: 156868 - protein, 184 aa, Triticum aestivum
  Clone ID: PAT_TA_51286.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEE

SEQ ID NO: 156869 - protein, 65 aa, Triticum aestivum
  Clone ID: PAT_TA_51287.pep
RETGDNLTCKYEYRFIRIWIAYKRRDSLMSCKSLRISAVFILLDGFLGSKTNQVEVAKSDNGSNA

SEQ ID NO: 156870 - protein, 101 aa, Triticum aestivum
  unsure (1)..(101): unsure at all Xaa locations
  Clone ID: PAT_TA_51288.pep
MHLTIXYGAGLEFMLXKSCKVHKCGXSARSGEDKATIKALLYXMKYHLIKXAQRVFIKYDSVRPGVFVLINGFDWELCEVLHAPLGKHKHVVVLIATLPGG

SEQ ID NO: 156871 - protein, 33 aa, Triticum aestivum
  Clone ID: PAT_TA_51289.pep
VYVIRLPERPSHASFSRMFLNKSFHVNVGDHGL

SEQ ID NO: 156872 - protein, 62 aa, Triticum aestivum
  Clone ID: PAT_TA_51290.pep
VQFFHLARPYSGLRPVRGTCPLMHTARRLDPMRHVQGVYDGVLKPQCRVWYPSPLVLRRPVG

SEQ ID NO: 156873 - protein, 47 aa, Triticum aestivum
  Clone ID: PAT_TA_51291.pep
PASPTNITMVTSRPSTIIKTSSVLIRTNLLDEIYCSLARVRRCAHFL

SEQ ID NO: 156874 - protein, 74 aa, Triticum aestivum
  unsure (1)..(74): unsure at all Xaa locations
  Clone ID: PAT_TA_51292.pep
PRFIVTQDQRLWAKFITPGVLFLYITVWIGWVVPIYLIAVDXHNKVSMQEIITSVELASRIFTREFIWAVAASF

SEQ ID NO: 156875 - protein, 68 aa, Triticum aestivum
  Clone ID: PAT_TA_51293.pep
VGFYFTALSGSLSRMNLSLVHFQKLTGIPLHADHAPCEHSSECKLLPTFYSLCDPAVYLLRTDANAPL

SEQ ID NO: 156876 - protein, 114 aa, Triticum aestivum
  Clone ID: PAT_TA_51294.pep
AKLLQLQAERKLDKDQLASLSSEKSVQEYLKGERENITRIIKQMLVVGEIFKAENLQYSTDQLVKEVENSIEEFKRYNQDYDEGNIKQQVQDVLEAAKVLEWLKENCTIEYIKK

SEQ ID NO: 156877 - protein, 53 aa, Triticum aestivum
  Clone ID: PAT_TA_51295.pep
CTDATQVINEVEEVKKEYPDAYVRIIGFDNMRQVQCVSFIAFKPPGCEESGKA

SEQ ID NO: 156878 - protein, 147 aa, Triticum aestivum
  Clone ID: PAT_TA_51296.pep
LKFYMRGLTSLIKELVVRSNNQHRELWFLTQEELRGPGRRGGHAATSPLTIDPVEQRGGHGAELVKLAVGGGHPPLGLRRAGKRRLEADPGLPGERQQRARPVPRPGRRVAAHELQRRDGGGPVKDPERLQPVGRARVPLVARHRGG

SEQ ID NO: 156879 - protein, 85 aa, Triticum aestivum
  unsure (1)..(85): unsure at all Xaa locations
  Clone ID: PAT_TA_51297.pep
DGVWKEKIKGPLKVNCLVSGGERSRLIMRQKGTSRLILNASLXPYITLKYMHKKGVTFACINSMWEISEWAHHILTLKFKNSGIR

SEQ ID NO: 156880 - protein, 102 aa, Triticum aestivum
  Clone ID: PAT_TA_51298.pep
KPSPSPSFTFTVIVLMLFLSLLSLSEQMHMAPACTLSKEISLFPPHWPGSSSPMAGEVNLTPKVNIKPKPFFFFFSHSQCPHPCRWGTPTPMMILNSTRPHP

SEQ ID NO: 156881 - protein, 107 aa, Triticum aestivum
  Clone ID: PAT_TA_51299.pep
TCRFIYSARGKRSFFFLVSRVLRGGGKSWAKPSVSFLRGGGGLVSLVLGGPGPPFSFCFLLGGQQLFFKEVFWVCRGLLPRGWFCFHFGGRPCWGSALNGSRFFFSG

SEQ ID NO: 156882 - protein, 91 aa, Triticum aestivum
  unsure (1)..(91): unsure at all Xaa locations
  Clone ID: PAT_TA_51300.pep
RVDCQGEQQDQKSTNLMIRKLTVQRLFLXIAQDSKTGLXITVTRRAVPTEAGRAYXMACERHTNLCAIHARHMIIIPNDIHVQLHIHDERV

SEQ ID NO: 156883 - protein, 61 aa, Triticum aestivum
  unsure (1)..(61): unsure at all Xaa locations
  Clone ID: PAT_TA_51301.pep
MYKLYLLNQNLINDLYGEIIGTRFEGAAVXSIQFQAYVDAIGLQRFRECXAHYSRWAMLAT

SEQ ID NO: 156884 - protein, 87 aa, Triticum aestivum
  Clone ID: PAT_TA_51302.pep
SIKFPLVYQTRQDTNRRPEHQLQGEKAEPVHVDGAAVDATVFNGPQPQRQRRYLSYVGSSSALTRLICCLFISQRLDAEPCDCGLIR

SEQ ID NO: 156885 - protein, 176 aa, Triticum aestivum
  unsure (1)..(176): unsure at all Xaa locations
  Clone ID: PAT_TA_51303.pep
MGPTVMASSATFVTPFQGLKSTVGLPVSRRSNGASLGSVSNSGRIRCMQVWPIEGIKKFETLSYLPPVSTXEALLNQDHYLIRSKWXPCLQFIKGGFIXREHNASAVYYHGRYWTMWKLSMFXCTDSTQVINQVEEAKKEYPNSYVRIIXFYNMRQVQCVSFIAFKPPGCEESGKA

SEQ ID NO: 156886 - protein, 103 aa, Triticum aestivum
  Clone ID: PAT_TA_51304.pep
LRGIAFLVVPPRQIFGSVPSTTNESLWTCRGEWRTRLYVDSWTLTACACAPSYPVVFHTLCTDASHMHYQDARVVILVMQGVKSSCNRGLRCRCARKTGSAWH

SEQ ID NO: 156887 - protein, 127 aa, Triticum aestivum
  Clone ID: PAT_TA_51305.pep
MVLFSSFCIIEGPETIQDFIQMQSQEIQDNIKSRRSKIFLLMEEVRRLRVQQRIRAAESRCSSSEENEMPEMPSTIPFLPYTSPKTMKQLYLTSFSFISGIIIFGGLIAPILELKLGLGGTSYEDFI

SEQ ID NO: 156888 - protein, 82 aa, Triticum aestivum
  Clone ID: PAT_TA_51306.pep
TVHRVQRLQTASARTQDTEYVIAETAAMAAGGILRQLQHCPRGRGRRPARSSLMNWRRWMRSSSRQSLYYIALNLELLNLDR

SEQ ID NO: 156889 - protein, 56 aa, Triticum aestivum
  Clone ID: PAT_TA_51307.pep
VCVTLPSILFLIASSVMRSYGPPFYTLKPHIDYIKYSWTHSEIIMVKVNKYHFWLR

SEQ ID NO: 156890 - protein, 118 aa, Triticum aestivum
  Clone ID: PAT_TA_51308.pep
LVLAMSCTAVRTMSRRPREEEPSSPVSDDDVGSTATSSKRRPSSAARVPEAMEQREQAQKVALEALRNASATDNVVRIYKMFAEVSKAARPDAPAACFDGFLSFHQEAAQAVADIESI

SEQ ID NO: 156891 - protein, 89 aa, Triticum aestivum
  Clone ID: PAT_TA_51309.pep
AERRREPGAARGAEAARAGRAGLPRPRPLQAGPPPRRPREARRPLGRAVPAAHERRGRGGGAAQPASAPLFITAEQGGLLGGTVPGRPV

SEQ ID NO: 156892 - protein, 116 aa, Triticum aestivum
  Clone ID: PAT_TA_51310.pep
MTLLLNSNSLSGQLPANLGFSKLSYLALANNKLTGPIPPSIAHMKDSLLEMVLLNNQLSGCLPHELGMLTKTAVIDAGMNQLTGPIPSFFSCLSSIEQLNLAGNHLYGQVPDALCK

SEQ ID NO: 156893 - protein, 95 aa, Triticum aestivum
  Clone ID: PAT_TA_51311.pep
REELSWSMSRGATLHCLDCFFFLPCLHSIFMFAPDLLPETSNSVMISMKDGPLDGMASQYILGAFRCSPPEPISVGQPTRLDLIHQLGAAWNDVH

SEQ ID NO: 156894 - protein, 154 aa, Triticum aestivum
  unsure (1)..(154): unsure at all Xaa locations
  Clone ID: PAT_TA_51312.pep
QSTTINLASRSRLGALSSAAVSVPCLVAKWSPPACAGANTRWGCSRMLSKKADSAMEVEADNAMLLXGQAMAQDLLLGSNRGMRXFEPNDXKDKAGETITFKNNAGLPHNEEFXDEDSLPSCVDVFNISHKEYLNFSGETLSFILTGPGTYCLY

SEQ ID NO: 156895 - protein, 175 aa, Triticum aestivum
  Clone ID: PAT_TA_51313.pep
MAPTVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 156896 - protein, 164 aa, Triticum aestivum
  unsure (1)..(164): unsure at all Xaa locations
  Clone ID: PAT_TA_51314.pep
HPRVLGDSRRFGLLKFTRRNNGGQTKGMRVPALPCPDYLDSMLYVGXHGLHPLSLAEDPTDLRRIGHAELRNGRWAILWVSXMHDPGKLTNRTRLLHERTLXYYDAQETYLXSSWTLLVIEIILLHYVEIRQWTDIKNRSSVNQYPIFKSYSDEARRVLDTSVT

SEQ ID NO: 156897 - protein, 60 aa, Triticum aestivum
  unsure (1)..(60): unsure at all Xaa locations
  Clone ID: PAT_TA_51315.pep
REHKTLSRYYHGSHXRLEKRPMLGCKDATQGINDEEDDKREYVTRMLYYHIIHDAYEALR

SEQ ID NO: 156898 - protein, 82 aa, Triticum aestivum
  Clone ID: PAT_TA_51316.pep
RHTENLVKSYWATTHWNYSLGHSWWWIFETQRAGPQNGFLQTDHPPGRLTACKGGGGPGIPLLHSTPPPFYWAYTNGPLIVP

SEQ ID NO: 156899 - protein, 50 aa, Triticum aestivum
  Clone ID: PAT_TA_51317.pep
SPMDATSNRMGRSLDQGSFVVASKCVVIQSRSQCVMGPIHLRLDGIVNRS

SEQ ID NO: 156900 - protein, 153 aa, Triticum aestivum
  unsure (1)..(153): unsure at all Xaa locations
  Clone ID: PAT_TA_51318.pep
QRPRXRAVAAVHYGILEDVLSPSKIVGKRVSNXVDGAKVIGISLFPKEPTASEFEVNAFSAVFPRVCGKDVVXFEYPVTEPALRSHALGPRFRFFLTGMFWARSQLVVLALYSRFMGLLTMWGGAVWWGLSMNVFNVKVLSSFIIHLCSVILL

SEQ ID NO: 156901 - protein, 76 aa, Triticum aestivum
  Clone ID: PAT_TA_51319.pep
GIAIHELTKTAYFAPLVRRAQGAQDDYRYRNCYPDCPLCKHNPCLKHLILQKHAPHGPHCEANFIKLLELTSVLIL

SEQ ID NO: 156902 - protein, 80 aa, Triticum aestivum
  Clone ID: PAT_TA_51320.pep
RVIRKNKLGGMLLKIQHTKRTPTTLGASGQPKYQFPPQTNDVNRVGHLTLYEVLQVPGWRTDLFAHKGELDFLGGLGMTD

SEQ ID NO: 156903 - protein, 94 aa, Triticum aestivum
  Clone ID: PAT_TA_51321.pep
AHSTDVCPPKNCPHLQQLGRFCDSCNTRLEEDIEWNLRGKLVKILGTQKQLWECNACGKLLKVANKVWDYCLQVEILYAELFVGHYGFDSRRAT

SEQ ID NO: 156904 - protein, 65 aa, Triticum aestivum
  Clone ID: PAT_TA_51322.pep
RRCAKFLLIFMCTSLATAETRTWRFVQLCHSALPVGRLGLNSLSMSPGQTLPTMGWAHSQWGPTD

SEQ ID NO: 156905 - protein, 79 aa, Triticum aestivum
  Clone ID: PAT_TA_51323.pep
VKNVRQQEKNRCPYCHGTGYLPCARCSASKMLLGTKRFSLSTTERCSNCSGAGKVMCPTCLCTGMAMASEHDPRIDPFD

SEQ ID NO: 156906 - protein, 39 aa, Triticum aestivum
  Clone ID: PAT_TA_51324.pep
GSKAVEELTDELDKLYQKTRCDRGLLDQLESRTTSSRSR

SEQ ID NO: 156907 - protein, 75 aa, Triticum aestivum
  Clone ID: PAT_TA_51325.pep
QGTNPCLLNNQPCHIITHTLSLLSKREARFILPNSHLGHPKCISTLLRVTREQVLSNTSRCTYLAKRIYRLPFQI

SEQ ID NO: 156908 - protein, 44 aa, Triticum aestivum
  Clone ID: PAT_TA_51326.pep
AQVPLVVFLGGGPKKKGGQFKVAAGQSGKGSICGQNLNCNLFNC

SEQ ID NO: 156909 - protein, 182 aa, Triticum aestivum
  Clone ID: PAT_TA_51327.pep
MAAAAATSDVLAEAEATPAPNVLQEIAQNRATTPGRRRGLLGFGSVSKSVSFAPGTLQDPSSRPDGAARSSSASRKCLDKTPVGDGDDKSKRSSAPAAVAVGNSPLGSSLRMAKQMQAEAGSWFMEFLEAALEAGLKKKRTSSSTGKGATAAQGCPQSLVLRVINWVEMEQSGGESRKAGHP

SEQ ID NO: 156910 - protein, 106 aa, Triticum aestivum
  unsure (1)..(106): unsure at all Xaa locations
  Clone ID: PAT_TA_51328.pep
TPNPPLGFSRLKKLAFFNQNFFSTETGPGAPPFGKTAPPTPGEWAPRGGPPPPWGPPLGPRAPPGXPPPGPPLGGNHHPTMPPPTGEVTPSPPPKKPPGPGGRPKP

SEQ ID NO: 156911 - protein, 81 aa, Triticum aestivum
  unsure (1)..(81): unsure at all Xaa locations
  Clone ID: PAT_TA_51329.pep
QYGHMLVQDXDNLKRVRRANTYMSQAGLGYANQDVIKSGAFSEGKGAQLGTLPVPSECTDHTAKNFDPASRSDYHICLYAF

SEQ ID NO: 156912 - protein, 80 aa, Triticum aestivum
  unsure (1)..(80): unsure at all Xaa locations
  Clone ID: PAT_TA_51330.pep
KSYSLPRYEXGYSGRVFNPLMFAPTLENKEKELANGSQKKLAFVEFLVQHNVTGKGPLXNMQQPLDDPGHNTIIQAISGQ

SEQ ID NO: 156913 - protein, 68 aa, Triticum aestivum
  Clone ID: PAT_TA_51331.pep
ASFSPTSPIIGCYEDGEQGYHSVTLSTLGYFFCTYMHVRDMYMDILMKLQGHVVSYGIGLVSMAYYSS

SEQ ID NO: 156914 - protein, 85 aa, Triticum aestivum
  Clone ID: PAT_TA_51332.pep
PVSSVPKACRSWHPLCWKCRASQAISCPPCQDRSTGSQFLKLRVPCALSTCYSCWCLPCRISSVRNGISKGFLLIDSVGYRVCSL

SEQ ID NO: 156915 - protein, 151 aa, Triticum aestivum
  Clone ID: PAT_TA_51333.pep
GRVGGQTDGCAAAFCASWAASARAEDRAAARRPMAAAAEPRDTVFAAGRCHAGHRTLATAAAVRYAPGRLIEKYAGPECILRHAGAVVHGRLGVQRWEQPGRRMSPLREEPSRGKRRPGHGLLPKFALDDIKNDALEVSITKSELNHLIDV

SEQ ID NO: 156916 - protein, 60 aa, Triticum aestivum
  unsure (1)..(60): unsure at all Xaa locations
  Clone ID: PAT_TA_51334.pep
DAWXKKKKGGKKKKKRRTNLGGPAYMLRALQTHSVASSDIYNHFTWPSYLQTPVLQKPSL

SEQ ID NO: 156917 - protein, 51 aa, Triticum aestivum
  unsure (1)..(51): unsure at all Xaa locations
  Clone ID: PAT_TA_51335.pep
MQAVAPIFSLIAPKFQFKGANKRGIPXVSRDPAALLAKYSDPLVYTXPIRV

SEQ ID NO: 156918 - protein, 156 aa, Triticum aestivum
  unsure (1)..(156): unsure at all Xaa locations
  Clone ID: PAT_TA_51336.pep
NRRPSPAERAWRRKTESRSVWSNLLYRQQGGLSIFFGKAEQNGEVNSKSQLAPLRDTPFALRGALGRSSSYLEQATGYTCSPLAALLPRMTSTTANGLLHSSCPLSSPVTNRPMSPHLPLKKPQLSATLXSRHRIFGAELGDAIVSAPLDTKFSLM

SEQ ID NO: 156919 - protein, 111 aa, Triticum aestivum
  unsure (1)..(111): unsure at all Xaa locations
  Clone ID: PAT_TA_51337.pep
MMAGTMATTVVPEVVLAALLVAMLEAAIYWGNANCDVNSCLSYXKCNANGTAASWSGACWRLVRLSGSSARKNARWKCINRGVKRANRGLDPRMASKFRFKSRYCISYSMD

SEQ ID NO: 156920 - protein, 78 aa, Triticum aestivum
  unsure (1)..(78): unsure at all Xaa locations
  Clone ID: PAT_TA_51338.pep
PVDATHYHNLEERPYLNGLRHFLICGEVPYMGSRATGQIHAAMNLIAAPHPSKFELXTIRGDLTCAGGKNSVTYIAYP

SEQ ID NO: 156921 - protein, 108 aa, Triticum aestivum
  Clone ID: PAT_TA_51339.pep
LPCWMDASVTTGGLLPMPSDQRRPARLPPDQTPRSQIPQRESECSGAYTWGPTEAARATRHCFAYTPRCWTFSYKGSSTCYEAVSACSREIKDSYVIRELTLPRDDYI

SEQ ID NO: 156922 - protein, 80 aa, Triticum aestivum
  Clone ID: PAT_TA_51340.pep
QEASTEATHVTVCTRKVVIQVGSRLHVRWTRQLLCCIYITQVVVYKSFAALHLSHVSESQWLVLLQIRTSCISGCSGIYV

SEQ ID NO: 156923 - protein, 73 aa, Triticum aestivum
  Clone ID: PAT_TA_51341.pep
RSRSPHVSRHYALDHLVKFKLLSHACIFVYICNNCASICRCVFFIMLYVQKDTCSYTKMGFDRRLRGRKGLPL

SEQ ID NO: 156924 - protein, 123 aa, Triticum aestivum
  Clone ID: PAT_TA_51342.pep
HPNLNPFYVPCLTQERSSRSKRDRRCPSRRAPRRTTSRSRRTGAPSRNASTSARPRTQADAAAVHQQALGTQCSRTPRLLRSSLSNKVDQFCVGESFSCTCRLSCLDFNPVVCMCKRMHMSPA

SEQ ID NO: 156925 - protein, 53 aa, Triticum aestivum
  Clone ID: PAT_TA_51343.pep
PYPFLDLSSNLAPLWYFAVAFMQLPCYLIFRLVMNLKHHLLAKHFPDSMVLGY

SEQ ID NO: 156926 - protein, 95 aa, Triticum aestivum
  Clone ID: PAT_TA_51344.pep
HGFTSALFAGSYLGPTLAGCEAYQRLAETEPEGVPGSKSYRVKMAHGYKATNKKRQEPGSPKSEATKNKGEAQKVRFGDGKPGRPETLMARATNE

SEQ ID NO: 156927 - protein, 118 aa, Triticum aestivum
  unsure (1)..(118): unsure at all Xaa locations
  Clone ID: PAT_TA_51345.pep
MYKYYSKTQLAPLRDTPFAXRGASGSSSSYLEQARGYTSSPLAALRPKMSSTTGNXLLHFSCPLSSPVTYRPLLPHLRVKKPQFSETFSISPRTFGVALGDAIGSVPLATKFSLMFGV

SEQ ID NO: 156928 - protein, 96 aa, Triticum aestivum
  Clone ID: PAT_TA_51346.pep
RPGLGDHRWPLVTHFVGCKPCGEPDATYDVVACREGMECALNFADDQILGLYGFQHESLSTTAVWRVRNDTGQPLDADDQEIGRLLHPEFRAANIN

SEQ ID NO: 156929 - protein, 72 aa, Triticum aestivum
  Clone ID: PAT_TA_51347.pep
ILLSPSKQAPEGDSMHGTLQLLRARSIIFKVQTNNGYFFRPYCIISRQGQGPHRLRGGPGTGVIALCHGAKG

SEQ ID NO: 156930 - protein, 126 aa, Triticum aestivum
  Clone ID: PAT_TA_51348.pep
WGYEANMFLSFHCLKNVPMWGLIWGAPFFGGWVIFLSSWGSRFFSLKTGCLSPPFFLRWFLPWAPPGFPFFVSAFLFFGFFIGVPFSPRGWIFPFFLRCFIRPSFGAIGSPPGAGAGFPVLPPALV

SEQ ID NO: 156931 - protein, 69 aa, Triticum aestivum
  Clone ID: PAT_TA_51349.pep
EAIKCPIWGLRMSGALQDLGVTRKESKKECPYAYGGLKNSGNLRHEHCARFKTVRPSGCEQSCQNVNNE

SEQ ID NO: 156932 - protein, 100 aa, Triticum aestivum
  Clone ID: PAT_TA_51350.pep
GQCRGNQQDPNANTTVGPMDPGSSTSLDSHYLVTLKGGQGVFPSEGTVVTKARAAGLVDKLQDKGVFFAHFKNSIKGMGQMGVLPGARGQIRNKCKVVNS

SEQ ID NO: 156933 - protein, 75 aa, Triticum aestivum
  Clone ID: PAT_TA_51351.pep
TRERVALIENHPQGITRPVPSSTLYNLWNARNVRTRTGRDEASHHPLPETLSKRWGSLSSLTSLSFLWPSFFYGG

SEQ ID NO: 156934 - protein, 101 aa, Triticum aestivum
  Clone ID: PAT_TA_51352.pep
GPPERPSLSVFRSTKHLYAQVIADPKSCPLASASPMPKALSKELGFSVGPPPEVAPKFGEVFAKSCLEKGIPQVVFARGGFLSHGRLKALPDAARETGLEF

SEQ ID NO: 156935 - protein, 78 aa, Triticum aestivum; identical to SEQ ID NO: 106977
  Clone ID: PAT_TA_51353.pep

SEQ ID NO: 156936 - protein, 48 aa, Triticum aestivum
  unsure (1)..(48): unsure at all Xaa locations
  Clone ID: PAT_TA_51354.pep
TVXXFDNAGAMMSVDDTLMCSFQILKPARKMMGGSTNNKSGFKSFRGW

SEQ ID NO: 156937 - protein, 93 aa, Triticum aestivum
  Clone ID: PAT_TA_51355.pep
TPRVRPRVRPRVRSSSVAGMPPMGRQMPPSQTSDRRGGSSASNTRKDEYNWGYDADDLSEEVLRTSTALENIQLDRKARNLTTSWRHPGNGAE

SEQ ID NO: 156938 - protein, 151 aa, Triticum aestivum
  Clone ID: PAT_TA_51356.pep
APFPRNGRRFWIFHFGEGVNGGYVPVPWGSPAPAFVSGVFQSGAGGFSFPGVVPVLPNLQADVFPGDVVGFTPPRLPVAGVPALVARNLVRGLGAQFFNFAVPVRPGAPPKGFFPAPWWLVLVPAPLSVVPRFCLPFFFFFSNPAAKKNFS

SEQ ID NO: 156939 - protein, 61 aa, Triticum aestivum
  Clone ID: PAT_TA_51357.pep
THNPNRGARKKRPKTTAPAAPSASAAPTTAAPAAAARSLIIDQAGTGGAASIKSIHNHQTR

SEQ ID NO: 156940 - protein, 141 aa, Triticum aestivum
  Clone ID: PAT_TA_51358.pep
PPLSLRGLSFPPQKGALRWAPHFPPANHPWVLCLGNYRPPGPGIFLNLILSLCHFVSLGVCKHPLFFGRGRFNFNFNRFFFFGRFFWPGRGFLTGAPLNCFPVPLLFGGKIPPLFYIWTACGEGKTPPRVMPLGPGGGFFF

SEQ ID NO: 156941 - protein, 51 aa, Triticum aestivum
  Clone ID: PAT_TA_51359.pep
ASQTQGRITDSGWPCEFNHDHLSFHACDSSIIIGLIISAVTVVPVVDPWEQ

SEQ ID NO: 156942 - protein, 95 aa, Triticum aestivum
  Clone ID: PAT_TA_51360.pep
GEKGDAGAMTRGDQTIKSTNQRRKPARKMKGGTTNNKTGDKSNRGGRQRPDGGHAAYDRGNITQRLQRTGIGICAETSLALEGQSRSRTVHQPSG

SEQ ID NO: 156943 - protein, 107 aa, Triticum aestivum
  Clone ID: PAT_TA_51361.pep
DAMQVALKMVALVYHPTGRYALESCLASSGLASSIFFFSHLYDHQSAFIIVNHSSRCTMHSELMFFGCLFFLRSTEIWLEARIWEVRLTLFWFFFQDRVVNPVKFRS

SEQ ID NO: 156944 - protein, 157 aa, Triticum aestivum
  unsure (1)..(157): unsure at all Xaa locations
  Clone ID: PAT_TA_51362.pep
MACAVAPGSPVFSPSRLGLLQQLEQQLHHHHHHGCSSSGASFLPSSPLRPFAHLRARIHPDPSPCAAPPLPAVKAEDSSSVAPAKAPVKRRRPAPLLVPAAVTVAPAVLEAAAASXVDEVAEQGDGFAAFCRRGKGRKRVEMEDRHVAAVALGGDRA

SEQ ID NO: 156945 - protein, 78 aa, Triticum aestivum
  Clone ID: PAT_TA_51363.pep
SRSRTSLEIPLSPPAKSEKSKAPRARSLVKSPSSMMLLSYLNNAHTSQGSNLHQKANGSPHKLRSKSPLPPCQSGPTP

SEQ ID NO: 156946 - protein, 72 aa, Triticum aestivum
  Clone ID: PAT_TA_51364.pep
PRGPGYFFFVELSFRACVVGGNFLVLLGEGRRGSRVLLCVCQVLPPGIPFSFRGMNKLKRGFLEGFKGGPPP

SEQ ID NO: 156947 - protein, 125 aa, Triticum aestivum
  Clone ID: PAT_TA_51365.pep
VVCLTQIIGAERGLYPGAAAYGTSLGAVHQLVRLSAMELGKHKIRVNAVCRGLHLGDKFPVSVGEEKAEKATGEVMPLRRWLDPEKDLASTVLYLVGDESRFMTGTTIYVDGAQSIVRPRMRSFL

SEQ ID NO: 156948 - protein, 50 aa, Triticum aestivum
  Clone ID: PAT_TA_51366.pep
PKRSGRTASSLAYEEPTLSTYIVILIPKASTRTLLSYICCSIDAATRMLV

SEQ ID NO: 156949 - protein, 70 aa, Triticum aestivum
  unsure (1)..(70): unsure at all Xaa locations
  Clone ID: PAT_TA_51367.pep
FHLKSFHNASXDSAFYSVCPLGAIPASQGLLRFXASLFVEXATHISVLGPTDARSRLVYDGFLGTIFAVS

SEQ ID NO: 156950 - protein, 133 aa, Triticum aestivum
  Clone ID: PAT_TA_51368.pep
NGRGRQWPTREGFPNAPLVQGPPLKSSSAPHFFQVPRIFIAYQCPPKETKPSKLEIGLPECMFLPSIVFVPRSWPCLFLMYFSIQAPNVTLRFAFCHLCRIVTTRPMLFTPFLFLSTLFYLYIPKSVFAPRFP

SEQ ID NO: 156951 - protein, 193 aa, Triticum aestivum
  Clone ID: PAT_TA_51369.pep
SVYQSALIVTGILGHEMLSTSGLKIRTWANVPRGSGLGTSSILAAAVVKCLFQLMEDDGGDDNVARAVLVVEQIMGTGGGWQDQIGGLYPGIKCTQSFPGQPLRLQVVPLLASPQLIQELEQRLLVVFTGQVRLAHRVLEKVVTRYLRRDSLLISSIRRLAELARAGREALMNGEVDELGGIMLEAWGLHQEL

SEQ ID NO: 156952 - protein, 161 aa, Triticum aestivum; identical to SEQ ID NO: 129051
  Clone ID: PAT_TA_51370.pep

SEQ ID NO: 156953 - protein, 82 aa, Triticum aestivum
  unsure (1)..(82): unsure at all Xaa locations
  Clone ID: PAT_TA_51371.pep
GLGKWQENFVSSQXRRXGGRSGYAGRTGGSGRGGGYQNDRSGQGSRGGYGGGGSRFHDGRARTQSGMPSRGDRGARLVSLSR

SEQ ID NO: 156954 - protein, 65 aa, Triticum aestivum
  unsure (1)..(65): unsure at all Xaa locations
  Clone ID: PAT_TA_51372.pep
ETLKRAAFFFFFFFWFRALPTIXSSRHLSGSHWSRFCCPSVLWSICWLFFVXASPFGGGVRPMRV

SEQ ID NO: 156955 - protein, 75 aa, Triticum aestivum
  unsure (1)..(75): unsure at all Xaa locations
  Clone ID: PAT_TA_51373.pep
LKRAAPXFFFFFFFFFFFFFFFFFFFFFFFFFFFFFFFFFFXQSRLGCRSSIPAQELGKSVRTIAVLSQPADFLQ

SEQ ID NO: 156956 - protein, 31 aa, Triticum aestivum
  unsure (1)..(31): unsure at all Xaa locations
  Clone ID: PAT_TA_51374.pep
LXPXEXTQFGLISLISALMDFQFSNNVSKSG

SEQ ID NO: 156957 - protein, 172 aa, Triticum aestivum
  Clone ID: PAT_TA_51375.pep
PHRPRRRGRASACTRRRRGRRAGAALHGTTPTTTPGSCVPGPAAPASTPPPSSPASPRSPTPPPPPRVPRRLRLPRHPPAARPALPRLRRTTPIPRRRSTSTVAATKSDLAAASTSAASSRSRPPPAPSRCQRRQNRRGGGTASSACSARGRRSMWAGAPTACAPTWMRIRV

SEQ ID NO: 156958 - protein, 192 aa, Triticum aestivum
  Clone ID: PAT_TA_51376.pep
ASYRALLRTDQLRRGGIAPALSPAVPESVAVLERDLPMIDLKRLTSGDAGERKACADAMARAASEWGFFQVINHGVGRELLEEMRREQARLFRLPFDTKEKAGLLNGSYRWGNPTATSLRHLSWSEAFHVPLASISREDCDYGKLSSLRAVMQEVADAMSRVADTVAAALAEDLGHDAWGGEPAFPAGCDGT

SEQ ID NO: 156959 - protein, 166 aa, Triticum aestivum
  Clone ID: PAT_TA_51377.pep
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVRYRLDGAKVIKIYLDPKERNNTEYK

SEQ ID NO: 156960 - protein, 58 aa, Triticum aestivum
  Clone ID: PAT_TA_51378.pep
GAPNLCFLGFSAVTIPSCFCLGFFSAKNQLVGFTRRSFGPICPPPCAGILGRPPRLLC

SEQ ID NO: 156961 - protein, 61 aa, Triticum aestivum
  Clone ID: PAT_TA_51379.pep
RSWPRTNSSSGPTRRTVLPTVSTARRRRLLIGHQGSAAASPRTPGGVSSLLFCFKLFPALH

SEQ ID NO: 156962 - protein, 91 aa, Triticum aestivum
  Clone ID: PAT_TA_51380.pep
FQEWSTNRYKSVEHKVVANAKAERLSVAYFLCPSYDSLVGTCGEPSPYRPFTFGEYRRKVQDDVKRTGKKIGLPNFLKQSPVDAMNHSLCT

SEQ ID NO: 156963 - protein, 101 aa, Triticum aestivum
  Clone ID: PAT_TA_51381.pep
KFQRSPCNLPKGPLGAGGGPHSGPSHSRSTPNSPAPGPSPLGPSGSSPRLAVNIALELPCLPYCFKAWRKRFGRPLALGFGGAAALLAGCPPGAPRLTPLS

SEQ ID NO: 156964 - protein, 120 aa, Triticum aestivum
  Clone ID: PAT_TA_51382.pep
EGYLIFLGDYSAFDMGAILQGGGGLLLKGLWRLLFLLEGDFRLCLGCCSVLGKPASPFIVEGGVREPSLFYSYGKAFWSEDKDVFTRTAGSFSLFAFRPPQLLVTCIAAFSASLLTFCLD

SEQ ID NO: 156965 - protein, 96 aa, Triticum aestivum
  unsure (1)..(96): unsure at all Xaa locations
  Clone ID: PAT_TA_51383.pep
MATARTGIKCTELVAWXAVTPISITEVDVEAADXMDVQVKILYTILCHTYVYFWEDNEQTPXSSRILGHDAGSIVVSEQHGLTKLEPIDHILPCVH

SEQ ID NO: 156966 - protein, 131 aa, Triticum aestivum
  Clone ID: PAT_TA_51384.pep
ETQVLKEKRIPRSITSSGVAGIYFFKEEMKEWTGMRVGESNGESNAVLNVGNGKVTANGFHKAGNGGKGASSTGVDPASSTGVDPASSTGVDPASSTAVAPASSTAVAPASPTGVAPGVTGAQVGGEPKVE

SEQ ID NO: 156967 - protein, 67 aa, Triticum aestivum
  Clone ID: PAT_TA_51385.pep
FLSVECWTHPMLMFQTNNDKSGVERNVGLCQGVQLTFGHENGGTTRIKMHRFCKISRGVGQSPCWIM

SEQ ID NO: 156968 - protein, 191 aa, Triticum aestivum
  unsure (1)..(191): unsure at all Xaa locations
  Clone ID: PAT_TA_51386.pep
NIAXKHIVAAQREKVKDAMTVLTTSTKSDNSKLGVSDTKXMILEPPSFLKGTMXEKIVEFILRNGKEFEQKLIEQDRMTGRFPFLLPSNPYHSYYLKMLQETQEFKSRGGSSEHKDRRSSSERQDWRSSSERRDRRSSERKDRRSMDRKDRSSSDLRDSGHDKGRXSANKDSSTSDRSSAEPSQKQLSDKQ

SEQ ID NO: 156969 - protein, 198 aa, Triticum aestivum
  Clone ID: PAT_TA_51387.pep
SSRQVREEEESGGEEVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQG

SEQ ID NO: 156970 - protein, 169 aa, Triticum aestivum
  Clone ID: PAT_TA_51388.pep
GKANRSRRGAEPSCRRAAPAPHFPPVIRPWHLSSSRPATRTSPGPSLTWGSLSDRWALCCLTLLEEYDGAGTAIAKHLIYQIGGIYLIVRRVWVLHQPWASYPKGRCTAWHLREFFCVCTQTTYMHDTISLLLTRILVQCLHKLHNPLDVPYDFKDRKHPYTLISLRPA

SEQ ID NO: 156971 - protein, 104 aa, Triticum aestivum
  unsure (1)..(104): unsure at all Xaa locations
  Clone ID: PAT_TA_51389.pep
LFKKXMLELDALSHFHFAPKPVIEDMSIQVNIPALAMEEVAPVAVSDAAMLAPEEVFEGKGDIKEDVELTQAERKRRRANKKRRYAESHKERPAKLRKENSSNI

SEQ ID NO: 156972 - protein, 169 aa, Triticum aestivum
  unsure (1)..(169): unsure at all Xaa locations
  Clone ID: PAT_TA_51390.pep
AEGGGDHEGVYDQAVXKVVDIVDTFRIQXEVPAFDKKQFIFHMQXGSIILSAKIGGDALDAFLKYVXRHMSIFLVSSRTFSFLLDXSRHYDAGVVFAYFKEGSAGPTFLCFVHGLQRGLVLIALYVKIYPVCRIFAVFYGCQSSLQCWCQILAYVECLKNINNKCGIDL

SEQ ID NO: 156973 - protein, 92 aa, Triticum aestivum
  Clone ID: PAT_TA_51391.pep
SPALFQSPGIPIPRFFFLGAPPQPRGGKALFSSSSFGGPPQNAPPPGVIFSLLNPWVPPGGFSPRGVFCFFSLPRRVVGPCPKVFGFFLNRF

SEQ ID NO: 156974 - protein, 165 aa, Triticum aestivum
  Clone ID: PAT_TA_51392.pep
KAEDLLDEHEYNILKREAENGKDHSLEHASSSDAIMKHMRTVSSRLSNMRPKNKKLFDQLKELKAILAKVKDFRDLLCLPAGNGVEASAVLTSVIPVATSIGLPRVIGRDKDRDDIIDLLTKPIAVESGTRRYSGLAIVGLGGMGKSTLAQHVYNDKRVEDHFDV

SEQ ID NO: 156975 - protein, 65 aa, Triticum aestivum
  Clone ID: PAT_TA_51393.pep
PPYAEDAGRICTYFNDYPFSSFSSGRAKTVDSPDNYAWIEAINSPVYINMRPGMYTGPTVQDRLS

SEQ ID NO: 156976 - protein, 122 aa, Triticum aestivum
  Clone ID: PAT_TA_51394.pep
VVAPLTGNEMHHNSLKFMQALCGSVPLVHIEDVCEAHLFCMDQPSVAGRFLCAVGYPNMEDYLARFAARYPEHKILLKKVAGEGVRVKGDSSKLVDLGFRFKYGVEETLDCSVECAKRMGEL

SEQ ID NO: 156977 - protein, 115 aa, Triticum aestivum
  Clone ID: PAT_TA_51395.pep
THSRAGNPLGKLIGNFIQAFVKEHSGTLYIHKPGHRSDQSKAQARPCPSPSSTPCVSYGTYWTQNTPALGEEPGDARTQQLHMVKLAPGAGRPLGGPGPFEHHANNPRAPGKVTL

SEQ ID NO: 156978 - protein, 115 aa, Triticum aestivum
  Clone ID: PAT_TA_51396.pep
GGLFGRYSGPRETLGFGLAWFFPPGLMPLGGQLFSLGRGFSFSVFCRKWSGGGPVVPSGFVPGDGKTGFVLKLIFGLDWNLDSLDRVPLVSFRGYEGVLFSFGSWFELCPPTAGD

SEQ ID NO: 156979 - protein, 116 aa, Triticum aestivum
  Clone ID: PAT_TA_51397.pep
EKPKNRYRPPGQGGPQKKRLHKKTKKGTGRTGGCPRGAGAGQKKGPKKTRMGKPNMRKGKCPKNPPRPGSPKLIGDPMFCPPEGGPSKNLGRFSALNNGGALGKGPKARGGKKKLH

SEQ ID NO: 156980 - protein, 59 aa, Triticum aestivum
  Clone ID: PAT_TA_51398.pep
INNSRRDGKPDRVSFFIQVVVWEWPWHKLRRLLASRIHYFIVQDGQRSAFLIFPSGQNA

SEQ ID NO: 156981 - protein, 111 aa, Triticum aestivum
  unsure (1)..(111): unsure at all Xaa locations
  Clone ID: PAT_TA_51399.pep
YHAFLACGAFIKHFPRLLGPGFNKAGKFPPLVSPRESLESKVIEPRAPVXFQLKKVLCLGVPVAPLGMEEKQFFQKVQISVNFLVSLLKKNWQTVKCLYLKSPMGKVYRLF

SEQ ID NO: 156982 - protein, 70 aa, Triticum aestivum
  Clone ID: PAT_TA_51400.pep
VKPIPHIPIGPSRRVCQLYSASLGRAGKSLAIYRRQGLGIISCMFGAYDEHIMLRFCCSVIGIAVIVFVH

SEQ ID NO: 156983 - protein, 75 aa, Triticum aestivum
  Clone ID: PAT_TA_51401.pep
AGQQRRVRSPTRIGGDDGPLLFFFSKDGPPYDPRPPPPLALPLFVVGLSPRAPIASRHGSRGSCFERALATQLTN

SEQ ID NO: 156984 - protein, 196 aa, Triticum aestivum
  unsure (1)..(196): unsure at all Xaa locations
  Clone ID: PAT_TA_51402.pep
XHLTCDFPRLLHASDEAYEPMKRYFGQTRVPDYWWFVRGVEGVTGVLMVVLMAVAYTLAHPRFRRSKLGAXNPLQEASADFNMFWYSHHLFVVVYVALVVHGVCLYINRTWYKQTTWMYLAVPVLLYAGERLLRALRSHGLTTVRIEKVAVYPGNVIAIHMSKPHGFRYRSGQYIYVNCGEVSPFEWHPFTITSAP

SEQ ID NO: 156985 - protein, 82 aa, Triticum aestivum
  Clone ID: PAT_TA_51403.pep
MADIAMLVADEAFEKRLQRGAPFAGAGEEASKGRENFGAVTKVWGSWASGVKVRVALLVKADMVAEPKTPVALAAFDGFFSA

SEQ ID NO: 156986 - protein, 73 aa, Triticum aestivum
  Clone ID: PAT_TA_51404.pep
LAPFLKRGNWKNLGFPKFNGFEKNPLFPSWGNRKKAPTNRLSKNLPTLNGKWNPPFRGLLNPGVVLFPPSVTF

SEQ ID NO: 156987 - protein, 130 aa, Triticum aestivum
  Clone ID: PAT_TA_51405.pep
IWPSAPITGARLASLGGWGWRWNTRCLLTTGCSALALSVCVCLFHTDGERGRCLGLNGPVVLGIWCSTFKTPCSCCSVSCWCICMGWRALGSPYTMVLLPLRRFLSYAISKSARNYPGGVRSLRSEITSL

SEQ ID NO: 156988 - protein, 50 aa, Triticum aestivum
  Clone ID: PAT_TA_51406.pep
SRGPPFFFFFFFFFFFFFFFFFFFWFFFFFFFFFFFFLKKKRGDLKREGY

SEQ ID NO: 156989 - protein, 117 aa, Triticum aestivum
  Clone ID: PAT_TA_51407.pep
CAGLVAVAAVSAAVTLATVRLYRGLESDFRKKIRLQEHGESTARACMHAARSPVLIWQELVLLVRSIGSGGQIQMAGGVRPATGKKKVRFADDVVEPSSNNDEYRRRRRRLVAGQTS

SEQ ID NO: 156990 - protein, 140 aa, Triticum aestivum
  Clone ID: PAT_TA_51408.pep
GRGSKHIWGLHTPFTNAPLGEKTPNRKERERPESFNTANQKGPPISSNQGGPQQTRGTPLGSFSSSDRRGRPALPTTAPLPLAAWEEEEVRNPGTARGPGTTARGKNKRSPYPQGHTPAWSLSASTAAMLVATIIDPLFL

SEQ ID NO: 156991 - protein, 165 aa, Triticum aestivum
  Clone ID: PAT_TA_51409.pep
RVSMSIVLPPARKYVARDINFELNTIFSYILIQFKSWLSAPPFPSRSPPSRRHLHSSPPAPGLCSSPQIQAFAPPCRPPQALPQGARRPLLLLASSRHGGAPGELLACGSSSKGHLAALVSSHSLPRLQELQGRGPPPKRLHRTNQHECTTSKPPTSLSTQESPK

SEQ ID NO: 156992 - protein, 121 aa, Triticum aestivum
  Clone ID: PAT_TA_51410.pep
VTNVVADVYTMINLTRYILTTISWFKFEFTRDPFGSNVVVIDMLIGLVIQVDTQWLRLCSEPCLCERTKKRKACCTYPTLTVIISPLWYFKSDKEYISCLRHEIWSLGSDMYGPPFILSCC

SEQ ID NO: 156993 - protein, 55 aa, Triticum aestivum
  Clone ID: PAT_TA_51411.pep
PCWRDVFKRVACDHQGQRVGVFYCGDQKLTPELRRLSQDFSHRTTTKFVFHKENF

SEQ ID NO: 156994 - protein, 82 aa, Triticum aestivum
  Clone ID: PAT_TA_51412.pep
GPVRLVRPLPLPDEGQVEKEKDGEAQKEAPKIEAAIQVRGPPRRRLNLVSLPQSVGMTGFFWFLICLGCFDVLGMPPLVTWG

SEQ ID NO: 156995 - protein, 103 aa, Triticum aestivum
  Clone ID: PAT_TA_51413.pep
MQGGKSSSAVGAAKEAVANVGTSAWASKEKTMAVVQETVNKAKAHDPAAKAEAEARKQERIHEAEAAKRDAMRHNAAAKEHATAASYHPTTGAGVDARDEVEG

SEQ ID NO: 156996 - protein, 66 aa, Triticum aestivum
  Clone ID: PAT_TA_51414.pep
QDQQRHHHHHHHRGGHHHRQRHHRLPSKWNWQRVPPSAAPGDGEEIDPRYGVEKRLVPTGPNPLHH

SEQ ID NO: 156997 - protein, 86 aa, Triticum aestivum
  Clone ID: PAT_TA_51415.pep
GWSCNLRPPSRRLKGFYQMWVWVTFHTQPETRKCLHLTVRCGTWHPGVPHSKPRARGARCAAGALTGVGARLDHRLRWVSYPGQVS

SEQ ID NO: 156998 - protein, 197 aa, Triticum aestivum
  unsure (1)..(197): unsure at all Xaa locations
  Clone ID: PAT_TA_51416.pep
PLSRPPVSAHLLRLRRRRTHRGSSDSPDQERRAGRKSTYAGGEEMGLTFTKLFSRLFAKKEMRILMVGLDAXGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHW

SEQ ID NO: 156999 - protein, 189 aa, Triticum aestivum
  unsure (1)..(189): unsure at all Xaa locations
  Clone ID: PAT_TA_51417.pep
XSTLISQPSLLGPCPSRRRNGDAQLNLSIYSTEQSEMKRGARRVPGLLEEGREEMILLEAKLVCHDHVEVVAALGLVHRPAWTSGRSGREGIRRERRAAAALRLHRRASAAEAPPSRLAWPRSQRGLSTDHGRAVPGRGAETSHPGDSGEWVERFSRRRRRRDLGEVVGDGAGQGKVGFQSKNVILIYV

SEQ ID NO: 157000 - protein, 104 aa, Triticum aestivum
  unsure (1)..(104): unsure at all Xaa locations
  Clone ID: PAT_TA_51418.pep
GGWXRGRRGGAQAAGGGRRGSRLFARSRRWARRGGAQGGGRRAPRPAATGAARHGSGPRRRGAGSRLLARAAAAAEAPMESPTPKSPYELEPTNELALAHIIPS

SEQ ID NO: 157001 - protein, 122 aa, Triticum aestivum
  Clone ID: PAT_TA_51419.pep
ALRAQMEMQRSLHEQVEVQKHVDIRMDAYTTYINTLLEKACKIVSEQFASSGFSVSDQSLPELSSGGIMCGTATDALSSSVFHQLSVSSINMHSPGGKPSPSGMEGQLLLQRSPEFKRKSSC

SEQ ID NO: 157002 - protein, 81 aa, Triticum aestivum
  Clone ID: PAT_TA_51420.pep
SPLFFRFIPLFCALSICRLFSPLACPRFCPVIACPQEGPPCFWLWFRLVLFFSYPVAFFLVMLFALFFYFCLNFQLPSQPV

SEQ ID NO: 157003 - protein, 79 aa, Triticum aestivum
  Clone ID: PAT_TA_51421.pep
PGPPPLPFWPLVSPRGGFKPGPPFPRRLFPSPPPFLGPGRPLAFPPCPPPPSSPPPGAPPYRGSPWVFFKKMGVFSPPE

SEQ ID NO: 157004 - protein, 112 aa, Triticum aestivum
  Clone ID: PAT_TA_51422.pep
TVDSVLLPPELFGGAPSPAPGASVDAPASAPAPETSSAPAPSPKTDKTKPKHKSPAHSPPAPPADTPDTAPAESPDGDEEADKADNKNGATAVGMGIAAMVASVALVGATLL

SEQ ID NO: 157005 - protein, 94 aa, Triticum aestivum
  Clone ID: PAT_TA_51423.pep
KSSPHARVFFRQPPIRVGRQIVNVPSFLVRVESEKPIDFSLTSPFGGGPSGRVKKKTPKKASGGGDPGGSEEKELGTSSFPLFFFKCWGFGAFS

SEQ ID NO: 157006 - protein, 44 aa, Triticum aestivum
  Clone ID: PAT_TA_51424.pep
APFGDLPSTVITMHVVVQPSSAKSKPDKKTNKLPKTTRCSCTIL

SEQ ID NO: 157007 - protein, 101 aa, Triticum aestivum
  Clone ID: PAT_TA_51425.pep
PGNGVGFKPDILAMDFMEKVLEVKGEDPVKMANQLALQEGLLVGISPGATPVAAIELAKRPETKGKLFVTVHPSAGERYFSWALFKGLRKEVEAMHPVPVD

SEQ ID NO: 157008 - protein, 128 aa, Triticum aestivum
  Clone ID: PAT_TA_51426.pep
GNPAQTNKYGITNDNKPKGAGPAKPPAKKPETKRGGGGGKNKTHDGPGYWFGPNQTAGEPPGPPPPKRGGGGGALLKHGITGRSPNSTKDTGGPPLTLKTAGPPGALSGPHLATARGTDPLDKAHPGL

SEQ ID NO: 157009 - protein, 112 aa, Triticum aestivum
  Clone ID: PAT_TA_51427.pep
LAFSRLERQMQCIVRRTGDTFANWSSKCNYDPRPFMINTRKKERKSGQPDFEPNALTYTIQLWFAKFHPKNSPPARTYSPKAFHRRNEPHCPLPPYGLPQPITHLNTYQALT

SEQ ID NO: 157010 - protein, 78 aa, Triticum aestivum
  Clone ID: PAT_TA_51428.pep
DACLNYVCLGLPWPVVSVISLAWVQELRFFLKWVSFVGNFGFFLWNLLFVGPFPTCVFGRSDFFRTGFVPTIFPLLSV

SEQ ID NO: 157011 - protein, 115 aa, Triticum aestivum
  Clone ID: PAT_TA_51429.pep
HASTVLVHRWQRHQYHMFYEIFNGTQMHFRIQDLQMGMTAFCITDKSWLSQKMQATLRQLLPFCTAAFARGSSSPISPSSSMIPSSSSSLPLLQRTGDAGSGFPEGSTNLAPASG

SEQ ID NO: 157012 - protein, 65 aa, Triticum aestivum
  Clone ID: PAT_TA_51430.pep
PRKAPTPYKPPVGAKSTPPYKLNGRPLWLPLANANFLTPSPWCSLLKNPRAPVAGFWRLLTSPPP

SEQ ID NO: 157013 - protein, 71 aa, Triticum aestivum
  Clone ID: PAT_TA_51431.pep
PPASPNCGACLGGPRDTYARMNDPPVCVSTTTRTFPGRLGPKEGQIYLVFPFPGGASVLPGFVPAPRDFLW

SEQ ID NO: 157014 - protein, 72 aa, Triticum aestivum
  Clone ID: PAT_TA_51432.pep
RLSPPSSPSAGLSSPSASSRCSASSHSSRSSSSRPHNMLLLALLVFLQWTWTWRPCAIYQSQEVLATSSLVW

SEQ ID NO: 157015 - protein, 65 aa, Triticum aestivum
  Clone ID: PAT_TA_51433.pep
GDRISLLGWERSVSQQHQLQIANYIISHPCQYLQGHVVTKGRESHRKFNIQRKSGKIEANRRNRQ

SEQ ID NO: 157016 - protein, 109 aa, Triticum aestivum
  Clone ID: PAT_TA_51434.pep
VFIAGTRGPRGKQPGGFLQQVLGLQTFFLISFLQNVLLGVSQKSSFLFVRGQLLGALWGGAKLKWASPLGSWQINPVWGGLFQTWGVLRDPRLSKGLDVWLMPPLSGYM

SEQ ID NO: 157017 - protein, 98 aa, Triticum aestivum
  Clone ID: PAT_TA_51435.pep
PKESEHQRPSAEASLAGGANPSARIWPPKAVRKGQRQPKGSQAVLDKKPLEYNQSDRKLSLRLDQFSQDLRLRMLFWNRGHKLGSCMDEGLAARFCVV

SEQ ID NO: 157018 - protein, 52 aa, Triticum aestivum
  Clone ID: PAT_TA_51436.pep
QVIFPLQFKSLASSSINPSIRLIKSSRSFSPLCYGRTLVVREKVFFCILQAC

SEQ ID NO: 157019 - protein, 124 aa, Triticum aestivum
  Clone ID: PAT_TA_51437.pep
MKRQIKRPTRSQESPEPGEKLAFAEKENLLAAYMEHDEPELAEADEEEEEEERAMSCGLGGKKRRLALEQVRALERSFETDNKLDPERKARIARDLGLHPRQVAVWFQNRRARWKTKQLERDFN

SEQ ID NO: 157020 - protein, 136 aa, Triticum aestivum
  unsure (1)..(136): unsure at all Xaa locations
  Clone ID: PAT_TA_51438.pep
MAGGDDLKLLGAWPSPFVTRVKLALALXGLSYEDVEEDLYKKSELLLKSNPVHKKIPVLIHNGAPVCESMIILQYIDEVFASTGPSLLPADPYERAIARFWVAYVDDKLVAPWRQWLRGKTEEEKSEGKKQAFAAV

SEQ ID NO: 157021 - protein, 196 aa, Triticum aestivum
  unsure (1)..(196): unsure at all Xaa locations
  Clone ID: PAT_TA_51439.pep
GSIQYLHLANLDLHPTFQLGLRTLXKLHLYNVHITGDELGCLLSHSFALAHLRLQYCHDIIRLEIPCLLQRLRFLEVLECSLEVLEINAPNISRFRLMDFNVQLSFGKSRKMKNLMLNNSCGISYAIDNLPSCAPKVETLTIHSSYEIINAPVASSKFRHLKILIIYLLGLHSHRDYDYLSLVSLFDASPLLEKFV

SEQ ID NO: 157022 - protein, 69 aa, Triticum aestivum
  Clone ID: PAT_TA_51440.pep
GGPFGQVKSKVQKGFSNLPFAAWKFWPIFCWVPFGALPLPPRVFFARSLASFWAVFFTLKTPRSLAGAC

SEQ ID NO: 157023 - protein, 71 aa, Triticum aestivum
  Clone ID: PAT_TA_51441.pep
VLIIDGGTDWAVKGLPENKWWFYSQFRDSLVKLSQYQPGGNVVEIRRNRCFAPNGQSIPATAGDEGFAASA

SEQ ID NO: 157024 - protein, 71 aa, Triticum aestivum
  Clone ID: PAT_TA_51442.pep
PNKPVPGPNPLFHFSQFPWFPPAWFFTPLLKVIFLFPLSNGVPSKCLGVEKFNQSPWAHFHIFPMDVFFSP

SEQ ID NO: 157025 - protein, 58 aa, Triticum aestivum
  Clone ID: PAT_TA_51443.pep
ARGLLIFHAIKKIGPKSIAKLTPVEFLLTWPQTTCMEPRCGSLRRFQRCSFLALIGKI

SEQ ID NO: 157026 - protein, 74 aa, Triticum aestivum
  Clone ID: PAT_TA_51444.pep
FFFFFFFFLFFFFFFFFFFFRDKQINPSLETILKGSSYMRKPKGEKLGTSFFLNEKFKPPLHMRCAKTNPTTRG

SEQ ID NO: 157027 - protein, 97 aa, Triticum aestivum
  Clone ID: PAT_TA_51445.pep
KGHDWGDLHNIRGGAEIEDPGGFKEQKAGGKEKFIEMTNGRNQKQGASIHKINCRRVLLKWGVQPSSWGTWKRGPSFWGTWKRRPTSWGTFLGGRGP

SEQ ID NO: 157028 - protein, 97 aa, Triticum aestivum
  Clone ID: PAT_TA_51446.pep
IQRTGAQSYSLSRSILAVRALYLFVTLAQRWPNTTPRLYSLSILFLLGLYFPISPISFLGQRFFRDSCGREITLLIEINYDFQPKLIATCAQKNKFS

SEQ ID NO: 157029 - protein, 65 aa, Triticum aestivum
  Clone ID: PAT_TA_51447.pep
AVVPGIRRRTSVQVLPLVSTLWGVLLFGEYRRSSRRTYTLLGSMLFMFVVAMAVLMASSAHRKPL

SEQ ID NO: 157030 - protein, 72 aa, Triticum aestivum
  Clone ID: PAT_TA_51448.pep
RCRTTKLISQCCISLAIFLFTVCVLLRSKVIKQSSFKQRIPCKVFHLIYDDDTQVVHAQRLPPVEKPNQRPQ

SEQ ID NO: 157031 - protein, 129 aa, Triticum aestivum
  Clone ID: PAT_TA_51449.pep
KFVLFVSPVQSKYDWFEGDLSSLRQMSEHRHHNLKNVKISGFCPQKSMVELARHILENATSLECLTLDTTPISYRCSGDILDRKCPPLETAYIRDAYKSILAVRTYIEGKVNSTVKLNLLGPCSRCYAL

SEQ ID NO: 157032 - protein, 94 aa, Triticum aestivum
  Clone ID: PAT_TA_51450.pep
PNKQFILGPKGRGPYWSAQPMKLGKQCSCPPLGAWPNEPTAPILINWRSRAINWTITGGICGKPSRVPVGGVPQCPKPWDEWTGINNPINMDEN

SEQ ID NO: 157033 - protein, 40 aa, Triticum aestivum
  Clone ID: PAT_TA_51451.pep
IIWNWGTGIIIRNYWGKPTPRAVFFSSPSDWPLQGFFLFP

SEQ ID NO: 157034 - protein, 119 aa, Triticum aestivum
  Clone ID: PAT_TA_51452.pep
PSVRIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVDGPYKPAAYRY

SEQ ID NO: 157035 - protein, 75 aa, Triticum aestivum
  Clone ID: PAT_TA_51453.pep
RAAVIAVPCCSQAAKCSRRVAHFSCRLGDDSLRTLIKREMTSKSKIESLQLLQSSVTDVNSINQGNKTHQQVHHR

SEQ ID NO: 157036 - protein, 61 aa, Triticum aestivum
  unsure (1)..(61): unsure at all Xaa locations
  Clone ID: PAT_TA_51454.pep
EIGNCSNLTMLGLTETCIFGPLXGRLENLDTLAIYTELLSAPIPPEFGELVPCATAGGCPT

SEQ ID NO: 157037 - protein, 108 aa, Triticum aestivum
  Clone ID: PAT_TA_51455.pep
LETNNQGEYFLQLQDNLQILTNKLSIICIFHPTTPASSSPSCRFVARPCRQHSNDHLSGCCCLWVARCIDCLVIPHLLALHIFYLMKCILANSMFFYHFILLCRFYCL

SEQ ID NO: 157038 - protein, 200 aa, Triticum aestivum
  unsure (1)..(200): unsure at all Xaa locations
  Clone ID: PAT_TA_51456.pep
PSVRFEDDPATSGVLHKHLLRTMGTPIVDKILSSLDRDNKLKNGMEYEDSEEQHAQLSTTDRTFLAKDLPGQLSSKAQALVEALEGKRFDSFMDALRDTAEESGLLFKKLDKRLERSMLHSYRKDLIAQVSSETDPVSFLPKVVALLFLQAHNKGLQAPGRAVGAVITLLKDKLPASTFKVLTEYHATTXESSRTTSCCH

SEQ ID NO: 157039 - protein, 171 aa, Triticum aestivum
  Clone ID: PAT_TA_51457.pep
ATYTLTELVMPLLEKAASDARVITVASGGMYTEPLNTNLQYSESEFDGTKQYARNKRVQVALTEWWAEKYSNKGVGFYSMHPGWADTPGVSKSLPVLSEKLSGNLRSNEEGADTVVWLGLQPKEKLVPGTFYFDRAEAQKHLKFAGTAASHEKIGSIVDSIRSICNLPANP

SEQ ID NO: 157040 - protein, 108 aa, Triticum aestivum
  Clone ID: PAT_TA_51458.pep
NLNSVGFNKMRALVGISFLITCRVIIITGGVIFTSKIKIDQSLLVFIRHVPDVAIAYEAHLFLRGSNSATAFNWVHILPSTHRVSNGAFIGLVLVDLVVAVVVQSIDD

SEQ ID NO: 157041 - protein, 56 aa, Triticum aestivum
  unsure (1)..(56): unsure at all Xaa locations
  Clone ID: PAT_TA_51459.pep
VRHPEPRTCLRSPTPKNHKPAVRFPTIKCVMGDNTLIIFFKPQVKITFSLLYSLXA

SEQ ID NO: 157042 - protein, 57 aa, Triticum aestivum
  Clone ID: PAT_TA_51460.pep
ITVAAQFCAHFGVLTQTLHAWRKTPRGITPLKNKTLLKHFGPRNNDDSMSPVIPEKT

SEQ ID NO: 157043 - protein, 180 aa, Triticum aestivum
  Clone ID: PAT_TA_51461.pep
NVTVVAIQSLHFDVISGLIKVPKESSPSPQEKCATLLEHLAACEQQGTAMTAARSESVIEAVLEMGVIHGTTCNPENLDEPPTIMVEVSQAVGATVRLLTKLLNFDIFARSINSVRNVALLRRMLQSSVPLQSKDWVTACLIKLESRGLVDRSVGDIGMEITIYHTIPRLVEQMMIHFLL

SEQ ID NO: 157044 - protein, 79 aa, Triticum aestivum
  Clone ID: PAT_TA_51462.pep
LLFQREQKPVCSTMENISFASGTETIVSLGYRKTKYSPIRMVYRSNEITCTQAGGMCRNQRSKNRTAETASPLCSRSVL

SEQ ID NO: 157045 - protein, 112 aa, Triticum aestivum
  Clone ID: PAT_TA_51463.pep
MLCSVHYQRVSMQEAQLAKEKMNGKLVCGRPVVVHLASEKCFLDSGNSQRALKDKKLAGGSGSKLAQTDRAAKISAIKNKLKSLENDGCSTKRPRLNPDDLKSTGEQSDKKL

SEQ ID NO: 157046 - protein, 49 aa, Triticum aestivum
  Clone ID: PAT_TA_51464.pep
LLLVVMHPLLWVPSILLPGTRSYMLGWCLQPAASRCTSWIGCVIFGVVS

SEQ ID NO: 157047 - protein, 85 aa, Triticum aestivum
  unsure (1)..(85): unsure at all Xaa locations
  Clone ID: PAT_TA_51465.pep
RASSVMQDLNLNVEDLGARPSVXCYPGAFLLDHDALVRRSNAMQASQKCEHYVNATAAHSRPARSISRTSGRIEMHIALFSATKH

SEQ ID NO: 157048 - protein, 99 aa, Triticum aestivum
  Clone ID: PAT_TA_51466.pep
HCRDKEPSPNIRLEEKWERRVQGPKSPLFLRSKSPDDCWHKETLDDKPSSSCEPDPHRKKENKKGRRSSEKKERKERKAKKKAKHRHRHHHHHKSRRRE

SEQ ID NO: 157049 - protein, 116 aa, Triticum aestivum
  Clone ID: PAT_TA_51467.pep
SVTLSSESSWIVSLAFTYIDKLGKRRNEGPWGPDKGNSQTIEFGPKEYVTEISGTIDNVISSLVITTNIKKYGPFGHEKGNRFSAAVPENTCVVGFFARTGNALDAIGVYHGPIVV

SEQ ID NO: 157050 - protein, 124 aa, Triticum aestivum
  unsure (1)..(124): unsure at all Xaa locations
  Clone ID: PAT_TA_51468.pep
NHRSYLFPGRRFLAXNISKLKTXLTSNLNVPDRSLSPGGTADRLPEIGRGGPRLISPANNGVNPLGFPFWCLGLLPSAFAPFVGGAPFGVPGCLGSFVALFLEWLWPFFFFFXGAGSGSFFFFW

SEQ ID NO: 157051 - protein, 85 aa, Triticum aestivum
  unsure (1)..(85): unsure at all Xaa locations
  Clone ID: PAT_TA_51469.pep
NRPKKSERKQGXRTRRRKRGRPGETPRTPRKRTRERERHPGDKRTDXGQKNXGQTDGXPEKYAGNKKAKXPGEHVKNXAMLRVXG

SEQ ID NO: 157052 - protein, 81 aa, Triticum aestivum
  Clone ID: PAT_TA_51470.pep
MEGEGTSSSGGGFRARIAHYLYSEEKKHVVAGIAIFAAILGVPWYLMTRGAKHDSHQDYVERANKARSDRLSSGQPSSLKE

SEQ ID NO: 157053 - protein, 121 aa, Triticum aestivum
  Clone ID: PAT_TA_51471.pep
MADVEYRCFVGGLAWATDDQSLQNAFSKYGDVIDSKIITDRETGRSRGFGFVTFASDEAMRQAIEAMNGQDLDGRNITVNEAQSRRSGGGGGGCFSSGGGGYGGHLREGGGGSGYWGTGGC

SEQ ID NO: 157054 - protein, 79 aa, Triticum aestivum
  unsure (1)..(79): unsure at all Xaa locations
  Clone ID: PAT_TA_51472.pep
CNIIPKFKKKKKKKKKKKKKKKKKKKKKKKKKKKKKKKKKKKKKKKKKKXRGGPFLKKPNFSPRGWKKKNFFFGAPKLN

SEQ ID NO: 157055 - protein, 168 aa, Triticum aestivum
  unsure (1)..(168): unsure at all Xaa locations
  Clone ID: PAT_TA_51473.pep
AWVXNDQAINVIRKKYELEXVETLXXEKEKAEKLIREMEHKCNEKXLENKRESERCLMRLKEEHAAVVARIQQDNELKESTLRAYHKEELQRIRSQGESELRERLSSLRQEHEAQIKTVNIRHEEDCQKLQDELELQKSKEEKQRALLQLQWKVMGESQQVDQEVNSK

SEQ ID NO: 157056 - protein, 149 aa, Triticum aestivum
  Clone ID: PAT_TA_51474.pep
GAAARDLERALLLSGESLENYGAVENILVEMGTYFQVQDDYLDCYGDPEFIGKIGTDIEDYKCSWLVVQALERADESQKSILFENYGKKDPACVAKVKDLYKELNLEAVFHEYESESYKKLIADIEAQPSDAVQKVLKSFLHKIYKRQK

SEQ ID NO: 157057 - protein, 85 aa, Triticum aestivum
  Clone ID: PAT_TA_51475.pep
VVENACSVPSTSRHELGHRRREPTRSRKAVRSGVAANGAAQSADCRLDAYKSVPTSMSQLDSIFGYESYLLCIQFCHYFVKPLSS

SEQ ID NO: 157058 - protein, 88 aa, Triticum aestivum
  Clone ID: PAT_TA_51476.pep
MGGASRPSSFPTILQSRDRGSDGGYEENAEGSRDSGGDTSSMGDPELDGPGSGSRHGTRAGGSSKSSRQVMERRERDGRREGKWERKQ

SEQ ID NO: 157059 - protein, 40 aa, Triticum aestivum
  Clone ID: PAT_TA_51477.pep
VHMRGHGRRVQDSRSSCQTHERLWIKYYTRYKEHCAHMHL

SEQ ID NO: 157060 - protein, 57 aa, Triticum aestivum
  Clone ID: PAT_TA_51478.pep
KKKPGNGPHPPEAAKKGTPTPLPRGTNTQPSISTTTSSSPQQTELGSSVEHKVLYDL

SEQ ID NO: 157061 - protein, 49 aa, Triticum aestivum
  Clone ID: PAT_TA_51479.pep
ICRCQIGHQDCSISKRTFWEVLNFIQKGQHGFFFRPMAYILQVYKWHLE

SEQ ID NO: 157062 - protein, 52 aa, Triticum aestivum
  Clone ID: PAT_TA_51480.pep
QEDGEDQGKLGIPRSPLAFIHTTAMHISVTSNLNYRRCCESEVINMGNGCRL

SEQ ID NO: 157063 - protein, 83 aa, Triticum aestivum
  Clone ID: PAT_TA_51481.pep
KVFSSVHPPRTCPCQTHPLTKTPWSAPPQDGMRSVATRTPPLYAHIKHRQLIIKPCVRRGWPQIHVKTSPPLHGPPVSVKNIR

SEQ ID NO: 157064 - protein, 60 aa, Triticum aestivum
  Clone ID: PAT_TA_51482.pep
FSITQNFDLSFYLSLPLSIAASIISDFRDSLLVTNQLGLDFEASSPPSRKSAASEPQGLQ

SEQ ID NO: 157065 - protein, 117 aa, Triticum aestivum
  unsure (1)..(117): unsure at all Xaa locations
  Clone ID: PAT_TA_51483.pep
PPRPPPGPKPPRRLPKIPKGTTPKNCPNTTESPPPXKAPTPSPTPPVPPKXTRRPMSEKRSCPPQCRNATGVFVQARHPAQRACPFEFWVRRLSKKLGHLDYGPCWHLDFNLNPQGA

SEQ ID NO: 157066 - protein, 99 aa, Triticum aestivum
  unsure (1)..(99): unsure at all Xaa locations
  Clone ID: PAT_TA_51484.pep
HMILLYYNWGGTNLFFEANLIVAGRGPRVGSITVPESSSPTSSCPNGSSPQTGHPARFCKVYQLARAMINFEXSNVYDLLLSTIQWMDCGSCMPARTYV

SEQ ID NO: 157067 - protein, 147 aa, Triticum aestivum
  unsure (1)..(147): unsure at all Xaa locations
  Clone ID: PAT_TA_51485.pep
PPPPXXPPPPXPPPPXGAPPPLXPPPPPPSAPPPPAPPPPANPSPPGPPPAPPPGPLNPPPPPPILQKGPPPPTGPPPPGRPGQRTPTPPPLTTXKIXPPPPHPPPXKHPHATQFLFTSSKKGEPDPPKGKKSPLPRFEIEPKKPQD

SEQ ID NO: 157068 - protein, 52 aa, Triticum aestivum
  Clone ID: PAT_TA_51486.pep
YILGRFFGFFFWETGSFKKSSPSLLESEGLMGRFQAIHPGIFPIFWPCLGGP

SEQ ID NO: 157069 - protein, 119 aa, Triticum aestivum
  Clone ID: PAT_TA_51487.pep
PLFPSPQKFFPQGWGKRSEGPPTKAPRAGTQKKRAPEKAQTGPPRGPPQGPRPKGRIQAKGGQARPHFHEPIKKENGERKLSLGEPGSPKMGKPLGSRKREFSPPTPLLIDLGRGQKPR

SEQ ID NO: 157070 - protein, 72 aa, Triticum aestivum
  Clone ID: PAT_TA_51488.pep
ASMGEQAAPWYKKTPRKTLWLLDLRQGALCPSKHRSYLMRNYSLLSFKEDPSRMSHLSRSNETPAKMLQPLK

SEQ ID NO: 157071 - protein, 75 aa, Triticum aestivum
  Clone ID: PAT_TA_51489.pep
REGASMHQICSLVADNTATICSTSPLLLLNTSLLVEITSRGRICLLLWCGPHALRLHPCKECIHRPWCCMVLRLL

SEQ ID NO: 157072 - protein, 64 aa, Triticum aestivum
  Clone ID: PAT_TA_51490.pep
KCILIRNRGATMHMHGLNPGCSPRPHHPDQHELVEANWCSSLFVHPLCAPPSLQFYERERAGDC

SEQ ID NO: 157073 - protein, 143 aa, Triticum aestivum
  Clone ID: PAT_TA_51491.pep
KGNGKKGPGTPRPRNPPKKTPRPRPKSPRARPRIKTPLRRVKRPRARKGKKEDPPPRGNKEGGETMAEEERRNQKRGKTLARAGVGTCNFKELKSQASGPKPGFQKKGKRSTPPPPLGLGEKGSEVCALRSPAPMNEGALLGG

SEQ ID NO: 157074 - protein, 55 aa, Triticum aestivum
  unsure (1)..(55): unsure at all Xaa locations
  Clone ID: PAT_TA_51492.pep
TKEGKPPHPRWPPLYXVVIWAVRQCIDXPVVMVASGHYXTXLYSLVLWSIMQCSP

SEQ ID NO: 157075 - protein, 131 aa, Triticum aestivum
  Clone ID: PAT_TA_51493.pep
MANTGEKKKNALHHQIKGTPPGGKKKGPGPEQITPTTKKPPKEKPIPPRKRNNQPGGEEPDPTKGGTPKRPPKKGNDLKKPQSLDPKKKFSPGGTGRRGEPHKKPWGGGKNIRGPPLRGPIPGLEKGETPG

SEQ ID NO: 157076 - protein, 82 aa, Triticum aestivum
  unsure (1)..(82): unsure at all Xaa locations
  Clone ID: PAT_TA_51494.pep
RVXLKLPVLRNCPQLINEIHXSITCSAYETTPFAKISGCYGSTLLNSRQCVEMSELLYLQCGVPILSVGVQVHAFVALNNLC

SEQ ID NO: 157077 - protein, 71 aa, Triticum aestivum
  Clone ID: PAT_TA_51495.pep
IKLVFLYLPAPPIGDSRSFYHRIFKFASVRVTGGPVEVPSSHAMCYLMAVLPHNNVLSDGCPYSLQPFNQE

SEQ ID NO: 157078 - protein, 89 aa, Triticum aestivum
  Clone ID: PAT_TA_51496.pep
HMGYCTTEAFRIVANNYHSIDYHATYPEIKALIQEVTVTPAEVAEVLMRSDDDADVALHDLVELLKLKKKDATEMKTESKPAEEQKDQD

SEQ ID NO: 157079 - protein, 182 aa, Triticum aestivum
  Clone ID: PAT_TA_51497.pep
VKGVKRARTLPVSNPSQFPPPVEIDFFPSLDLAGLPPPMSSSRGDALLDSAPLLGAGAGGGGQRRGNALRRPSLRGAARLLRRSGRRAMREPPMLVREAAAEHLEERQADWAYSRPVVALDLLWNISFITVAAVGLVLSRNEKSPMPLRTWVAGYALPCLQHMVCVLCKNRMRRNQRGGAPA

SEQ ID NO: 157080 - protein, 191 aa, Triticum aestivum
  unsure (1)..(191): unsure at all Xaa locations
  Clone ID: PAT_TA_51498.pep
AGGGRRGRDGRHRDAASYLYTILDKISRPLTLVLDLSGPIVWPTCDGGAYHDTLECNNMDCMRAHRFHPPNCQHTGYGMPDAHNPYRCKCTGHPNNHVYSDTAXGDMTRDTLCVNATDGRNPWGPVSVTAVTTCALDSLLAGLPVGAAGVAGLARSVLRFPVQVSRTQGVTNSVALCLPICHRNGLGIFGG

SEQ ID NO: 157081 - protein, 171 aa, Triticum aestivum
  Clone ID: PAT_TA_51499.pep
MEGSAVPAPLRTRVCIIGSGPAAHTAAIYAARAELKPVLFEGWMANDIAAGGQLTTTTDVENFPGFPTGIMGIDLMDNCRAQSARFGTNILSETVTEVDFSARPFRVTSDSTTVLADTVVVATGAVARRLHFPGSDTYWNRGISACAVCDGAAPIFRNKPIAVIGGGDSAM

SEQ ID NO: 157082 - protein, 131 aa, Triticum aestivum
  unsure (1)..(131): unsure at all Xaa locations
  Clone ID: PAT_TA_51500.pep
RERAVHAQPTRGPRCWTSGWDGGHVLQLWRRLKXHQGTRNWSALHQKPXNYLCHQTPKHHQLLTPXDQPVYNKDKSINGGGYVEVYLHQELRTRLSXHRFRTVWDCYGITHLYEEYRKGCIDLCLGGPFLT

SEQ ID NO: 157083 - protein, 67 aa, Triticum aestivum
  Clone ID: PAT_TA_51501.pep
MGDAKSSWPELLGAPSEVAKQKILSDRPDVRVFIVPVGNNVTGDFNDKRVRVFVNTRGDLARVPNIG

SEQ ID NO: 157084 - protein, 119 aa, Triticum aestivum
  Clone ID: PAT_TA_51502.pep
FNHETTIALNCVEFPQNSGLPQTSRSESITGQSPASSQMGLLPPAAAAGRRSGHLSLDVLSEFHPWARNFAVRVELSQHLLPTLLGHLLYPQRPLASFHLLLLARRFLRQTPKTCHLLQ

SEQ ID NO: 157085 - protein, 115 aa, Triticum aestivum
  unsure (1)..(115): unsure at all Xaa locations
  Clone ID: PAT_TA_51503.pep
TQNKVLFCAQEGQTTTRKSGGTSMSVKSFWIYTYYRPAGLAWLLIGRKSQLITFFFITKDWAMVGEPQPEXXXVKKNERERNLFYLGIIDFSQNSPPVDGKTFGIARPPGARTLH

SEQ ID NO: 157086 - protein, 49 aa, Triticum aestivum
  Clone ID: PAT_TA_51504.pep
SPPPPMSPLNWAKGGVLPRFLNPPALGPPRVVPLPRPKVWPLYRPFFNL

SEQ ID NO: 157087 - protein, 123 aa, Triticum aestivum
  Clone ID: PAT_TA_51505.pep
MHTPSVLEDLQALKAAGEVWLLSNMDSQEDIVYPNDPKVKIKVDDDLKELFRGIELPRDMVDIEKELQKNGMKPMTDTTKRRAAAQIHGVKPKAKPKKKQREITKRTKLTNAHLPELFQHLKS

SEQ ID NO: 157088 - protein, 85 aa, Triticum aestivum
  Clone ID: PAT_TA_51506.pep
RKLPEGEFPFFAQWAANYTNLARVQAPENSKSFPEFGLQKNLRKKFAPKTGGAAPMPGVAREIPPQFIPPANILPDKAPKAAVAP

SEQ ID NO: 157089 - protein, 98 aa, Triticum aestivum
  Clone ID: PAT_TA_51507.pep
LSLVTLFSRITIQLAWKNQKVVDQQDGKRKTRTKLKFVAVHVCIYQDSVLCRNVPEICFTQRDQTIRNTSRIVDAFFIFLLIKRNLHLPRIRPTSMYA

SEQ ID NO: 157090 - protein, 138 aa, Triticum aestivum
  unsure (1)..(138): unsure at all Xaa locations
  Clone ID: PAT_TA_51508.pep
KKPPPPTTPPKKKTTPPGPKRRTKEGPERRQPTPNNPGGXHKKNKLNPPKKQGEQNPQNTAAPPARGPEGGXPGKTSTPPSKGPRAGVDCPQRGGHAPPPGEQXPQPKRPPTPPKRSPSRSRSLRRCKCKALPGPEDH

SEQ ID NO: 157091 - protein, 92 aa, Triticum aestivum
  Clone ID: PAT_TA_51509.pep
DQQLVGVLLVLYINTGVQPWVLPGKQRTFKQKIWESINHLKSRFYKKRGGHSQLRVVTGAPGTPRSAEVSKFKGNNPGGAPTFNRKKKPRAP

SEQ ID NO: 157092 - protein, 59 aa, Triticum aestivum
  Clone ID: PAT_TA_51510.pep
IFLFTGTDDKCHFQNIGICYFYEPKIYWCHFLKGNAQCLCINGGSCLGIITFWGAWAGH

SEQ ID NO: 157093 - protein, 157 aa, Triticum aestivum
  Clone ID: PAT_TA_51511.pep
TTIPYAELRHDVYRPLINAFDQAMERQGAITTDARVPSPAAAPFELCYNSSRLSPTRFGYFVPTVELMLEGGRNWTVFGINSMAQVNRATACFAFVEMKAGDKSWYGGVAAPAVVLGGFQMQQNLLMFDEEKQTLGFTGQLTGRGLSCGHFNFTMPA

SEQ ID NO: 157094 - protein, 136 aa, Triticum aestivum
  Clone ID: PAT_TA_51512.pep
GAPAVVFRDRGEARGGNTAAPGGARQPFFAPAKKTQSQFPHLRWKIKGSVSRPLIQQTGAPGWFAPDCALVGLPVPRRVWSFPLFVFFPVCLFIGPRVCIPCTPEGPPPVSCLVLPPAYSVHLDRPMSCMRCFPWC

SEQ ID NO: 157095 - protein, 93 aa, Triticum aestivum
  Clone ID: PAT_TA_51513.pep
RMVQQIISMFSCDSWEIKMFMETSYAVCWVRTKDVAFLTNTQCVTLLCGTTARFMIHSTAKLLSPKRKENERRKKLLHTRVNKFFCPLLVLCS

SEQ ID NO: 157096 - protein, 129 aa, Triticum aestivum
  unsure (1)..(129): unsure at all Xaa locations
  Clone ID: PAT_TA_51514.pep
SLHHHRHFQSINSYDPSVLQHHVSWGTYSTTLITRQPVVSLLCCRSQGGCRRRASPSRMSCRSPDHSRSYRRAFCTLQCXHGYFLSSTPCREGPSAKTSAQTKNGVGLFGPLQLPVFLSLLCALWTWNP

SEQ ID NO: 157097 - protein, 108 aa, Triticum aestivum
  unsure (1)..(108): unsure at all Xaa locations
  Clone ID: PAT_TA_51515.pep
NQVVFPLLLPXDFTASCLLTRPSSLRRGCAFYXLXXFXPRVSVWLSXXLXFFAYFVGGXTPVPPXPFLAFVTLXXFFFFICPSPSSSGLGFIFSTFWFCFFFPLFFFF

SEQ ID NO: 157098 - protein, 118 aa, Triticum aestivum
  Clone ID: PAT_TA_51516.pep
HWTVAALLMCMITSNKFCLQPFLANRHALKMKDLEPETQQVKLRNTTSEKYLRDGPSHKTRYKLVSGKYLLKQLQFTLELFRLTAFTRYGAIHDKTTQTFTDCQVLTYALIIPWALSR

SEQ ID NO: 157099 - protein, 79 aa, Triticum aestivum
  Clone ID: PAT_TA_51517.pep
ASSSAIKHDQLLPVSDICFPRSVRDGPPAPENVVASLSRYGGARVLLYVQEPPNLLRGITVVYRRWSLLWFLVCTFAMS

SEQ ID NO: 157100 - protein, 108 aa, Triticum aestivum
  Clone ID: PAT_TA_51518.pep
IDKVESSPPKKQLPGVYDLVAVSTHKERSAVSAQYVGWVKQDDGKWIEFDDDNPNIRKEEDILKLSGGGDWHMAYLPKQSPHGGVEELGRSGSTFLCRERNTSFSAHE

SEQ ID NO: 157101 - protein, 108 aa, Triticum aestivum
  Clone ID: PAT_TA_51519.pep
MQCISAPKNLKLAVPHGMERTPRAILFLLLLLLVDPGVAQNTTGKADEFHVGVILNLGSLVGKVARTSISLAVQDFYAVHQNYSTKLTLHFRDSMASDVKAASAGMCL

SEQ ID NO: 157102 - protein, 58 aa, Triticum aestivum
  Clone ID: PAT_TA_51520.pep
QRTDTSMDELLWQTQNKPQNRKRNLTELIAPTVQFYNPVHFSRIKTFSFSYRQGHVPG

SEQ ID NO: 157103 - protein, 100 aa, Triticum aestivum
  Clone ID: PAT_TA_51521.pep
GAGVSRARTHASRGKLPCPARDFAALRTPRCRAAVVTARWRCREPATAVGLPPAVKPGHATSDRPAAGKNHCLQNEAPHWESCGEEICTPTSWCVKFSPL

SEQ ID NO: 157104 - protein, 81 aa, Triticum aestivum
  Clone ID: PAT_TA_51522.pep
CWKRIATLPCDGLQQQVKCRRSYGLFSPLLRDATIAIDILSIISRSSGVIWATVSLLLVKSMDMECSSVSFLFLCKSKNAQ

SEQ ID NO: 157105 - protein, 113 aa, Triticum aestivum
  Clone ID: PAT_TA_51523.pep
AARTKEGSSAIAGRGKGGKGLGKGGAKRHRKVLRGNIQGIPKPAIRRLARRGGVKRISGLIFEETPGVLKIFLENVIRDAVPYTEHAPRKTVPPMDVVFALKRQGRPLFGFGG

SEQ ID NO: 157106 - protein, 102 aa, Triticum aestivum
  Clone ID: PAT_TA_51524.pep
RVGGVLAMSRAFGNRLLKQFVVAEPEIQDQEIDDEMEFLILASDGLWHVVPNEDAVSLVKMEEDPEAAARKLTETAFGRGSGDNITCVVVKFQHSKAAGDQI

SEQ ID NO: 157107 - protein, 139 aa, Triticum aestivum
  Clone ID: PAT_TA_51525.pep
MKAIIQELQVALRKGDDATAQAKIQSYVRLVKTAKKHFKKSAKKANVVSAACKVVMLLTKAREVSVSLLESTVHLLSKEIRMPKQSLVSKAFHKKKAVVCQEEQLQELECSIGDLENGAGHLFRKLIQIRVSLLDILSS

SEQ ID NO: 157108 - protein, 75 aa, Triticum aestivum
  Clone ID: PAT_TA_51526.pep
STPGGSPLCQRKSSSPPESVEKGNRFFFQSMSMPGVKKVNPCWAEFTGGKPVVFQNVRRVKPMSPPWGGDVVSLI

SEQ ID NO: 157109 - protein, 72 aa, Triticum aestivum
  Clone ID: PAT_TA_51527.pep
KKKECFPGLFGRQEKKEGTRVGTTSCAPVASWAVLLIESAVTSCNPDYRRSGATATGYGNCVIATPYLVQLY

SEQ ID NO: 157110 - protein, 82 aa, Triticum aestivum
  Clone ID: PAT_TA_51528.pep
EKKPVFSGPSRQRSLFSPYHPLASALYLCFRPDLSMAHKLLFCFPPTQEPFSESFHVYQKKRAPPLPCISWIPPCGVEFAPI

SEQ ID NO: 157111 - protein, 134 aa, Triticum aestivum
  Clone ID: PAT_TA_51529.pep
SHFPGVNTLGVSMARIDYAVGGQNPPHTHPRATEIIFVTEGTLEVGFITTANKLFTKTVTVGEVFVFPRGLVHFQQNRGDCPASVIAGFNSQLQGTQAIATTLLAATPPVPTDVLAKAFRVDNEDIDAVKARFK

SEQ ID NO: 157112 - protein, 114 aa, Triticum aestivum
  unsure (1)..(114): unsure at all Xaa locations
  Clone ID: PAT_TA_51530.pep
RXPXQTSCXXQNRCLKSFRLXLXQFQVXHSXENNMFLNSKKGLFFTFGESSPQSWLFLXXSXXXCXGPXFNXPXXXXRXXCXXKSFLCSRQRPNWVGFSFLLCSYFLTLVADLL

SEQ ID NO: 157113 - protein, 183 aa, Triticum aestivum
  unsure (1)..(183): unsure at all Xaa locations
  Clone ID: PAT_TA_51531.pep
CFDKRVIEXFEKEAAXMNKRSFKSAWVLDKLKAERERGITIDIALWKFETTLYYCTVIDAPGHRDFIKNMITGTSQADCAVLIIDSTTGGFVAGFSKVGQTREHALLAFTLGVKQMICCCFPMAASSPKFSXARSEEFVQEVSSFLVXAGSTLSRFPFVSFFGFGGGSLFCEAPHLGWSRAPP

SEQ ID NO: 157114 - protein, 171 aa, Triticum aestivum
  unsure (1)..(171): unsure at all Xaa locations
  Clone ID: PAT_TA_51532.pep
SGLIGGAPWXRVPYPFQWGAPTFDAGEAFAMMAASFVALVESTGSFIAVSRFASATPLPPSVLSRGVGWQGVGILLDGLFGTGNGSSVSIENAGLLALTRVGSRRVVQISAGFMIFFSILGKFGAVFASIPAPIFAALYCVFFAYVGSAGLGFLQFCNLNSFRTKFILGFS

SEQ ID NO: 157115 - protein, 89 aa, Triticum aestivum
  Clone ID: PAT_TA_51533.pep
APGGRGRERSPRPRRGAPRPSQPRPRRRPTQWRSPGRRGPSPRRRGRARAPASRQGRSARRRSAPAGAAAAAAARAAPRRRRPSRHGKP

SEQ ID NO: 157116 - protein, 110 aa, Triticum aestivum
  Clone ID: PAT_TA_51534.pep
KPKSYQMGGRVYLGGSDCCSFPLRRPEQVCRPASASSFARLLTHLARPFHHIHLGYIAPCCWPSARSVPSSSTRWWMPCTCQCSYPAPRYFIFVGDVHDDDRRPDVLARP

SEQ ID NO: 157117 - protein, 94 aa, Triticum aestivum
  Clone ID: PAT_TA_51535.pep
GDPRVGFITTANKLFTRFVTVGEVFVFPRGLVHFQQNRGHGPASVIAAFNSQLQGTQAIATTLFAATPPVPTDVLAKAFRVDNEDIDAVKARFK

SEQ ID NO: 157118 - protein, 103 aa, Triticum aestivum
  Clone ID: PAT_TA_51536.pep
GSNLTSIISLHGSRGFSRRTGGTQHLAVVGSVRRQRRFELLELPLGRDLGRCGIIAATRCYCPCVVCETRSLFCAVVLELVAVSYGRISGLLCFFILFSPVHR

SEQ ID NO: 157119 - protein, 183 aa, Triticum aestivum
  unsure (1)..(183): unsure at all Xaa locations
  Clone ID: PAT_TA_51537.pep
MADRGGERGVGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKXLQFAGIDDVFTSSRGSTKTLGXFVKAT

SEQ ID NO: 157120 - protein, 182 aa, Triticum aestivum
  unsure (1)..(182): unsure at all Xaa locations
  Clone ID: PAT_TA_51538.pep
TLAAASCPCRQDPRAAATTMAVTNGATVVDDPVQEQSKSAAPLLLKGKRLSANAVLTTGGSALAGGYDLCSAEEAVVPVRGKDLVATDLRVDDLEGTYARIEPRMGLVCKHSIDVGADEVDADYRXPLGVDLLIHSDADFDDKPGDRVAQMGVQRIATSXVCDVDNLNSTVRGEGGLHSTGV

SEQ ID NO: 157121 - protein, 209 aa, Triticum aestivum
  Clone ID: PAT_TA_51539.pep
LSPPFSPPPATDPEPGGTRREEGKGREEETTEPSARTRQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCA

SEQ ID NO: 157122 - protein, 153 aa, Triticum aestivum
  Clone ID: PAT_TA_51540.pep
SDGQESALTSIFSRSSSLASDSSTPAVIPWPWPSCRDPQTDSFRAAEEPCATAAGGSRCGPVAARHRKLVGGPAEMYKTVNSVYIDPDDGESFSCLSTEEEEETVVVEDDGFLTPTASEEWSEAVIRSLSRTTSSTGRFFFDQGPATNSNLSA

SEQ ID NO: 157123 - protein, 183 aa, Triticum aestivum
  Clone ID: PAT_TA_51541.pep
PKVASVLGASQKGYTLLPYQLPPYLANASSALIRKKPTIDLSQLAPRAVLSIARPIMASGNDWLGFSLSGQENPQPHQDSSPPADIDIAGASGFYGLPTQPAPDAQLGVPGHHQPSYGITEAFNRGAHEIHDWNMRGDLDYNGGASELSMLVGSSAVGGKRAAMEAETEPKLEDFLVGNSFVS

SEQ ID NO: 157124 - protein, 184 aa, Triticum aestivum
  unsure (1)..(184): unsure at all Xaa locations
  Clone ID: PAT_TA_51542.pep
MDMEIPVIDLXGLTGDASQRSQTMARLHEACKDWGFFWVDSHGVDAALMEEVKRFVYAHYDEHLKDRFYASDLAKDLQLPAEESKTVSGEVDWETAYFIRHRPANNVADFPEIPPATREMLDAYIGQMVSLAELLAECMSLNLGLDGGLVRDTFTPPFVGTKVAMYPACPRPDLVWGXRAHTDA

SEQ ID NO: 157125 - protein, 135 aa, Triticum aestivum
  unsure (1)..(135): unsure at all Xaa locations
  Clone ID: PAT_TA_51543.pep
LPLRMFVGIGRVGLVNYRVDYXSLLCFCARCLQRRTLVGASDLXRSRMMNFKRISLTDFKIDLMRIPNKGSLINAMAGSICELQMXNSSWGMMLVVQTRRAYLNDFVRFKVMLSNIIRCGAIRQDLAKLKKEVAG

SEQ ID NO: 157126 - protein, 205 aa, Triticum aestivum
  unsure (1)..(205): unsure at all Xaa locations
  Clone ID: PAT_TA_51544.pep
GHGGSRVAEACRLRMHLVLAEEVRLRRLRPGGEGQRQAEDDEDGARWKEAMTACFARVDGEVGVDDGTDTGEQTVGSTAVVAVVGPRRIVVANCGDSRAVLSRGGVPVPLSSDHXGDYYLKPYVIAEPEVTVMDRTDKDEFLILASDGLWDVVSNDIACKIARNCLSGRAASKYPESVSGSTAADAAALLVELAMARGSKDNISV

SEQ ID NO: 157127 - protein, 79 aa, Triticum aestivum
  Clone ID: PAT_TA_51545.pep
MVLFVQHVFVVQDVLIDSRLYFIFHNVLINLINGASLNITVIDVCSVSHAVLSDVHLAYFMVFHSVLWVSFETYLLTIT

SEQ ID NO: 157128 - protein, 194 aa, Triticum aestivum
  unsure (1)..(194): unsure at all Xaa locations
  Clone ID: PAT_TA_51546.pep
INQKRVKDTASVDCSGDNSSEQQTSTSATXAAKTAGSTSRKRKHAHASASSENGTQVFKDSQQVVGASSAGAGDHNMDARNGKSQTSANQANSRNNVDAKRGAASQQVVIRTEDLRAEVTVPCWDDVAVPNSETSEYKSSGKKSIGYVLDEWDEEYDRGKAKKVRKAKEDDNDDGMNPFQAEANYVSARKTKQN

SEQ ID NO: 157129 - protein, 167 aa, Triticum aestivum
  Clone ID: PAT_TA_51547.pep
MAVNEETSVYVGGLPYDADEDMLRSYFGPCGTIVSVKVINDQRIRGKCYGFVTYTQHRAAQRAILEMDGKQIGNRAVRVNEVRTRGNTRDFGRDGFRRDPVRDGRDVYWDRRDRERSYDRHRDRDPYHDRDSDRPRDHDKDDKEQPPRKRFSRPKGRESRDISSSSD

SEQ ID NO: 157130 - protein, 181 aa, Triticum aestivum
  Clone ID: PAT_TA_51548.pep
CTGDESKEECLEQKLKEASDTITEKDSRLSELQSLINSAHTPTLQTEPVNIDELETELESHLQDKIEAEIQCLVMVKARQNWQARAEDQIALEEHRLSAGDDTTMLLKLQDTEKKIVMLKEQVDRLEAHEKELSVTTEVLRMQSKTFKIGLFGLLQLIMLFLSLKMFFAQDSARFGDLVPT

SEQ ID NO: 157131 - protein, 163 aa, Triticum aestivum
  unsure (1)..(163): unsure at all Xaa locations
  Clone ID: PAT_TA_51549.pep
TLQLSAVDLLAKXLAKAVGYTDIKKRSLLSSMENHTTLHLQTGRPLYTPSFVISTLKRFMPEDRLSSLHGITLTTDGTSAVFDVPSAEVQDYIQGAENAAGVTIDEVKQLPALQEREQSRGNSGGSRFGGRGGGGRRFGGGGGGRFGGGGRGRGGGGGRFNRR

SEQ ID NO: 157132 - protein, 76 aa, Triticum aestivum
  Clone ID: PAT_TA_51550.pep
RSPSRGPGCTRTSNPMKCSSSATQSCFPLAWTPSSNRCNPSHLHHLVCKVLPQSRDPKSLSILLAIHGIYHQLFRS

SEQ ID NO: 157133 - protein, 145 aa, Triticum aestivum
  unsure (1)..(145): unsure at all Xaa locations
  Clone ID: PAT_TA_51551.pep
MEMITTVSVYERLVKEXLPKMEYDYYSCRAIDQRTLNETREVLSRILMQPHVLIDVYYINMDPNILGFDLFMPIMIATTAMQKMVDPIGKLATDQSPVCAGTIMTFELWATSSDVRVNSYRPTILLFQLYGYKDRHIVGQLKKRA

SEQ ID NO: 157134 - protein, 56 aa, Triticum aestivum
  Clone ID: PAT_TA_51552.pep
ICWPELQAASSHLYSNRGSLASQRLHTSCSHSHSRTDELTHTHVLEVELTYYLLWS

SEQ ID NO: 157135 - protein, 114 aa, Triticum aestivum
  Clone ID: PAT_TA_51553.pep
CYPCCSTAVNYYSLRLRTFPDTTLMSKERKRKNILRSINMHLARAKMQTKKRHSGQCSLRMLARRSKSNSKQIKSSQIHEVKSCALNLCPRSAWHHATALLDITFLPNFSELCF

SEQ ID NO: 157136 - protein, 88 aa, Triticum aestivum
  Clone ID: PAT_TA_51554.pep
KKLLVIDFPAQWWGPSRIMAPIFFDFPKKFPAVVFFKVAVFEFKPIFEQFRVGAMPPFLFFKEGDVKARVVGAFKGEFPPKVGLPGAA

SEQ ID NO: 157137 - protein, 198 aa, Triticum aestivum
  Clone ID: PAT_TA_51555.pep
PYRICRPKSRVLGKGELVVDLKKIQRRYARSDLCIDILAAIPLPQVTVWLIMPGIKRSDYNIQNTTYAVIILVQYVLRMYLIVPLSNQIIKAAGVVAKSAWGGAAYNLLLYMLASHITGAIYYLLSIERQITCWNQQCLAESSNMSCNIGFISCENTGLNSYREWQSKTQIFNNCDATADPPKFNYGMFSSALTKRAV

SEQ ID NO: 157138 - protein, 98 aa, Triticum aestivum
  Clone ID: PAT_TA_51556.pep
ALLFHALRSSYPPPFRSQSAMPLSDRPRKGFLTFEVGTACGIRIRISACWLWMCSPLMNVCAAPHPRPWARRLSSQLTGASRHTASPHRFSFSLVQIP

SEQ ID NO: 157139 - protein, 153 aa, Triticum aestivum
  Clone ID: PAT_TA_51557.pep
FVIQAGTDASLVPTEMSTINATVRLTFRNTGSFFGVHVTAQPVTLYYSQLLMASGDMKYFYQPRKSQRKVAVTVVGNKVPLYGGGAGLSSTPGPKGVPPPPVPLQLTLRIRARALVLGKLVKPRFYNNVQCTVRLDTTKLGKAISLKKSCTHV

SEQ ID NO: 157140 - protein, 139 aa, Triticum aestivum
  unsure (1)..(139): unsure at all Xaa locations
  Clone ID: PAT_TA_51558.pep
DPACAMRRNSTRRIVRWRLKQDLEHARSRCASPSSLSTPTRNQLAPCSKMGTIRRNSNGVACTRSAFRAVHACETMLSSRRQMVVDEEVATAANTAVAGCRGENGRVWRGCGGYQLFFGAMAAARSGEGGGGXEGRPRX

SEQ ID NO: 157141 - protein, 134 aa, Triticum aestivum
  unsure (1)..(134): unsure at all Xaa locations
  Clone ID: PAT_TA_51559.pep
RKLEVSLKEMLIDFLPTDGGXSLAEAPALVKAPGGAPANVPIGAPRLGGMAVLRLKLGDDXFGQMLDKMLRHNGVNTVGDNFDSGARTALDFVTLTALGXRKLMFYRNRKAIMLLTANELMVDIINKAEVFHYR

SEQ ID NO: 157142 - protein, 155 aa, Triticum aestivum
  unsure (1)..(155): unsure at all Xaa locations
  Clone ID: PAT_TA_51560.pep
QVFDEDRCSGGHWEATCRHHSLHGQHTTLDAMQKRCKYSXDRLNPAAIKEVFEARALRMAVNCAQNISKAPSQEEGFSELSPDLLEAAVAHVQLIIVTKFIEKLQEDIPGPGVKEQLQNLCSIYALHLLHKHXGDFLSTGCVTARAGALANELLG

SEQ ID NO: 157143 - protein, 131 aa, Triticum aestivum
  Clone ID: PAT_TA_51561.pep
FSVELPVAFDGVVGTAGHQSGDGVSRAPQHGVGREPWCRPHRRSMAGAPHASILGCASGAASTYRGRLGHVSSLHERAQLRAPCWPPTHSSASSFLGAPGVLDPVHVPCRRLLLLHAPMSAGRSDRIRCGW

SEQ ID NO: 157144 - protein, 184 aa, Triticum aestivum
  unsure (1)..(184): unsure at all Xaa locations
  Clone ID: PAT_TA_51562.pep
GLAPXATADAAFPHTADTDGRVSPGFYRTKEQTPCRRWTRKREVEEEEEEKERSLVSIMKTKPLVPGSGRARARVVSLPRKRAKDYGNVPLAELLLRAMEHDKQAEKDYEEEEENGEDEDEQGTLFEEEDSHFDVKALSVMLCKIALFGSQRSIFLLYKVQRRSCPKFKSNDAQFFLXKKKXKX

SEQ ID NO: 157145 - protein, 209 aa, Triticum aestivum
  unsure (1)..(209): unsure at all Xaa locations
  Clone ID: PAT_TA_51563.pep
DPTTGWIGPDGLWRIAVGAELKSYTAALLYKSEDFLSWTRVDHPLYSQNLSNIVECNMWECLDFFAVLPGNNTGLDMSAAILRGTKHALKMSVGYFDKYLIGVYDLKRDAFVPDTIVDDCRLWLKIDYGNFYASKSFFDSKKXRRIIWGWSKEADCRSDDVAKGWAGIHTIPRTIWLDSNGKQLLQWPVDEIESLRTNEINHQGLELNK

SEQ ID NO: 157146 - protein, 208 aa, Triticum aestivum
  unsure (1)..(208): unsure at all Xaa locations
  Clone ID: PAT_TA_51564.pep
GRVGAEVNVVSSAPPAEEEEEEAGNLDRFLASTTPSVPVRNTPETSLRMRRSGDAMDSSPYFCLDDLWESFREWSAYGAGVPLVLNGGDSVIQYYVPYLSAIQLYADPSRPVAWYPIYRIPTGPTLKDLDACFLTFHCLATPSKDSHPTTPACPGFEGIGHCTTATGRLSLPAFGLASYKLRSSLWASNGAPEXESVTSLMQEADNWL

SEQ ID NO: 157147 - protein, 109 aa, Triticum aestivum
  Clone ID: PAT_TA_51565.pep
VRFFFLRSASPPFFFFFFFFFFFFFFFFFFFFFFFFFFFFFFFFFFFFSIPILILSSSSLQQQPQLTRREHTPRTLLWSCAQSPVPYTAIRYIAILVSVGRAAACVLRT

SEQ ID NO: 157148 - protein, 88 aa, Triticum aestivum
  Clone ID: PAT_TA_51566.pep
LELQSVQLCDSSTSSSPTEPSKICRDFTKITTCWQAAFLDETEKKMDEEHAEKSHGFCCHFKQSKLPTGAHLSWRNGDTQEQFFSHIE

SEQ ID NO: 157149 - protein, 115 aa, Triticum aestivum
  Clone ID: PAT_TA_51567.pep
RGLDTRATGLWVTPGGAKSLLNLKLGLAVETRRRAQERHTFTQHLGPAGSRPLCQLADVAILYGTELGREFWAIAGASTLGASAQTPAGWELTHMLRTPPSPWDCMRTSAPPMPP

SEQ ID NO: 157150 - protein, 66 aa, Triticum aestivum
  Clone ID: PAT_TA_51568.pep
QSRIVSYKANQFLMICHSFKPQQQDITPRLQYRARANEGTTQDTRIQGFYRATDWTRSQRSCLMRK

SEQ ID NO: 157151 - protein, 157 aa, Triticum aestivum
  Clone ID: PAT_TA_51569.pep
RVAQRFGPPAAAPRRAKPNPPRKGEPRRDGFSAARLFSQGVSYTYDDVIFLPGFIDFPADAVDLSTRLSRRVPLSVPCVASPMDTVSEAAMAAAMASLGGVAVVHSNTEPRAQASIVRAAKSRRLPFVSSLPIFCPAFAPTLNDFAGPDYAPVTGQG

SEQ ID NO: 157152 - protein, 200 aa, Triticum aestivum
  unsure (1)..(200): unsure at all Xaa locations
  Clone ID: PAT_TA_51570.pep
FNYELVXQMIEIYNEQIHDLLGSNGSEKNLGILNSSLPXGLAVPDATLHPVNSTTDVIELMRTGLGNRSVGATALNERSSRSHSVVTVHVQGVDLKTGATLRGALHLVDLAGSERVDRSAVTGDRLKEAQHINKSLSALGDVIFSLSQKTSHVPYRNSKLTQVLQSSLGGHAKTLMFVQINPDVSSYAESLSTLRFAERV

SEQ ID NO: 157153 - protein, 75 aa, Triticum aestivum
  Clone ID: PAT_TA_51571.pep
CYCCHPMHIVVIHSLLPCLQVSCWRPGSERSDRRWSSTGTSSTRWTSRGPTSGTVHLLVGRKRSQVHDISLNHYS

SEQ ID NO: 157154 - protein, 197 aa, Triticum aestivum
  unsure (1)..(197): unsure at all Xaa locations
  Clone ID: PAT_TA_51572.pep
HTXAAPPPSSGPPFPPAAPAHEEAAGGAAQPGVAGRRRRRGADASQGGGSARLRLCIHLAAHGSMCAEAGTGDHEQMSSADARCAKSGKMGAASPQAFQDAVPDGSECACLAYRRYASEQAGGNVHREAPEQPNQYIAPPYWRNPAADAASDGDAYESSALVAREPYGRITSALEGSNKRSTRRCAWSATTQGVRVC

SEQ ID NO: 157155 - protein, 91 aa, Triticum aestivum
  unsure (1)..(91): unsure at all Xaa locations
  Clone ID: PAT_TA_51573.pep
SSITSRPLTSSCIAFSPLIVTQHAIFYKTPETERPAHPPPARGGTLGERNETDCXQTPWTDAGERRILRLLTDXENVEGRDLLHPCIXPAW

SEQ ID NO: 157156 - protein, 150 aa, Triticum aestivum
  unsure (1)..(150): unsure at all Xaa locations
  Clone ID: PAT_TA_51574.pep
AWATQRPVIKALIDLQALEPTGDLSPVRRSGQFFLDNLLCQXRINRHTLAAIAEDLFAIALDQXYRFPCTFTFVIRALSTLXGIAYILXPDFSFVNSGAPYAQELLALNTRLRAGPELVQEIKKXANDDPNSTISTPYISQRVEDYDWVT

SEQ ID NO: 157157 - protein, 73 aa, Triticum aestivum
  Clone ID: PAT_TA_51575.pep
HSTTARAIMDEYYVGEIDATPIPPKVKYTPPKQPPFNQDKTPEFVIKILQFLVPLPILGLAVPVRIYPKAEFV

SEQ ID NO: 157158 - protein, 75 aa, Triticum aestivum
  unsure (1)..(75): unsure at all Xaa locations
  Clone ID: PAT_TA_51576.pep
PQEVVGPVPPKGSVLGFFPXPMQAVKQGFQDLGAPPWRPAHDLFRAGTFRLKVGPGPPQVEGGTPGLVSAEKKSF

SEQ ID NO: 157159 - protein, 65 aa, Triticum aestivum
  unsure (1)..(65): unsure at all Xaa locations
  Clone ID: PAT_TA_51577.pep
VGGGVVFFGTPKERIVFFXNAICGICLPKYSTHFYFREVPCPPFFPKKWVAKWPQINPLCPLSKV

SEQ ID NO: 157160 - protein, 120 aa, Triticum aestivum
  Clone ID: PAT_TA_51578.pep
RPPASKEGGQKKGKKKSKKSVETYKIYIFKVLKQVPPDIGISSKAMSIMNSFINDIFEKLPGESPKLARYNKKPPLPSREIQTSVRLVLPGELAKHPVSEGPKAVPQFPPSLESPLLCLP

SEQ ID NO: 157161 - protein, 118 aa, Triticum aestivum
  Clone ID: PAT_TA_51579.pep
EKVEEKVQAIGFEFPVFVKVMNERDVWSPKRLSFSLEYASACRFPLEQTHVILGLEGSNMKWFSRMVAQKHKDVRHISSFWKDLVFLAGMKVGDICLVELADRSSESLPMTVHLIRKL

SEQ ID NO: 157162 - protein, 103 aa, Triticum aestivum
  Clone ID: PAT_TA_51580.pep
APTRATGPNQPHAGGNYSSKVKDKITITPSSTSSFFLISRRADPHQTRSILFQLFPSSSQCHRVLLLHQTCFLRLIKAESVVDLDPQQLFCGQSLVNPGHQVR

SEQ ID NO: 157163 - protein, 43 aa, Triticum aestivum
  Clone ID: PAT_TA_51581.pep
RELPCGHHFHCACIDKWLHINATCPLCKFSIRKGGSSSGSEEV

SEQ ID NO: 157164 - protein, 64 aa, Triticum aestivum
  Clone ID: PAT_TA_51582.pep
AIANQLGGPTWKGVPPHTGGGASVPPVKKAGLAPKISPLSPGGGASLELLEGKPLPGVFALPEG

SEQ ID NO: 157165 - protein, 89 aa, Triticum aestivum
  Clone ID: PAT_TA_51583.pep
SIDHLHGGRSKWQCVKPLSCGRYLEALSAPWSAIHRHTHIFATTDACTSNNMLVFYRNFNMSSKKGENHNPFSGKKKNKPLGVGGLGAC

SEQ ID NO: 157166 - protein, 60 aa, Triticum aestivum
  Clone ID: PAT_TA_51584.pep
VCKAASAASKLAEQAFEAASANKRLDDKLLPLKCCLMSVSLPWDFIAHDLLHKETPPLDF

SEQ ID NO: 157167 - protein, 55 aa, Triticum aestivum
  Clone ID: PAT_TA_51585.pep
VLVRNIPPNPDESVSKPVEHFFLVNHPDHHLKHQVITKFWNISHLKNHHFIRSVN

SEQ ID NO: 157168 - protein, 93 aa, Triticum aestivum
  Clone ID: PAT_TA_51586.pep
GSINPSFSFRPNSCWVWTQTQFSIKIWDLESKLFAQALWPRVPVPPKQMLACTCLSWSAEATPLIRWYHLWKYTACFKVGRVHATLHRVCFLF

SEQ ID NO: 157169 - protein, 58 aa, Triticum aestivum
  Clone ID: PAT_TA_51587.pep
DFGIQRLSSLARLTVSLFCVGSTAAEVEATEDAFKSMAEANPNRPILEMIRVNPHRMF

SEQ ID NO: 157170 - protein, 103 aa, Triticum aestivum
  Clone ID: PAT_TA_51588.pep
GLRKSVLKRAVIVAIVFIRYVAMPVIGIAVVRAAHGVGFLPHDPLYRYVLMLQFALPPAMNIGTMAQLFDVGQEECSVIFLWTYLVAAVALTTWSTVFMSILS

SEQ ID NO: 157171 - protein, 127 aa, Triticum aestivum
  unsure (1)..(127): unsure at all Xaa locations
  Clone ID: PAT_TA_51589.pep
FLGGEGGAGKGKGLQRGAREKAVGGALRKXGGAKGRQGNQKVAKGSFSGGGIFLALLGGTKGRGKKLGKFEGMMWTPGFILGNGPKTKTKGWPFWKEIKWGRLFHSRGNKKCGLGGGPLFPEKVVPC

SEQ ID NO: 157172 - protein, 71 aa, Triticum aestivum
  Clone ID: PAT_TA_51590.pep
SQANWNSLAGGVALNFNRRARTSHSEIGCDSFHSIGDMFLEQTVQWLTRVIRLGCADIAAVGEGRSRLELV

SEQ ID NO: 157173 - protein, 95 aa, Triticum aestivum
  unsure (1)..(95): unsure at all Xaa locations
  Clone ID: PAT_TA_51591.pep
TLLLHDTCCTLGEKNPRRFFEGAALLRRMNRFGLLAAGPDKLDYVLALSAENFLAXRLPTLVFYAGVAKSIHHARVLIRHRRIRVGGLFLSAPSF

SEQ ID NO: 157174 - protein, 95 aa, Triticum aestivum
  unsure (1)..(95): unsure at all Xaa locations
  Clone ID: PAT_TA_51592.pep
MAKAFTAVPSILPVKILNVQSVALSKYSQLQKLPTRPDGMFMHLRHMTCRIIVHSRPQEANYDIEVLQLAYCLDAAPQLETLXLNVIVVLFIKKY

SEQ ID NO: 157175 - protein, 54 aa, Triticum aestivum
  Clone ID: PAT_TA_51593.pep
SRVRCGNATRTIQGSVCDPVSARVPARRQCSRGWPVALSAGKPSPACRVPPPVL

SEQ ID NO: 157176 - protein, 113 aa, Triticum aestivum
  unsure (1)..(113): unsure at all Xaa locations
  Clone ID: PAT_TA_51594.pep
MANVPKTNKTYCTNRCASKHTLHKGTQYMMGXDSLSVHGKRLCYMQRAGCGAQTNPALHMMXETTKMIVLKLLCPTLMHYSQRPLXRRXPFEIGGXDKKGRGTFSSSGIAFAL

SEQ ID NO: 157177 - protein, 156 aa, Triticum aestivum
  unsure (1)..(156): unsure at all Xaa locations
  Clone ID: PAT_TA_51595.pep
RPVGGAHRGRSRRRRCPPTRAGDLARARLAWGLXXALKRLNAPSHWLLDKLGGAFXPGGLSGPHXARECLPLVLVLXNRLDSALTYRXVLSILMPRRFLVAGLVRSVSTSPAGFLALLSLPPPGALSRLLCGSXARFRLPSVWAVVAHSPLCLVRS

SEQ ID NO: 157178 - protein, 86 aa, Triticum aestivum
  unsure (1)..(86): unsure at all Xaa locations
  Clone ID: PAT_TA_51596.pep
KLLHSAGGREDAPEFAKKLASVADLYVHDAFGAAHRAHASAXGVARXLMPSVAGFLLPKELDSLVGAAANPQTPFAALVGGSGASS

SEQ ID NO: 157179 - protein, 115 aa, Triticum aestivum
  unsure (1)..(115): unsure at all Xaa locations
  Clone ID: PAT_TA_51597.pep
SATTYGPSSFSAAVTIFRGLRASPPPEARSVDSXAYDCNSVGEQELRWGGLLMYHSFXRVTREVVGSGGXPKPVFHWLQGDSVQSRPLLNECMLFNLLAWRSEEDSLTDGSWLCE

SEQ ID NO: 157180 - protein, 161 aa, Triticum aestivum
  unsure (1)..(161): unsure at all Xaa locations
  Clone ID: PAT_TA_51598.pep
KGGPPGFPPPPGGKTGAREGKKGAPKKKKKRAQPPGGKQGPPKAAPPLKKKNNNKKKTTKKNKNNQNHTPPPTNNNQPTNXXXXXXXXNSCFFICIYHFDTPPPTTNIAHNPLGSLSLXLXISLSLNKGKEKEKKQRRIPEGGRDGSADSSNSPDTRXLEL

SEQ ID NO: 157181 - protein, 78 aa, Triticum aestivum
  unsure (1)..(78): unsure at all Xaa locations
  Clone ID: PAT_TA_51599.pep
KTSXKNTSKVSTHKALREHPWCLCFPRFVWNGVNVCNNRKIIGNWVIEVMPETLLSSFLXFICTRLFQLIFVFNHVVK

SEQ ID NO: 157182 - protein, 68 aa, Triticum aestivum
  unsure (1)..(68): unsure at all Xaa locations
  Clone ID: PAT_TA_51600.pep
VVRRLQPHSPPTTCMSSTSFLNGVLHQRKLNDDRRAQERRHEQDGDQRGHGTPRXDLLSRRQAWSSAV

SEQ ID NO: 157183 - protein, 97 aa, Triticum aestivum
  Clone ID: PAT_TA_51601.pep
HNTPTREPPPERNEKSPPKRTSLYPEREGRGGGLAAPKQHGSMLCRVRQAPHQQIYASHRRPAWGGRRGSGSTLSGMLALQTKKERERRVPSMPRRT

SEQ ID NO: 157184 - protein, 112 aa, Triticum aestivum
  Clone ID: PAT_TA_51602.pep
VKLKYRVSLVPSCRDRYQHRLLRPSVLLSKLSPAQVALIKCKVLVRGTRDHELVRPVADGHHSTGVSVEARAVPVPAINRRRLRQPGYLCSVAPVVVLVSFSRPIGRGTYVW

SEQ ID NO: 157185 - protein, 80 aa, Triticum aestivum
  Clone ID: PAT_TA_51603.pep
HRARVDQGSVLVVWPVWGRAQTHRDQVEHQQPALASTALVTLWEHGWHVADLACGVRRQYSIRSRPCQRTECAQGRQTAV

SEQ ID NO: 157186 - protein, 72 aa, Triticum aestivum
  Clone ID: PAT_TA_51604.pep
CVTPWLLIARRSNRRCSSQGLFLASAVVSPVCLSSSGCLSNVKSARVLVLTCMEPLMMGCYELLWAPIKSLL

SEQ ID NO: 157187 - protein, 105 aa, Triticum aestivum
  Clone ID: PAT_TA_51605.pep
PVKVVDIVDTFRLQEQPAFDKKQFISHMKRYIKNLFAKLEGDALDAFKKNVESPPKYLLSKLKALQFFVGESMHNDGGVVFPYYKEGAADPTFLYFAHGLKEVKC

SEQ ID NO: 157188 - protein, 114 aa, Triticum aestivum
  unsure (1)..(114): unsure at all Xaa locations
  Clone ID: PAT_TA_51606.pep
HLIGTQVRPRISDEYAQGFTDKGFLARGQRTRVSKQGMXETNHKERVQSREPHIREGRQIFNVPSFMGREKSRTHKFFSKTRPHGAGPTGRVKRRQPQQGEAVAQITGGNKEEE

SEQ ID NO: 157189 - protein, 94 aa, Triticum aestivum
  Clone ID: PAT_TA_51607.pep
SEQSFRGPPSPKGSFFGPPKKRIFLAPSPRRAVLPFGILGKNFFGKLSCPRFCKPRQLFYPNLYPDPGGSYGFLLRSFAPGYFNWGYSQKEPCF

SEQ ID NO: 157190 - protein, 95 aa, Triticum aestivum
  Clone ID: PAT_TA_51608.pep
AALFHKVVGMVKLAERLDVPANTSFHNSVLAACAKAEDLMEMERVFRHMKHMQCEPDAITYSILLEAYRKEGMFDKMYALQQENPSLVSTELVMV

SEQ ID NO: 157191 - protein, 129 aa, Triticum aestivum
  Clone ID: PAT_TA_51609.pep
QLVEYEQKLFGPSAGSPAQTTVLTESFPSLGFGFPQPSGDIQVPAFNQTPVPSFSSGPAQTMFPVTSLSEPTVQWESESVPPQGSTMAQSPQLRRITRWTALKMTFNMSHITWDRCMLLLGLSNMSLHV

SEQ ID NO: 157192 - protein, 159 aa, Triticum aestivum
  Clone ID: PAT_TA_51610.pep
PIKVHLIINKLTLLTRSWNELTLACLICNFDCSISFRHVGKCILNYNSDSSYRALLRELNQVIMFDTGITALLAQKIICACPRIVSRTLVSVHQGITFLYKNLCKLLSNTIDSRTKGEGLFFRLSIKEQESAFEFFPLMSEYIKKLGGPMCSIKRNMWT

SEQ ID NO: 157193 - protein, 144 aa, Triticum aestivum
  Clone ID: PAT_TA_51611.pep
QARTTRTDTNCIGWFRKNHGFTTRCSRPTHTHEKIERFTPRQHLEMKKAKPSYHFTTRAVSPSFSPTRCLMIPVNSCTDQYSALSSSSARATLLPSSVVMARFFPSLAAIKPSFKALLSFLRLMLARATFCFAHSSLLSSVMMT

SEQ ID NO: 157194 - protein, 74 aa, Triticum aestivum
  Clone ID: PAT_TA_51612.pep
SHCSVCQHTVSWHRVTPITEECCFAHGLFQSVGGISCTSGPRYLTLVCNTATTLTIGLESGTGCWLRSTCAFRT

SEQ ID NO: 157195 - protein, 73 aa, Triticum aestivum
  Clone ID: PAT_TA_51613.pep
RLERAPRFTSLQSPCLINPCCPVGSTKIMMWGFVSLSPPMATGTLPLLLLLLGLWRLRLPPVVLVVVHPDLED

SEQ ID NO: 157196 - protein, 120 aa, Triticum aestivum
  Clone ID: PAT_TA_51614.pep
MTNGGVDRAVECTGHIDAMIAAFECVHDGWGVTVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 157197 - protein, 99 aa, Triticum aestivum
  unsure (1)..(99): unsure at all Xaa locations
  Clone ID: PAT_TA_51615.pep
MWDVFELMMSIIFSGSVVVANELFFFLVXAXDGGGGGGLTRLCXXXXARGGGLDIVSGVSGXSVALSAVSRGPPCVLFFLVPFGVVCSGPGFWWVFLRV

SEQ ID NO: 157198 - protein, 158 aa, Triticum aestivum
  unsure (1)..(158): unsure at all Xaa locations
  Clone ID: PAT_TA_51616.pep
GNQRTGFAPPSSSTHKRLKKTIRWGERASNTGLILDSTISPRVTPNICNPPNQFGPHLITACVGQPQVIITPGGKPGAGDPPLVRFPTPRPRGCRPPRGRPRPXAVAEPEVPGREPEPYGDEPPPLEGHDGEPEEGPLPRVDPXRAPPGPPRPGRAPP

SEQ ID NO: 157199 - protein, 73 aa, Triticum aestivum
  Clone ID: PAT_TA_51617.pep
FQPCQSRRWVAGHRIRLDEGIFRWDRDKEWFWQLHEVRSHDMQDYGSVFGAQCEKHGGGGKQLYRRNKRASTF

SEQ ID NO: 157200 - protein, 104 aa, Triticum aestivum
  unsure (1)..(104): unsure at all Xaa locations
  Clone ID: PAT_TA_51618.pep
VLQNEVWGGGLHXCSTACCKIPHLSFTTTGLSGEGKVSLSRGMLLTRVAXLPGLNLXQVLPLLLGLFLWLGLGPLGLRGXLLXANTPRLAFXSPIVPAXGRMLV

SEQ ID NO: 157201 - protein, 95 aa, Triticum aestivum
  Clone ID: PAT_TA_51619.pep
FSRACQPKPGGFRRHPNVPSDRCIGKPEQLSMSQRPGVRNLGSQKSGPCRCGHQHGLSGLLIGFCFLVFGWVRSPSQQESAWCYKERSGMCALVR

SEQ ID NO: 157202 - protein, 161 aa, Triticum aestivum
  Clone ID: PAT_TA_51620.pep
VAWLVPPFQVGNPPVTIILCIALSAFVTRAKSSGSFLLTFLHRYHVLRESGGVIFNPWFIHGSFQACTLLGVCRVPYALKLAPSFSVWRIDLQMYMGRHSLGVRPSGQVHEGAPRCNPMGRCPPFSNSRRLAQYNTGALCICSKIGRRTCYSAPRCRRKLG

SEQ ID NO: 157203 - protein, 83 aa, Triticum aestivum
  Clone ID: PAT_TA_51621.pep
AASPSPSPSALRAWIGRRRRDGPSPRPGAGSPSRRSWPGAPPAGAPRRPARAGAPPRPGRRAPRPWDPLPWLLAAGRRGRRQC

SEQ ID NO: 157204 - protein, 148 aa, Triticum aestivum
  unsure (1)..(148): unsure at all Xaa locations
  Clone ID: PAT_TA_51622.pep
APPPARERAAWPRAWETCGCFGVQPSPVKVCRGVPVPFFWLSAVGLXRGGVVVFSHCVXLVSWGLANVSCEALVAARFACFLCLALPAGLGAFLLRVRVPPFLVLRFSXLLSCAGAGWLPSVFWGAFGXPPGVCARFALGAVLLSVRW

SEQ ID NO: 157205 - protein, 71 aa, Triticum aestivum
  unsure (1)..(71): unsure at all Xaa locations
  Clone ID: PAT_TA_51623.pep
AKARAGNPAEAPAHRGKRSQRTPASHAHRAVRQPPNNWXAPPSSGKGTRETKGGPKAARHTGAARKPNAHE

SEQ ID NO: 157206 - protein, 114 aa, Triticum aestivum
  Clone ID: PAT_TA_51624.pep
FSTASLTPGGCGSFLLVYCLTLVFSGLPLVIGEGFLWLSDHAVLAPSGSAVAGSFPLLAPRPGLCVVKGGGGTCFRCAIVFCWTSVRSPWMLVAIATYAFGELAVPLFFLAFVL

SEQ ID NO: 157207 - protein, 74 aa, Triticum aestivum
  Clone ID: PAT_TA_51625.pep
ALAPQGVCLTDATLDQSKKGNQKADKSQLVPHFKCVSILLPIHFIIVTNFGSSVPNLANPRICETPSSLIFLSK

SEQ ID NO: 157208 - protein, 111 aa, Triticum aestivum
  unsure (1)..(111): unsure at all Xaa locations
  Clone ID: PAT_TA_51626.pep
PTEQHKGKDXTKRPASQTRQSQERTSKTTKWTSKEQKCSQHKIQTESTANDGEKKKRVSSKATHPPPRDCRRSTGKTHDKHDXXANPKXTLEEQHVLRSELXGHQPLRIKD

SEQ ID NO: 157209 - protein, 56 aa, Triticum aestivum
  Clone ID: PAT_TA_51627.pep
SAMGTTKNDGKSQTMTVEMTTDELKKWLGFKEGIIDERSTTKIFATAASPYGDTRI

SEQ ID NO: 157210 - protein, 81 aa, Triticum aestivum
  unsure (1)..(81): unsure at all Xaa locations
  Clone ID: PAT_TA_51628.pep
PHRRSVSSYILRIASTPDHVASIGVVEVSCVVAAEGRLPCLALDEVLFHGSATSTIAACLGPSCGXMALPTCLPLFSDRRM

SEQ ID NO: 157211 - protein, 104 aa, Triticum aestivum
  Clone ID: PAT_TA_51629.pep
MGTQGAPFLNLPKKKAESPPPVPQENNKPPAPMDQAEEDAGAIPKSVVSRKKRAPLEPTTLSPERKKSQVALPHPRKKAAESRASAKAKRRGGPKFPRPPPIML

SEQ ID NO: 157212 - protein, 144 aa, Triticum aestivum
  Clone ID: PAT_TA_51630.pep
RRCDARDPESLLDLAKGVTTDESFKSYAESISAISGLMLVLCNCFLPWSGEMRTRDHIMFRASSADHEGGNIGFPDGRRLPILFLSDGIVTQAFHRRRHLRVMSNMTPSRSVMVVLVPSTSSTSIPRFSASFSTSASMTLVRDT

SEQ ID NO: 157213 - protein, 94 aa, Triticum aestivum
  Clone ID: PAT_TA_51631.pep
PSTCYRAMLSAVVVTRKRRRSGMLGPLRRRELGIGRSHGRSSWLLEYGMLHTNVKCGSSMSYGPHQGARSCKRIRLSSHQWMRSCFCVHHQWTW

SEQ ID NO: 157214 - protein, 110 aa, Triticum aestivum
  Clone ID: PAT_TA_51632.pep
GHKRGGAKPRLKEPGLLGPKKWKGGKKPPFGGGGGRPVSKKAPPAPPKKQWWGAKKNAPPPGPQIGPKKKKKKKKKKKKKKKKKKKKKKKKKKKKKKKKKKKKKKKKKKN

SEQ ID NO: 157215 - protein, 93 aa, Triticum aestivum
  Clone ID: PAT_TA_51633.pep
PDAHGAVSPQKSQDAPGVGQNGLSPTSLSSRTYLKSASISASKCVVVNPNKQPEYDDAISEETEGAVDGLSEKVSKMHTGAGPAWIDVFLHSM

SEQ ID NO: 157216 - protein, 106 aa, Triticum aestivum
  unsure (1)..(106): unsure at all Xaa locations
  Clone ID: PAT_TA_51634.pep
VFDDQPVKVVDIVDTFRLQEQPAFDKKQFISHMKRYIKNLSAKLEGDDXDAFKKNVESAQXLLSKLKDXQFFVGXSMHXGGVVFAYYKRELLTNFPDFAHGLKGKC

SEQ ID NO: 157217 - protein, 124 aa, Triticum aestivum
  Clone ID: PAT_TA_51635.pep
EGKSPRAKSARRGPAKQKRGEAPPEKEGGTPRTEPKKPPGPPKKARQKGQKKGEEMLSGTATVKKRVAEDQSRPTKTYVRQPPISRATRRHRQSEPPPNRQAWHTRKKKKHQIQHGSTLREYVV

SEQ ID NO: 157218 - protein, 149 aa, Triticum aestivum
  unsure (1)..(149): unsure at all Xaa locations
  Clone ID: PAT_TA_51636.pep
ARYLQLDRKKCCFPANLAAHVCEWSNKHTEVGTATSWDGALQMGTRHFQHKYYNLFTCNCXSFVANCLNRLAHGGSAEWNVLNVAALVWLHGEWVDKMSIVRSFAPFVTVTCIGVFMAGWSFLIGISAFCLLLIGWFVFAVNCMKGLVC

SEQ ID NO: 157219 - protein, 115 aa, Triticum aestivum
  unsure (1)..(115): unsure at all Xaa locations
  Clone ID: PAT_TA_51637.pep
PGPPTGPGRGSQPTGASPPPTPNPPPPGGRRRSKKPGGKKKRXSPGAPKPQRAAGGAPGNGERSSPPPGGGKGGGKNPINEXGPCGQPGSQGPQGSPSPGNPPGFALCKKPPPLP

SEQ ID NO: 157220 - protein, 89 aa, Triticum aestivum
  Clone ID: PAT_TA_51638.pep
KNSKGAPPPPKVSPGKLKKTTKAFKISPKKKKKKKKKRGATQIFFFFFFFFFFFFFFFFFFFFFFFFFFFFFFFFFFFFELVPRSAERP

SEQ ID NO: 157221 - protein, 102 aa, Triticum aestivum
  Clone ID: PAT_TA_51639.pep
VHVVSGLPAASSRERLEILDDESHVLSFRVVGGEHRLKNYLSVTTVHPSPAAPSSATVVVESYVVDVPAGNTTEDTRVFIDTIVKCNLQSLAKTAEKVAAVS

SEQ ID NO: 157222 - protein, 139 aa, Triticum aestivum
  unsure (1)..(139): unsure at all Xaa locations
  Clone ID: PAT_TA_51640.pep
AAGIWNPKTHQPVQQVLAEMTNGGVDRSVECTGNVNAMIQAFECVHDVXLAKTLIIHSSMIILHCLFSLDENLNSVIYIQGWGVAVLVGVPHKDAEFKTHPMNFLNERTLKGTFFGNFKPRTDLPNVVEMYMRKVNRNR

SEQ ID NO: 157223 - protein, 110 aa, Triticum aestivum
  Clone ID: PAT_TA_51641.pep
IAVVVGTITDDMRIQEVPAMKVTALRFTETARARIINAGGECLTFDQLALRAPTGENTILLRGPKNAREAVRHFGKAPGVPHSHTKPYVRSKGRKFEKARGRRNSRGFKV

SEQ ID NO: 157224 - protein, 145 aa, Triticum aestivum
  unsure (1)..(145): unsure at all Xaa locations
  Clone ID: PAT_TA_51642.pep
VDQDGAHTASPLASFQQXRRLLCAQQPTIARILCCGCPGDSWLETRELRAWGYSATTHYSRRLAELHTTMPPNWELQPAVWLELHACIQRRCSTTSCNRSVWRCIQGEEGCIQWRTPTTRSNREIRSWNQPHPFNGRPASMDAGL

SEQ ID NO: 157225 - protein, 110 aa, Triticum aestivum
  unsure (1)..(110): unsure at all Xaa locations
  Clone ID: PAT_TA_51643.pep
FRREPTSEGMRRWPQLHSSMXLVXLGXGTRSTSXPCSLXVPSPAXSTPAAFFWWXXXAAVWGGHCSIVLIFSAFSGFTFWRQSAVRLGLRCGALGVLPLFPFCRCCVVFL

SEQ ID NO: 157226 - protein, 102 aa, Triticum aestivum
  unsure (1)..(102): unsure at all Xaa locations
  Clone ID: PAT_TA_51644.pep
LSCCGGNCGCGPACXCGNGCGGCXLSPEAVAAGXPLLVSAAGAHLSCSGGMVMAAASGGCGCSQCMCGSCCGCSCCRCCVVGARSCVLRACGLRAVALLLPC

SEQ ID NO: 157227 - protein, 205 aa, Triticum aestivum
  unsure (1)..(205): unsure at all Xaa locations
  Clone ID: PAT_TA_51645.pep
VHLLVGTPGRILDLTXXGVCILNDCSMLIMDEADKLLSPEFQPSIEQLIRYLPASRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLH

SEQ ID NO: 157228 - protein, 88 aa, Triticum aestivum
  unsure (1)..(88): unsure at all Xaa locations
  Clone ID: PAT_TA_51646.pep
GPGXSRLRDGXXPPXGTGPLLQGXXLHRAVXATXGRHATRTRHRASTHRATLPPGRFGLYIIAPKRVGGGGAAVSCHRLPTPEXEPLD

SEQ ID NO: 157229 - protein, 79 aa, Triticum aestivum
  unsure (1)..(79): unsure at all Xaa locations
  Clone ID: PAT_TA_51647.pep
LPHMLWLGRSRDELSERLLIIESVNITGDGVAMTCKVKVLYINLCVSLTFMSDSKITLPFTFVCILYIXNAVQTTFCLC

SEQ ID NO: 157230 - protein, 57 aa, Triticum aestivum
  Clone ID: PAT_TA_51648.pep
AKQKNGTRNKWKQAETASKATSASDQARNTPPRYRSLLTRGELNPALGGSPRLGPAW

SEQ ID NO: 157231 - protein, 83 aa, Triticum aestivum
  Clone ID: PAT_TA_51649.pep
MGGGGRGRSSTGAGAGWAWSWACCAVAAGVAAVGLAGAGVLVWWAVAFLPARVLLWLVPVGLVLLGSPLVAWLFLFASGACRR

SEQ ID NO: 157232 - protein, 59 aa, Triticum aestivum
  Clone ID: PAT_TA_51650.pep
MEFTAETLDFKFLLKPKDAETPCITEERPTRLLTRGMLQGDVRLANFRLNGDDQLLEYK

SEQ ID NO: 157233 - protein, 93 aa, Triticum aestivum
  Clone ID: PAT_TA_51651.pep
PFKASPSPKLQPNLEESCCGGNCGCGTACKCGNGCGGCNMYPEVEAAGATLLVSATATHKASSGGMEMAAENGGCGCTQCKCGTSCGCSCCSC

SEQ ID NO: 157234 - protein, 175 aa, Triticum aestivum
  Clone ID: PAT_TA_51652.pep
DTWLYSSAGAWWTPAATQHRETDVFPITQNELIRGVTAAPWQIDGVTPPPPRNRHVPGHRQPPAGGVGGEEGGGHGGSEARSTRTEAAAPPAVGFGGAGGRGARPSAYGALYNHPNLNKTASIAWRARDGSRRLFDGLDRLAGPSRRGSVCGLTAVRSADAVVQTRPDGCRTSGC

SEQ ID NO: 157235 - protein, 81 aa, Triticum aestivum
  Clone ID: PAT_TA_51653.pep
LASKQRQLCSVPESHFNYFLCASSWLRAPSSRAFFSLLLITSLECLSSVVAAVSSFFRFLIFNVPLALSGSLIFSLIRCRS

SEQ ID NO: 157236 - protein, 178 aa, Triticum aestivum
  Clone ID: PAT_TA_51654.pep
MEHGCTTSMPGQVGSGVERLHGSSSMRRIQSGLGSAPAPDARAGFRQAGHGDGSAPYVSRVSIDEARRRENVNPNNEDNIMMGNGSALRETAWKGLVSNDIYYIWNHGPKFGGGFDCRYCPLITRGGGATRFREHLGGIPGDVKQSITAYFDKELSSNKVSMQPKISTALNVESKEYL

SEQ ID NO: 157237 - protein, 179 aa, Triticum aestivum
  Clone ID: PAT_TA_51655.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQQGRTLDSHIEEQF

SEQ ID NO: 157238 - protein, 179 aa, Triticum aestivum
  Clone ID: PAT_TA_51656.pep
MARCTGILRSMMYQNDQGRPKSDTTRHTKLYLSALELVRMGDANVQSYEATMLLLQQAKAKLAPICAERDGMGVADREAAALADRTEDGELDGDDDVISSISAPKRNRAMGRPTTSRDKPPYEKPVKRSRFCKICRKEGHKSTTCPDCGDLPKPPRKAPKCSNCGVLGHRRSSCGKEIL

SEQ ID NO: 157239 - protein, 166 aa, Triticum aestivum
  Clone ID: PAT_TA_51657.pep
MDPAEGRRILVAVDEGDESVHALRWCLTNFAARGDGELAPPDTILLLYVRPTPPTYSVLDASGYMFANEATAAIDGYSRAVADAVVDKAQKLCALHSKENGKVKVDVKVAVGDARSVICDMVDKLGADLLVMGSHGYGFLKRALLGSVSDYCVRNANCPVLIVKSK

SEQ ID NO: 157240 - protein, 147 aa, Triticum aestivum
  unsure (1)..(147): unsure at all Xaa locations
  Clone ID: PAT_TA_51658.pep
MGRMHSXGEGILSVMRRLRGQGGLPQSWVKTAAADVDELITRLQRRVRCTSQIGVLLRDQHGIPLHKSVTAKARSSASSMLMVLAAREIPEDLYFVINKAEPITQXHFERNRKDKDSKFRLILGESKIHRLAHYYKRTKKLPPTWKY

SEQ ID NO: 157241 - protein, 110 aa, Triticum aestivum
  Clone ID: PAT_TA_51659.pep
DVRVTATCIRVPTMRAHAESVNLQFEKPLDEDTAREILRAAPGVTISDDRAANRFPTPLEVSDKDDVSVGRIRQDLSQDDNRGLELFVCGDQIRKGAALNAVQIAEMLLK

SEQ ID NO: 157242 - protein, 33 aa, Triticum aestivum
  Clone ID: PAT_TA_51660.pep
LGTLTALGLTIYSNASAPGISFVASATSALLGP

SEQ ID NO: 157243 - protein, 143 aa, Triticum aestivum
  Clone ID: PAT_TA_51661.pep
QQQHFLGPKKSWGGGQPLGRAVITDLLEQKLRFFAKGGETPNDDLVKKPPPRVFYIGAIGSPLGGLFFHAGYAGDAPPLSHEGKPLVFLPKRPPGGEKLFHLQFLTKIESCSTMRVKFSRAKKKGPAFKIFKKGAKLKPSWKN

SEQ ID NO: 157244 - protein, 133 aa, Triticum aestivum
  Clone ID: PAT_TA_51662.pep
RFPLSRLLPCTDCERKGEIPMHAPHAHSTARRTSSLTEPPPVAASLRSSNSPPHLVVVPAPPLPGCSTAQRRFQQLAVLIIARQRRLWLAAVVDLHHHVPAKKHISPEKNSDGQLQQNQKLVPAEEKKTAVPA

SEQ ID NO: 157245 - protein, 150 aa, Triticum aestivum
  Clone ID: PAT_TA_51663.pep
KKKTKISGPGKGGKGFGKGGAQGPRKVLRGNIQGIPKPGIRCLGGCGGVKGILGVIFEETPGVVKIFFEKVIRDAVSFPGDGPRKTVPPMGVVFALQGQGGPLFGFGGLAPPPPFKGLGVVVVYVISASPCCLLFFVEWDGMGILLVFPF

SEQ ID NO: 157246 - protein, 72 aa, Triticum aestivum
  Clone ID: PAT_TA_51664.pep
KSRKDHKLRQGIRHPASSVVHPPGAAGGELAGEGVNNEQGVEVDLVPCPCSPKCLENWSWGQRRCLTGGARP

SEQ ID NO: 157247 - protein, 93 aa, Triticum aestivum
  unsure (1)..(93): unsure at all Xaa locations
  Clone ID: PAT_TA_51665.pep
KRASEGPPIYVGWPPPRGPPGFPFKPPARNFGGNLRGNQFPPGNTFAPDXPPAFKPPPKGKTGPPPGPGPEIPGGGPAPTPAKRGPKKAQAQK

SEQ ID NO: 157248 - protein, 161 aa, Triticum aestivum
  Clone ID: PAT_TA_51666.pep
PHGYFAQSNVLGYPDTGGQVVYILDQVRALENEMLLRIKQQGLDITPKILIVTRLLPDAVGTTCGQRLEKVIGTEHTDILRVPFRTENGILRKWISRFDVWPYLETYTEDVANELMREMQTKPDLIIGNYSDGNLVAPLLAHKLGVTQCLLVLASGICCCL

SEQ ID NO: 157249 - protein, 55 aa, Triticum aestivum
  Clone ID: PAT_TA_51667.pep
PFSYAFISPRIMRTFVNTSSSGFMVLISFVASETILCWWITLDEAPNLFYYTLSC

SEQ ID NO: 157250 - protein, 111 aa, Triticum aestivum
  Clone ID: PAT_TA_51668.pep
GGFFLKGTGKYKFPRGKKKPKIYKGKTGKIRRGHGAWGVGLWKKGRGSDPQGSLWGGEKRGGSHFQNRGSKAQEKSLFKGGNELGGNPGDPGGFKRGGGEPPPFEHRPQKA

SEQ ID NO: 157251 - protein, 60 aa, Triticum aestivum
  Clone ID: PAT_TA_51669.pep
GVLVWWTVAFHPAREQLWMVPVGLVLLGTPLVAWLSLFASGACRRLGTTTHHHHPPPAER

SEQ ID NO: 157252 - protein, 87 aa, Triticum aestivum
  Clone ID: PAT_TA_51670.pep
AYLLSMYSVFLQTIAWFRLCKAFSKHPSKGAEMQINHGMMHPYLNQVYFNSVSRSILHTSSFVVISSFVVIRGKEQRIIIRTKHFTT

SEQ ID NO: 157253 - protein, 154 aa, Triticum aestivum
  Clone ID: PAT_TA_51671.pep
KKARGKEANNKGNTNKGDKIAPKQEAGDKKKNEGAHGQAIQGVDGNQLGEADEFDDKKKELEGLRNPIIAKKDQGAGADMAGGKDEDHAPPAAGGAGPKIEEVAQASPWTRLLPQSLSPPLCWKPLQDVVLDVSLVCVNRVCCRPLSVNVSYNW

SEQ ID NO: 157254 - protein, 82 aa, Triticum aestivum
  Clone ID: PAT_TA_51672.pep
PPFKISCPGGNSGWGPPRKGGNGLGGCNMSPQVGAPGPPPLVSPPPPPKASPGGKKKAPKNGGWGCPQCKGGPPWGCSCRSC

SEQ ID NO: 157255 - protein, 99 aa, Triticum aestivum
  unsure (1)..(99): unsure at all Xaa locations
  Clone ID: PAT_TA_51673.pep
PSPPPPPPSPXPPPAPKPPPQRASGAPRRARAGKPGATPAPGSGSARRPRPRAAGRPPPPKGPRSGPPGPLGAPPKPSDLWGRDTPVRGGGGGGGGGGV

SEQ ID NO: 157256 - protein, 91 aa, Triticum aestivum
  unsure (1)..(91): unsure at all Xaa locations
  Clone ID: PAT_TA_51674.pep
GREYXDKEPFPXTSKDQTEKALGKPGVKCLENVGHEISPVGPHFKKTASFLRPFKPKCPKRGLQMKKNPFKEGGDPGNRGAKTTELLEKLN

SEQ ID NO: 157257 - protein, 99 aa, Triticum aestivum
  unsure (1)..(99): unsure at all Xaa locations
  Clone ID: PAT_TA_51675.pep
KASAAPKKEAAEGQKAGVAAAAPEEAKKSPSVQRKLXKRPQGRPLGSPIEEQFSGGRLLACISSRPGQCGRADGSLLEGKELEFSMRKLPKKKGKGAPA

SEQ ID NO: 157258 - protein, 77 aa, Triticum aestivum
  unsure (1)..(77): unsure at all Xaa locations
  Clone ID: PAT_TA_51676.pep
GPPSTPEAKPKFKALXTERQEPEKTSLKEPERIKKEIAELKEMKKKTSPMPAAEYFAKPPEPKKKFDDETRNDYWGY

SEQ ID NO: 157259 - protein, 95 aa, Triticum aestivum
  Clone ID: PAT_TA_51677.pep
GVVLLKLLTGQRALDKNRPPGQHNLVEWARPYINSKRRVIHVLDPRLGSQYSLPAAQKAAALAMQCLSMDARCRPDMDQVVTALEKLPEVKKTYK

SEQ ID NO: 157260 - protein, 125 aa, Triticum aestivum
  Clone ID: PAT_TA_51678.pep
KPVMGRQGLARDSGDHRGCAGGPKLFGRPCWVLGVPRVRAGGPPLFGRARPPPPGGACRARAGGPVLYGGPPRNPEALGVPQVRAGGPTPTYRGRPAHQVLWEECQVKEICPRGNNKVFFYSPIS

SEQ ID NO: 157261 - protein, 123 aa, Triticum aestivum
  Clone ID: PAT_TA_51679.pep
HLFQVPRQILVCHHGYVTMSNCPKLSRPSGAEVYICLHVGLAEEDSMRGGYRCGRGSCRGARVEEKLWRAACCGAGGVLRRRRGGRWPDLRGVLTGTGLGHESGGFAPPARAATGRQDGVRGA

SEQ ID NO: 157262 - protein, 137 aa, Triticum aestivum
  unsure (1)..(137): unsure at all Xaa locations
  Clone ID: PAT_TA_51680.pep
APPPHKGAKPGADPXGTGSQGKRFXKRAPPGSXNXXXXRNANXPVLXAKXKXQGELILGAMCYLAFTPPPTAKMLLXXGTEGPPPLKPSIFXKKKRFFMXNXXEELRGSVKQFSPRRPRLVYTPLLLLKKKNHNTRA

SEQ ID NO: 157263 - protein, 192 aa, Triticum aestivum
  unsure (1)..(192): unsure at all Xaa locations
  Clone ID: PAT_TA_51681.pep
ISYSMALYALALFYAACRDLLRPYNPVPKFIIIKSVVFLTYWQGVLVFLAAXSIIKNAEXAADLQNYVLCVEMLIAAIGHLFAFPYKEYAGANARPSGGFRESLLHALKFNDFYHDTVHQFAPTYNEYVLYNHNEGESAPTKFPSGSAVPSVRDVELAGIIVMPPSNNSPVTSSMSSNHVDQDESMTTPIRN

SEQ ID NO: 157264 - protein, 77 aa, Triticum aestivum
  unsure (1)..(77): unsure at all Xaa locations
  Clone ID: PAT_TA_51682.pep
GILSQPPPXTFPQCCDNCNSWSGYQFCEDVGPRCRRGCANCQVVQMSPVKTFRCGDGRPVYDGHDTPTPCPPPCKKH

SEQ ID NO: 157265 - protein, 63 aa, Triticum aestivum
  Clone ID: PAT_TA_51683.pep
APLVSFLLMVYCHRMYYCPKCLLCCHHWIIISIPLVSRLGDDHCVPIDGILYICPPGSRPGIM

SEQ ID NO: 157266 - protein, 100 aa, Triticum aestivum
  unsure (1)..(100): unsure at all Xaa locations
  Clone ID: PAT_TA_51684.pep
KIYFKDEDPKFPAGGLMSQYLDSLPLGAPVDIKGPVGHIEYAGRGAFTVGGERRFARRLAMVAGGTGITPVYQVIQAVLRDQPDDTTEMHLVXANRTEDD

SEQ ID NO: 157267 - protein, 180 aa, Triticum aestivum
  Clone ID: PAT_TA_51685.pep
MCGGAILAELIPPSAGRASKQVAAGRASPKKAGKSKGQKYGSVADVDDFEAAFENFDDDLDLQAEEDGDDHVVFASRPAFSPAYDGGRRAVPAASKKKSVRPLHGIRQRPWGKWAAEIRDPHKGTRAWLGTFDTADDAARAYDVAARRLRGSKAKVNFPDAARAGARPRRASRRTAQKPP

SEQ ID NO: 157268 - protein, 116 aa, Triticum aestivum
  Clone ID: PAT_TA_51686.pep
RAFCHSNGVHLSAYAPLGRMKDVSSNPVVTSVAESLGRTPAQIALRWGLQQCQSVLPKSANESRLKENIDLFDWSIPEELCTKLSEIKQVKQIRGDSFVHPQSIYKTYEELFDGEI

SEQ ID NO: 157269 - protein, 143 aa, Triticum aestivum
  Clone ID: PAT_TA_51687.pep
SDAWARKDCLAAAAGRRGGGQEFFHIVLERNMQLHPRHFGPHLRDKLVAKLMKDVEGTCSGRHGFVVAITGVEDIGKGLIREGTGFVTFPVKYQCVVFRPFKGEILEAVVTMVNKMGFFAEAGPVQIFVSNHLIPDDMEFQSG

SEQ ID NO: 157270 - protein, 108 aa, Triticum aestivum
  Clone ID: PAT_TA_51688.pep
TNWVGHSLKRRRRLKSLEQGQTLKRKKRPIEPNYLKTVLRGRTFDKSKKNTHSICTRGGHLGKNNFAPLRALGPRLDLKEKSLEKSPVQPGGRGLRQSLGNKIEKLLL

SEQ ID NO: 157271 - protein, 70 aa, Triticum aestivum
  Clone ID: PAT_TA_51689.pep
VSTTFWGGGPPLGGVLFSQSFSVKKKVFFFSGFPRAFFPCFWAESVSTPPLVKKGKFPPPLPWGGEEIFF

SEQ ID NO: 157272 - protein, 154 aa, Triticum aestivum
  Clone ID: PAT_TA_51690.pep
TKPPHSNGDRPVPDKEERHNYPHTQNKREGRNTRQSLPKNKGRRTRGGVANKTHGKNLGGGAQQAHGDQVREDPHAHRRVHFYPDGRDPRSHRTNVGGRHAGGARQINRGGTWDDATQKKIRETRHGPTGEKQDRCPVCKIGGGHNILGEGRNK

SEQ ID NO: 157273 - protein, 104 aa, Triticum aestivum
  Clone ID: PAT_TA_51691.pep
PLKNRRAGKKFLNFFLYKKKPRAPSRGQNVPPAMEASHQTDPPWDRRNRLRGFLRGARASGILLGESFFRCFWDPTRPWAGPTLSPGGVGFFTGLGLLSGKKRG

SEQ ID NO: 157274 - protein, 81 aa, Triticum aestivum
  Clone ID: PAT_TA_51692.pep
GCQIYFSFVNGRCILQRAYVGYNKGLCTEPSKTHNRVHGPCNLYGMPGLIGIGFLAGDYTLLAYILTSTTLGRKLAELTPW

SEQ ID NO: 157275 - protein, 78 aa, Triticum aestivum
  Clone ID: PAT_TA_51693.pep
MDLNFILAKSLYASLFEILVEQINKSLLVGKRRVGRSISFPLHLQRDAMDLLSAPPPSLNHLCHMQQPTYLGAAGVIV

SEQ ID NO: 157276 - protein, 147 aa, Triticum aestivum
  Clone ID: PAT_TA_51694.pep
MAGRYSFWACLGPLDTKKPRNFQPVRCIWAWVDYSNIGGVAFNQAGAGKVTRGEGTLDGGETWQVCQLDHPERPTKYGKDWGWGFWAVNLKGLDLLGPKEIAVPAWDEALNTQPERLIWNLMGMKNNCWFRVKNNVCPPHKGENGLV

SEQ ID NO: 157277 - protein, 87 aa, Triticum aestivum
  unsure (1)..(87): unsure at all Xaa locations
  Clone ID: PAT_TA_51695.pep
GLIYEETPGVLNIFXLEKVIRDPVPYPEHAPPKTVPPMDVVYAPKRQGRPLSGFGGCFPCPVWFLPPLFLLSKGVCFCSPLGFGLCS

SEQ ID NO: 157278 - protein, 61 aa, Triticum aestivum
  Clone ID: PAT_TA_51696.pep
HMDIQESSLVALLLLLMVVISDILFRVDNIQILPLYRSLSLSAMLVFFFTWQKHIGSIIIS

SEQ ID NO: 157279 - protein, 117 aa, Triticum aestivum
  Clone ID: PAT_TA_51697.pep
LQSAVKEVVPSNFLIDASTTKKHSEPSEVTLMVKLNHGNIVKMFLSWNETGSNFMGLPSDATFICMMLSARTLSYYLDQRSIIELDTVNNLFLQIMMGLEHIHKQNVVHHDLNLEIS

SEQ ID NO: 157280 - protein, 77 aa, Triticum aestivum
  Clone ID: PAT_TA_51698.pep
FYFGGPKKKILICKPGEVKFGFFKNGPPLFFFFFFFFFFFFFFFFFFFFFFFFFFFFFFFFFFFFFFFFFGRCYDIP

SEQ ID NO: 157281 - protein, 167 aa, Triticum aestivum
  Clone ID: PAT_TA_51699.pep
MSSDCPALRSGFFSQLLPFSGLVWTLRNQNCLTPQMVHLLQAHMLILTLQNQSDSRGIPGFLSRMECDHLVSMAHSKIGSSLLVNDGATNISQNNIDAGLLLRLADSNLKDTQAKEGTPSDCAGYAVKPVKGNAILLFNSRPDGIADKDSQYEACSVLEGEKWLAIK

SEQ ID NO: 157282 - protein, 189 aa, Triticum aestivum
  unsure (1)..(189): unsure at all Xaa locations
  Clone ID: PAT_TA_51700.pep
AWEPRQQXLQIPDSDIVIEGNCARVVCQKHKEKSHXILNPGSELALCDCSWSRKGNLCKHAMKSAKVCRDRGLAPPSLALLRYYQALANVVHCPPSDSVICDHAIAVAVSVRTQLDALLSATNGSSPDTSLFKGPQSTSDNEPRELDVREANIENGSEVPADEDSDEDSPACKKRKPRGPSDEDEIATA

SEQ ID NO: 157283 - protein, 92 aa, Triticum aestivum
  Clone ID: PAT_TA_51701.pep
KREGFLDISKGPQHIGGGETYFKREIHSFYPGGSHWGESLKRLILGNGGRKCFVSSDTNGHFLAGWAAPNLVKNPCHGWSCHPGHGETPAAF

SEQ ID NO: 157284 - protein, 84 aa, Triticum aestivum
  Clone ID: PAT_TA_51702.pep
FPLLVNIGPAGLLPKAQKERSRWSPKKVLKSVPPGLRPQVLNFLEPFFFETIFWAPFAGLFASPPYLKPPLFCHFSFPHPRQVI

SEQ ID NO: 157285 - protein, 85 aa, Triticum aestivum
  Clone ID: PAT_TA_51703.pep
FFFFFFFFFFFFFFLFFFFFYGNFCFYFLFFFLKTKGQPFGRRGGEKTNPASREKRKGPQKKKGEGATQSAKGKNGRRVFVQKPR

SEQ ID NO: 157286 - protein, 107 aa, Triticum aestivum
  unsure (1)..(107): unsure at all Xaa locations
  Clone ID: PAT_TA_51704.pep
QALKVIDNVDTVRIQDQHDFHKNQFIFSMKVSINNLAAKLKAYILDVFKNNVESPAKYFLSKIKAPQFFVGKSKHHNXGLVFGVATSYAPADPTFVDFSHGLKEVNC

SEQ ID NO: 157287 - protein, 132 aa, Triticum aestivum
  Clone ID: PAT_TA_51705.pep
SISVGGMPALKSLRDSHRSFDEAALEGIRRAVVGGAYEVIGLKGYTSWAIGYSVASLAASLLRDQRRVHPVSVLAAGFHGISDGHEVFLSLPARLGRAGVLGVAEMDLTEAEAAQLRRSAKTLWENCQLLGL

SEQ ID NO: 157288 - protein, 88 aa, Triticum aestivum
  Clone ID: PAT_TA_51706.pep
SLAAEQRLQHARRRSLNGDREYTLFTKDTLVDGGMGDLQASEDLHDLQAFEDLHDLQTSEGLDDLQAAECLQDLQLSWWSDYVMCLVC

SEQ ID NO: 157289 - protein, 57 aa, Triticum aestivum
  Clone ID: PAT_TA_51707.pep
GRGPRRFVPPLPRPLSRPCPGGGLGGPALEMEPPPFNSGGSGLFVSSRLVGGLAPPA

SEQ ID NO: 157290 - protein, 58 aa, Triticum aestivum
  Clone ID: PAT_TA_51708.pep
LSEENLVLFTRREDLRQRDTQLKQTIGELEHELEETRRKCSQLAAELQLRRSQQQHYM

SEQ ID NO: 157291 - protein, 103 aa, Triticum aestivum
  Clone ID: PAT_TA_51709.pep
VFPKDGLSGFLNSAISLGPDKAPFVLPQKFCWNIGSVFPLLVTEPFEYGCNFCRLVGCKFNPLWRILRCEPGYCVRFRTCSVQYRVRLRPHCCAAVGSATVLQ

SEQ ID NO: 157292 - protein, 148 aa, Triticum aestivum
  Clone ID: PAT_TA_51710.pep
TERNLPAGTCPAGHRAGGQAASSLLFSSLLWSRRLRLSSAPPPAVHKPRTQPWPNSPFAFLHLLLLINGRTGGRLVAERRQAWMEEGRQMAASGGLKRRRRRRGRRRRLGRGSPGSGRALDWANRGAEPHGDRVAHAPVERRLAQAQR

SEQ ID NO: 157293 - protein, 85 aa, Triticum aestivum
  Clone ID: PAT_TA_51711.pep
MIVGFGKWGWSPLQPGNPFAGVGDDVKVHLWHGVEDLFVPVALSRYISKRLPWVIYHELPTAGHLFPVADGMPDVIVKSLLLGDG

SEQ ID NO: 157294 - protein, 124 aa, Triticum aestivum
  Clone ID: PAT_TA_51712.pep
LQRSFEEGYSDRCIYCRLDRCSRRAQVGYNHTKHLCLSESHPFVCLFVVFRGEHIRNSYVVKKKKKKKKKKKKKKKKKKKKKKKKKKKKKKKKKKKKKGGPFLKDQILLPRACNVMVFFWGPQN

SEQ ID NO: 157295 - protein, 181 aa, Triticum aestivum
  Clone ID: PAT_TA_51713.pep
MAASSPAATATTTPPLAGPAIHRGPAAARLLSGSLSRRSPPASTAQAVSSSAAPKPRGLLLPCRAAEGAAPARAEAPLKVMISGAPASGKGTQCRMIVEKYGLVHISTGDLLRAEVSSGTDIGKKAKEYMDNGMLVPDQVVTDMVVSRLSQPDVRERGWLLDGYPRSYAQAQSLESMKIRP

SEQ ID NO: 157296 - protein, 156 aa, Triticum aestivum
  unsure (1)..(156): unsure at all Xaa locations
  Clone ID: PAT_TA_51714.pep
MAPDHGSKVDISFAGRFTASAIAACFAEITTIPLDTAKVRLQLQKKAIAGDLAGPKYRGLLGTAATIAKEEGAAALWKGIVPGLHRQCIYGGLRIGLYEPVXLAIAVANPTDLVKVRLQSEGKLAPGVPRRYTGAMDAYAKIVRQVSCCFCSCFAS

SEQ ID NO: 157297 - protein, 133 aa, Triticum aestivum
  Clone ID: PAT_TA_51715.pep
MGSYGGDDGGVELTELTLAPPGERARRARRARKSVEAAAFVKVSMDGTPYLRKVDVAAYGDYLELLQELNAMFYCCSIGLMDGYGQWEHAVVYEDGDGDWMLVGDVPWEMFVCSCRRMRVMRACEARGLSANA

SEQ ID NO: 157298 - protein, 151 aa, Triticum aestivum
  unsure (1)..(151): unsure at all Xaa locations
  Clone ID: PAT_TA_51716.pep
AGALRGAGLRHSLFRRAGAAFGAHERGRAAPAPPVAPAVAPTPVLGEPMDLHDCCGGGAEEPGAXDGLVKGLREAAKCVGKHAAELCVLPVDCDQPDDVWLVGALCAGHTVDRLTAPRAFTLGERAGLCXIGSGGEARTAGPCSCVAAKGS

SEQ ID NO: 157299 - protein, 68 aa, Triticum aestivum
  Clone ID: PAT_TA_51717.pep
KQQRGFLLAPPETNKQTNKGGAFAKTGGVGRKGPNWGPPGTTGKPTVYALGGGPFLKTSVKFRKRKTR

SEQ ID NO: 157300 - protein, 103 aa, Triticum aestivum
  Clone ID: PAT_TA_51718.pep
GHLLVAADRYNIERLKLICEEKLCNLIDSNVVATSLALAEHHGLHRIKDACFEFLTSPSNLEAMMASDGYEYLKNSCPSILRELAASFLPAELKAVKDIIMTT

SEQ ID NO: 157301 - protein, 160 aa, Triticum aestivum
  Clone ID: PAT_TA_51719.pep
ISRFSINSFFRLLLLNDKVESLPNNFSNLRRLRHIELHDGRTCLSYKALPQIPNIGNLTLLQNFREFFVPKKKGYELGQLRDMPKIRGSLSIPNVENVPKKDQSLESKLHQKCHFGSLKLVWSSNNTMNVEDSFHSGILKALLPPPQLGDLPIILMVIDL

SEQ ID NO: 157302 - protein, 150 aa, Triticum aestivum
  Clone ID: PAT_TA_51720.pep
CYPRIWERASPISLETGDGDPKLIQGGFEGVSTPVSSNNPSIPLVEGGPNLFLPPPMPKGRQFCAKLEFVACYKGFPGPSGLSQGSAIIVSPAAQGGPDRVFSFMFGALFYKKQGFVFIFSFFRAPVVSKNVFLSKTIKGWALLGPCSVP

SEQ ID NO: 157303 - protein, 123 aa, Triticum aestivum
  unsure (1)..(123): unsure at all Xaa locations
  Clone ID: PAT_TA_51721.pep
ETDSALSFGRFLPCCMLNIGFXIITTIGPWIVFRXKSLRGRLDATXTFCDQALVGTPCFGGFPLFSLYTIGSIXVNHRVYMYFRGPQSSRLRKKIQQCHRCQRSVLRLCTHILVHPMRCMLRE

SEQ ID NO: 157304 - protein, 115 aa, Triticum aestivum
  Clone ID: PAT_TA_51722.pep
GREAKKLAPVLRWGKSLARLLSLGRGDRGHQTLKAVKPPKGQVPVYVGGGGPGKPLRYVVPVVSFTPPMFGEFLREAKKGFGFQPPGGITIPWAPPKFEGAPPVAAPGKKGFPRW

SEQ ID NO: 157305 - protein, 140 aa, Triticum aestivum
  unsure (1)..(140): unsure at all Xaa locations
  Clone ID: PAT_TA_51723.pep
RDLVTSATTRLPLLARLCTCRQPRGLLGACGHLGGRHAPAQAPXSTTNSGLCGRALQTFARRXPVRLHKLXAPDCGIEELKLDRXEARNDILKEMLNGLEIALDKGKVDLTDNVGLGESSEPKEVCAGADLRERRPMGPS

SEQ ID NO: 157306 - protein, 63 aa, Triticum aestivum
  Clone ID: PAT_TA_51724.pep
NCFIFFEAKTKRGLKMGALPQILGQRGSLMCQFYQVLSFFYPGTQPVVARVQPCQLSPSCFFG

SEQ ID NO: 157307 - protein, 99 aa, Triticum aestivum
  Clone ID: PAT_TA_51725.pep
SPESMFSSVEKGPLTSNLVDSSDEIAKATINQSCGTLGSLKKCWLRSHKCSVPKEVPRRRLNVPAKIRVSRLTPVPVMWSKVMQLWMQKRISFPLLPYE

SEQ ID NO: 157308 - protein, 87 aa, Triticum aestivum
  Clone ID: PAT_TA_51726.pep
FLHVDLGILPQILRLIPSLMKSCKKSHHGSKTGPFPKVRSLFGLHLNCCSCSDQKRSSQCRTFFRPCVCLHLLVGTLAIPVETHLAR

SEQ ID NO: 157309 - protein, 65 aa, Triticum aestivum
  Clone ID: PAT_TA_51727.pep
TSQYVDVLRFHKLIMRTTHGHTLTSESIQCGPTLGTDGWLTGALIICLVPNYDANGPYRALLDEH

SEQ ID NO: 157310 - protein, 60 aa, Triticum aestivum
  Clone ID: PAT_TA_51728.pep
RNKVAWYNVTLLCMHRSIRSCQKALKWLVSRIFQSSWNVPCIYPLVRVHKIVIVNNAIKL

SEQ ID NO: 157311 - protein, 119 aa, Triticum aestivum
  unsure (1)..(119): unsure at all Xaa locations
  Clone ID: PAT_TA_51729.pep
KLADVKQMAGAARXAGQGSSGFENHIRPIDRYAMRFLELWDPXIIEGAAVNYQVNVAEKGWGLDRIEERRQHLEAGIYXDQEPRSYESWDVEXGTTAYGQQGEALGIKQLLEEQESRAV

SEQ ID NO: 157312 - protein, 76 aa, Triticum aestivum
  Clone ID: PAT_TA_51730.pep
EYCNPINPIPMTRESTTATLVEAITYQEDKAWNLTISDRPPYDAENNRTTRQTRTFTTISQFTACKASTQMTLRKG

SEQ ID NO: 157313 - protein, 183 aa, Triticum aestivum
  Clone ID: PAT_TA_51731.pep
VVVDWGAAYLAPLLQFLTDACVVLFLIQSADRLIQCLGSFYITVKRIKPRLKSPALPDAEDPDAGYYPMVLVQIPMCNEKEVYQQSIAAVCNLDWPRSNFLVQVLDDSDDPTTQSLIREEVAKWQQTGARILYRHRVLRDGYKAGNLKSAMACSYVKDYEFVAIFDADFQPNPDFLKRTGPHF

SEQ ID NO: 157314 - protein, 73 aa, Triticum aestivum
  Clone ID: PAT_TA_51732.pep
IIDETCPYLNYTSSLAPVVRSLLVSKLGFVLDFRCGWGLMVMKSLGRPTNPDEKAKKNVKVCLICTFLQNIGI

SEQ ID NO: 157315 - protein, 116 aa, Triticum aestivum
  Clone ID: PAT_TA_51733.pep
ISLWLAGAVWNFARAVPSQTLPIKALFPGPMPLFFYQGGAPPFFLTPGVPPPPVLVLKPPLQLFLSLSPLLYLFPLSLPLLTGFVVFEPAGLPSLPLCRYFSFFGLPPKTLAVSNL

SEQ ID NO: 157316 - protein, 99 aa, Triticum aestivum
  Clone ID: PAT_TA_51734.pep
FPYGQKALGDFLNHPGSLKFSWAGGAFFKMGIFFPPLQKQRGVFFQRNFQGGFLWPGFFKIWAKKKGSLGFFPKKIFKFPPKPPPLGFWPNIFKLGGAF

SEQ ID NO: 157317 - protein, 97 aa, Triticum aestivum
  unsure (1)..(97): unsure at all Xaa locations
  Clone ID: PAT_TA_51735.pep
PPQWPPVFKGPLFSNPNAPPQYPPPLPSPKEASPPAPPKPMPTRXSPPANFSGPNGSPPPTARSHLGGPPPPPHPVSSLQKRAPPEKPPPLRKSPPP

SEQ ID NO: 157318 - protein, 82 aa, Triticum aestivum
  unsure (1)..(82): unsure at all Xaa locations
  Clone ID: PAT_TA_51736.pep
SEKDMRAYIPNIAFGGEEPVTMKRFGSFWFKXESPVLRTLVLVSTRSVCDEELFLNYRYSSSKGRPEWYTPVDEEEDKRRWS

SEQ ID NO: 157319 - protein, 78 aa, Triticum aestivum
  Clone ID: PAT_TA_51737.pep
IIMFQYQLKHKRGQCFFARTKNWGTVIESTGQWGTHFSSRIVGDLNLSFRRPPQSWALGPCCPLGDWAEHSYSCHQGF

SEQ ID NO: 157320 - protein, 52 aa, Triticum aestivum
  Clone ID: PAT_TA_51738.pep
GVTKPKEVRKFKGEGMPLHQSNKKGDLYVTFEVLFPKTLTDDQKAKLKEVLA

SEQ ID NO: 157321 - protein, 151 aa, Triticum aestivum
  Clone ID: PAT_TA_51739.pep
PTNLQPPDLLNRQIGLLPGVIVDETPPGVKFGDVRSDVPANSTFRKGSVVNATFYSACPRNDLLTDGTFALVEKLDGGSDWVPVYDDDDWSLRFRWSRPLPVSPMSFATLEWTVPEDATSGVYRLRHFGASKPLIGSINYFTGTSSAFVVR

SEQ ID NO: 157322 - protein, 91 aa, Triticum aestivum
  Clone ID: PAT_TA_51740.pep
GPPPAQALGVGPNPPRVGPPLICWARASHLGVPLGRFPLLCPRYARPIFKFSIRPRLRGGAWPARYFTFWDCSRIPFVVIAKLASFCFDGT

SEQ ID NO: 157323 - protein, 77 aa, Triticum aestivum
  unsure (1)..(77): unsure at all Xaa locations
  Clone ID: PAT_TA_51741.pep
PPTLWAILTFALPRVTXSKKRLVPLFLLPNKGDLGFLVGLLKEGKLKPVIDSKFPFNNPGKGWQTSINGHAPGKIVV

SEQ ID NO: 157324 - protein, 177 aa, Triticum aestivum
  unsure (1)..(177): unsure at all Xaa locations
  Clone ID: PAT_TA_51742.pep
MAPTVMASSATCDDTFQGLKSTAGLPVSRRSNGASLCSDNNGGXRIRCMHVWPIXGIKKFETLSYXLPPFTTDALLKHVNYLIRSKWMPCLXFSKDGFIFTEHNAYTGYYNRRNWTMRKLPMFRCTDATHVINEVEDVNKEYPDAYVHMIXFDNMHHVQCVNXIDFNPPGXEESGQA

SEQ ID NO: 157325 - protein, 154 aa, Triticum aestivum
  Clone ID: PAT_TA_51743.pep
MAGNNPPPKPWERVGTSSGPAPFKPPSGGSTSDVVEASGTAKPGEVVSAAQSNAAFNVNNPVAGPVPPRPWQQQGYGNTYGGYGASTYNSYGGFGGAYSNGGLYGNNNMYSGYGGGYGSSYGGSGMYGGSMYNNGMGNPYGGMGMAPYNQGLIH

SEQ ID NO: 157326 - protein, 70 aa, Triticum aestivum
  Clone ID: PAT_TA_51744.pep
FLSKHGVKKFFILKKRAPLFFFFFFFFFFFFFFFFFFFFFFFFFTDAWADAWADAGRTLGGRWADAGRTL

SEQ ID NO: 157327 - protein, 105 aa, Triticum aestivum
  unsure (1)..(105): unsure at all Xaa locations
  Clone ID: PAT_TA_51745.pep
MTILCWNCWGLGHPGTVRELVCLVHTYRPSVVFLSETRQCEESVKRIRGRLGLKHCITHDGVGKGAGIALFWDDSIEIKLLSYGPRYIDVHVRNDPHXPLWRGIL

SEQ ID NO: 157328 - protein, 186 aa, Triticum aestivum
  unsure (1)..(186): unsure at all Xaa locations
  Clone ID: PAT_TA_51746.pep
AYSCSPIYSTWPPPGMASSATTDAPFQGXKYTAGLPVSRRSSGSLGRLSNGGRIRCMQVWAIDGIKKFETLSYLPPLSTQALXLKHVDYLIRSKGVPCLEFTKDGFDLREHNSCPGYYDGRYWTMCKLPMXGCTDATQVLNEXEDVKKEYPDAYVRVIGFDNLGQVQCVNFIAXFRPPRCDESRKV

SEQ ID NO: 157329 - protein, 167 aa, Triticum aestivum
  Clone ID: PAT_TA_51747.pep
TRRLNAAIFTRLTKLTSAQARLGLGIRKLRKPINPSPVKHEIFLAANQSFTAEEITSKKPKMGDGKISQRRERASSSKNLVSRAQKWQIPFSLRIQRRNEPQQIWSPTVAAKGNIWGANRKEMIIRRRGRSTLAHSSVLKWRHHELTPALQTEKITREGQKKRIHRF

SEQ ID NO: 157330 - protein, 96 aa, Triticum aestivum
  Clone ID: PAT_TA_51748.pep
LIQRTHASLGRRPSAVRPRRGRDVGILVRMILRSLTGLKPVRGLKVTAHCTWYWIDGDLYKKLSSTKDSWVSSEFFFNTLVPAISAHLKRRTCTRV

SEQ ID NO: 157331 - protein, 98 aa, Triticum aestivum
  unsure (1)..(98): unsure at all Xaa locations
  Clone ID: PAT_TA_51749.pep
SHRQGDFVQDSTPTGVSMVHSRPTTRRGVHXTLKVRLETGLTRMTIKHPAHGVGSTELQGKTYVCKGTMTKLTRYGAHYHVCICCDHIYVCVMLHTVI

SEQ ID NO: 157332 - protein, 52 aa, Triticum aestivum
  Clone ID: PAT_TA_51750.pep
IIGSRSGCMQVVYSIVERWEQDYLIGLGESFIHDGGRIACISEVAMGYRNWP

SEQ ID NO: 157333 - protein, 79 aa, Triticum aestivum
  Clone ID: PAT_TA_51751.pep
MYRHFRTSVLIVGLGAWESTSNKKKKKKKKKKKKKKKKKKKKKKKKKKKKKKKKKKKKKKKKKKKGGHLKRNKILIGFT

SEQ ID NO: 157334 - protein, 194 aa, Triticum aestivum
  unsure (1)..(194): unsure at all Xaa locations
  Clone ID: PAT_TA_51752.pep
MPPSLLLPTSSSLRLRLPQPRRSTPLLVSFPARRLHVDLRLRLRLAAAGPNGVNGAASPGDGGGANNLPQNRRDILLEYVKGVQPEFMELFVKRAPTQVVDAMRHTVTNMIGTLPPQFFAVTVTTVAENLAQLMYSVLMTGYMFRNAQYRLELQQSLEQIALPEPKEEKGSEDYAPXXTQKKVSGEVIRWNKVT

SEQ ID NO: 157335 - protein, 123 aa, Triticum aestivum
  unsure (1)..(123): unsure at all Xaa locations
  Clone ID: PAT_TA_51753.pep
RPRGRXRGLLSSTRRPFLPQRSSLQLTSPACMPRLASPRLASNSCRFGSIVSRRLNPSIIPTMNREPAGRFMSHRRRALIHLPANANRCSPAGQIRWPPTGGISCRPARGSCPSSGQVRCTAS

SEQ ID NO: 157336 - protein, 112 aa, Triticum aestivum
  unsure (1)..(112): unsure at all Xaa locations
  Clone ID: PAT_TA_51754.pep
RHLDTCRRTISALVEVXTAAPGRIXTYLRGGLRRGTDVFKXLALGASCVFIGXPVEFALAERGEAGMQNVLCMMREEFELTMALXGCTKLSDMTRXHILTEGDRLGRPLPRM

SEQ ID NO: 157337 - protein, 131 aa, Triticum aestivum
  unsure (1)..(131): unsure at all Xaa locations
  Clone ID: PAT_TA_51755.pep
LRETVIEKNGLAWVFFTQXWDSMPGVIPRATRGIHVTNRPALSPILXDHSGLHLGGRTLRHPGXNAPGAPNNQVALDACVQRSSTKRRVTXILEGNANXLPTVCKRMTELPVACEICEATKFNHEPEDTIA

SEQ ID NO: 157338 - protein, 167 aa, Triticum aestivum
  Clone ID: PAT_TA_51756.pep
FRSILKCIKKPALALLAWTSYIPWKVAALQPSPMCSWHLSQPCKLVISINSVIRTGMPTLRCRGHKPEPGLGSSSDTAVPRVIAEPALWAGTHGVMDDSTRTGQATMRSNPWAEHADFPRCGRKAPQPVPWGWVFRSRSPCIAHSACITVARTIDPRKDPQVGRLTL

SEQ ID NO: 157339 - protein, 84 aa, Triticum aestivum
  Clone ID: PAT_TA_51757.pep
SRSKTSPQDRQVPPLRQLSGRANLFWPAESKGGRGVLGPWEPQKPHNVPPPRYLPDREVGRKNAPKISPGTNVVKNQLKYQTFI

SEQ ID NO: 157340 - protein, 72 aa, Triticum aestivum
  unsure (1)..(72): unsure at all Xaa locations
  Clone ID: PAT_TA_51758.pep
PLHLFEXGSVPNMFTSIAGNVFGFKALRALRLVDLRIPPTXSKTFQGPPHGLQVASNKRHKYEARFHCVCPF

SEQ ID NO: 157341 - protein, 194 aa, Triticum aestivum
  unsure (1)..(194): unsure at all Xaa locations
  Clone ID: PAT_TA_51759.pep
PASGSHEVIERGEKRREGSGSVTNAAPTAGNGTPVRPQSSNPSNKKLXKIQFESDASVGPNGKASPREGESDVSKPGSRLGRRRKASAKSQNGTEDAXGLDNPDLGPLLLXHARHLIAXSDNPGTCAEXALLATKSFEKIASGKAXLNLVXSCMLSAAIHCNMGKVPKKLSLVLQPIPSEFLLTRGRSGNTHLG

SEQ ID NO: 157342 - protein, 144 aa, Triticum aestivum
  Clone ID: PAT_TA_51760.pep
MRIEELPGDSGGGGGGGGAGELQLRREDGGADGCELKLRGEDGVVAAAAEEEKGEGAGRVKRAAVGVGARMLFYPTLVYNVVRNQCESHFHWWDQVDEHVLLGAVPFPSDVLRLQKLGVCGVVTLNESYERLVSKSLYEAHGIE

SEQ ID NO: 157343 - protein, 111 aa, Triticum aestivum
  unsure (1)..(111): unsure at all Xaa locations
  Clone ID: PAT_TA_51761.pep
GCQPNECSRKYCYWGTDXRYCRQNWPSGPSTRSGGGSTHPVQSVQTDTCFDWIKSQAVXHGAQSMSFXYTTPFFLGGAQANPYLCKWSTSDDCQMXIALFFLHFTHETCTH

SEQ ID NO: 157344 - protein, 116 aa, Triticum aestivum
  unsure (1)..(116): unsure at all Xaa locations
  Clone ID: PAT_TA_51762.pep
XXVGRVHKRKTRXPTGRXXAXXVKGXXSXXAKQWYEKLXEETGAVAXXRXGSLPPDXSXHDXXXLRSSGPAXRRXXRGGXVLESYRRAXLPSPLALRXXALPXLXGATXPLCRXXC

SEQ ID NO: 157345 - protein, 118 aa, Triticum aestivum
  unsure (1)..(118): unsure at all Xaa locations
  Clone ID: PAT_TA_51763.pep
GPNGKASPXEGESEVSKPGNRLARRLKASAKLHNGTEDAGLDNPYLGPFLXLKHARDLIASDNARRALKYALQATKSFEKCAXGKPRLNLIMSLHVRAAIHCDMGKATNKLYLVLQRS

SEQ ID NO: 157346 - protein, 68 aa, Triticum aestivum
  Clone ID: PAT_TA_51764.pep
PKWLGPAALSKQGPRKSAIDQHGRRWKQGKKMFDHATFSNICLVNAHGRKWKQGKKKAFQHNPTSHTS

SEQ ID NO: 157347 - protein, 164 aa, Triticum aestivum
  unsure (1)..(164): unsure at all Xaa locations
  Clone ID: PAT_TA_51765.pep
IVDILHCXKKKKKKKKKKKKKKKKKKKKKKKKKKKKKKKKKKKKKKKPKKKKRGRPPLKNPKHPPPPGENLKYFLFLGPPKKKKPRPPPFKTRGGGKKPRGPPKKKARGKKNALLPRGGKKEKRPPPQPPSKKWAPPKREKGPPPFGPKKPGGGGGSPPGAPSL

SEQ ID NO: 157348 - protein, 169 aa, Triticum aestivum
  unsure (1)..(169): unsure at all Xaa locations
  Clone ID: PAT_TA_51766.pep
MARRLSLRALCFVRALASPGPRLDMAPAGVRLKISXNVRKARLDPPATDKEKLVTPRGEGELEVPIDLYMLTPXXEEGIYLPYSCRASSCCCCACKLTIXEYNQFHHSFLDYHQIEAGWVLTCHGYHKXHILIKTDKEDELTVLAAIPMCLCNEIQLISYYLLIMHALT

SEQ ID NO: 157349 - protein, 73 aa, Triticum aestivum
  Clone ID: PAT_TA_51767.pep
LPPQPQLHGQKSTAGPESDPPTAIPGQTLSRAVGNGHDAGAGRGSAAQQRCGTQIPRVPRHASRRARTADSVG

SEQ ID NO: 157350 - protein, 138 aa, Triticum aestivum
  unsure (1)..(138): unsure at all Xaa locations
  Clone ID: PAT_TA_51768.pep
MAKLQDKXGLPTGQQRLIVXGSSSRYGRTLADYNIHNESTLHLVLXLYGGMHHLPHRPCTDETITLEDDSYDTIHIIKANIQHKEDIPPDQQRIISACKQLEDGQTLDSYNIQNESTLHLVLMLHGGMHIFVKTLTGK

SEQ ID NO: 157351 - protein, 190 aa, Triticum aestivum
  Clone ID: PAT_TA_51769.pep
ATRTLLELYKASQVSTSDDELILDIIGYWSGHLLRQQLKSSEAQRTPLLREVEHVLDSPFYTMLDRLEHKRNIEQFDIIEHPILQLTWQTNQDLLALGVMDFNTSQSIYQQEYQHLESWVRESRLNRLPFARQKLAYFYLSAASTMFPPELSDARILWAKNGALTTVVDDFFDVGGSKDELENLTALVEM

SEQ ID NO: 157352 - protein, 186 aa, Triticum aestivum
  unsure (1)..(186): unsure at all Xaa locations
  Clone ID: PAT_TA_51770.pep
MAPAVMASSATSGAPFQGXKCTGGLPGSRRSSGSLGSVSNGGRIRCMQVWPIEGMREVXTLSYLAPLSTEALLKHVDYLIRSKWVPCLEFSKVGFVFREHNRSPEYYDGRYWTMWKLPMLGCTDATQVLNEVEEVKTEYPDAYVRVIGFDNXRQVQRDNFIAFKPPGXEESGKALNYELEAMDLCI

SEQ ID NO: 157353 - protein, 188 aa, Triticum aestivum
  Clone ID: PAT_TA_51771.pep
SALLDGQIIKYQPMINEAAKAMLRKILQQDTSPHRFESMGNSDNLLLENCMPSAQTFDSSSSTRNSAVTLAEVPGNSGMPYMPTSSGLSAICSSSTPPEMQCPVLDSNSSTQLPTQLPNMSAASSIPKAMTPGLSDISIPGFPDLHDLITEDAINIPVENYAMPGPECIFPLPDEGSDDSVPMDPIDT

SEQ ID NO: 157354 - protein, 127 aa, Triticum aestivum
  unsure (1)..(127): unsure at all Xaa locations
  Clone ID: PAT_TA_51772.pep
MASCMITSAIVAPTSVPYLSSRGSYFVVVCSGGKKIKVDKPLGLGCGLTVDINPNGKKVVKKGMYQFVDKYSANVHGYSPIYTPIEWSESGDRYAGXTTGLFIWAVTLAGLLGXGILLVYNTITISC

SEQ ID NO: 157355 - protein, 92 aa, Triticum aestivum
  unsure (1)..(92): unsure at all Xaa locations
  Clone ID: PAT_TA_51773.pep
LPRGSLPGFPFAAXMCFVASSPFLCGXIVGFPWPSALPCLISSGGFWCLVLRFSLGALVAVAPCPRRVASSYVRGPGARSSPTPLRPPCAWS

SEQ ID NO: 157356 - protein, 94 aa, Triticum aestivum
  unsure (1)..(94): unsure at all Xaa locations
  Clone ID: PAT_TA_51774.pep
PTQMAWWATSVAAFHGLKFTPGLVVRRRSNGARLGSVSNAGRIMCVRGSPIAGVKEFLTLSCQAPLNTAALLXKQAVYLVPPKWVPRREFSKVG

SEQ ID NO: 157357 - protein, 79 aa, Triticum aestivum
  unsure (1)..(79): unsure at all Xaa locations
  Clone ID: PAT_TA_51775.pep
SGVRSGCCRGVASPGSGARRPLRACGXVASHAAASCGVRLLRRAPRTVRGASPVSLAAPRASPCSTIPHLSAVGVWRPR

SEQ ID NO: 157358 - protein, 91 aa, Triticum aestivum
  Clone ID: PAT_TA_51776.pep
TTTRAQATGHHPQAASTEHDTKATRKQRNNRRRSPAAGPARPPSRRGRRRKRKQAGRSRGRRPRAATPGRRPGRGGRRQAHVGERGRHCWV

SEQ ID NO: 157359 - protein, 69 aa, Triticum aestivum
  Clone ID: PAT_TA_51777.pep
KNRFNRLPFPKQKLAYFYLSAASPIFPPEVFYAPTLWAKNGALPPVVDDFFDVGGSKNELETPPPLVQM

SEQ ID NO: 157360 - protein, 66 aa, Triticum aestivum
  Clone ID: PAT_TA_51778.pep
KPAYATGAPDAWSGPRQGGLASKRRWPTSYVRVTGFDNLRQVPVRQFHSIRDPRVKRSMVRPNMAI

SEQ ID NO: 157361 - protein, 32 aa, Triticum aestivum
  Clone ID: PAT_TA_51779.pep
AKANSLGQLGKYPSDGEPPEAKEGMFVKNYSY

SEQ ID NO: 157362 - protein, 85 aa, Triticum aestivum
  Clone ID: PAT_TA_51780.pep
TGGMLIATQKLTNSHAIKFYRGKNYHRPTKSSPSNLLTKREALRRSVEVQRRGSMKYYVWERQKSIEDLQWRLANVTTKIRKLTA

SEQ ID NO: 157363 - protein, 93 aa, Triticum aestivum
  Clone ID: PAT_TA_51781.pep
NWRIHSVIPQHVSPDKTAVGLHVRTLGRVSSIRVGRLLACRWLGCNEPGSLHLSPVLGSHHAYIRLRVLTLGFLHTPYHLCGLPAPVHWQFAH

SEQ ID NO: 157364 - protein, 88 aa, Triticum aestivum
  unsure (1)..(88): unsure at all Xaa locations
  Clone ID: PAT_TA_51782.pep
VVYKQPGRVLPAHGSITQPKRLNLSCISADLYLVSNSKQIGTFAAPSLKCGSLRLHLHDNHGVRPRRPRPLLTTRRVTAVPRQIQTXR

SEQ ID NO: 157365 - protein, 69 aa, Triticum aestivum
  Clone ID: PAT_TA_51783.pep
KNCGFFPQRRNVPGLFGFRANQKKLAPPKVIANGVPVDNRDENFRIGEKTPIKGAREFAKTMYSSFGPE

SEQ ID NO: 157366 - protein, 93 aa, Triticum aestivum
  Clone ID: PAT_TA_51784.pep
ELAELQRLSKSMKKLEKDLKHQELYKNEQYRMKLKKSNERLLALIKSSLDIVVAVGLLQLAPKKVTPRVTGAFGFASSLIACYQLLPAPAKSK

SEQ ID NO: 157367 - protein, 107 aa, Triticum aestivum
  Clone ID: PAT_TA_51785.pep
AADIVLMKSSLVDVITAIDLSRKTLAKIRLNYVWALGYNVLGMPIAAGVLFPFTGIRLPPWLAGACMAASSVSVVCSSLLLQLYKKPLHVEDVPIPAGPGDGGSNLV

SEQ ID NO: 157368 - protein, 109 aa, Triticum aestivum
  Clone ID: PAT_TA_51786.pep
TSRRAWRRWGARRTSPSTTTSTPCRRTTRPRRRPPPPRRSHRPRRAARRGRRAASPPRPTTTSTTSPPHRRPRRRGMRRGTTRSTSIRRQEEEEEGRRRRGRDERPPRP

SEQ ID NO: 157369 - protein, 52 aa, Triticum aestivum
  Clone ID: PAT_TA_51787.pep
PKGQLIGIYTQYLCSGNGPSWNMTGSIFFACDVASRPIQTPESHTHAIGPCI

SEQ ID NO: 157370 - protein, 89 aa, Triticum aestivum
  unsure (1)..(89): unsure at all Xaa locations
  Clone ID: PAT_TA_51788.pep
KGKKNYTTNKSGHGGNYYYLGTKKNXKKRKLMKKKXKIKNKKKXXKKKKKXXXNKKXKKKKKKIKKKKKKKKKXXKXXKRNKIKLEKER

SEQ ID NO: 157371 - protein, 116 aa, Triticum aestivum
  Clone ID: PAT_TA_51789.pep
ATNGIRVQLKGVFDILANVVPITEKDSRIHNYGVTEDDSLAHFDIGFKFHSLTDDVHGVLGQTYRTDYVNKLSVSTNMPIMGGTSTYVTSDIFSTDCKVARFGRSSGISMVTGMAT

SEQ ID NO: 157372 - protein, 81 aa, Triticum aestivum
  Clone ID: PAT_TA_51790.pep
KLVSVGITPTISRMGTVAPCKILPTPSVLSFASTELRWCFPVCLVLPPETKNESWHHNKASCRVRTKYPHIHDHRTNHFPL

SEQ ID NO: 157373 - protein, 61 aa, Triticum aestivum
  Clone ID: PAT_TA_51791.pep
FHQYYTVSSIGSKFHKVKTKTKCKQSINPSFRDLKQICKMGKKKVRRRRLEEEDYYDATKM

SEQ ID NO: 157374 - protein, 82 aa, Triticum aestivum
  Clone ID: PAT_TA_51792.pep
LEKERGVKTGGPGESRFLIKRKWPRLLFWVWGAPFFSRGQKNLPWWLNHHRRQKEPFFFFQGNRGGSWGFLGPRKFGLGQAP

SEQ ID NO: 157375 - protein, 81 aa, Triticum aestivum
  Clone ID: PAT_TA_51793.pep
KWGVQSRNVSVQMPGNSSAIRQAHLFRNSHEGGESTGRDGLLLAVCLSARRVRFASYNISRSHISCWASHLTTLCICRLMW

SEQ ID NO: 157376 - protein, 123 aa, Triticum aestivum
  Clone ID: PAT_TA_51794.pep
FRNNQQFQALREMVHTNPQILQPMLQELSKQNPQLLRLIQENNDEFLQLLNETFEGGDGDFLDQADQDEMPHAISVTPEEQEAIGRLEAMGFERARVIEAFFACDRNEQLAANYLLEHAGDEE

SEQ ID NO: 157377 - protein, 136 aa, Triticum aestivum
  Clone ID: PAT_TA_51795.pep
HVMGTSFDVHVQTQYDQRRELNATTSPRHTAKTPSRTPAPATGGRGPAATRSASSSAACPSSPRRRRRRRRRPFPYRRRSPPCLRRSSWSRRPTSRRSTRRPPRPPPKTCAWTARTGAAATPPAFAAAAAAAGASG

SEQ ID NO: 157378 - protein, 96 aa, Triticum aestivum
  Clone ID: PAT_TA_51796.pep
PPSFPKCPRVLVPPWGAAWKITPRLLPGVLAPSSGNFSKRFFFFFQRRLTPLFRYYGGSTVILNWVLGVIFLGRVVGVFFFGLPFVDPPWFLGRPL

SEQ ID NO: 157379 - protein, 83 aa, Triticum aestivum
  Clone ID: PAT_TA_51797.pep
NAGHESHCKSKKVVVITLSIMALKNGNSLPASSGFLGFGGGLGRRRLYFHGLMDCKHRLIVYAGGSTFTIESAFPTVGSSNKG

SEQ ID NO: 157380 - protein, 122 aa, Triticum aestivum
  Clone ID: PAT_TA_51798.pep
MFEDNGKKRESKFTSTNSASTIVSKIEDIAKCMRLKLVKKDGGMMRMESFKPGRKGVMSIDAEIFEVTPDFHLVELKKTNGDTIEYQKVLNQEMRPALKDIVWAWQGEQQPQPQPQPQQQPC

SEQ ID NO: 157381 - protein, 133 aa, Triticum aestivum; identical to SEQ ID NO: 156632
  Clone ID: PAT_TA_51799.pep

SEQ ID NO: 157382 - protein, 86 aa, Triticum aestivum
  Clone ID: PAT_TA_51800.pep
LALLLYSQGKRFDIILIVLFELLIISRERRWPSRLNHLSEIRGPPYRTLHIFRSLGMSTSFSHARRRPSCGMLGGVGNIRVVGAIS

SEQ ID NO: 157383 - protein, 107 aa, Triticum aestivum
  unsure (1)..(107): unsure at all Xaa locations
  Clone ID: PAT_TA_51801.pep
TPSTTTRSSSAPSSTCSSASXASATANTSTTTGTMTSSSSTSSSSSSTSSTSTTSSSTSTSTGGDGVVVSATSATGQCDGGNEACASCSSSSSCAPRDDDEASRGED

SEQ ID NO: 157384 - protein, 136 aa, Triticum aestivum
  Clone ID: PAT_TA_51802.pep
RLPSSPSSHAIERRAPVVGVPVRPRNAHSWRRRVWVGAGARHRHGIVPEIELPLFVPVAACASLVGGSAAVPLFIHHGASRHQEGVATGALLVPAAVVDRGARRCLEIVVSGGPEVQLLEVLQALRGDAGVLLGLA

SEQ ID NO: 157385 - protein, 48 aa, Triticum aestivum
  Clone ID: PAT_TA_51803.pep
NLPACLKVAVREENKGKMIVTMFPSGGERYMNSDLFAAVREECIAMTF

SEQ ID NO: 157386 - protein, 111 aa, Triticum aestivum
  Clone ID: PAT_TA_51804.pep
LAKGGPFKTFVFGGVFFFLPVFILLGGHFFGLGMDFFFSFFSRKWSGAFPVFPSVFFPVFGRLGFFLKFIFGLDCNFDFLDRVPLVSFRDYAVVLFSFESWFPPSPITVGI

SEQ ID NO: 157387 - protein, 98 aa, Triticum aestivum
  Clone ID: PAT_TA_51805.pep
STSGTQLEVITAGAYRSVLHRVAPVAEGRRLSVATFYNPGADAVVAPAATARQPAAQLYPGPYRFGDYLDYYQGTKFADKAARFQAFKELFGSRIRHD

SEQ ID NO: 157388 - protein, 73 aa, Triticum aestivum
  Clone ID: PAT_TA_51806.pep
NTSLKTVVLILALRTLDHRAYPTWNKKLTWGGVGYSKPPPPSCAWHALAWFPPPSYSLPPVLFPFLALLCCFF

SEQ ID NO: 157389 - protein, 93 aa, Triticum aestivum
  Clone ID: PAT_TA_51807.pep
LLFAPSYCNIDVMCSKHRYGTMSKDAGATLMYQLATVMGIGTKKLEWITRVFNPGLDAMPVIGFQHLGVDLSGLFVLACPCVQYFPLIAKIKF

SEQ ID NO: 157390 - protein, 100 aa, Triticum aestivum
  Clone ID: PAT_TA_51808.pep
DIVDTFRLQEQPAFDKKQFISHMKRYIKNLTAKLEGDDLDVFKKNVESATKYLLSKLKDLQFFVGESMHDDGGVVFAYYKEGAADPTFLYFAHGLKEVKC

SEQ ID NO: 157391 - protein, 142 aa, Triticum aestivum
  Clone ID: PAT_TA_51809.pep
IAPAFRIFNGAQMVGAPNGIGSCFFLQNGWSLTGGGGGLTKGSPLYFSLLPTYVSALVEMRIYSCLGRMELPWRASQKILWVDSFLPLSLGLIRLACSRPPPLFCWPFCWNAFLRNCARPGTGSGEAGGFPVFFRGGGVALG

SEQ ID NO: 157392 - protein, 108 aa, Triticum aestivum
  unsure (1)..(108): unsure at all Xaa locations
  Clone ID: PAT_TA_51810.pep
IPAPIKRAVYFEPSCPPTRGKKGATRGEKKRNRKWHVSKNGRNNNTFFFFLRSPGALFFSEKSNDSVWGACPKAWIWRNSGSFSALTQSWPPPGRGSCHXRWRLPLVS

SEQ ID NO: 157393 - protein, 59 aa, Triticum aestivum
  Clone ID: PAT_TA_51811.pep
APKKDLLVTPGVFRIQTKPFKLGLLGFPQLVMVFLSPKMFFAQDFARFGVFVPPLWLTS

SEQ ID NO: 157394 - protein, 65 aa, Triticum aestivum
  Clone ID: PAT_TA_51812.pep
DHPATITVDSLGLRFQSTGNSWKVTLVPFHSHDLICEPYVIKQYLCTQMRAHINETYVYHKLLQH

SEQ ID NO: 157395 - protein, 98 aa, Triticum aestivum
  Clone ID: PAT_TA_51813.pep
GHRGGRVPPCTPLVGEVRRISLKHSVIVRSGAPWSISHTARSWSPVCSIDVSGNNFVEIKFGEGGRSCRREDCPRNAVYHVLILFSTPYLSGLVVLSL

SEQ ID NO: 157396 - protein, 101 aa, Triticum aestivum
  Clone ID: PAT_TA_51814.pep
GAPNITFFVKRKEKRVGIFFQNWGGGGGSQYPGGPPENLFFLFSRAIPLGNGFKKHWGFGKTAGRGCKILQKEKKKNPFMVGDPKKCSKKPPNEKRGGVVF

SEQ ID NO: 157397 - protein, 112 aa, Triticum aestivum
  Clone ID: PAT_TA_51815.pep
GELVGYWPSFLFSHLASHASMVQFGGEVVDTRAEGSHTATQMGSGHFPGEGFGRSSYFRNLEVVDWDNSLIPLTTFHVTADHPNCYDIQGGVNAVWGNYFYYGGPGRNVRCT

SEQ ID NO: 157398 - protein, 80 aa, Triticum aestivum
  Clone ID: PAT_TA_51816.pep
AAYCVGGSGPPPPPALCEIIICGKLLVSLVNPQIDPLGCNRYSIGTMALASPCSPRSCIPQLYKLVCLDGFPPPVRPMWF

SEQ ID NO: 157399 - protein, 115 aa, Triticum aestivum
  Clone ID: PAT_TA_51817.pep
SMALKTPTFLLMYCTRFTTKTGIGNNNMCHASESEMMASVEMVGGEVGLVGLLQPADHGVVGTEPSGRGGELVHFGGGPGGALLLGLVGGRVLLGPPRVGLPPAEAFRQLSSLVL

SEQ ID NO: 157400 - protein, 61 aa, Triticum aestivum
  Clone ID: PAT_TA_51818.pep
VCCLSNGMSLVKLSSWQVLHYWEAFTFSFFPSIHRHTFCYGIKMVSAFTQATCGCICFSHR

SEQ ID NO: 157401 - protein, 75 aa, Triticum aestivum
  Clone ID: PAT_TA_51819.pep
CCWGLFFFFFFFFFFFFFFFFFFFFFFFFWGKETRGHSFISSRGRGQNHWGGGGKDTPFFPGQMGLGIHALHHIT

SEQ ID NO: 157402 - protein, 122 aa, Triticum aestivum
  Clone ID: PAT_TA_51820.pep
FLGSISPKHVKMILYMARELKKSLAKDGGNVQYNRPDCQRGGEGHQMVISTVYAEICRLPVGLHYHQHMNSTRSTCTRLKITKQAFLGPHWSPPINGVGNWCAGHGQPCGQLHEQLENPGCH

SEQ ID NO: 157403 - protein, 56 aa, Triticum aestivum
  unsure (1)..(56): unsure at all Xaa locations
  Clone ID: PAT_TA_51821.pep
GKKTRSPGEEVAKVFVFFNQGXPIHALLECLKEWNGEPLPFFLSGRLKKNSLLQDF

SEQ ID NO: 157404 - protein, 121 aa, Triticum aestivum
  unsure (1)..(121): unsure at all Xaa locations
  Clone ID: PAT_TA_51822.pep
MGSSAKVAAVNPFELCYDSSKLAPTRFGYLVPNVXVMLEGGTNWTVVGGNSMAQVNSGTACFAFVRSGGSTGGATPALVIGGFQMENKLVVLDNGKKTLSFTQNLPGMGFSCSNFNFTRAG

SEQ ID NO: 157405 - protein, 100 aa, Triticum aestivum
  unsure (1)..(100): unsure at all Xaa locations
  Clone ID: PAT_TA_51823.pep
GQVYGYRNSLWAEHXLGMVDDHFKEPSSLECVRLVNQIAEENWERFASEEMKTLQGHLLRYPVKVESDGKIVPLPDQECFPDVGGKICGAPTSLPDSLTM

SEQ ID NO: 157406 - protein, 89 aa, Triticum aestivum
  Clone ID: PAT_TA_51824.pep
GANPFQCPRCGSRETKFCYFNNYNVRQPRHFCRACRRYWTAGGALRRVATASPGRRRPRPSARSAAAAASATASASEEGAAAESVDSRS

SEQ ID NO: 157407 - protein, 93 aa, Triticum aestivum
  Clone ID: PAT_TA_51825.pep
IGGAPSPPKRGEKNVKPGYGPLVVAGKKGKGGFLTSSSGRNHTFWANTGGPPLGALAGPRLADNLGATAGGPKTPGVGGGPQNLAGVPGPLEK

SEQ ID NO: 157408 - protein, 62 aa, Triticum aestivum
  Clone ID: PAT_TA_51826.pep
FNHNRNISVSCYYLLSPVSAFCFGLELLSKQATTFAAANHFIQAGLETNIDFILSPQYTKSF

SEQ ID NO: 157409 - protein, 66 aa, Triticum aestivum
  Clone ID: PAT_TA_51827.pep
KLSGYPSQFLKTGVAKKTIGRGKVLSLGPPGGVGLRLVLLRVFLFRQGLFNVALVGHVRVDAYIVT

SEQ ID NO: 157410 - protein, 60 aa, Triticum aestivum
  Clone ID: PAT_TA_51828.pep
KLQASWRILSYSPAPRASPVLAIRQPGFIGVPLWQRIRLYRPLSLRETPFSQPFCLEPCS

SEQ ID NO: 157411 - protein, 74 aa, Triticum aestivum
  Clone ID: PAT_TA_51829.pep
RPSCWAPPRQRSRTPGHIPCPGKTGPPLGKGWPPPGARGGWPPQGGLCPPAPKLGGEGQPPQAPPPPVGAKIVG

SEQ ID NO: 157412 - protein, 121 aa, Triticum aestivum
  Clone ID: PAT_TA_51830.pep
ETALRDYKAQLEEDPIVHRHLSSLYDTLLEQNLCRLIEPYSRVEIEHVAQMIELPVDHVEKKLSQMILDKKFAGTLDQGAGCLIIFEEMKTEAIFPATLETISNVGKVVDSLYMRSAKIMA

SEQ ID NO: 157413 - protein, 75 aa, Triticum aestivum
  Clone ID: PAT_TA_51831.pep
GAPNEDHPVNVRSGKENVRVQWAAPGNPHYMQQFQFPHGGFLLKECHACPVLACQAPPPPCSFVLNVAWLRKVLS

SEQ ID NO: 157414 - protein, 68 aa, Triticum aestivum
  Clone ID: PAT_TA_51832.pep
DPVDPQQEVDVERIYVGLSGPLKSQSFFPRQASTVSHSRQVNGRKTFVARRPVLFFLPNKNSPVASLD

SEQ ID NO: 157415 - protein, 86 aa, Triticum aestivum
  Clone ID: PAT_TA_51833.pep
LFTELAHRYKDRAGGYTRLLRTRIRIGDAAPMAYIEFVDRENELREAKPATPPPPQRVPLDPWAKSRASQQWAGPKVTVNSKSEGL

SEQ ID NO: 157416 - protein, 129 aa, Triticum aestivum
  unsure (1)..(129): unsure at all Xaa locations
  Clone ID: PAT_TA_51834.pep
FYKDPLDQKSKKQSAPRFVSPLTHVAWADGARARATRAAHLEHGRRRLCSRPHAAGAASLARSHPRCCSRTASQHAPMHPXPAAARSWRRGTRPHAAGATAAARSHPACCLRPELVLSPTHGQRGAARA

SEQ ID NO: 157417 - protein, 70 aa, Triticum aestivum
  Clone ID: PAT_TA_51835.pep
LFPIKNLIFKSYISTHITWSSLHTWALLTSYGLFWGFTPPPPLTMGPQSKFAHAGGLPNRVHQNSDTGGP

SEQ ID NO: 157418 - protein, 46 aa, Triticum aestivum
  Clone ID: PAT_TA_51836.pep
ALGFIHSVPLETVPSVVILARWAGFYNIDFEAKTRKLVDCFCDKVR

SEQ ID NO: 157419 - protein, 103 aa, Triticum aestivum
  unsure (1)..(103): unsure at all Xaa locations
  Clone ID: PAT_TA_51837.pep
RAYSLPKSRTAIVRRCILMMCWSSPGAPYLGESRKDVGSRALFDAHTRIQDRPNXFTKNSLDSMIDESNLYHCHTXTKCTHIXPKELNPENPSDTIKKLEVEA

SEQ ID NO: 157420 - protein, 80 aa, Triticum aestivum
  Clone ID: PAT_TA_51838.pep
PTQPPRSIGEGTPCDAQPNTALVDKSSDCHCTDKTHRLYEGDGYCVCLPDTQKSQFTAHRAKENDGNCMCGDRCTCTNWT

SEQ ID NO: 157421 - protein, 194 aa, Triticum aestivum
  unsure (1)..(194): unsure at all Xaa locations
  Clone ID: PAT_TA_51839.pep
XQSKAAAQLQLHPKLLLSSPVVGWRSVPVSAVVAVGVAEHHRAVDVLVLPSISVQRGRCCGGSSVVPVNLAGGGDASTQHAWCCILCRSPRARELQRSTAQRAWRSCSATCDVVLGGGPRRRRSCSAAFMVLRPSHRRRTAELQCSASCCDRWTSPATGSCSAADLIGAAELHCDTLCCDRWTSPAAGATVQHI

SEQ ID NO: 157422 - protein, 137 aa, Triticum aestivum
  unsure (1)..(137): unsure at all Xaa locations
  Clone ID: PAT_TA_51840.pep
VSNGGRIRCMQVWPIEGNKNVESLSYLPPVSTXALVKQVDYLIRSKWEPCFEFSKVGFIFREHNASSGYYDDRYXTMCNLLMFGCTDATQVINEVKKVXKKYPYVYVRIMGFPNMRQVQCVSFIAFKPPGCKESGKA

SEQ ID NO: 157423 - protein, 109 aa, Triticum aestivum
  unsure (1)..(109): unsure at all Xaa locations
  Clone ID: PAT_TA_51841.pep
VTCSLEVERAPTPADMYVLGWWSIQFFKGSXLKWPVGVIRYEYDQLQAPVGGRVYFTGQYTSEHYNGYVLGAYLSGMNSADIIMIKVLINVEFKVPFQVQRVAHTCRIN

SEQ ID NO: 157424 - protein, 106 aa, Triticum aestivum
  unsure (1)..(106): unsure at all Xaa locations
  Clone ID: PAT_TA_51842.pep
ARLRLFRLRYKCFHRIPVIFXKCGKSYIPGFDKKKCLVPPDLTVAAXCVYVVGNRIDLTADKALFLFVXSLFPPPPALMWCPFRGDQGQGRLPLRDPPRPVHWGLI

SEQ ID NO: 157425 - protein, 105 aa, Triticum aestivum
  Clone ID: PAT_TA_51843.pep
MPPFFFFFTNMLSHSHCLKLDNMSFITKSNVEVTCNSMLCEVHLFTQLKKNPSLHLCFLIYFQPTQQNARARRSSYASADNDESLSLPAEELIQNDDPTEDKNKE

SEQ ID NO: 157426 - protein, 130 aa, Triticum aestivum
  Clone ID: PAT_TA_51844.pep
SRSRTSDQGAVRHHARAQAASGSASSVALPGAPAAHNNLALPGPDGAVGGDPFAASLSVPPPSYVQMAEMERKQELLAQEQRMWAQYRQGGMQGQAGLNGLAVGGGGSAFASSTSVPMPMAYHGAGGYYY

SEQ ID NO: 157427 - protein, 62 aa, Triticum aestivum
  Clone ID: PAT_TA_51845.pep
GEELFSKKRKGLGVWKFLEPKKCGSPVNGFSGILWNFCQFFFTTKNLPFFCSLRPLFLTVCF

SEQ ID NO: 157428 - protein, 115 aa, Triticum aestivum
  Clone ID: PAT_TA_51846.pep
KIRRVDSRLITPLMDGGSSPSQRFCPSPFSAATSPSSSHCGKAQFPRVIATVVAVRCTAAPVAGEVRCTTAPAAGEACRMQHNALHCSSATPAMCCTVAPAAGEVHRSQHNVSQC

SEQ ID NO: 157429 - protein, 75 aa, Triticum aestivum; identical to SEQ ID NO: 117166
  Clone ID: PAT_TA_51847.pep

SEQ ID NO: 157430 - protein, 91 aa, Triticum aestivum
  Clone ID: PAT_TA_51848.pep
STKELLTLQCKQTLEQESNITASFPAAVQEMDKKSLEEEYKALQGDGAGEAEYFQSLEERIIKMKGVSDPIKCCCGLEYNVELGGESMGVR

SEQ ID NO: 157431 - protein, 189 aa, Triticum aestivum
  unsure (1)..(189): unsure at all Xaa locations
  Clone ID: PAT_TA_51849.pep
PRVRPACAHASAGLSHGVRLPVPVGRRASRFTVRASSAEAEAVGRRAVLGLMASVVVGSAFAQVVHAGSVAAMKVGPPPTLSGGLPGTDNSDEAWDFDLPLKNRIYLQSLPPAEAVVRSKESAQYILNLKPVMDKKQWPYVMNDLRLXACYLRYDLKTVICFKTTIEEKKDLKYLTGKLFATLDGLDHA

SEQ ID NO: 157432 - protein, 203 aa, Triticum aestivum
  unsure (1)..(203): unsure at all Xaa locations
  Clone ID: PAT_TA_51850.pep
PGAWGKGKARAVEKPLSVARKQQAVLANVDQVTGERIPKSFVFSRGKLPSTLRHLQQDLRKLMLPYTALKLKEKKRNNLKDFVNVASPLGVTHFLILSNPKSLRHLRFAKSPQGPTYTCQISEYALAADIANSQKRPRCPAEIFKNSPLVVLSGFNGLGEPFKSFVTFFRHLVPAIDTDTVKLSTCQRXLLLQYDKETEAIDF

SEQ ID NO: 157433 - protein, 118 aa, Triticum aestivum
  unsure (1)..(118): unsure at all Xaa locations
  Clone ID: PAT_TA_51851.pep
ARNSGPPPRPMGLGRSKHTFQEEPREPGSPYRDGPAARQANTRLXQRETMPLNNPRQHTGLGGNIPQDSLPEGPXGTVKTLLALCDTGEAPVPLFYCAEDDIEKIFDCITAYRVRDRY

SEQ ID NO: 157434 - protein, 101 aa, Triticum aestivum
  Clone ID: PAT_TA_51852.pep
KQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 157435 - protein, 97 aa, Triticum aestivum
  Clone ID: PAT_TA_51853.pep
LTLIFAIQRCDPAPFYLFDEIDAALDPQYRTAVGSVVRRLADLADTQFIATTFRPEILKVADKIYGVTHKNRVSFINVVSKEQAMDFIEHDQTANAS

SEQ ID NO: 157436 - protein, 104 aa, Triticum aestivum
  Clone ID: PAT_TA_51854.pep
PTRPPTRPPTRPRSASTAAQPPAGTPPRPRACTSRVTSTKAPSLPRHSRIQDLGATRVCVRTARHMDCAKIRACVRACRYICSSFSAVYLNSLSSRFLLFNQNY

SEQ ID NO: 157437 - protein, 172 aa, Triticum aestivum
  unsure (1)..(172): unsure at all Xaa locations
  Clone ID: PAT_TA_51855.pep
NRELXVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEAFAELKVKEIKNGRLAMFSMFGFFVQAIVTGKGPLENLADHLSDPVNNNAWAFATNFVPGK

SEQ ID NO: 157438 - protein, 71 aa, Triticum aestivum
  Clone ID: PAT_TA_51856.pep
LQKEIRYRKENITCTRNVTLNVALNRREGQITLGTWSACGDTTVGYRSILKTTGHDLALRSLVYILRREVA

SEQ ID NO: 157439 - protein, 104 aa, Triticum aestivum
  unsure (1)..(104): unsure at all Xaa locations
  Clone ID: PAT_TA_51857.pep
YEPYINPVLVQINNAVVVPHIASAYKXRXEGMPPLVAINXLGKCKGYXCWGNPNVGGALPPLSKVVPPPCVAQASVNAKQLEPAILPSFRQSHSMGSITVAITT

SEQ ID NO: 157440 - protein, 144 aa, Triticum aestivum
  Clone ID: PAT_TA_51858.pep
LSSRLGCRWLRRWAADLEEEAAKRSAEEQRQRTAIDAHDSDIALVRAQAKQVSDEAEHLAKARAHVCVEMAEKQGRIASLEVVGATLKQTLDLLQLEITSTSAKLGQKRLFYTKTMETLSVKLQEHQGWLDSDKNKMVAIEPFA

SEQ ID NO: 157441 - protein, 83 aa, Triticum aestivum
  Clone ID: PAT_TA_51859.pep
NAAARAYMHPPKGKTEVNTKYVSCYTVKKPFGFDQNKDYHLKNFIPFFFKSDFFTMLSQGSKLIMLAKYTSCLKFLAIIIGWC

SEQ ID NO: 157442 - protein, 90 aa, Triticum aestivum
  Clone ID: PAT_TA_51860.pep
EWSKGKEGNIRSLLFTLQYVFWPESGWKPVPLVNIIEGAAVKKAYQKALLCFHPDKLQQRGAAMPQKYIAEKVFEFFQEAWKEFNSVPFG

SEQ ID NO: 157443 - protein, 121 aa, Triticum aestivum
  unsure (1)..(121): unsure at all Xaa locations
  Clone ID: PAT_TA_51861.pep
GTLSKATMFTSGSVSPKVGAXFIATYPPAALERTEPPAVHSCAVPLVPGTRSIGRSRTCDGHEPSLPRPVSTWIAQHCAVGPVCTIQSTDQKVGRQEGKRPRRSDHLLRSMQCPSLAPRRT

SEQ ID NO: 157444 - protein, 81 aa, Triticum aestivum
  Clone ID: PAT_TA_51862.pep
TQLPFPVEIALLDPPEDDAPHFLVPNKRPPEHGEHTRFFGYSFLVHVALNCQRLARVTFTFVATPLLLLPRMAVMAQVLLV

SEQ ID NO: 157445 - protein, 50 aa, Triticum aestivum
  Clone ID: PAT_TA_51863.pep
VQVGSYPVKTPSLPLFEGEYQGVFVPVPVLVMSPAWVPFLVPNLGNQGTR

SEQ ID NO: 157446 - protein, 81 aa, Triticum aestivum
  Clone ID: PAT_TA_51864.pep
VRKLVKPPYWSGTADFHQQHPHPPQDLYHPDQKADCVRGGVLDPLHHRADRTVRRINLLVVRALYFYGKYSRVHHVGTPLI

SEQ ID NO: 157447 - protein, 43 aa, Triticum aestivum
  unsure (1)..(43): unsure at all Xaa locations
  Clone ID: PAT_TA_51865.pep
IKSPLVHILQITKSQQLSYVIRPALINKGSLRYPLTHAXAHAX

SEQ ID NO: 157448 - protein, 89 aa, Triticum aestivum
  unsure (1)..(89): unsure at all Xaa locations
  Clone ID: PAT_TA_51866.pep
MGQRRRHSAVELAAGADGLALCATVAGYLYSPEATACGLPPGPGGSLGAEEGDSYLVGAGLVGWSLTTKYAPCXGLPAGPYGLLGPDEG

SEQ ID NO: 157449 - protein, 201 aa, Triticum aestivum
  unsure (1)..(201): unsure at all Xaa locations
  Clone ID: PAT_TA_51867.pep
LGNCTSLRHLSLSXNHITGHFPSKISLLGNLTGLDLGYNNLDGVITEEHLVTLKNINHLDLSHNSFSGHLPXKLGAKGLVELTLSSNKFTGYIPETICTLRNLLVLDLSNNLLEGELPQCSQKPNLVFLLLSHNKFSGKFPSSLKNYSSLAFMDLSWNNFHGTLPSWIGDLVYLRFLQLSHNFLCGDIPVTITYLKLLRQL

SEQ ID NO: 157450 - protein, 43 aa, Triticum aestivum
  Clone ID: PAT_TA_51868.pep
IKSPLVHILQITKSQQLSYVIRPALINKGSLRYPLTHASAHAS

SEQ ID NO: 157451 - protein, 138 aa, Triticum aestivum
  Clone ID: PAT_TA_51869.pep
SVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 157452 - protein, 128 aa, Triticum aestivum
  Clone ID: PAT_TA_51870.pep
LLEAEIDELSRQVARKSSQGSNELLEYLKTLEPQNLKELASSAGEDVVFAMNAFIKRLLAVSDPAQMKTAVSETSGAQLANLLFWLMMVGYSMRNIEVRFDMERVLGAAPKMGGELPPGPGDNTQTQL

SEQ ID NO: 157453 - protein, 110 aa, Triticum aestivum
  unsure (1)..(110): unsure at all Xaa locations
  Clone ID: PAT_TA_51871.pep
LVTSNVGYYIFWFSMLTRKSVFSTIDEKYFGIPGKKHATHDGELPVKPWIIRAMRLKAQTQSVQPNGSRPVHPSLTKACPNPLVYKFXSVCVQLXPAFXFQFQXRRRRLR

SEQ ID NO: 157454 - protein, 84 aa, Triticum aestivum
  Clone ID: PAT_TA_51872.pep
GFIFSAELPQVMPTLGENLSKKKVEKMVPEAHVDGDGQINYDEFVKVIMAQKREKRIKERRAPSAKKSPAGASGAKSGSKCIIL

SEQ ID NO: 157455 - protein, 107 aa, Triticum aestivum
  Clone ID: PAT_TA_51873.pep
STEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 157456 - protein, 85 aa, Triticum aestivum
  unsure (1)..(85): unsure at all Xaa locations
  Clone ID: PAT_TA_51874.pep
FTKVGFFFREPNSSPGFFAGXYWPIWKLPLFGCPPPPQVLPGVGGVKKESPYAFVRVMGFDNMGQVQWVSFFAFRPPGCEESGKA

SEQ ID NO: 157457 - protein, 74 aa, Triticum aestivum
  Clone ID: PAT_TA_51875.pep
RCYPEKWKVFYDDPKRPNRYLLARESSSRPDATDIEIIFGGGGASEQPEEEPSMMTNVMAAFSSVSRFMRVISK

SEQ ID NO: 157458 - protein, 65 aa, Triticum aestivum
  Clone ID: PAT_TA_51876.pep
EQIRTKNGGGDPGAYVKIRQNCIGTLYPGKRGVNCKGLAGLKKGKAQSQCQGTKKLYTDFMFRPM

SEQ ID NO: 157459 - protein, 63 aa, Triticum aestivum
  Clone ID: PAT_TA_51877.pep
LISGKYHKFLGVQQSQKQWRTRSFIASWRRRISESMYNQMAKSMLSFTDCRLHRKINEHVAAA

SEQ ID NO: 157460 - protein, 97 aa, Triticum aestivum
  Clone ID: PAT_TA_51878.pep
TGNIGLCGTPLERNCSGNNSPEHDNQQKNQNVSEPVLFFYFGLGSGFVAGLWVVFCTLLFKKVWRVAYFRLFDKSYDKAYVFVVVTWGRITGKATTT

SEQ ID NO: 157461 - protein, 86 aa, Triticum aestivum
  Clone ID: PAT_TA_51879.pep
TRPGQVKNLHLNLDRRTGFVKGYALIEYENFEQAKRAIRESDGTELLSQIISVDWAFSSGPVKQRNTRKRSPRPNRSRSPPRRRYP

SEQ ID NO: 157462 - protein, 70 aa, Triticum aestivum
  Clone ID: PAT_TA_51880.pep
KGRSCIISSNKTCFSGIKKDSSSRFCSHSTQTWCTCYATRTIQGTGELLVLQGHGNAIIRDLCHLINIPS

SEQ ID NO: 157463 - protein, 84 aa, Triticum aestivum
  unsure (1)..(84): unsure at all Xaa locations
  Clone ID: PAT_TA_51881.pep
SESSFLWMPPSGFRKKKTVLALQLDLISKVVFARKGFSQLKCRRINFXQHRASQIVQLLLLKVHAALWPFDDLSXPSVTRXLGN

SEQ ID NO: 157464 - protein, 169 aa, Triticum aestivum
  Clone ID: PAT_TA_51882.pep
LWLQDTREKLPVRRAAVSPAEARGAACHPCHFDAPQALGLGQDHGCCHALYLPTPAPRLGTTGLTARSATRFTDENICRNLVPSRVNAVRNVQVLMPARSTILCCVPWKNEPRLWIFHLPYNTWTIVGTSCTWRRLTTVCLCTHDGKLAVLSMRCRSRACKSDLQKRRA

SEQ ID NO: 157465 - protein, 175 aa, Triticum aestivum
  unsure (1)..(175): unsure at all Xaa locations
  Clone ID: PAT_TA_51883.pep
MAPAVMASSATTVAPFQGXKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 157466 - protein, 156 aa, Triticum aestivum
  unsure (1)..(156): unsure at all Xaa locations
  Clone ID: PAT_TA_51884.pep
TIESELNKAARYPTISLRVHDDAIQTKLKQSNPIATLKDDGTEERNVPSPLEATPIDXGPLDGYQDVEXEESLDGXDVPYIPAIQTVXILIHPTKGDVQPFVVIRKHSQDYXHRERXATHANYKEFILTARLELFPLDGDPKVLDEYILKNKGLLH

SEQ ID NO: 157467 - protein, 40 aa, Triticum aestivum
  Clone ID: PAT_TA_51885.pep
DKANKIMFKRGFIFYMGYNTRGQGHIQKACIGPQLHTIIH

SEQ ID NO: 157468 - protein, 73 aa, Triticum aestivum
  Clone ID: PAT_TA_51886.pep
MDPSPPMVLGATMVKVFPWFPPKWGSPPGVVYLAPLVAAKWPGPGTGGNGDPLGGFCKTPPPPVECKVFSKLS

SEQ ID NO: 157469 - protein, 64 aa, Triticum aestivum
  Clone ID: PAT_TA_51887.pep
ACICHFQKVYFMFALDYVNGNGQISWFQLLQVFMTVIMESMIPQRRAGSTNKRLAGAFGLNSGR

SEQ ID NO: 157470 - protein, 63 aa, Triticum aestivum
  Clone ID: PAT_TA_51888.pep
SYRPFSSNNDPLSTSLDHTQETPVYYQGVTLLLRTRMSKSPFKPIQIYNCSQRFWPNLTYAKH

SEQ ID NO: 157471 - protein, 83 aa, Triticum aestivum
  Clone ID: PAT_TA_51889.pep
DACSMSVKTRECSCAVYSVVSRAWAQGLGVKRSIYTGASLVGTVDTCFVRPPSYRFSAMIVRRCGICYKCHSSRIRDFPSDPV

SEQ ID NO: 157472 - protein, 64 aa, Triticum aestivum
  Clone ID: PAT_TA_51890.pep
DKKQQGQGARGFIKKKSPGVGFGGAGFKIKKGRPGEIRVGHTSPGHLEGKIAWGAQKRGGQKGS

SEQ ID NO: 157473 - protein, 83 aa, Triticum aestivum
  Clone ID: PAT_TA_51891.pep
KVGLFFREHNASPGYYNGRYWTMWKLPMFGCPAPPQVINKVEKVKKEYPYGYVRIIGFDNMRQVQWVSFFAFKPPGFEESGKA

SEQ ID NO: 157474 - protein, 83 aa, Triticum aestivum
  Clone ID: PAT_TA_51892.pep
KEFSLGATFRVQKKKNWASFTMGSDQQGRICPKGVLSTQRQAYKFQQHRAFKIVQLLLLKGHAPLWPFEELISPRGTRSLGNF

SEQ ID NO: 157475 - protein, 100 aa, Triticum aestivum
  unsure (1)..(100): unsure at all Xaa locations
  Clone ID: PAT_TA_51893.pep
GEMMVSQKIMLCHLLDSTGSLFCAAAHSSAASTYLLNRVAHLFLSFNLGDGGCRKAYLSSHLLFSAFLXVRFSVECVRHTCVYLAPRIIACRQMNVPLSL

SEQ ID NO: 157476 - protein, 92 aa, Triticum aestivum
  unsure (1)..(92): unsure at all Xaa locations
  Clone ID: PAT_TA_51894.pep
GAGKIGFPHPAEKAKARILPIPPKKMNGHPDANFEELARSINDFYGAQIKAVCVESGRLALCRDPSXVIHEDFNAGITPVPAKKKSSLDYSP

SEQ ID NO: 157477 - protein, 53 aa, Triticum aestivum
  Clone ID: PAT_TA_51895.pep
SPGSQGFQVLLGSVKLMFRGLLGAGYMQVSRSSHSVLRVCQRLFGDDKCCLVD

SEQ ID NO: 157478 - protein, 166 aa, Triticum aestivum
  Clone ID: PAT_TA_51896.pep
MSGWFQEKSGDATKTASETGQSIQDRAVEAKDQTGAFLGEKSEAVTKAASETTEAAKKMGDEAMGKVSETVEAGKDHAVEGKDQTGSFFGDKTDAVKKTATETADAAKEKSTEAAQHVQDTAAQYTKDTPVAPKENVFQQAGGNMVGAATDAKDAVMNTLGMGGDK

SEQ ID NO: 157479 - protein, 84 aa, Triticum aestivum
  unsure (1)..(84): unsure at all Xaa locations
  Clone ID: PAT_TA_51897.pep
XXYGNQXLTSSXSYPSHKIHDPPRKLMASVRSRLVQLLPPQLGKGSDCGAVLPSLATGATLEQLIYEPGHPSQRRKSLQKSHSL

SEQ ID NO: 157480 - protein, 126 aa, Triticum aestivum
  unsure (1)..(126): unsure at all Xaa locations
  Clone ID: PAT_TA_51898.pep
MGGGVGAASDVSSVVLMXVDALELSKETMRTVKQNLWWAFLYNIVGLPVAAGALLPVTGTMLTPSIAGPLMGFSSVSVMANSLLLRARMSSRHHVQSRQKPQSTISGVSDGADEVEQSYPSKWRST

SEQ ID NO: 157481 - protein, 155 aa, Triticum aestivum
  unsure (1)..(155): unsure at all Xaa locations
  Clone ID: PAT_TA_51899.pep
MAPAVMASSATTVAPFQGXKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGLNNLRQV

SEQ ID NO: 157482 - protein, 84 aa, Triticum aestivum
  Clone ID: PAT_TA_51900.pep
YIVQVSASHIKKLQHYLVMTNKKLSPKTHASQEDWHGSSRGRKIDRTNLHKMLEHRPPRPLRIRHHPISCGAPPFEENRSDTIL

SEQ ID NO: 157483 - protein, 50 aa, Triticum aestivum
  unsure (1)..(50): unsure at all Xaa locations
  Clone ID: PAT_TA_51901.pep
LIITLFWDSLVNNNCIRHISTRTXLLNEAYFLTLFVICMHDGCGVVLRKE

SEQ ID NO: 157484 - protein, 168 aa, Triticum aestivum
  unsure (1)..(168): unsure at all Xaa locations
  Clone ID: PAT_TA_51902.pep
MAQTMACMTGLSQGVRXPSARTGEDDAQPWFTRVGVVGLGGRAGGTVRPPSRYLGSHGPAGVIRSAFAQVVHAGTVTVIKVGPPPTLSGGLPGTFNYNEAQGTFXLPLNNRFYLQTLPPVEASATSNVVAQDILNLKPVMNXMQWPYLMNDLRLRACYLHYDLKTVIS

SEQ ID NO: 157485 - protein, 64 aa, Triticum aestivum
  Clone ID: PAT_TA_51903.pep
FGNQMFSSSKRFPLPKIFVPPRKLMGFVGSPLVQLFPPQLGKGNAFGTFFPSLATGATLGQFFF

SEQ ID NO: 157486 - protein, 94 aa, Triticum aestivum
  Clone ID: PAT_TA_51904.pep
WLVDNTDIKLVGTEGVFARTMCNGELPRFGIDYISVAAFDHLISAHVAFFKNADIILVEALKLDNVKTGLYMLHCLPLRLVGSEGSPIRCILIK

SEQ ID NO: 157487 - protein, 108 aa, Triticum aestivum
  Clone ID: PAT_TA_51905.pep
FFFFFFFFFFFFFFFFFFFFFFFFLGKGNICKGLITNQVSKRGNLVFNEEENHFKNYPSSRGPILPSKNKTGMFFLPLDNLHVRDIRTLKLFPGKIHTAHDAALRPCS

SEQ ID NO: 157488 - protein, 85 aa, Triticum aestivum
  unsure (1)..(85): unsure at all Xaa locations
  Clone ID: PAT_TA_51906.pep
PLQPLKFDGNDNRPLGETLENMPALHRMFPLPPEKAVLXQKIKAQVKKTPSLGRETLVRLYIYLKLLPECRSLLIPIFFWSPPCC

SEQ ID NO: 157489 - protein, 84 aa, Triticum aestivum
  Clone ID: PAT_TA_51907.pep
MEGSSSRTPEITIVPAPRPAAGGGGGGGAVEAVKAASKEPISPGSPSPASRERPGAVSLPGWKLDSLCKESSSPPAMMARFPYF

SEQ ID NO: 157490 - protein, 161 aa, Triticum aestivum
  Clone ID: PAT_TA_51908.pep
YEDEHDLCHKPWSRDRQPHIASGVPNPYGESFSRWRTFQGFETQCPISKICSALCFVQGYISYSGSYIIPIADLVSVKNLGCLIKANSTARPQTDVRFAWILSVWVGQWGHVWTVSGMQWPCVQRADASRSHPVRVHFSLQALNFFHRSFLIHGNTSPNFD

SEQ ID NO: 157491 - protein, 72 aa, Triticum aestivum
  Clone ID: PAT_TA_51909.pep
KVPYYILLKEPRPHTHDTNSITFRRIVIDEYGNRGSTQSTLLNGSLMTPLPICLATLDGEKNRLPADSHIVD

SEQ ID NO: 157492 - protein, 120 aa, Triticum aestivum
  unsure (1)..(120): unsure at all Xaa locations
  Clone ID: PAT_TA_51910.pep
NRPFFGQGGTLGAMGLVSILRVCLPMXGVASFNGGGPSPGAALTFPGRKKGAAKFQPPEGWSQFPGGFFFGGVSGAIWAYFLLXGVALPYFFQVDFFFLACMSDGGPPPDDVVDLFLGVG

SEQ ID NO: 157493 - protein, 94 aa, Triticum aestivum
  Clone ID: PAT_TA_51911.pep
GSIISCSIDLNNRPQHYYFSSPIAASKHALRLLFDGHTQGATRYRHTRWSCWSQEDTIVAEDGRGVPVARLTSHQAARRATPSAPSPSRSPSAR

SEQ ID NO: 157494 - protein, 60 aa, Triticum aestivum
  Clone ID: PAT_TA_51912.pep
KGGGGGQKQKKRPEKKARGTETELKRVKTFLKICHGGIWGAPKFFTNRLAEIHEMIILHY

SEQ ID NO: 157495 - protein, 81 aa, Triticum aestivum
  Clone ID: PAT_TA_51913.pep
PGNRLRSKDKIPHQFYRVFPNGEGQDPPPQGGVYPEKVNPGRQGVGQNFPSIGKNVSPLEVKFPGKNSFDILFCTLYMRTC

SEQ ID NO: 157496 - protein, 173 aa, Triticum aestivum
  unsure (1)..(173): unsure at all Xaa locations
  Clone ID: PAT_TA_51914.pep
MATPAALGRHAVRARAAATTLAPAPLPAGNGGLSVAKAMSRARDNGMTAFIPYITAGDPDLATTAEALRLLDACGADVIEVGMPFSNPYADGAVIQASAXRALAAGATSDTVMAMLKEVTPELSCPVVIFSYFNPIERRGTGSFTAAAREAGVRGLIVPDLPYTEASVLSIEA

SEQ ID NO: 157497 - protein, 181 aa, Triticum aestivum
  unsure (1)..(181): unsure at all Xaa locations
  Clone ID: PAT_TA_51915.pep
MSPQTXTKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTYSKTFQGPPHGIQVERDKLNKYGRPLLGCTIKPKLGLS

SEQ ID NO: 157498 - protein, 51 aa, Triticum aestivum
  unsure (1)..(51): unsure at all Xaa locations
  Clone ID: PAT_TA_51916.pep
XPVXIHHQLLRPAHLPKTPPVPVTPHQAPPTLPRQQTAQTSSASSRSMARL

SEQ ID NO: 157499 - protein, 50 aa, Triticum aestivum
  unsure (1)..(50): unsure at all Xaa locations
  Clone ID: PAT_TA_51917.pep
AXGXSXRGVLGSWDPXNLLCLNLPFRRPXQISTYAQLFWTADGXGGRGVL

SEQ ID NO: 157500 - protein, 174 aa, Triticum aestivum
  unsure (1)..(174): unsure at all Xaa locations
  Clone ID: PAT_TA_51918.pep
PSWYPLDTSVSPLQGLKPTDGLLVRKLSXGASLRRLRQRCEGLGRVHVRSRQGMTTIXTLSYLPPVXTEALLKQGDYMIRSNGLTXLRYTNAGVIVGDDKSIIEHYYGRXATQYKLSMSSXAPYAAHLIKNEEDDKQDYPDSYVRIIGLNSKRQVQSNSFMVFXPPGCEEAGKA

SEQ ID NO: 157501 - protein, 62 aa, Triticum aestivum
  unsure (1)..(62): unsure at all Xaa locations
  Clone ID: PAT_TA_51919.pep
AASTIIPILGQFKIDTYIQQPAYTGEKKNXRIPLTSLKSTGDRRTLARSQGNKAGDDESYTD

SEQ ID NO: 157502 - protein, 133 aa, Triticum aestivum
  Clone ID: PAT_TA_51920.pep
TRNPHEHTLTLAMSSVRVSGAEWQQWRRRQPRVGVALAHNGHGWRCQQVQGARRLRPKRKRAYSTLLCRRHLQGRAGSIMETNPMLNKVDRPVPFTGGTFFRKDGSTTSGKYPGAYCKVWKLFNLGCLFAKRA

SEQ ID NO: 157503 - protein, 44 aa, Triticum aestivum
  Clone ID: PAT_TA_51921.pep
RVGGRVGGRVGAYVRIIGFDNMRQVQCVSFIAFKPPGCEESGKA

SEQ ID NO: 157504 - protein, 34 aa, Triticum aestivum
  Clone ID: PAT_TA_51922.pep
LQRGAEKPALRCPAGYKLEFATGNDRSNDLCIVL

SEQ ID NO: 157505 - protein, 194 aa, Triticum aestivum
  Clone ID: PAT_TA_51923.pep
MAASLQPGSFPFCAVVAPVSSESITVLQRVEGPVTPSELVEMLQRTIDEQRVAFRASLADEQAAAFRASRAEEEERRRSALRLRQEQDAAYLESLRKDQEKERLAKSFQEGAVKPKAKAKPSTKYPGQAGGETTRTTQIRAPTHKETAPSHRTEANTKIMIRFPNGERMQQSFRHTDTIREIYKYVNSLGMPGI

SEQ ID NO: 157506 - protein, 38 aa, Triticum aestivum
  unsure (1)..(38): unsure at all Xaa locations
  Clone ID: PAT_TA_51924.pep
FQTPRASNFWGPKVYNLYNVFVNGRGDXAEHFKTIKAC

SEQ ID NO: 157507 - protein, 120 aa, Triticum aestivum
  Clone ID: PAT_TA_51925.pep
LTTPTTKAERMNEITSASEGFVYLVSINGLTGARPSVNPHVKDLLREIKQVTDKAVAVGFGISTPDHVRQVAQWGADGVIIGSAMVKQLGEANSPREGLKRLEVYARSLKDALHAVICTI

SEQ ID NO: 157508 - protein, 24 aa, Triticum aestivum
  Clone ID: PAT_TA_51926.pep
DMLGLAFCSWLLWTLLIGIKRIIY

SEQ ID NO: 157509 - protein, 120 aa, Triticum aestivum
  Clone ID: PAT_TA_51927.pep
SGSLSPAGHGKFMQYAGGQLVNVIGRRTLPLTVGSAPAEYWPVVGAASVDTDAGAGMDSFPSSPSSLGLMSGSLGGSFGNNIYDDDLFDLIPDQGRVPMHMHACNTRPTLHAWGSSNIFL

SEQ ID NO: 157510 - protein, 111 aa, Triticum aestivum
  Clone ID: PAT_TA_51928.pep
SRCYRGKRVAPPPFFFELILRGPRGCFDGWGWNKPVFPGPPCRPPKLLGAMVMVVLCGGKNKGREDFVDFYRGLGTPSLYGSANGCCFLLGIRMTPSGPLPQFRSFFYFLT

SEQ ID NO: 157511 - protein, 63 aa, Triticum aestivum
  Clone ID: PAT_TA_51929.pep
HCFGFSLSRGFFYLFLGICVCPCLCPTLAGAFMFVCECYRWLCLWPGVLILPPLLTLPVFMVT

SEQ ID NO: 157512 - protein, 115 aa, Triticum aestivum
  Clone ID: PAT_TA_51930.pep
PQVHLLLLPPPCCRCRCRRRRPLQHHQDSPIPPRQLPPPHRPPPPAGSTRRHRRRPPPRAITTTTTAAENRRSHTVNLPGSGWWHPARSSLRAPQLFRSVLRRPGRVVVDRLDSS

SEQ ID NO: 157513 - protein, 58 aa, Triticum aestivum
  Clone ID: PAT_TA_51931.pep
RRLQEEVLHHVQQVDNECHQGYGRVQPWRPLRQERLVNYKHVARPWVRACMSKLNLLV

SEQ ID NO: 157514 - protein, 75 aa, Triticum aestivum
  Clone ID: PAT_TA_51932.pep
ITLLYVRSWHALIAWRVCFFKIGFRVPAHINMRLFLGGYVLLKNEYAWGFVCFALWALVKISCMLAPAPKCIWPL

SEQ ID NO: 157515 - protein, 117 aa, Triticum aestivum
  Clone ID: PAT_TA_51933.pep
GIPMPSSIGEDGEELAPKQKIRIKLRSYWVPLIEDSCKQIIEAAKTTNAKTMGPVPLPTKKRIYCVLNSPHVHKDSRFHFEIRTHQRLIDIMYPTAQTIDSLMQLQLPAGVDVEVKL

SEQ ID NO: 157516 - protein, 93 aa, Triticum aestivum
  Clone ID: PAT_TA_51934.pep
HPTKKWDACPNFWGSKKRGTNQPKTRGLGGNQVSFGPKSLKFGTRAGGRKPMLVESQNPWGGNPWMGKTPMGDKTPCYKWGLVKLVYETWGKN

SEQ ID NO: 157517 - protein, 193 aa, Triticum aestivum
  Clone ID: PAT_TA_51935.pep
RPRGRGHGGALIGPPAAIFQSGFPRAGPRVILPWVRFVLLVVRSRLGDQRARPDFSLSGSILSERIISRRPGAASKGRGRRSHDAGGQILPRLALPAQLLRPGLRLGVPPQRHQALRAGGLRRGGHGGGRRRRQQREAQQVAFPAAAHAGHHREPRLQPPCLLRQRRRGTARLWGQSHWRDWPGPLHQLPAPG

SEQ ID NO: 157518 - protein, 127 aa, Triticum aestivum
  unsure (1)..(127): unsure at all Xaa locations
  Clone ID: PAT_TA_51936.pep
DRXXGRSRGFGFVTFGSEESMRQAIEEMNGKELDGRNITVNEAQSRRSGGGGGGGGYGGQRGSGGGYGGGGGGYGGQGGGGYGQGGGGGYGQGGGGYGGQRGGGGYGGGGGGYGGQRGGDSSXQWRN

SEQ ID NO: 157519 - protein, 131 aa, Triticum aestivum
  unsure (1)..(131): unsure at all Xaa locations
  Clone ID: PAT_TA_51937.pep
HSPALQDEDSPLIQFAQNRSPPMMNSITLLGQLPKLLMRGIQATIHDLYTSFGSVFTVNLFGHKITFLIGPEVSAHFFQALESEISQXEQSRFSVDALRPSKLRNHVDPMLQEVEGYFAKWGQEGIIDLKH

SEQ ID NO: 157520 - protein, 66 aa, Triticum aestivum
  unsure (1)..(66): unsure at all Xaa locations
  Clone ID: PAT_TA_51938.pep
GAGVLLQCVGRVNHSDCSGFLAPLHSYMXKMPSMTRRMTLWSETPSYDTCIDISMLSHRNRVRNLS

SEQ ID NO: 157521 - protein, 115 aa, Triticum aestivum
  Clone ID: PAT_TA_51939.pep
PTRPHDLVQHPAGRELGAVPVRLLASDLAGTRSATRSTLMSSALLVTSTLHTAILNKKLLHVLVRPPAETPALVEALDIVAHTVECYLNPHANNRTAMTNVVTNLKRMLTIINTY

SEQ ID NO: 157522 - protein, 172 aa, Triticum aestivum
  unsure (1)..(172): unsure at all Xaa locations
  Clone ID: PAT_TA_51940.pep
STAYPVAALSCAFQVPTPLIKGXKKKFNQNPPDWIPCRLLIVASSTARTGNHCSQRVICSGLRCLEFLFWYSSGEGRYLELLFRQVPWMDDADTPTGWFPPLDRDAALQDAISFAEDANGISRSMNDEQAACGCVGSSSGWLTRRHGKGKQKGLEEMSAMCRAVDSFIQLPW

SEQ ID NO: 157523 - protein, 61 aa, Triticum aestivum
  Clone ID: PAT_TA_51941.pep
VPIRPTSPRPGPDGEVTVALAGSHASGGHDRGIPMHHGQRPVIHTQGAFTECRNTAGSTCG

SEQ ID NO: 157524 - protein, 88 aa, Triticum aestivum
  Clone ID: PAT_TA_51942.pep
LDACFLTFHQLSNCPQGDNLWAPDSTPNIPLPVFGLASYKFSNSVWSSTDGDWKLASCLRQAAADWLRDSRAGHPDYQFFVSHGAYNR

SEQ ID NO: 157525 - protein, 95 aa, Triticum aestivum
  Clone ID: PAT_TA_51943.pep
YTSFSGGRHACPGEAYAYMQIKVIWSHLIRNFELKLISHFPKTEWSKFGLEPKGKITISYKRRQLVAWYLLPQFLNVSLFRDFTINYIRMYIDIF

SEQ ID NO: 157526 - protein, 77 aa, Triticum aestivum
  Clone ID: PAT_TA_51944.pep
VTIKTYIVDILYNIMRPFIYIATDSILIRACFLEPCWYMNMDIHIFLGTNKKDKWRRKTQSNVRVDKTAMALYPRVR

SEQ ID NO: 157527 - protein, 88 aa, Triticum aestivum
  Clone ID: PAT_TA_51945.pep
KGRQRQHLYHKLAKFAKAGMHSVARRKIPWLARKLFQLYTKFFRATTYKTLQIKRLSGFWKPEQTDTWLSAPSLIHPIHYEINIAPNR

SEQ ID NO: 157528 - protein, 133 aa, Triticum aestivum
  Clone ID: PAT_TA_51946.pep
KGSKRGPLRGRSASWVLTTCPRSRGSVFSPSTPRVLRSPARPKQFPPPGPHIKGPWGFFNPAMAWGFPSPFIFFVCSQKNGFAHVHGPPFFKKACSFLNPTGGFVYAPAQKIFFPSFAFVLGDLKMRNLFGPP

SEQ ID NO: 157529 - protein, 78 aa, Triticum aestivum
  Clone ID: PAT_TA_51947.pep
EVGDPGGLGFYPLGYGPGSPEKLKELGPKGIKKGRLPMFAVRGGWFQAGYTGPGPIDNLLGPLADPGQAPFFGAFAPK

SEQ ID NO: 157530 - protein, 71 aa, Triticum aestivum
  unsure (1)..(71): unsure at all Xaa locations
  Clone ID: PAT_TA_51948.pep
AYWPALFAKVLEKRRVDDLILSVGFGGGGAPTAAASAPAAGGASPPXKKKKKKKEGAKEKNHYYLGFSLFD

SEQ ID NO: 157531 - protein, 43 aa, Triticum aestivum
  unsure (1)..(43): unsure at all Xaa locations
  Clone ID: PAT_TA_51949.pep
TNGKILYSMVHDDDGSYNEMIVIPDCLXRTGHSQQIXRRHXII

SEQ ID NO: 157532 - protein, 58 aa, Triticum aestivum
  Clone ID: PAT_TA_51950.pep
YPEIRHFPKVPQPVYRCKIYFSNYFLLLLASVCFSVRHACLFFQFKSLCILLGYLVLV

SEQ ID NO: 157533 - protein, 82 aa, Triticum aestivum
  unsure (1)..(82): unsure at all Xaa locations
  Clone ID: PAT_TA_51951.pep
TWRICASGWAFAGGFARLAGTTRRALIQRLINHMRSRTHEMRTALXTFIFDIFNNNHTTGSTSEMIFRLLNPDYNMDYYIHI

SEQ ID NO: 157534 - protein, 47 aa, Triticum aestivum
  Clone ID: PAT_TA_51952.pep
CRPLGLTMISCIIKLSSYACPSALQTIIVPSYIFCKDSEKMLVSINN

SEQ ID NO: 157535 - protein, 101 aa, Triticum aestivum
  Clone ID: PAT_TA_51953.pep
EETAYLFITTPGQLTCLINDSAGVVATNTAAVQLANARDKPCVALFSSKAKARLFLPYAEERKSCTVVASATGKLAGIDIEAVKKAVKDLEPAPSFALAQT

SEQ ID NO: 157536 - protein, 67 aa, Triticum aestivum
  Clone ID: PAT_TA_51954.pep
QGNVEEGSSRSDGGGAADAHGWSYYSKGGGGGGSGGAGRRRSYLPYKQELVGLFANVSGLRRSYPPF

SEQ ID NO: 157537 - protein, 131 aa, Triticum aestivum
  Clone ID: PAT_TA_51955.pep
IRCMQVWPIEGNKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 157538 - protein, 72 aa, Triticum aestivum
  unsure (1)..(72): unsure at all Xaa locations
  Clone ID: PAT_TA_51956.pep
YKGTAYAQVVIGPEVVYKNXKQFKWFPXELGGKFLRQPGPLPGLNPKIPFFLDPNGWKVVLVDQGAFPKEFH

SEQ ID NO: 157539 - protein, 66 aa, Triticum aestivum
  Clone ID: PAT_TA_51957.pep
GGLAFAPTTYFLPCIMWLIICKPRRFSLSWFTNWICIVLGVILMIIAPIGGLRQIIISAKTYKFYS

SEQ ID NO: 157540 - protein, 49 aa, Triticum aestivum
  unsure (1)..(49): unsure at all Xaa locations
  Clone ID: PAT_TA_51958.pep
SPIYTPKEWFXFGAPYPGGTTGFFIWAVPLAGLLGGGVLLVYNPSALPG

SEQ ID NO: 157541 - protein, 73 aa, Triticum aestivum
  Clone ID: PAT_TA_51959.pep
PFFTMMMRPSTITSEAISLKVQLHYALLCPLCTSKSDIARLHSSMFFHRPCTLILLMEAPEQMHMRSSKIHMC

SEQ ID NO: 157542 - protein, 111 aa, Triticum aestivum
  Clone ID: PAT_TA_51960.pep
GITIFSLPEKKNSTNSYKGTIVLWPMHVYQVALSAYVCLPVSLAERMCDLGVFCFKLSVLFLDWDYCKQAICTAQLSAHDSHSQYCICICAVILYLYRSQKKKKKRAALAY

SEQ ID NO: 157543 - protein, 63 aa, Triticum aestivum
  unsure (1)..(63): unsure at all Xaa locations
  Clone ID: PAT_TA_51961.pep
VRLGLGGAQKILPLGPLNTFXRDGLEKAKNELSESIENCVSFIHKCRSCEWAVPALYRYAKPK

SEQ ID NO: 157544 - protein, 109 aa, Triticum aestivum
  Clone ID: PAT_TA_51962.pep
QGMSASDEVMAQYVHAEVESSQSVVDLASPKKRPRIEADAVLPAASDDSANQLLDPFMFDDQFGFLDSSSYEWLDSLFGADAEKIDDSQLGLWSFGDDDCLARTARACK

SEQ ID NO: 157545 - protein, 86 aa, Triticum aestivum
  Clone ID: PAT_TA_51963.pep
GFFLPVFFLKGGGFFLNTKIFFSPNFRSPIFFFPPFLRMGILAFLGPGLNFFQLKAGKKFLPKVFKPCFLNFSKILSMMGVFFVFF

SEQ ID NO: 157546 - protein, 85 aa, Triticum aestivum
  Clone ID: PAT_TA_51964.pep
FSKVGFIFREHNASLGYYDGRYWTMWKLPMFGCTDATQVINEVEEVKKEYPDAYVRIIGFDNMRQVQCVSFIAFKPPGCEESGKA

SEQ ID NO: 157547 - protein, 101 aa, Triticum aestivum; identical to SEQ ID NO: 157434
  Clone ID: PAT_TA_51965.pep

SEQ ID NO: 157548 - protein, 84 aa, Triticum aestivum
  Clone ID: PAT_TA_51966.pep
SRSRTSPRDRRVPHLRQLSVRANLFWTADSEGGRGVLGSWEPEKTYYVSTYRYLHDRDVCSKNAPNIFPGTYVVDIQLILQTFI

SEQ ID NO: 157549 - protein, 77 aa, Triticum aestivum
  Clone ID: PAT_TA_51967.pep
FAEAALCCTSPRLTFLLSHTHVEITKYITSFVVHIPLENTVTSVNGIHIFQKNVSIFSVTIQTPTPKSEETKLRIWN

SEQ ID NO: 157550 - protein, 81 aa, Triticum aestivum
  Clone ID: PAT_TA_51968.pep
GLTPPAPPMVPPVPRAVAPAISRWAKAGWRRTSTPAPGSSPRARKILWSGPMIKFTGLGAPSDGGIWGHQKNVCVMLGPVV

SEQ ID NO: 157551 - protein, 83 aa, Triticum aestivum
  Clone ID: PAT_TA_51969.pep
PISSWWPPRTLILFPGRFGLAPSANRKGTAGLKLEGGESGLQKGDPAGFTFAETVAWGSFGHILGGGIGVGLKNTGGLDQIMG

SEQ ID NO: 157552 - protein, 58 aa, Triticum aestivum
  Clone ID: PAT_TA_51970.pep
STVFHGLTSQDRVAQQLALVFELALWFWITTVQQAVPTGLCAKARTFGDNFKCNAYNS

SEQ ID NO: 157553 - protein, 98 aa, Triticum aestivum
  Clone ID: PAT_TA_51971.pep
LRLGPAGRMKTWASQRDTADAPGLPLGLSNASMYEATRNWRCDDDGPPPWSSRSPLGRRPAAAAARWACWSYRRAAPSPSPAPRPPRLRGHVRCAASC

SEQ ID NO: 157554 - protein, 93 aa, Triticum aestivum
  Clone ID: PAT_TA_51972.pep
PRVRGPPQLVGGGRGPIFNKGDRLPMLVFFPRSPLSEYIFWAPRLPTSFFFKRKPQPKSPFLPAVRRPLWLSGGAGLFFWASFLGTPQTCSFF

SEQ ID NO: 157555 - protein, 63 aa, Triticum aestivum
  Clone ID: PAT_TA_51973.pep
SEHHQLNHDTIFHMPNSILQPKDCNILNIKASPKTSISLFESLKLKLPNIQKLVDILCSCAIC

SEQ ID NO: 157556 - protein, 134 aa, Triticum aestivum
  unsure (1)..(134): unsure at all Xaa locations
  Clone ID: PAT_TA_51974.pep
VRAVAPHALRVAXASVAXILAHTKQVVVVRLLAQKTYKVNLMTLXAEVDMEFPEHVYIFYKDKXEGMALPFSYAFGSCSSCIGKLVSDKILQFDQSFLDPHQMKTGWVLTYHAFPKCEHGYLVPQGVGVSRISC

SEQ ID NO: 157557 - protein, 153 aa, Triticum aestivum
  unsure (1)..(153): unsure at all Xaa locations
  Clone ID: PAT_TA_51975.pep
WLQGRWEGFSDASXADLIAEHEIWAAVHPLAKNEAFNCSNGDVFKWKQLWPMLADRFGVEWAGYEGEDNRFVLADAMAGKEPVWAEILRENELITTELQEIANWWFVDAMFNVEIEHLDSMNKSKEHGFLGFRNTANSFNAWIDKMKVLKIVP

SEQ ID NO: 157558 - protein, 119 aa, Triticum aestivum
  Clone ID: PAT_TA_51976.pep
PTMYMDFTMQPGSQLHQPILKGWNAFMYIIEGEGVFGKEGAAPASAHHCLVLGAGDGLSVWNLSGAPLRFVLAAGQLLNEPVVQQGLFVMNSRAQIQQAMQDYYYGRNGFEKASQWSSA

SEQ ID NO: 157559 - protein, 124 aa, Triticum aestivum
  unsure (1)..(124): unsure at all Xaa locations
  Clone ID: PAT_TA_51977.pep
QARAPVEDQEVIVEDEPKFKPFTGSGNRLDGKXPKQPAPGASSATAAARSAPSDSNKRANQQTASPSGASTSTRQKTGKLVFGSSASSKKEAEAQKEPAKGSEPPKKEEPKFNAFTGKSYSLKR

SEQ ID NO: 157560 - protein, 130 aa, Triticum aestivum
  Clone ID: PAT_TA_51978.pep
MKPRDLLERIRRPFASRRGTSASARREEEDLEAIAAREQRAFRYEALAAATRNFSEKQKLGQGGFGPVYRGQLADGRDVAVQHRNVVNLLGYCAHGADEKLLVYEYVPNESLDKILLLRPPAPPAGPTHR

SEQ ID NO: 157561 - protein, 164 aa, Triticum aestivum
  unsure (1)..(164): unsure at all Xaa locations
  Clone ID: PAT_TA_51979.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILXGIWGGQGSRENP

SEQ ID NO: 157562 - protein, 101 aa, Triticum aestivum
  Clone ID: PAT_TA_51980.pep
MDRSWIRGTLFSREYINGVKEFMNLIQAKFSEDEEILCPCRECLNRKYWHQAVVNKHILTHGMESTYTRWIYHGEDFNADVIEHPVDVHDSEDGNNGADRF

SEQ ID NO: 157563 - protein, 190 aa, Triticum aestivum
  Clone ID: PAT_TA_51981.pep
ALIGKGGTLIKSLAEASNAGITVSHHRVCYGFNDRLVNITGHLEDQLQAIFLILSELLDDVHYLSSYQRVGFPRYHVSSVERDGDGQDEYVQRYHSRPDTPVGSPDIDDGRHVEGTLTIAVANEYVGAVVGRGGRVIKEIEQATGVWITVFKGKLLPGMREREVRDQRDAGGRWDAAGGRWIRGSTFCGT

SEQ ID NO: 157564 - protein, 101 aa, Triticum aestivum
  Clone ID: PAT_TA_51982.pep
VDIVDTFRLQEQLAFDKKQFISHMKRYIKNFTAKLEGDDLDVFKKNVESATKYLLSKLKDFQFFVGESMHDDGGVVFAYYKEGAADPTFLYFAHGLKEVKC

SEQ ID NO: 157565 - protein, 141 aa, Triticum aestivum
  Clone ID: PAT_TA_51983.pep
SVRRWRHTRWKSWQSRTRRKERFPIRQPEDLRYSGSRLSARCWPATAHGMRLKVVAFDLVPMGLVIRLGNQGDWRNGGEPTPSSGSEDSKGRRAVSRSREIGYTRRMREKEEGGGGAGVLIKITCRWAFGLSDKDAVCLQR

SEQ ID NO: 157566 - protein, 90 aa, Triticum aestivum
  Clone ID: PAT_TA_51984.pep
PGPVFKNKRGFPVGRNRFFLAQMGVFYFFFNPELPKGGRGGFLGPFFFLWGGGILILGGGGWELSFFPPPINWGEFFPWFFWSLGPKVRK

SEQ ID NO: 157567 - protein, 127 aa, Triticum aestivum
  unsure (1)..(127): unsure at all Xaa locations
  Clone ID: PAT_TA_51985.pep
NARLKETVARLRVALPEAAFTYVDVYTAXYRLMSEAKKIGFGDPLRVCCGYGGGEYNFDKDIGCGVKVEVNGTVMEGKSCEDPSRSVSWDGVHLTEAAYKFIFDQIVEGALSDPPVPLRRACQTKGQ

SEQ ID NO: 157568 - protein, 158 aa, Triticum aestivum
  Clone ID: PAT_TA_51986.pep
MAASAIRNPSPAAAVAAPLPSRAVLRMVSPSVRRGASVVASASMRPAKAVTAEAPSPVAERVNGAEVAGAGIARPDALGRFGKFGGKYVPETLMHALTELEAAFHALADDEDFQKELDGILKDYVGRESPLYFAERLTEHYKRADGTGPLIYLKRAGS

SEQ ID NO: 157569 - protein, 117 aa, Triticum aestivum
  unsure (1)..(117): unsure at all Xaa locations
  Clone ID: PAT_TA_51987.pep
IDSIGRGTATEIPAKKAKTDKLAAEFSKYVPGSMTDKYMTKLRKELXXXDEHLSKGDLGEWEQLLRSRFHVGLRSVADGKEDKXDSLEXPEWEWLTGGSSYAVVDRRWVLYAIGRTF

SEQ ID NO: 157570 - protein, 124 aa, Triticum aestivum
  Clone ID: PAT_TA_51988.pep
MEGLPAQVEVPSYFLCPISMEIMRDPVTLSSGITYDRESIERWVFTDGHGECPMTKQKLGAADREPTPNHTLRRLIQGWCAVHAVERFPTPRAPIDAARVETIVDAARRGQDLLVASLRELADI

SEQ ID NO: 157571 - protein, 128 aa, Triticum aestivum
  Clone ID: PAT_TA_51989.pep
MAVEAMAEKNTGAGAAGGVAPESGDRRSRFRRICVYCGSAKGRKASYQDAAVELGKELVERGIDLVYGGGSIGLMGLVSHAVHDGGRHVIGVIPKSLMPREVTGEPVGEVRAASGMHEEEGPTWFRSC

SEQ ID NO: 157572 - protein, 94 aa, Triticum aestivum
  Clone ID: PAT_TA_51990.pep
MAAPPARARADYDYLIKLLLIGDSGVGKSCLLLRFSDGSFTTSFITTIGIDFKIRTIELDGKRIKLQIWDTAGQERFRTITTAYYRGAMGILLG

SEQ ID NO: 157573 - protein, 97 aa, Triticum aestivum
  Clone ID: PAT_TA_51991.pep
NLSGIQDHSTRIRPALSDKSVINAMEFAAKQLGLEYKLMISRAYHDSLFMARISPMGMIFIPCYKGYSHKPEEFASPEDMANGVQMLALTMAKLSLE

SEQ ID NO: 157574 - protein, 80 aa, Triticum aestivum
  Clone ID: PAT_TA_51992.pep
GGNLQAGFLNMGLNLAPVLLKWFLVKHNLFFRGRMELGFPLEKGPPQGVLLPVGPKKVLSQFFRAPWWKEKKMAGGFLLP

SEQ ID NO: 157575 - protein, 137 aa, Triticum aestivum
  Clone ID: PAT_TA_51993.pep
FFFFFFFFFFFFFFFFFFFFFFFFFFFFFFFFFAKQRPPSQKRGKPHEKKIWAPPAKRKGEKSRGGNPTPPSPPPGPGLETGTNGGIGPRLAAQYPRGPTPETGAPPPEKKTPRHHKPQTIYFASKKNPASPTNFGG

SEQ ID NO: 157576 - protein, 64 aa, Triticum aestivum
  Clone ID: PAT_TA_51994.pep
MYSFILKLKSERLVEDVVESVAEGGSVRLSLLLELQRRYTKINGKVAIAETRLSLMQEDMYILT

SEQ ID NO: 157577 - protein, 170 aa, Triticum aestivum
  unsure (1)..(170): unsure at all Xaa locations
  Clone ID: PAT_TA_51995.pep
MAPTVMASSATSVAPFQGLKSTAGLPVSRRSNGASLGSVSNGGRIRCMQVNNIVSVFLLIFXLTEVNNNQMYQKCQSDVQVWPIEGIKKFETLSYLPPLSTEALLKQVDYLIRSKWVPCLEFSKVGFIFREHNASPGYYDGRYWTMWKLPMFGCTDATQGDQTRWREGQE

SEQ ID NO: 157578 - protein, 157 aa, Triticum aestivum
  Clone ID: PAT_TA_51996.pep
QFLCQFYAHHRKPPLLGIFENCSKEGMVFTPIPPLVADYISPERFSLGRPRLTYVLDCRHGRVLIEDLEQKYLIVCDPITSEKCRVALPCKFKWSFVGAVLCTAGYKGPSSPFKVVLVSWDGVDNQLLAYVYSSMTDTWGNLISVEAPDNTYFHGLA

SEQ ID NO: 157579 - protein, 83 aa, Triticum aestivum
  Clone ID: PAT_TA_51997.pep
ANALVEKAKRFIKVDVADIVSVSTCSDLTLPPGAGLCINTTYGPVFLVAETWESLDGWLDAICLVYPIFARGKTDVLAGIITG

SEQ ID NO: 157580 - protein, 123 aa, Triticum aestivum
  Clone ID: PAT_TA_51998.pep
QQIFVSLSLITVEKHTTRKLLLVLFPWLQMLADFLDVTKDEKLIMHMWNSFIRKQRVLADGHIPWACEGFSRLHGPQLVQNLPLLWCWRLVMIKLWNHSLLDARAMNTCNTILEGYQPEKKMF

SEQ ID NO: 157581 - protein, 45 aa, Triticum aestivum
  Clone ID: PAT_TA_51999.pep
PPPKNIVHLFFQSIKKTMSLGTLIRPLTTSHSGSKTSRTRGRTPP

SEQ ID NO: 157582 - protein, 93 aa, Triticum aestivum
  Clone ID: PAT_TA_52000.pep
PGSGLQLLYVHFPKSQTVDASKSSLISDCPSGGWCEDRKLFLCSDAEALARQSDGRSFLQQRGNQSTGQRLELAASLFCTVKVLTFVFDHVST

SEQ ID NO: 157583 - protein, 111 aa, Triticum aestivum
  unsure (1)..(111): unsure at all Xaa locations
  Clone ID: PAT_TA_52001.pep
SATSVATFQGXKSTAGLPVSRRSNGASLGSVSNGGRIRSMQAWPIEGIKKFETLSYLPPLSTEALLKQDHYLIRSKRGPRLEISKAGHIFREHNASPGYYEGRDWTTGKLP

SEQ ID NO: 157584 - protein, 121 aa, Triticum aestivum
  unsure (1)..(121): unsure at all Xaa locations
  Clone ID: PAT_TA_52002.pep
GGTREEGKGREEETTEPSARTRQAPSAGAEMGLTFTKLXSRLFXKKEMRIXMXXXDAVXKTTXXYKXKXXKXXTTIPTXXXXXXKLXRTKNINFNRLGIVGESRTKIKPPXGRHLLXKNTP

SEQ ID NO: 157585 - protein, 104 aa, Triticum aestivum
  Clone ID: PAT_TA_52003.pep
NGGGGGNKTFPRRACPIPGAETPPIAYKGPPPPHGNKKNPLTPQRENKFPPPFFWDYGKLTGFPYKKKKPFFTEAVSPKASGGGGGTKTPALSPAPLEKRKAPP

SEQ ID NO: 157586 - protein, 200 aa, Triticum aestivum
  unsure (1)..(200): unsure at all Xaa locations
  Clone ID: PAT_TA_52004.pep
CNNLKSFKDGEKPHESIFKSLTPVCTPRHANKVQPLGVASPRGQKKKSGVVRLSFTRTSFDGEQTTEICSRRYLIRPRAGLLIPQASEKISEGCWSILEPSTFKLRGESFFRDKKKSAAPGSSPYTPIGVDMFMSPRKIHHIAQHIELPSIRPSEKVPSVLIVNIQIPTYPTAIFLGDSDXEGINLVLYFKLNENFEKDI

SEQ ID NO: 157587 - protein, 105 aa, Triticum aestivum
  Clone ID: PAT_TA_52005.pep
IFEARNKTKGGSFEGGDKEFFKFKVGSGQVIPAFEEAMTGMRPGGVRRIIVPPDIGYPDNDLNKLGPKPTTFSGQRALDFVLRNQGLIDKTLLFDIELIRIIPSQ

SEQ ID NO: 157588 - protein, 49 aa, Triticum aestivum
  unsure (1)..(49): unsure at all Xaa locations
  Clone ID: PAT_TA_52006.pep
MAAPPSQASLLLQKQLRDLAKNPVDGFSAXLVDDXHVFEWQVTIIGPAR

SEQ ID NO: 157589 - protein, 163 aa, Triticum aestivum
  Clone ID: PAT_TA_52007.pep
MADVEYRCFVGGLAWATDDQSLQNAFSKYGDVIDSKIITDRETGRSRGFGFVTFASDEAMRQAIEAMNGQDLDGRNITVNEAQSRRSGGGGGGGFGGGGGGYGGQRREGGGGGGYGGGGGGYGGGRSGGGGGYGSRDGGGYGGGGGGGYGGSRGGFGGGNWRE

SEQ ID NO: 157590 - protein, 89 aa, Triticum aestivum
  Clone ID: PAT_TA_52008.pep
MITRSKLVEQLRDYQIRSQHKRDIIGAISWGLLCCLLIVSSYMMLYFRHFWLSAVIISVGILLPAGLYILRQRKLAKKRERRLLLPLSM

SEQ ID NO: 157591 - protein, 115 aa, Triticum aestivum
  unsure (1)..(115): unsure at all Xaa locations
  Clone ID: PAT_TA_52009.pep
HVGKSDIFDTXSRIREMLKGNSRCEKIGRVMEKVYCRAHGEEGMSVRVSGSFIMGNEFLVCADGFCAEGMLSIVELSPDILSKQAGHFQEDFFMEPGTAMGCYVISRQELHIGVS

SEQ ID NO: 157592 - protein, 64 aa, Triticum aestivum
  Clone ID: PAT_TA_52010.pep
AKQALTVCPKMNPIIELKTGPNYLPKTAGWIKLRSLREEYQELGCPTYGSVSNDRRNAPAHYAT

SEQ ID NO: 157593 - protein, 124 aa, Triticum aestivum
  unsure (1)..(124): unsure at all Xaa locations
  Clone ID: PAT_TA_52011.pep
KRSSSTVSFSLRCWVSIPXGVSTVASGGXHVWNMPALSQIFGANSVLQFGVVTLGHPWENAPGASANVVALEACVQAXNKGRDLAPKGNKIIAAACQWSPQQILSLVKYVRRANSSSNRKTTIR

SEQ ID NO: 157594 - protein, 79 aa, Triticum aestivum
  Clone ID: PAT_TA_52012.pep
TCSGRLSFLTMSISSGDIFQIYGADICSFLVIAECHYFIVTLRYLNIICHGSRHATFTMSRLLRLNYLIRSKWVPCRRS

SEQ ID NO: 157595 - protein, 135 aa, Triticum aestivum
  unsure (1)..(135): unsure at all Xaa locations
  Clone ID: PAT_TA_52013.pep
MSEYKNVVGGKLKLKGKPLDVKEGGVKKKNKKKHRREESSQGEHGELREGGSSELPGDPDNEFSEADSXGEEGSAQADYDHLTPAERRYIEQKQKIDVHKLAKVADKSHRDRIQDFNQYLANLSEHYDIPKVGPG

SEQ ID NO: 157596 - protein, 89 aa, Triticum aestivum
  unsure (1)..(89): unsure at all Xaa locations
  Clone ID: PAT_TA_52014.pep
PRPPKTAAASDAPXPSTQELKDEILDVSAKIFKAGMSLLVIDTENKFVSTGFAKEIARVXXQGKYYYLPNASDAVISAATKTALADLKS

SEQ ID NO: 157597 - protein, 132 aa, Triticum aestivum
  Clone ID: PAT_TA_52015.pep
AYTRTHVIYMYLIATHHTITRHHAYIGFLYRLCLLEITQIFTSIGHRNLAQATANVVESQRDSRQSRKPRQEPLSVLSASLLFLDLQTQVSDQAQDNKRTVTSFLTLYPHNTLIWIYLLTLSYKGKKECHCY

SEQ ID NO: 157598 - protein, 92 aa, Triticum aestivum
  Clone ID: PAT_TA_52016.pep
EPRPPRRQRNDALPTAPAMLHCSSYPAASQLRGSGEAPMQPPVKLQCSTARCSAVPGSPVKLHCSADDASLQHRRRRGGGPSMLHSSTQRRR

SEQ ID NO: 157599 - protein, 123 aa, Triticum aestivum
  Clone ID: PAT_TA_52017.pep
MATYPLLLLFAAVAVAVAAASSAGDKPTAYEMLERYDFPRGILPEGVEGYELDPDGGFQVYFPRECEFLLAKQWLVKYDTRIAGDRLSFYIGPVSTSFPLSDFASSPHCRGYHDRAAVAAAVS

SEQ ID NO: 157600 - protein, 89 aa, Triticum aestivum
  Clone ID: PAT_TA_52018.pep
MGSILADEFRGCELFSAGNMDPYAVLKCTSQEQKSTVASGKGSDPEWNETFVFTVSENATELVIKLLDSDGGTDDDSVGEATIPLDGSV

SEQ ID NO: 157601 - protein, 122 aa, Triticum aestivum
  Clone ID: PAT_TA_52019.pep
MATASLSSVVVAVDGSEESMKALRWALDSLRLRSDGALVVLHVQPPPGIAAGLNPGPIPFGGPSVAEVPAFTQAIESHQRRITDAILEHALKICSDKNVRGRLNEAFLCRLLNSTLPPAARA

SEQ ID NO: 157602 - protein, 68 aa, Triticum aestivum
  Clone ID: PAT_TA_52020.pep
SGSMNGFRSYTDRISAKGYSESNSQSSIQQGRYCDDSYGLKFSYSCGMVPFYHCWWERRVSRRVECCV

SEQ ID NO: 157603 - protein, 66 aa, Triticum aestivum
  Clone ID: PAT_TA_52021.pep
CNPFCSRHWTFHHGSHSWIGKELINKHHLLSNNLYMIVSTVYCTTAYCAPAYPPSFQQYLHECKDI

SEQ ID NO: 157604 - protein, 107 aa, Triticum aestivum
  Clone ID: PAT_TA_52022.pep
MFNRLFGKPKEQANAGALATLDKLNETLDMLEKKEKVLEKKAGAELERAKEFSKAKNKRAAIQSLKRKKLYEQQIEQLGNFQLRIHDQMIMLEAAKATTETVDALRT

SEQ ID NO: 157605 - protein, 75 aa, Triticum aestivum
  Clone ID: PAT_TA_52023.pep
FTDWITLVGFDVCDGVEYDGNAWFLLLFAESTEFFISMENKMEDLFNLESDIVDLSMSIDTTKTDDHVSNAEIPC

SEQ ID NO: 157606 - protein, 84 aa, Triticum aestivum
  Clone ID: PAT_TA_52024.pep
SGVKCLNNVSIPRRSYARFPGDTNNQAVGVSSFFKDPVELQMGKEWPIPQWSVKKFQFLNPHPRGKNPNFFEVFPPHGVSLGPI

SEQ ID NO: 157607 - protein, 63 aa, Triticum aestivum
  unsure (1)..(63): unsure at all Xaa locations
  Clone ID: PAT_TA_52025.pep
KKNLAHRFXGHVGTKKKNPLSAMLDKDPALMKKRNSLLKKLKLYKSVRNKIDWVAWKLFVLIQ

SEQ ID NO: 157608 - protein, 148 aa, Triticum aestivum
  unsure (1)..(148): unsure at all Xaa locations
  Clone ID: PAT_TA_52026.pep
MASPSVFAGIAQGPEDPILGGTGAYNKGPSPGKGNLGVGAYRTEGGKALVPNXARAPSQSRSQTRQRVKEIWPTPDWADSTRWRAKLILGAASPVFKEIRGVPGQXLXGPGSLKGEGEFLAGTYHERTIYIPKPTWGNNPKVFTLPGL

SEQ ID NO: 157609 - protein, 59 aa, Triticum aestivum
  Clone ID: PAT_TA_52027.pep
NKNWGFLIHDPWKKTRSLERNGPIFTYIHYQKIFPLPRLNRPFGEHFWPLLKQFLGPPF

SEQ ID NO: 157610 - protein, 70 aa, Triticum aestivum
  Clone ID: PAT_TA_52028.pep
GGNTLAPYFGGLHTLCGNWFLLGTIEGGRPPIRIPVPVMDGTGLKGSLPILGGVISVLGGAPPVLGEAIS

SEQ ID NO: 157611 - protein, 61 aa, Triticum aestivum
  Clone ID: PAT_TA_52029.pep
TDVTPSCALSKMYTYLKGTPLGESYGGYIVTNPNKKTERITTISYSQTLLWIHARGRKVPL

SEQ ID NO: 157612 - protein, 96 aa, Triticum aestivum
  Clone ID: PAT_TA_52030.pep
PKKGNDEVFFHLGAYKEAFKKKKNSYRKERVKKSVSTNEFLNPPKGKRFYGARARGARARGTPGGFKGGFGGGGYQGPPPAPAIQAQTRFPPPGGK

SEQ ID NO: 157613 - protein, 118 aa, Triticum aestivum
  Clone ID: PAT_TA_52031.pep
KGNPKGSFPKQNFSPNKQGKGAQQGALGNPNPPKTGPQHTGNKPTFPGGNNIFGGKKTPNWVRNNNLGARDPTKLVCWSGGKKGLNPPFFKKKNWGGPKKGPPETQKNWGGQPGPGGP

SEQ ID NO: 157614 - protein, 76 aa, Triticum aestivum
  Clone ID: PAT_TA_52032.pep
QGGLYTKTNSPPHYDPPGENKKNNPAPKPREHQKPGASKGGTGKSVPLKTGNVYIGGQGYLQSKTRPFSTKPIFIC

SEQ ID NO: 157615 - protein, 161 aa, Triticum aestivum
  Clone ID: PAT_TA_52033.pep
GKTRTPLESISHATFGHFTLETILLTSYDLFYKQQTPKIGGELHLPGEKNKKPKENENLTKKPRDRETTRHSRGKIYPPRPSGQGEHNQELCPTKHLMGKTKHLGWFLHFWSGYFWAALMDPSLGNFRVRVLNLCLENCRDPFLQSVPALIIAENSGKLIF

SEQ ID NO: 157616 - protein, 176 aa, Triticum aestivum
  unsure (1)..(176): unsure at all Xaa locations
  Clone ID: PAT_TA_52034.pep
KAKKRFPGGKTPFKKGGGQKRGRKKGKKRVGPSKIFFFKGVKQGAPEIGFFSKAMSLINSFFKEIFXKLPGGAPKFARFKKKPPLPPRGIQTSVRLVLPGGLSKHPVFEGPKAVPQFPPFLIQFLAPGVGGFFPKISLGPWKLGGDFFVWSWFGDVPGSSWGWSLLKTNHDLGVFL

SEQ ID NO: 157617 - protein, 104 aa, Triticum aestivum
  Clone ID: PAT_TA_52035.pep
GKKFKKGFDPNPFFFFFFSPPSRGRGPIERKGGYFFFSPPPKPRAFLGGERGGKPFRPKTQRRFPPLKGRRFRAKLWGLGRVISRKWGFPKGPKNEPMVVCGPP

SEQ ID NO: 157618 - protein, 105 aa, Triticum aestivum
  unsure (1)..(105): unsure at all Xaa locations
  Clone ID: PAT_TA_52036.pep
PSISKQSSFPARIGNCWGMGMSAAHQKXLFMPLSCPICYEDLDPTDSSFLPCPCGFHLCLFCHKRILEANARCPGCRKLYNAGFAGKGAPAPVRLSRSCSMGPRH

SEQ ID NO: 157619 - protein, 107 aa, Triticum aestivum
  unsure (1)..(107): unsure at all Xaa locations
  Clone ID: PAT_TA_52037.pep
GPPPIGPPKRPRPPSIGGGPPFCSPPGVXPPPLGPKGGESQPFFFPPGPRPLNNPAALXPPSGPPSLGPSGTPCAPNIGPRAGNSPGAPPPGPPPVKNPPPPFGDCP

SEQ ID NO: 157620 - protein, 96 aa, Triticum aestivum
  Clone ID: PAT_TA_52038.pep
PPQGDSPKFKIPCQVKPSLFKKPFFNPSKKGGRLSLFKPLVQKGVGKLREKLGTLFPLKGAGFVPSPKKGLFGKPDFVFPKAKRPRAITPLPLFQL

SEQ ID NO: 157621 - protein, 156 aa, Triticum aestivum
  Clone ID: PAT_TA_52039.pep
TAHFFGFLGAAVGLVFSCMGAGYGTANSTVGVASMGVMRAELVMKFIVPVIMAGVLGIYRLIIGVIISTGINPKAKPYFLFYGYSHLYSGLSCGLAWLAAGMAIGIVSDAGVKANAQETKLFVSMILILIFAETLALYGLMVGIILCLSAGQCRAD

SEQ ID NO: 157622 - protein, 174 aa, Triticum aestivum
  Clone ID: PAT_TA_52040.pep
HPVLLVPLLVLHPPHQALPGRRLPLLLQASAGRFRMAAVRAQAEAVDTSISPRVSALRPSKTMAITDMASALRQAGVPVIGLAAGEPDFDTPAVIAEAGINAIRDGSTRYTPNAGTMELRKAICNKLQEENGLTYSPDQVLVSNGAKQCITQAVLAVCSPGDEVKLSSLHTAIC

SEQ ID NO: 157623 - protein, 67 aa, Triticum aestivum
  Clone ID: PAT_TA_52041.pep
KTHESCKVNKCTKKRLLVKTLKPSQQVEHRFLQVSQKNPGAFTSHAAVQNGPSARESSSICWCPLTV

SEQ ID NO: 157624 - protein, 119 aa, Triticum aestivum
  Clone ID: PAT_TA_52042.pep
PWAPEHQPAPPPVGPATSICEATAQPPATSAVAAPDLEPTDQDPPATTHHATEKPPPRHLRWTPCARKRPTSRGSTPWSSPPAAATDRTGSPHEGGSALPPPSPEPVRASPADPLVATR

SEQ ID NO: 157625 - protein, 191 aa, Triticum aestivum
  Clone ID: PAT_TA_52043.pep
AAWVSLLWDDDIMALLNASDDDFSSNLLGPVDGSNSQLPAASNFDQKDEAKAQYGASSSGSHENLYPDTMVPDVPVDDNAGKRYFTNMLGSYPAPPAMASEFPPTTGKSIAALSGPSQIRVTAGIVQLGDHADNSDHWPLQKNGVFNLLLSFTVESNVSTKSITFDDEPATPRVSTVPTVLRGGLYLFFVS

SEQ ID NO: 157626 - protein, 68 aa, Triticum aestivum
  Clone ID: PAT_TA_52044.pep
SSKPAQEKGSAIRTAILAECLENKIHAWGSSTRIWIIVDGLFIFLMKLMRDEGAPFSPSRRRKERTSP

SEQ ID NO: 157627 - protein, 58 aa, Triticum aestivum
  Clone ID: PAT_TA_52045.pep
KKPLKRPSHPGSNYPCSKHLGFEVQITKAQNYKQLGPLCQKRSACENPVSWDFGLKTK

SEQ ID NO: 157628 - protein, 67 aa, Triticum aestivum
  Clone ID: PAT_TA_52046.pep
GLALGLAGVAPGMAIGIVGDAGVRANAQQPKLFVGMILILIFAEAFALFGLIVGIILSLGAGQFRAD

SEQ ID NO: 157629 - protein, 100 aa, Triticum aestivum
  unsure (1)..(100): unsure at all Xaa locations
  Clone ID: PAT_TA_52047.pep
KSFRELPGVKISDPRGAFYLFLDFSSYXGSEVGGFGPIKGFEPLCMFLLKKAQVALVPGNAFGDAKGICFSYGGALSTLQFGMEKIKNPMVLFKAPPGVQ

SEQ ID NO: 157630 - protein, 163 aa, Triticum aestivum
  Clone ID: PAT_TA_52048.pep
GKAVLQASFKEAMEAKIREEGEASGLREKIMGMEPEPEKKAAPIGRIMKRTNKLLFSSQKTVGFLQGKFMHKGGPVSNFSQPEPSGGAGVPSGFGNNPERFPPMWRSERAKRSSLFFDMFMSPDGMSFDPTSSACSDFPPTCHVCQRIYFPNKKEGERSPDCS

SEQ ID NO: 157631 - protein, 172 aa, Triticum aestivum
  Clone ID: PAT_TA_52049.pep
LSPMTGVPVVDETWSCVIDECHYVASATGFGFPWPHEEAFWWAGGAFDILLIAVLAPDPTVCFIPAPADPGIQVSAVVQFVAVAASVSCPNLRGIGDHHLWSLVLWPLVCAFLSSMCLPIASPSVKMCLWNMFLRLLHLSDSLASSDCSFSLRARCSRHSLPTSYLLSRSAS

SEQ ID NO: 157632 - protein, 74 aa, Triticum aestivum
  Clone ID: PAT_TA_52050.pep
CGLAPPLAPPGFPFYVPGFFFLWNFDGKPFSPGNPFCPFFPQPLNPPPKGKMGPPPGPGPKFRGPPPRRGGPNS

SEQ ID NO: 157633 - protein, 116 aa, Triticum aestivum
  Clone ID: PAT_TA_52051.pep
AGSLARQQRRSGVASYLEVLPGCHGGHQNCCWRWWLRRCFVEDWGIVPLVMVAAVSMGSWGAMYASTSFDTFFGTSWFPLFTHRLLGVKGGECVDLACDVVGVVLLGFWCWSRRGP

SEQ ID NO: 157634 - protein, 109 aa, Triticum aestivum
  Clone ID: PAT_TA_52052.pep
RPRKFFKKKKKTLGPRIQKGGPFWGPYNQARNIVFQPGSHPLLVPKKFPGVRGGPGQKPTMLKKKGGKKKRLRGTNFFPGKGWLFWGPPIFGPGLKLAPPLGSKLVSTL

SEQ ID NO: 157635 - protein, 80 aa, Triticum aestivum
  Clone ID: PAT_TA_52053.pep
TTPSTYLVLIFLKRKLDPCKHVSGHQNIGHPDALSISTSNIFHHQHIAGLTKGGGGTYPTKHVWGSANSGQKKPFHKLVW

SEQ ID NO: 157636 - protein, 63 aa, Triticum aestivum
  Clone ID: PAT_TA_52054.pep
PVGRFKCVWFRLSNRENEPRKEGKGGGHPNFLGWGKSRTVGCKSHFFIWFGGTRGGSMDLCKF

SEQ ID NO: 157637 - protein, 89 aa, Triticum aestivum
  Clone ID: PAT_TA_52055.pep
NPCTQPSSAPYLASCHDVCHYARDSFQDSPHLHLVFHLVYLRRLLLSCFIWSFHAFPCIMFRSMITLVMSLLVLLAAPMTSPTITYFKR

SEQ ID NO: 157638 - protein, 161 aa, Triticum aestivum
  Clone ID: PAT_TA_52056.pep
MKGAKSKGAAKADAKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 157639 - protein, 151 aa, Triticum aestivum
  Clone ID: PAT_TA_52057.pep
ISICPNWPARFQFASCKSQLARCGVIVISTDCVPPGFSTSVSRCAVQRELLPMRKPQVQCLRFITRTKTGLVHHLLASAGGSTVSSPSAVSRRQYLTPSSDSFLVFKLGMGFSGVVFITRTSGRLLRPSDCSRGIIPEPFPLDSTKSDTLT

SEQ ID NO: 157640 - protein, 105 aa, Triticum aestivum
  Clone ID: PAT_TA_52058.pep
KGPPLFFFFFFFFFFFFFFFFFFFFFFFFFFFFFFFFFFFFFFFFFFDPNMMVIHSYKYRSAYSIAAPQKQIQTRKCGFHGQKQIQLDSAQEIDWKNRFHVSPGP

SEQ ID NO: 157641 - protein, 40 aa, Triticum aestivum
  unsure (1)..(40): unsure at all Xaa locations
  Clone ID: PAT_TA_52059.pep
TTALCLIVYWHTIIIHHKINYLVIHIYNXPLRLLHSTKIG

SEQ ID NO: 157642 - protein, 47 aa, Triticum aestivum
  Clone ID: PAT_TA_52060.pep
ASLWLYRQILDAIEANDYNNFTKRAYVGKAKKFLSLPAAYARAALSP

SEQ ID NO: 157643 - protein, 66 aa, Triticum aestivum
  Clone ID: PAT_TA_52061.pep
GGGEPNKLRGGLTPKIKPGAKAPKGQGFLAPAGPPKGNFGVLNKTFFRFKILKKGTPFFWPPQVLF

SEQ ID NO: 157644 - protein, 51 aa, Triticum aestivum
  Clone ID: PAT_TA_52062.pep
IVPGPPIQVKEFLPRDTTWFGGTLKTEIFLWFKGNLFFNFGHLWEFWNRVF

SEQ ID NO: 157645 - protein, 130 aa, Triticum aestivum
  unsure (1)..(130): unsure at all Xaa locations
  Clone ID: PAT_TA_52063.pep
SLXFFFXPLHHNPPFSYPXXFFFNPYFIIFFICFITLXXLXNSPXNLYFIIIXXXITKLNLFISYXSPPFLSFIXSSLKXTTHQPHFHNISFLLLXPYXXNILTFPSFSSPLSFXSLIFFXILLLSPSSL

SEQ ID NO: 157646 - protein, 131 aa, Triticum aestivum
  Clone ID: PAT_TA_52064.pep
KQQVSRGKRQGTKPGQGGRPKITGGACPPKRGTGAFNQAVFGHDRELKDPGARTPRGKPPPPGGGGGPQKKGVKKRLTPAQTTTKTGGGGPPLDRPKQPQQPKKKTPDKNRENGQANTWGLFLFPLKRNPL

SEQ ID NO: 157647 - protein, 108 aa, Triticum aestivum
  unsure (1)..(108): unsure at all Xaa locations
  Clone ID: PAT_TA_52065.pep
RQGPKDRTFAQGFKGDPPPLVVESAKTLPPXGINPVCPHFGWVVPWNPPENKFLCPSHGSRSTTQGKVVRGPAPLSLALVPPDVYAGKVVFVPWVETDFRPGATPWWK

SEQ ID NO: 157648 - protein, 114 aa, Triticum aestivum
  Clone ID: PAT_TA_52066.pep
TPSGPRGGPACTSSLLLPVVSMALRSHPSCRSFWPLHITVGPRRLTPPSPRMIHEDFGDSSSNPPARPAPEQTHRLYGFWQVPRRPALSTIMFAMYTTPRPDGQVPRQRVYLYC

SEQ ID NO: 157649 - protein, 88 aa, Triticum aestivum
  Clone ID: PAT_TA_52067.pep
AHTWVSRAPMRPCNTRATFTLRRPKQISTYAQVLGVLHSLISGMSLQYFSNSVGVLDLVPGEAGGGADLLQLVPRRRSLPAGGVPRIR

SEQ ID NO: 157650 - protein, 97 aa, Triticum aestivum
  Clone ID: PAT_TA_52068.pep
NPGGPGDKGQKTPGFGQRGGTNNQTRVQNRYNRGRVCKAGSTNVPRAFTGGSYQSIYSGVGGKKKKKKGGGGTPTDSGFMGGAIIGEEGGKESTRGS

SEQ ID NO: 157651 - protein, 136 aa, Triticum aestivum
  Clone ID: PAT_TA_52069.pep
RGPKNHPFSGSKIGSFLVQGFLQTQKPFGGGKYFGLGVGYLHRGGVFLLQKPAFKQKPRPGVHLNFFFTGERAGVLNKEEPPPQEAPQGEPPNKKPRLFPRGGGTKIKTFLLGGKWGGTPNLWPPLFKEKGHPLFG

SEQ ID NO: 157652 - protein, 41 aa, Triticum aestivum
  Clone ID: PAT_TA_52070.pep
GPCCFQAFYVCSNLEAGNVTSLLIICHQALKYDSILSSFPD

SEQ ID NO: 157653 - protein, 104 aa, Triticum aestivum
  Clone ID: PAT_TA_52071.pep
NKGAPRRPLDLKTRGGVWEKFCWVFTTPNKNYWGGAGPKERKRKKKNLCSTGLLFSWGKNPPSVPGRKKQKLFFLAHIPPLGKIVVILGPKGVQKLPLQPQKFP

SEQ ID NO: 157654 - protein, 49 aa, Triticum aestivum
  unsure (1)..(49): unsure at all Xaa locations
  Clone ID: PAT_TA_52072.pep
XAYHNWSYFWCLTPTRLSRIRYTRCLTSSVKKFCRLHRFSAKWSGDNNS

SEQ ID NO: 157655 - protein, 75 aa, Triticum aestivum; identical to SEQ ID NO: 106874
  Clone ID: PAT_TA_52073.pep

SEQ ID NO: 157656 - protein, 78 aa, Triticum aestivum
  unsure (1)..(78): unsure at all Xaa locations
  Clone ID: PAT_TA_52074.pep
MSVSDQEAPGRCDPFGRRGGMGNANEGKAIFTPVEVEERNIIXRKLLNQVTSMAIRLHSHQITDFCKTMDSDPKNRQG

SEQ ID NO: 157657 - protein, 109 aa, Triticum aestivum
  Clone ID: PAT_TA_52075.pep
IKKSRRLCPTATREELLDSGMPDTLGASSDQRGRLMMTSERLNQSSDRIRESQITALDTEEIGVSILQNLHNQRETLMHAHKTLHGVDDSIGKSNKILASMSKWNKWFV

SEQ ID NO: 157658 - protein, 86 aa, Triticum aestivum
  Clone ID: PAT_TA_52076.pep
KKRFPKSPEEFGNPIGGAPPPPPVKTSLVTAPPGKGAFLEKAPQKACWPLQKFCLAPQAPPIAHVPYLPKNPRKKGVKPPLLCLGP

SEQ ID NO: 157659 - protein, 54 aa, Triticum aestivum
  Clone ID: PAT_TA_52077.pep
VFTRCQRTRRIGCFVQVKKLQASAVIPPNFRSAGQVLCLVDPPVKPCYDAKGRK

SEQ ID NO: 157660 - protein, 130 aa, Triticum aestivum
  Clone ID: PAT_TA_52078.pep
RCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 157661 - protein, 85 aa, Triticum aestivum
  Clone ID: PAT_TA_52079.pep
VFPIPALFFFGVKKWGVKPFLKRGFSRPGGNPLGLPSPLGGGGFFKSPSGSVFFFSGVTLLNFFPTLCFFPVFRFGGAFFPFCFF

SEQ ID NO: 157662 - protein, 160 aa, Triticum aestivum
  Clone ID: PAT_TA_52080.pep
MSFLFGKRKTPAELLRENKRVLDKSIREIERERQGLQTQEKKLIAEIKKVAKQGQMGAVKVMAKDLIRTRHQITKFYALKSQLQGVSLRIQTLKSTQAMGEAMKGVTKAMSQMNRQMNLPALQKIMRDFEMQNEKMEMVSEVMGDAIDDALEGDLGRREY

SEQ ID NO: 157663 - protein, 67 aa, Triticum aestivum
  Clone ID: PAT_TA_52081.pep
YWKSPTLCQVPDSKVSGCKPCSKDRELNPRVSHHILKPMIKLEPSLNICTNFTCLQKIWYNMNLFFP

SEQ ID NO: 157664 - protein, 114 aa, Triticum aestivum
  Clone ID: PAT_TA_52082.pep
MLIMKGDGGGRWVSAAPCGLRPCRARQPGLVAAAAEAVEAALARLVAAEAAQRREHACVDAALLLVALLHVVRVGHLLPRRRVIHLGEGWVGLLWKKKVSKGCALVCSPVAWED

SEQ ID NO: 157665 - protein, 73 aa, Triticum aestivum
  Clone ID: PAT_TA_52083.pep
VVCPVFGGMTFCAVSCYSMLLVRVGLRAVSALADSLEPESAAVDPRPHVYPAMFSQHASSPSTWRRDLGSVGG

SEQ ID NO: 157666 - protein, 78 aa, Triticum aestivum; identical to SEQ ID NO: 106966
  Clone ID: PAT_TA_52084.pep

SEQ ID NO: 157667 - protein, 75 aa, Triticum aestivum
  Clone ID: PAT_TA_52085.pep
MSCNCGSGCSCGSDCKCGKMYPDLTEQGSAAAQVAAVVVLGVAPENKAGQFEVAAGQSGEGCTCGDNCKCNPCNC

SEQ ID NO: 157668 - protein, 232 aa, Triticum aestivum
  Clone ID: PAT_TA_52086.pep
MARRRHSSSGLLCALFLLITAAMAADGAGARQRKLQQVPGPQPLPLPNPRPQPGPQPVPLPIPNPQPDPNPQPLPNPDPNPQPQPLPQPQPDPNPQPQPLPQPLPQPLPDPNPQPQPLPPQPLPQPLPGPNAQPLPLPPPLPLSPPGPNAQPMPLPPPLPLPPPGPNPLPLPQPDAPGSYPQVQPLPDSNTPGRQNNALQGPLGNGAAPALYSCGATYVHIFFMGLLLYYFA

SEQ ID NO: 157669 - protein, 90 aa, Triticum aestivum
  unsure (1)..(90): unsure at all Xaa locations
  Clone ID: PAT_TA_52087.pep
MASSSAVSKRGDAGGVLAAISRSSVAAHGREAAAXAGKLLRSXGKAARSAGTTLHALAVPLIIDMDRXQQMIDLYLQEQALLRSPPPLAI

SEQ ID NO: 157670 - protein, 70 aa, Triticum aestivum
  unsure (1)..(70): unsure at all Xaa locations
  Clone ID: PAT_TA_52088.pep
FWGHLSSFFGRFRPFRSFFFLFFFFFFFFFFFFFFFFFFFFFFFFFFFFIFFFFFFFFFVIPXPRPASKR

SEQ ID NO: 157671 - protein, 174 aa, Triticum aestivum
  unsure (1)..(174): unsure at all Xaa locations
  Clone ID: PAT_TA_52089.pep
CSVLRPASRHGGRRGVGAAVDGVLLELVPGRAGRGRVGGAVSRGEGAAHGRRPPPLLPRTVSSGPATVPCSSRLLHVLYNSSHNDLPXTHTLVKNAIVQFDASPFKHRHLTHYALEIFSNNKAAAPAKNEAAEGLEDDVAAAATDQAKNSNHVHTNLDNRHQGLTLYSHIEQQF

SEQ ID NO: 157672 - protein, 161 aa, Triticum aestivum
  Clone ID: PAT_TA_52090.pep
MKGAKSKGAAKADTKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAATKEVEEEDEEESDKSKSEINDDDDDEGSDEDEDDDE

SEQ ID NO: 157673 - protein, 152 aa, Triticum aestivum; identical to SEQ ID NO: 126264
  Clone ID: PAT_TA_52091.pep

SEQ ID NO: 157674 - protein, 68 aa, Triticum aestivum
  Clone ID: PAT_TA_52092.pep
PMVIYCSISGSVKTLINKQFGPPSDVGGPVQSLLLHMPTYGPAEHLFFLLDCKPHRLACRAPRRTCCL

SEQ ID NO: 157675 - protein, 108 aa, Triticum aestivum
  Clone ID: PAT_TA_52093.pep
ACGLTRAADATQRDGAGLVVAKTGQAQPRATHGVGRLDGASQMAASWRRQSNGGAQPLNVRVRRGDLKTAGSAEVVRGRLEDEGSILKPRRFGDSVVRGRLGPGELWR

SEQ ID NO: 157676 - protein, 78 aa, Triticum aestivum; identical to SEQ ID NO: 106966
  Clone ID: PAT_TA_52094.pep

SEQ ID NO: 157677 - protein, 153 aa, Triticum aestivum
  Clone ID: PAT_TA_52095.pep
ARPSLLSPHSILSVLSFLPSPPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 157678 - protein, 223 aa, Triticum aestivum
  unsure (1)..(223): unsure at all Xaa locations
  Clone ID: PAT_TA_52096.pep
PARGPAWAPGNKXXKKKKKKKKKKKKKKKKKKKKKKKKKKRSFKSAKKTFPRKKNSYYFSLKCFPGPHIWEDAFAPEDERCSCRIKLKAGGKCTLVVTDSGRPPRTKSPPGIVLGRGPSRTRLEHVGERPHAHPRGGSAACMKQLQGKPLGSVRLLELLPINGMEGKKYGNNGGLIGWTPAMVRACVLYLLALPLGPALAAPVCMGVPVPLMLLRPPPLSREC

SEQ ID NO: 157679 - protein, 196 aa, Triticum aestivum
  unsure (1)..(196): unsure at all Xaa locations
  Clone ID: PAT_TA_52097.pep
MTMRKRPSSSLLISPLLFMLLPAFALAAGRHNLITRDPQYGPQVNPNLEPLAGKQADPNPQPLPDPQPFPGPRPDPXPQPLPEPKAHTNPQTLPEPRPDPYAQPLPGPHPDPNPLPLPGQNLEWLMNPLPNPNSRPLPYPRANPNPRPLPGPQTDPNPQPLPDPNPKPLPNPQPNPNPHALPGPQTDPNPQPLPDP

SEQ ID NO: 157680 - protein, 116 aa, Triticum aestivum
  Clone ID: PAT_TA_52098.pep
GSSRLGSAIDPYQELIWACHALVRDATKNAVAATYGHHTRVRVSMPRRASSEGYVSTRQPQLILWETISGLEDLGLSHGARKLQVPQGGRYLPLPLGHALRGRCTGAGRTGNGQLS

SEQ ID NO: 157681 - protein, 173 aa, Triticum aestivum
  unsure (1)..(173): unsure at all Xaa locations
  Clone ID: PAT_TA_52099.pep
MSTEKKHLNPMRDIXVHNYALNISLGQSGDRLTRASKVLEQLIGLPPLXSKERHTARSLVMRRAEKIPCYVTIRSENDMHLLESGLKAQEYELLRRNFSDTAGFGFSIQLAIDXRTKYDPFTVIYGMDFFVVLKRAGHYVTRRLWCNVRVQNLQKCSKVDALYGFPFMYLGVF

SEQ ID NO: 157682 - protein, 75 aa, Triticum aestivum; identical to SEQ ID NO: 106874
  Clone ID: PAT_TA_52100.pep

SEQ ID NO: 157683 - protein, 85 aa, Triticum aestivum
  Clone ID: PAT_TA_52101.pep
YGSCNRQVGMCACLFQSLLDPTIWQHEASALGTTRRFSIFVGKWPRSTRIIALQTSYCKECAVSGSLNRHQLFDVHNIVFLYGQL

SEQ ID NO: 157684 - protein, 183 aa, Triticum aestivum
  unsure (1)..(183): unsure at all Xaa locations
  Clone ID: PAT_TA_52102.pep
QLNRNFQLVEGVSELEVDCWIGTREIMAAIGTAIYHEKNRICVDTKGFRXYKMIFAYAXHFAINASSTADIRYIKIKNXFLAQKNVKKEDMIDADAILQPDKAKDEIVLDCIVISSVVSSAVVLINDKXLVKNKDMMKLLQAIYVSDKFAIRDEYSAKTVPQAEFLPASVQRLCVDVEMLNFL

SEQ ID NO: 157685 - protein, 66 aa, Triticum aestivum
  Clone ID: PAT_TA_52103.pep
SPKPLTQKIKKKKKKKKKKKKKKKKKQKKKKKKPKKKKKKTKKKKKTPKKNFYREQRSRKELPQKP

SEQ ID NO: 157686 - protein, 145 aa, Triticum aestivum
  unsure (1)..(145): unsure at all Xaa locations
  Clone ID: PAT_TA_52104.pep
SSNPSAVFQSSHLSPLFRYLVLCTSTETEHDDQVLQKARYVENPGEDIHDAHDEKGASGKDCAAYMKKKXTTTSVDIHEIYFFNACRHPQPHIGVSSXGMSIMNSFISDIFXKLARESDCLPRYHKKPTITSRQIHTGGHLHLPV

SEQ ID NO: 157687 - protein, 166 aa, Triticum aestivum
  Clone ID: PAT_TA_52105.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGGGGGGYGGQGGGGYGQGGGGGYGQGGGGYGGQRGGGGYGGGGGGYGGQRGGDSGGQWRN

SEQ ID NO: 157688 - protein, 69 aa, Triticum aestivum
  Clone ID: PAT_TA_52106.pep
KRNFSCIKSTCLYYKGHDTKITRFETSTNPILDLATNVSAILKHNNRNIDTENIRNIMIETLALEKDTK

SEQ ID NO: 157689 - protein, 128 aa, Triticum aestivum
  Clone ID: PAT_TA_52107.pep
CCSPLPHWHAKFLQARIPYIMSSRRRTRRCHHCGQCPRLATCRRRERAHMSLRCRGRSLLQAGTPKITTTCCRHHQRLRRLDGSAAICAPWIRRSSQRLCYLSLHCKRAASAVCNYMFLFLPKLCNYM

SEQ ID NO: 157690 - protein, 78 aa, Triticum aestivum; identical to SEQ ID NO: 106966
  Clone ID: PAT_TA_52108.pep

SEQ ID NO: 157691 - protein, 78 aa, Triticum aestivum; identical to SEQ ID NO: 106977
  Clone ID: PAT_TA_52109.pep

SEQ ID NO: 157692 - protein, 103 aa, Triticum aestivum
  unsure (1)..(103): unsure at all Xaa locations
  Clone ID: PAT_TA_52110.pep
SVGAGQCHXWRKSRILVHIIAATLSLSWARGRHWLILSPNGRHSVHSRHGEGPNGTMLNLMSFMQVWIFICCKLSVEYCYVALAARAHYSVCVHPLLRETRAP

SEQ ID NO: 157693 - protein, 41 aa, Triticum aestivum
  unsure (1)..(41): unsure at all Xaa locations
  Clone ID: PAT_TA_52111.pep
ITDEIGLHSLRQRDXHIQITXATSGERLYEGLDWLSKTLPH

SEQ ID NO: 157694 - protein, 110 aa, Triticum aestivum
  Clone ID: PAT_TA_52112.pep
IPKPPLPQLPTKFLRIKDVELPASFIQKYLVQKLNLSSEAEVELMCAGKKVDPAITLHDITDCYLDKGPNGWVRSSVGSPATGFITTVFYSRPELPTPPTPPPPPESHHG

SEQ ID NO: 157695 - protein, 83 aa, Triticum aestivum
  Clone ID: PAT_TA_52113.pep
DRETATDRLLHNLPHLAKFVFSCMFCHTAIWDVEYQTLQYKSELKMHCFAVSELQEAAEAYLVGPLEDSNALHYPNHDPNHDV

SEQ ID NO: 157696 - protein, 113 aa, Triticum aestivum
  Clone ID: PAT_TA_52114.pep
WEEGRKECRNEERKKRYIHGLPALRIVVVVSGLVMMMMMMGRAGADECMDLCLHDCAVKGKNLTQEQCQYACNYGCPFGAAQHALSNAPAIARNGGKNTVHVLIHVLAAAMWL

SEQ ID NO: 157697 - protein, 133 aa, Triticum aestivum
  unsure (1)..(133): unsure at all Xaa locations
  Clone ID: PAT_TA_52115.pep
GKNHHTLRGGSLETTSKAKGKIPEKGGISPGPKRLFFSGKKVEKRPTLSAYKIXKEGPPSLGVPLRGGAPKGAKKTFTEPPKRKDKNKKGKLSALPFXKGDHTPPKGTRLTKKSPQAHCAAGRFMGKNFYRHY

SEQ ID NO: 157698 - protein, 169 aa, Triticum aestivum
  Clone ID: PAT_TA_52116.pep
MDGHVGQFFESVSSIFRGSDTLPVCDRDIIAGCEAEVAEAANEEQKNDSLMRLSWALVHSRQPEDVNRGIGMLEASFGKSNSPLQTREKLYLLAVGHYRNGDYTRSRELLERCLEVQPDWRQALTLERLLEEKTKRDGMIGMAIVTGAFGLVGLVAGGIIAAASSSRKK

SEQ ID NO: 157699 - protein, 234 aa, Triticum aestivum
  unsure (1)..(234): unsure at all Xaa locations
  Clone ID: PAT_TA_52117.pep
MAAATMALSSLAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGXLGEIVDPLYPGGSFDPLGLAEDPEAFAELKVKEIKNGRLXMFSMVGFFVQAIVT

SEQ ID NO: 157700 - protein, 170 aa, Triticum aestivum
  unsure (1)..(170): unsure at all Xaa locations
  Clone ID: PAT_TA_52118.pep
IFPPKKKRRGRGPHPFLFPGNHFRANFWGGFPTPGPPSKFPPGGAPRKEFSRFPGGQTPSQKPGTPPGGGFFPPPGTLRSPPFWGTPPLAIFPSPPWDLAPIPPPGWDFPLPRWEKKGGNKGRVGGNFFLVFFFFFFFFFFFFFFFFFFFFFFFFFFFFFFFFFFFFXXI

SEQ ID NO: 157701 - protein, 109 aa, Triticum aestivum
  Clone ID: PAT_TA_52119.pep
PCLITLPRFGRRPRRSSIPRPPAAFSSLPSPSLRRQGLPPVDWGSAPVMGSSFAHGSGSALQGRGGSGSGPCFGPDRQLWRGGGPLVRGGGWRRSWIRQQPRQNHLSSP

SEQ ID NO: 157702 - protein, 112 aa, Triticum aestivum
  Clone ID: PAT_TA_52120.pep
TLTLTLKKKKKKKKKQEEEEGRQRKKSHGALLQQLQRHQQLRQRKGEEACAEEGAAEAADREDHQQPHGAEERRRRRGQEGIRSHQHRRLQLTLRTPSSVRCTRTDARFLQT

SEQ ID NO: 157703 - protein, 114 aa, Triticum aestivum
  Clone ID: PAT_TA_52121.pep
RGGDVEEQHARRLRDAPRGPADGDADGGGGGRRRRRGTPSPARCVPVQKLQLPHLLHFPLGLLRLVLPAGVGDGGTHGPLQFLTCRGLNNAHVRGYSNMWLLLSVPMLVVAFEI

SEQ ID NO: 157704 - protein, 116 aa, Triticum aestivum
  Clone ID: PAT_TA_52122.pep
RCYELVALHRLKGQHVPVEVWSPASHCMWSCPSRRRPGGALVTPSRGRPLDLDELIQVQRRSDLLFDGLHALIDVPMPVLGGWELSYCLNYMQKGSSHCSSIDICSSQTLRSSHAY

SEQ ID NO: 157705 - protein, 56 aa, Triticum aestivum
  Clone ID: PAT_TA_52123.pep
MEPLEAAIAIVFNALLLVFMVKLFFAMFQMKLVVILFYLVVVLFALAFSGRGPAGF

SEQ ID NO: 157706 - protein, 84 aa, Triticum aestivum
  Clone ID: PAT_TA_52124.pep
SPIWNPPPSSMEVEGEDSFVLPADWDIPEAEWALMSESTKRQIKENFALEEEYRLRFRSAEVGVGGGGSGNLNTDFKSPVPQRR

SEQ ID NO: 157707 - protein, 125 aa, Triticum aestivum
  Clone ID: PAT_TA_52125.pep
IPRIHSDIDFFPYPIPDTISDVVPELHLASRSCSSSCCRRWAACSTIPDAECTAWHLPSCSSIPGLHSPGSSTRSTRSLRSPQSTTVPTTTALLTNPAPAPIARETSPLSAVNQPSAITSRTDVD

SEQ ID NO: 157708 - protein, 75 aa, Triticum aestivum; identical to SEQ ID NO: 106874
  Clone ID: PAT_TA_52126.pep

SEQ ID NO: 157709 - protein, 152 aa, Triticum aestivum; identical to SEQ ID NO: 126262
  Clone ID: PAT_TA_52127.pep

SEQ ID NO: 157710 - protein, 169 aa, Triticum aestivum
  Clone ID: PAT_TA_52128.pep
KNILGDTTEAVRKNALDVIVEVQELEEGELPTEPDHVLQENPVTHNNSLHELTAGTLECVVPSMVDAEPPLRHFSNEKIPVNMLEHKGESVSWEVAEDLKVMKKCKGNSPKAASKPPPEDPLKEYLGDKKVSESCSMKSAPLDVEAGVHGDGIMRRMVTFTARNYPEEA

SEQ ID NO: 157711 - protein, 145 aa, Triticum aestivum
  Clone ID: PAT_TA_52129.pep
GRVKPPPRAVRFRRSQPKDQAAPMASPRTSPWQRRIAPTALQCNPIEVSTVPVQLQRRFNDLAALHCSSGGAGDAPLPQRGLAPAVTDPSQHRSPCSGSRTVLLCSRQRRHGRPVSSQQRRMHRIIGNADGCCTEALALGVALKV

SEQ ID NO: 157712 - protein, 202 aa, Triticum aestivum
  Clone ID: PAT_TA_52130.pep
MKPPGAGALSPRHLLPLLLLLLYHLAAAGTAATDADALLALKSSLDASNRLPWHPSTARTLCTAWPGVRQCDPAGRVTKLVLENLNLTGPLTAALLAPLGELRVLSLKANALSGPVPDGLAAALPNLKLLYLAGNRLSGPLPASLALLHRATVLVLSGNRLSGRIPRELARVPRLTSLLLDGNLLTGPVSALPQSKLRALEV

SEQ ID NO: 157713 - protein, 197 aa, Triticum aestivum
  unsure (1)..(197): unsure at all Xaa locations
  Clone ID: PAT_TA_52131.pep
MAKKAAVIATLLALNLLFFTFADACGCHCGSCPSPGGGGGGGGGGGGGSGGGGGGSGGSGGSGGGGSGGGGSGGGGSGGGGSAGGGSGGGGSGGGGSGGGGSGGGGSGGRARCPIDALKLGVCANVLHGLIKLQLGTPRSXPCCSLIQGLADLEAGGVPVNVAQGQTPGLNLQMPNLFHPPPQIMKKKNPLRLQFPP

SEQ ID NO: 157714 - protein, 136 aa, Triticum aestivum; identical to SEQ ID NO: 106789
  Clone ID: PAT_TA_52132.pep

SEQ ID NO: 157715 - protein, 113 aa, Triticum aestivum
  unsure (1)..(113): unsure at all Xaa locations
  Clone ID: PAT_TA_52133.pep
MPLQKEKEPPLQTLPLQDEERARNKPNLVATPAMPIRKEALLGAMSLALVGAAPGVDACHVQXGKLTGGMPGIPTAPKPSFWCCANLPSHNGCFCQNPKDPSLVRYIPTPHAC

SEQ ID NO: 157716 - protein, 171 aa, Triticum aestivum; identical to SEQ ID NO: 141856
  Clone ID: PAT_TA_52134.pep

SEQ ID NO: 157717 - protein, 80 aa, Triticum aestivum
  Clone ID: PAT_TA_52135.pep
MSLIAGEEFQHILRVLNTNVDGKQKIMFALTSIKGVGRRFSKIVCKKADIDMNKRDGEVSEEEMDRLMVEVYKLGLLKEM

SEQ ID NO: 157718 - protein, 255 aa, Triticum aestivum
  unsure (1)..(255): unsure at all Xaa locations
  Clone ID: PAT_TA_52136.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRXLRGGMQIFVKTLTGKNITLXVESSDTIXHV

SEQ ID NO: 157719 - protein, 32 aa, Triticum aestivum
  Clone ID: PAT_TA_52137.pep
TMPKCATSIVQLVVLLVHMLVKICCLNCFFYL

SEQ ID NO: 157720 - protein, 127 aa, Triticum aestivum; identical to SEQ ID NO: 124219
  Clone ID: PAT_TA_52138.pep

SEQ ID NO: 157721 - protein, 150 aa, Triticum aestivum
  Clone ID: PAT_TA_52139.pep
PGPGIKKKKKKKKKKKKKKKKKKKKKKKKKKKTHFSPEEKKFVSSRPAEESTALGGGNAQKPKMGRERTLKKLKGGRGTHFEANKKALNFQGKICLQIFFCPPSEPKGKELAEAKRPKSELAQGFPPLKQGFLPIRPERGLKERERERLS

SEQ ID NO: 157722 - protein, 169 aa, Triticum aestivum
  unsure (1)..(169): unsure at all Xaa locations
  Clone ID: PAT_TA_52140.pep
EGRXRAGKIXXXKKKKKKKKKKKKKKKKKKKKKKKKKKKKFPPPPHTHTEPKPIFLKEKPPPSPSFSFLSEVQLLKGKRGYLQGGGDRWKPLRGGPPGKGKPPPKEGGAPVAQKKKREKKGAPGLRAEKWDRGPRNPKKKRGPSPNHGGFRPRRGKPQVGRNPPPGKPP

SEQ ID NO: 157723 - protein, 81 aa, Triticum aestivum
  Clone ID: PAT_TA_52141.pep
MAGGGLSGGAAAFWATRALEVVKRNDSPGLLWKRIKLTTTRKNNAKKRLKRLWQNEAVIRASAQAESSSTSNTAAASEKQQ

SEQ ID NO: 157724 - protein, 99 aa, Triticum aestivum
  Clone ID: PAT_TA_52142.pep
SLCGRRPPISVASLVSHSLAFSVSAAAGATSLISCTSAEPAGALAWASPVAGASHVLTTYSAATGVCTVGSSSVSTEPSGSGHQRWPSQSWMQENARSG

SEQ ID NO: 157725 - protein, 88 aa, Triticum aestivum
  unsure (1)..(88): unsure at all Xaa locations
  Clone ID: PAT_TA_52143.pep
MIISKKTRPDICEHLFEEGVLYATTDYNXPKQPQVDASTLEAIKFTKSFKSKEXMMETFSSEHYYWYQTNDVVEILXNFPNLPYEIVP

SEQ ID NO: 157726 - protein, 93 aa, Triticum aestivum
  Clone ID: PAT_TA_52144.pep
KVDDLVKDRIESQKEEKAKEQEEKDVVAQQNMYAQLLPLALPAPPGMGGPPPMGGMGMPPMGGMGMPPMGGMGMPPMGPGPMPAYGMPPMGNY

SEQ ID NO: 157727 - protein, 171 aa, Triticum aestivum
  unsure (1)..(171): unsure at all Xaa locations
  Clone ID: PAT_TA_52145.pep
RAGGRVRTRADAWADAWADAWADAWEIPKIPDLYLAHYRFLINQGPSELKEDAKAKLFEAIKENNMAPFYKVMTEELQLPLDQALYDSMVSNNEEELKKFDEKAAKAEQNEGETEVNEALLAKADYYAKIADKENALAAYENXLKRSFTTGTRIDIIXTYVWIGFFFYDNN

SEQ ID NO: 157728 - protein, 106 aa, Triticum aestivum
  Clone ID: PAT_TA_52146.pep
AFRGENGKELDGRNITVNEAQSRRSGGGGGGGGGGYGGQRGGGGGYGGGGGYGGGGGGYGGRGGGGYGGQRGGGGGYGGGGGYGGGGGYGGQRGGGGGDSGGQWRN

SEQ ID NO: 157729 - protein, 124 aa, Triticum aestivum
  Clone ID: PAT_TA_52147.pep
PRVRAQLVSMARDPRVAIIDVRDEERICDAHIAGSHHYASDGFADRLPEIAEATRGKETLVFHCALSQVRGPSCARMFLDYLSEAKEESAVKSITVLERGFNGWELSGRAVCRLKDAPCKGVCS

SEQ ID NO: 157730 - protein, 110 aa, Triticum aestivum
  Clone ID: PAT_TA_52148.pep
SPPPLEEKRSSNNSPRTPQNKNGAVGKSSHGEHEQQVHNVPINSPVELKHVHATVVKVPKVNSFALPHKLRIKAKAMQMKVEAFDNKFQAVQKRSSPIEISIKTISTGLV

SEQ ID NO: 157731 - protein, 67 aa, Triticum aestivum
  unsure (1)..(67): unsure at all Xaa locations
  Clone ID: PAT_TA_52149.pep
CNLQHGGMNQRLMVFDLHGIGVQREKEKRCDXLVIVVIKKYGGGVLVDXRFFRGVWEVFAFVWCXXN

SEQ ID NO: 157732 - protein, 189 aa, Triticum aestivum
  Clone ID: PAT_TA_52150.pep
QRPRTRGVVHDGLSTVQAMANKTSLGRLALSTANSTLTTVSRYAQPKYVQSYYESYIQPRIEKADALGCRSLDIIQTKFPVVNQPTEDILKTPYQMVDGMKVKIDSTFTQPAHQVAKEANKRFGTVVDNVEAVLNRYLPPSEDDGKHQEKEVNQAIRAYYLLNQATFRLSQHVQEQVKTTAGHIPRSPS

SEQ ID NO: 157733 - protein, 158 aa, Triticum aestivum
  unsure (1)..(158): unsure at all Xaa locations
  Clone ID: PAT_TA_52151.pep
AEHPGAPSWPWSWPQPSTQTRDAYQCGCQTGGNSFSYCICCYXCRYCGYCDAYCDTQCKSWCTSCGRTSPGRSLWGIMSSIIFKDLFVQLIVYQNDCEXYRCYYLFDAFVAVAALFPSLGTXRGTGTVXGLVGXFLGETSGGWSGGWXGAXXWGYCWG

SEQ ID NO: 157734 - protein, 163 aa, Triticum aestivum
  Clone ID: PAT_TA_52152.pep
PRVRDFEQDPSSAPEPPPPIEGSYQLFGATYTTDVVLPSLEDQGVRQLYPKGPDIDFKKELRTLNRELQLHILELADILVERPSQYARRVEDISLIFKNLHHLLNSLRPHQARATLIHLLESQIQRRKQAIEDIKQRREEAQRLLGESLVIIEGSQQQVMTPM

SEQ ID NO: 157735 - protein, 159 aa, Triticum aestivum
  unsure (1)..(159): unsure at all Xaa locations
  Clone ID: PAT_TA_52153.pep
FAKCTFVHTLLDDINDVSATLVEYRKLDAAIQRWNESAVSLVPDYLKKFYNKLLMCFREFEDELTLNSRYPIDHIKKMFQQQSKFYLQETEWLHQNHKPSFKDKLHXVXMXTGVTALCVYTMVCMGDGAXKGAXEWAVGYPDVIMVCAKIGRLMNDLVG

SEQ ID NO: 157736 - protein, 162 aa, Triticum aestivum
  Clone ID: PAT_TA_52154.pep
MVCLDPDSADTVFTWANDNFIIPSKDLVVLVHVRQIDIPVAPYINTTGYIDDISEERREESHRLLRYYAQDLHRKKIACKAISMVGDPKTELLRKSKEIKSDVVLMGARKMGAIKRTLLGSVSDYIVHNAPCAVIVTKPMEPEHVEERRKSIQTLTSDNNAK

SEQ ID NO: 157737 - protein, 177 aa, Triticum aestivum
  unsure (1)..(177): unsure at all Xaa locations
  Clone ID: PAT_TA_52155.pep
ILEELAVRGHHTTFYTRDDQAKFIKNFPTVDLVSAGPAVATKEEMGNLIRNLTTKEPVDRLVYMLEEFSQNFTEDYLNHMDLFSKKDVDLALCGHIMTACVEASIVNKIPFIVTSAIPLTPDTAAPYVNTDMLSLHNPTXQNVPFFTRLKEKVIDPIRVIIKARELHQEISTKNRWH

SEQ ID NO: 157738 - protein, 130 aa, Triticum aestivum
  Clone ID: PAT_TA_52156.pep
LEQYVIYSVDRLCDKCHSCCRTHMAVCHVVFVLGHGSAFLSIQPIWGRQGRHRPVVLIISHRFVTAIAVSRTLCLQLAIPQRHTVLNVVQATPQASRMALASAVYRDTGRHCVPKSGTEAIRTIFTFSRD

SEQ ID NO: 157739 - protein, 134 aa, Triticum aestivum
  Clone ID: PAT_TA_52157.pep
QFPEQEDLNNTVDSYSVTINGFIFCTRHGLEVCDKCPTDNRSANNMMVEDMLHDKLSEEEYSTKWKGDEREPFSVAHKWTRVAKGKPGCMAHKTVACDECFNWGEQLYRGIHGGRKPRVSRVQRKSRDNTDKLS

SEQ ID NO: 157740 - protein, 74 aa, Triticum aestivum
  unsure (1)..(74): unsure at all Xaa locations
  Clone ID: PAT_TA_52158.pep
FGSFKRGPPFXFFXFFFFXFXFXFXFFFFFXFXFXWFFFXFFXFFFFFFFLKDDKKFIVMRMEKGVYMIINKQR

SEQ ID NO: 157741 - protein, 167 aa, Triticum aestivum
  Clone ID: PAT_TA_52159.pep
AILHHPSTQLFLTHGGAGSVYEALYNGVPIVVYPFFGDQPAAAIMAEENGYGRRMKKNDQEQAIKVVQEVLRDDRYRQNASRFKALVQIRSNHGVQRGADVVEEALYLHQDGKINHRRDVRRDLSFLKAYNLDLYLFSLSVVLGSLFGVYRLVSYGLKQSSVKVKSA

SEQ ID NO: 157742 - protein, 85 aa, Triticum aestivum
  Clone ID: PAT_TA_52160.pep
SGFDAEKRLSRRYTCIWHFGHHANVFVMYLVYTKVYRLFEIGSFFFPRNAQGLNRLDDVFDIMTKLNAILCIMPFFYTKPSYLNI

SEQ ID NO: 157743 - protein, 124 aa, Triticum aestivum
  Clone ID: PAT_TA_52161.pep
LIEMNCTDYTAVFGRARWPGAPQRVLKTPFYVEWKNLPDHETEENQPIIGHSIIHGVHKDICRFAGTVPNATTTGDIDSMAMYAGQSVGLITEIVPAREVVKRLVAEAQRVIGEKLSGFPKSSE

SEQ ID NO: 157744 - protein, 59 aa, Triticum aestivum
  unsure (1)..(59): unsure at all Xaa locations
  Clone ID: PAT_TA_52162.pep
KAPGKYKKKVYVLPKHLDEKVAALHLGKLGARLTKPPKSQXLISIPVEGPFKPWALRIM

SEQ ID NO: 157745 - protein, 74 aa, Triticum aestivum
  Clone ID: PAT_TA_52163.pep
TLLQGYVGLGFLITFCGYEFDSLHLWMILAVWSVRQSRVHIQPCHYVMDLLFSFALKTSICYDDAFQKLLFLVR

SEQ ID NO: 157746 - protein, 136 aa, Triticum aestivum
  unsure (1)..(136): unsure at all Xaa locations
  Clone ID: PAT_TA_52164.pep
GPLPENTFCVPIFFPFEESYLTFPFALFFAKRTLYVCVFSLTDNETARVLSDAYKKGLDVRILPDNDQMXXKGAYVCRLHDPWGIPFXYAHSDPFMHNQFAVIYDKMVIPGSFHWSAGARYKNPKNVIVTHIPSVV

SEQ ID NO: 157747 - protein, 128 aa, Triticum aestivum
  Clone ID: PAT_TA_52165.pep
KSFPFFQGARFFFWPNAWGVLPRSNPIQLKSQGLFLRMFPLKRIFFDPLWFVSAYKGIFFVPFALGGFFSRFSKNGPLFYSFSRGGGFPEPSPFISACLKSKNPPFPFSPPKTFCGLFKKKKNKIKIK

SEQ ID NO: 157748 - protein, 78 aa, Triticum aestivum
  unsure (1)..(78): unsure at all Xaa locations
  Clone ID: PAT_TA_52166.pep
MAWEGNGVVASARKLIGATNPFQAEPGXTIRGDLAVQTGRNVVHGSDSPDNGKREIGLWFKEGELAQWESVQTPWLIE

SEQ ID NO: 157749 - protein, 84 aa, Triticum aestivum
  Clone ID: PAT_TA_52167.pep
FPSVRPRVRCGGNCGCSTACKCGNGCGGCNMYPEVEAAGATLLVSATATHKASSGGMEMAAENGGCGCTQCKCGTSCGCSCCSC

SEQ ID NO: 157750 - protein, 199 aa, Triticum aestivum
  Clone ID: PAT_TA_52168.pep
IITAARNDFIKRLSHENMDQEAYDYAVKHYEESLESARVSILTEVTEVKKIAIEAHKAGKTEVLDVELSKKVIESTERIKVAMGSSVSITHKTQSGKKLSSADSGAVLQIEVKDDQEIVGEQGVEFERKEESVDVVRKDKVQKEKHGSSLEKVVAGSLAIGAAAAGAAVLVHEKNKKDQKESQKQSSVLKYDTGIATIE

SEQ ID NO: 157751 - protein, 78 aa, Triticum aestivum
  Clone ID: PAT_TA_52169.pep
PFFTDKNKLRLGSFLNARRARAVTRRGVAWRSVARRATKKEKRVCTTFLSRLPITCGRTTFSKRSHSLPLYCIVVLLL

SEQ ID NO: 157752 - protein, 104 aa, Triticum aestivum
  unsure (1)..(104): unsure at all Xaa locations
  Clone ID: PAT_TA_52170.pep
NPXIMPALPFNSSAASSPSSSPTLSPTMTPSIVLHPASGVSSQKKELLKPKEDPAQAYRIRYAQYLAATFGFSMQAALAEADCQLAPRRTSSSSMSEAESLRAI

SEQ ID NO: 157753 - protein, 77 aa, Triticum aestivum
  unsure (1)..(77): unsure at all Xaa locations
  Clone ID: PAT_TA_52171.pep
EESYMMTTRCSTAIIESSRLDHTSPCHTXPHRGGXLLRTQXIRXXTHQGCRLGVVATVEHLGIDHLEAASESYXSNR

SEQ ID NO: 157754 - protein, 194 aa, Triticum aestivum
  unsure (1)..(194): unsure at all Xaa locations
  Clone ID: PAT_TA_52172.pep
MAISLGPYWALSTVSLLSIVGLYMLFTGSGEEFNVGKLLQETSPYAWALTGMGLCIGLSVTGAAWGIFITGSALLGGAVKTPRIQSRNLISIIFCEVVAIYGVIMAIVYSAKLSDVPADQLYTNSNFFTGHAIFWGGLTVGICNLLCGLSVGVTGSSAALADAQNPELFVKVLXVEIVGSVLGLFGLIVGLLTT

SEQ ID NO: 157755 - protein, 83 aa, Triticum aestivum
  Clone ID: PAT_TA_52173.pep
GSAVIILMPLVESWDTISMVCAGMLTNDIVYQRLDDVNLRLRAIMGAMPEAEKRYQQLQRKDEVEMHPAGTHPADDSDHLLEN

SEQ ID NO: 157756 - protein, 68 aa, Triticum aestivum
  unsure (1)..(68): unsure at all Xaa locations
  Clone ID: PAT_TA_52174.pep
XLARETRDLCCCSLEPXLTRYSRTVISASRRVVHCGSCALGPRLVFGLAFLFLLPWWGALVASPRCPP

SEQ ID NO: 157757 - protein, 58 aa, Triticum aestivum
  unsure (1)..(58): unsure at all Xaa locations
  Clone ID: PAT_TA_52175.pep
HQKALLPDKFTVLERAKIEQNLLSASKLYPKISFEEPGTMLXALDPKKAEKKASRNNF

SEQ ID NO: 157758 - protein, 79 aa, Triticum aestivum
  Clone ID: PAT_TA_52176.pep
SCARLFKRYFWSIIRSSRYRNIFQFKNFIFYFPTALQPVMFAFPKPPPPPQKTGFFKNFFFMHWIFFSWPTSLPIPVIQ

SEQ ID NO: 157759 - protein, 154 aa, Triticum aestivum
  unsure (1)..(154): unsure at all Xaa locations
  Clone ID: PAT_TA_52177.pep
LFSCVSFFSGRRFPSSACLRGGGACCRAPASLAAPGSPPAGPLPPXSRXXAXGPGRALPXPLSLVAGLPPPXLSPCPXXPRPRPGRGAPPPPARAPRPRGCPPPPLAPPSVPPPLRPPRPAXRPALPPFPPFFFPPLSLSPPPPPFFCLSPSLP

SEQ ID NO: 157760 - protein, 149 aa, Triticum aestivum
  Clone ID: PAT_TA_52178.pep
EATADCIDNEGYFHTGDIVVVDKNEHFFVVDRLKELIKYKGFQVPPAELEGILLKSPIIADCAVVGVYDSAQVTELPRAYITLKSDFQPSEKLAKEIMKYVADQVAPYKQIRSVRFIDAIPKSPAGKILRRVLRDQANLENKNGNRASL

SEQ ID NO: 157761 - protein, 85 aa, Triticum aestivum
  Clone ID: PAT_TA_52179.pep
VQQHKNRERVGEVGALAAGAFALYEGYEVKKDPAHARKHQIEAGVAGAAALGAGGYAYHEHREQKQAAYGGQQEYRMPVHNSYCN

SEQ ID NO: 157762 - protein, 64 aa, Triticum aestivum
  Clone ID: PAT_TA_52180.pep
FFFFFFYFFYFFFFFFFFFFFFFFFFFFFFFFFFFFFFFEEKGGKNSFFREKKKISIPPAREFF

SEQ ID NO: 157763 - protein, 74 aa, Triticum aestivum
  Clone ID: PAT_TA_52181.pep
GGVLIMGTLCPVCLLSPRVEPQRGRDVVLEFLFLVRFLRGQGFKPCCFGAWMGPKGGSCLLPEIALGPWGGALS

SEQ ID NO: 157764 - protein, 65 aa, Triticum aestivum
  Clone ID: PAT_TA_52182.pep
NYSPIFKLGLDELLLIRWGAIRPNFFSHYVHFFWGGAIANPAQKKGWAGVHLFFSFMGGPRGAKK

SEQ ID NO: 157765 - protein, 111 aa, Triticum aestivum
  unsure (1)..(111): unsure at all Xaa locations
  Clone ID: PAT_TA_52183.pep
GAKCSPPXRPPPAPPPWSCPPPPTRGAPAGSTXPAGRPGSANAPPASLAPGAAALVAPANEPAPRRPAGEASPRIRRTPGQATTTPSTPIISRCMGPPGRALNKIKPSCVP

SEQ ID NO: 157766 - protein, 136 aa, Triticum aestivum
  Clone ID: PAT_TA_52184.pep
SGLLWFLQLCARPHFPPDEGFPLVAGRFARPGLRGGWQAFRRRVAIPGSPRGPRLRARALCVGHGARLVVRSVPFRWSPLLVRPLCIPWVMGPPMLERGWVAVVVDNTPLPPPLVLFFHLFFRRSEHVKIVSISSL

SEQ ID NO: 157767 - protein, 160 aa, Triticum aestivum
  Clone ID: PAT_TA_52185.pep
LAQSFAKNMGLYGERVGSFSIVCADAEEKARVDSQLKIIIRPMYSNPPIHGAHIVSTVLNTPELKKEWLGEVKLMADRIITMREKLRGHLENDFGSKKSWRHITDQIGMFCYSGMTPEQVNKIKSDWHVYLTQDGRISMAGISSSNVKYLAEAIHNVTKD

SEQ ID NO: 157768 - protein, 96 aa, Triticum aestivum
  Clone ID: PAT_TA_52186.pep
DDPKEFRPERFQDKDVDFNGAHFELLPFGSGRRICPGLAMGVANVEFILANLLYCFNWELPDGVSCEDINMEEAGALTFRKKTPLMLVPTRYSMCP

SEQ ID NO: 157769 - protein, 56 aa, Triticum aestivum
  Clone ID: PAT_TA_52187.pep
KPTQGLLFPFLHRHSTTDEPGNTGSQHPPLLVMGFTHDIHFTGTHFYSVHGPPPWL

SEQ ID NO: 157770 - protein, 105 aa, Triticum aestivum
  Clone ID: PAT_TA_52188.pep
PPPRPPGGPQRSRGASPFQPKRGGAKGTPSRGPGRPRPLSSGPPLGRAGSPPPPATPRAPKSPPPPGRRGPPPPPLWGLKGDPNLGGSYLIKALFFWNPFFCKAL

SEQ ID NO: 157771 - protein, 35 aa, Triticum aestivum
  Clone ID: PAT_TA_52189.pep
AFHDDKAHGGVHIGTEVVLCKWCEGDNQRWKILPW

SEQ ID NO: 157772 - protein, 103 aa, Triticum aestivum
  unsure (1)..(103): unsure at all Xaa locations
  Clone ID: PAT_TA_52190.pep
FITGSALLGGAVKTPCIQFKNFISIIFCEVVPIYGVIKAIVYSPKINKXPPPPVNPNSNFFPGQAIFWGGLTGGNGKLKMGPPGRGNRNKGRLGLSPKTKNFF

SEQ ID NO: 157773 - protein, 117 aa, Triticum aestivum
  Clone ID: PAT_TA_52191.pep
CSFRARKNWMVGGPGPRHTRHTHFFTQSRIFLPTRRKNYKPQGPDGIRGRIGPGQWVHLWGPEINGPLAIHETNIDHFSFPKGGPCPRPGGGRGGAFPPYSFGGGGGSAFRPRAWAP

SEQ ID NO: 157774 - protein, 58 aa, Triticum aestivum
  Clone ID: PAT_TA_52192.pep
FLSGIIQAGAFEQSISYRVDHWYCPLIYSPIWTPYPRIAWHGQHTPLLTGQLNASYIR

SEQ ID NO: 157775 - protein, 204 aa, Triticum aestivum
  unsure (1)..(204): unsure at all Xaa locations
  Clone ID: PAT_TA_52193.pep
KRTLSSLTQTXVEVDSLFDGVDFQSNITRAKFEEINSAAFQGTIEPVERVLKDAKIDKKKVDEIVLVGGSTRIPKIQSLLQDVFDGKELNKSINPDEAVAYGAAVQAAVLTNQAGNEKTQDLLLLDVVPLSLGVEMQGGIMAVVVPRNSPIPCQKSKVFTTAADNQTTVTFPVYEGERLMTKENNLLGEFSLSSLIPAPRGTPE

SEQ ID NO: 157776 - protein, 163 aa, Triticum aestivum
  Clone ID: PAT_TA_52194.pep
MTPLDDKSLKIATFSLQKYLKEKDFATEFLERGGLVSLCEIIQSSSGNTLAYALNSFLSLMEHNTGWDTLDDVFVAYIANIVVTQPLSTIARPATAILEKLVCANELQEEKTGVSCFGYPTIHRAMIGEPDLIKILVDRLLSPEYLLSTSSLSLLIAMLRHAT

SEQ ID NO: 157777 - protein, 78 aa, Triticum aestivum
  Clone ID: PAT_TA_52195.pep
MSSTDAPAGTGGLAGESWQKSWPEVVGKSIKEAREIILKDKPDADIVVLPAGSPVTRDLRPNRVRIFVDTVADTPFTG

SEQ ID NO: 157778 - protein, 89 aa, Triticum aestivum
  unsure (1)..(89): unsure at all Xaa locations
  Clone ID: PAT_TA_52196.pep
FIIXRDNMGKSTIRQTTKHDPPSISDCSERRPSVTEECDSVLTRFTAQTAPEPISIRRNSRRSSATVFGISNVTFDDYVQKDLVSSSWS

SEQ ID NO: 157779 - protein, 123 aa, Triticum aestivum
  Clone ID: PAT_TA_52197.pep
MSGGGVAALQKDRNFIAVIGDEDSVTGLLLAGIGNVNQQQKRNFLVVDSKTPLNIIEDTFIEYTKRKDIAIILINQHVAEDIRELVDGHNQAFPAVLEIPSKDHPYDPEKDSILKRVKRLFGE

SEQ ID NO: 157780 - protein, 99 aa, Triticum aestivum
  Clone ID: PAT_TA_52198.pep
MSTRLAAEVRWCGGARSERPTLRRRRSGRTVQLGGRRKSGRRGCRLAVSWLVRWRLVAELLRPIKKALIEMAAGQRGLVALPLASFPFVGALSLPGAVA

SEQ ID NO: 157781 - protein, 130 aa, Triticum aestivum; identical to SEQ ID NO: 127462
  Clone ID: PAT_TA_52199.pep

SEQ ID NO: 157782 - protein, 187 aa, Triticum aestivum
  Clone ID: PAT_TA_52200.pep
MNLTGASVSESILAAHETRDIVLPNQNEHVAHVAIDIGGSLAKMVYFTSSADIKGGRLNFKKFETEKIDECIEFVAALMADVRTKSRQNNKLVLKATGGGAYLFYDKLKEKLPGVVIQKEDEMECLITGLNFFITEIPYEVFTYNEQDSDPMKFEKKTNDIYPYMLVNIGSGVSILKVTGPDEFSRI

SEQ ID NO: 157783 - protein, 135 aa, Triticum aestivum
  Clone ID: PAT_TA_52201.pep
DANGILKVTAQDKTTGRKADVTISNSTRLSAADIERMVQDAEKNAESDKQREAVVQAKQDLESYVYQVENNISDPNVNMKLRRGDREAIETALAEAMELMELNADDAQADDLKAAQSKLKRATTRAFAHVYSQRR

SEQ ID NO: 157784 - protein, 44 aa, Triticum aestivum
  Clone ID: PAT_TA_52202.pep
TTTLFYEVVDRPEILPKATILEEGRLTKLAPNYPGQPYFFQPST

SEQ ID NO: 157785 - protein, 104 aa, Triticum aestivum
  Clone ID: PAT_TA_52203.pep
YLVSCSDRLTHWFQSPQLLYWCVYCHSCLRASCVGLFSLSPMFPDDLGGGNFAQGCALHAGCTLFQVLRPRHGFRLMVILYPRFHTVCQVANNGHKVRVVAKGK

SEQ ID NO: 157786 - protein, 94 aa, Triticum aestivum
  unsure (1)..(94): unsure at all Xaa locations
  Clone ID: PAT_TA_52204.pep
TSGKKWRYYKLSTSQKTILFGDFSDKFPPVLRSFDKLTNRIELSSVYEIKQIQRYPGLSMTGSSPTGTLTEPINNNTSNYLLHSKRQKRPXSRN

SEQ ID NO: 157787 - protein, 66 aa, Triticum aestivum
  Clone ID: PAT_TA_52205.pep
YLPWFKPPAPLAGLGPIIDPARTPKQTGWAERLRVPNPIKALSRGPNRRRTPQRPINQKGTPPLPA

SEQ ID NO: 157788 - protein, 108 aa, Triticum aestivum
  Clone ID: PAT_TA_52206.pep
WAPAAPTLPSLFVDGELVGNAKELKRLHETGELASRLDGCESGGPGACQAFGNARFVLCEACSGSCKVYVDEEDHEDGEGTGDGGAGFRRCTECNENGIVRCSVCCCS

SEQ ID NO: 157789 - protein, 92 aa, Triticum aestivum
  Clone ID: PAT_TA_52207.pep
QFISPMKRYIKNLFAKLEGDALNAFKKNVESPPKYFFSKLKALQFFVGESKHKNGGVVFPHPKEGAADPTFRYFAHGLKKVKCQPPGKQKIN

SEQ ID NO: 157790 - protein, 89 aa, Triticum aestivum
  Clone ID: PAT_TA_52208.pep
PAPGTEMAQLVCGGCHTLLMYIRGATSVQCSCCHTVNLAMEANQVAHVNCGSCRMLLMYQYGARSVKCAVCSFVTSVGASSGAEQKPSN

SEQ ID NO: 157791 - protein, 62 aa, Triticum aestivum
  Clone ID: PAT_TA_52209.pep
PGERPPPMAPARQERFIPRWIAALWAPPLPHEIRAIGLSHGSQADKSLGQKLATRFSSNPGR

SEQ ID NO: 157792 - protein, 167 aa, Triticum aestivum
  Clone ID: PAT_TA_52210.pep
IDLMVGDIYGSDYTKLGLKSTRIASSFGKVFKKGVRQSQGNFQAQDIAKSLLFMVSNNIGQIAYLNAKQHNLTRIYFGGCFIRGHPITMNTLSYAINFWSNGEMKALFLRHEGHLGATGAFLKHSNIRRSRHSFSYSEHNFIPEINPNPSDVYGELEDTNVELREEE

SEQ ID NO: 157793 - protein, 99 aa, Triticum aestivum
  unsure (1)..(99): unsure at all Xaa locations
  Clone ID: PAT_TA_52211.pep
LLGVWASPYVVRVHLALHLKGVSYQVVXEDLASKSELFLRCIPVHKTARILXHSGRPVCESQGILQCIDEAFAGVGPPLLPAVPYXRSAWRFWAAYVEV

SEQ ID NO: 157794 - protein, 74 aa, Triticum aestivum
  unsure (1)..(74): unsure at all Xaa locations
  Clone ID: PAT_TA_52212.pep
LTTALGSXYEGTLLGYGISSISHYYWHLLLLLSSPSKISLTXSFILXYKALTIYLPFLGLGXMRLGASSRLHYG

SEQ ID NO: 157795 - protein, 38 aa, Triticum aestivum
  unsure (1)..(38): unsure at all Xaa locations
  Clone ID: PAT_TA_52213.pep
XHSTRDWRTALSYDISLRLDFYRSVLTSXSLVXAFASP

SEQ ID NO: 157796 - protein, 137 aa, Triticum aestivum
  Clone ID: PAT_TA_52214.pep
FVTKLSRLASRRIRWMVAVRSQQTESLSSSSTNKVVVFFLCSSIHHAHDPASLPVGNLAAPEPPSTGASQHRSRQQLLHRNTGCCSKCQHPAQQHPWQHRRRSIAIRGELQRPHDASLQPRWNFNDSHDAPLHPRVA

SEQ ID NO: 157797 - protein, 113 aa, Triticum aestivum
  Clone ID: PAT_TA_52215.pep
PPAPGRRQPSGFIHQHPRPRRGCRRRQRRRRGTPRTPGARGRGAWGPRGRLACAASYDGLLLVVEGRRDLPTGASASRFSQLGPSETLAICALSTLLPCQPPHASGWGQQEHG

SEQ ID NO: 157798 - protein, 85 aa, Triticum aestivum
  unsure (1)..(85): unsure at all Xaa locations
  Clone ID: PAT_TA_52216.pep
SWSSTRPTVEKCQEXLSKQLFYTRLASIPGRYEAFWKEVDAVKLLLKNRKDLKAEQAGVAALFGIELYAWLRAGEFIGRGFTLTG

SEQ ID NO: 157799 - protein, 87 aa, Triticum aestivum
  Clone ID: PAT_TA_52217.pep
SKNSITLCLLSFGRDCSSVAFFILCRSGLLSCEGVNEFCSGAFFRVLLMVLDQTIDSLLLHLSIYLSVYLSIYLSIYLQTAAVLVDP

SEQ ID NO: 157800 - protein, 196 aa, Triticum aestivum
  unsure (1)..(196): unsure at all Xaa locations
  Clone ID: PAT_TA_52218.pep
ELVGALVYYDGQHNDARMNVALAMTAACYGATVANHCEVVDLTKDDKGKVNGAKLRDTLNGDEWIVKAKGVINATGPFTDGLRKMDDAQNLDIVAPSAGVHIILPNYYSPRNMGLLDPATSDGRVIFFLPWQGNTIAGTTDSPTEVTQNPMPKEDEINWILDEVSHYXSADVKVRRSDVLAAWSGIRPLVRDPHAK

SEQ ID NO: 157801 - protein, 101 aa, Triticum aestivum
  Clone ID: PAT_TA_52219.pep
APSTPPHAPREKKRKASLARAAATAARAALRPAPLAGRGLGSSLPSSSPARAARLLRRWGGAGLETLLPLHTAVASARLKSCIAGDSTCWCSLSQGFKKRI

SEQ ID NO: 157802 - protein, 143 aa, Triticum aestivum
  Clone ID: PAT_TA_52220.pep
PVETFNPIRQGIHHDILLSNFFAQTEALMVGKNEEQVRAEMGTNVVENIVPHKIFKGNKPTNSFLFQKLTPATLGSLIAMYEHKIFVQGAIWDINSYDQWGVELGKQLAKAILPELSASGEVASHDASTNGLINHYKKNKKQY

SEQ ID NO: 157803 - protein, 42 aa, Triticum aestivum
  Clone ID: PAT_TA_52221.pep
QCSPTSEGFRRQPLGDHPPPIGDGGAPPSTPRLKFIIFPPFN

SEQ ID NO: 157804 - protein, 160 aa, Triticum aestivum
  Clone ID: PAT_TA_52222.pep
IDDMVAQALKSKGGFVWACKNYDGDVQSDILAQGYGSLGLMTSVLVTPDGKTMEAEAAHGTVTRHYREYQKGNPTSTNPIASIFAWTRGLGHRANLDNNKELTKFTLDLEQACIDAVQRDSVMTKDLALAIHGKNLKTEHYVTTAEFMKHVKDNLDKARQ

SEQ ID NO: 157805 - protein, 94 aa, Triticum aestivum
  Clone ID: PAT_TA_52223.pep
KCAPAGHFFGHKATSAGLKEQEAINFLEKKMKDSPQFTYDETVQIAVSALQSVLQEDFKATEIEVGVVRKEDRVFRSLTTEEIDQHLTAISERD

SEQ ID NO: 157806 - protein, 76 aa, Triticum aestivum
  Clone ID: PAT_TA_52224.pep
FFLFFFFFFFSFFFFFFFFFFFFFFFFFFFFFLEPGNKSKINKGKRQIGRKQAGVFKNNHEKIKKSSRKTGGQIRA

SEQ ID NO: 157807 - protein, 74 aa, Triticum aestivum
  Clone ID: PAT_TA_52225.pep
RGVLQGEHRPGQHAHPGLRPPARQPAAGALPPPRRQQGQPLFGALRPRRQLPRGPRDQDGLLHPIDRSTHCPPS

SEQ ID NO: 157808 - protein, 176 aa, Triticum aestivum
  unsure (1)..(176): unsure at all Xaa locations
  Clone ID: PAT_TA_52226.pep
EEERLKIERKDYAHLTFMNSGKRKFNGENKTQKKLGPSHKAESSKSGAKRSKPSVANEPSAPKKPYCKFCKHDGHKQKDCDGFKAWLVKKGIXTVRTLQRGERTLRVANGKEANVEAVGTLPLVLKDGFTLILNNAIYVPTMRRNLDDDGFETYFGNKRCVIKFGHDDIGHGVRHD

SEQ ID NO: 157809 - protein, 77 aa, Triticum aestivum
  Clone ID: PAT_TA_52227.pep
MPVSQELNVVDGEKASPWKCCDQTLCTRSAPPTCFCHDKVKKCAKTCKNCLKDESGSSLRVCGDPYFGWPGPRCHEI

SEQ ID NO: 157810 - protein, 148 aa, Triticum aestivum
  unsure (1)..(148): unsure at all Xaa locations
  Clone ID: PAT_TA_52228.pep
MGPEIGHPPHYMGSRPPAGSPKGQISLFYQKGGKWVFPTHRPKLKKRGGEQPRGEPGAGKAPPPGGGGGGQAPGPPQPNPGGGPPPREKKGGSFXKGTPGPPPGRNRGGNLTPPPPGAPGCRGGEPQEKGFWPKPRKGGGRPRGKKGP

SEQ ID NO: 157811 - protein, 79 aa, Triticum aestivum
  unsure (1)..(79): unsure at all Xaa locations
  Clone ID: PAT_TA_52229.pep
AGLKIDIKGIPKRAPFIKAMEEVYFKPQWETRSWGXKLFVQKKKASLNSFYRFRVILVKIKRGGVFWQKLSKLKKGVFS

SEQ ID NO: 157812 - protein, 138 aa, Triticum aestivum
  Clone ID: PAT_TA_52230.pep
QAKAPPKRVTGDFLVHPPKKPVSVRPRAPPWENRKHFFRAGAGFPLIVQGKALGKRSVLGPPLVQEKDPKRPLVSDLAPDFLKDPPDPPPLRGAIDPPLKDFNPPKISLFPPKGPIPVKDVLVPETMFVKNTGFFFSK

SEQ ID NO: 157813 - protein, 60 aa, Triticum aestivum
  unsure (1)..(60): unsure at all Xaa locations
  Clone ID: PAT_TA_52231.pep
EAGAKVIIIDIVVDSSSGQMFETQLLMDVAMMVXPGDDSGMKMNGVPSFGSRVSXSKMQE

SEQ ID NO: 157814 - protein, 125 aa, Triticum aestivum
  Clone ID: PAT_TA_52232.pep
GISMGNHHQDTAYSSNIHWLWGLLLSSAAVSRLATYVILYRNAPSEKTPSRPPTELVGAFLLIAGSILFMASNSGTLLWLRRNNVDSMFLMNVVVALTSITLSYVAALMIIKAWAKRREDSKRQH

SEQ ID NO: 157815 - protein, 56 aa, Triticum aestivum
  unsure (1)..(56): unsure at all Xaa locations
  Clone ID: PAT_TA_52233.pep
NQTVVDESLEKLKKVLEVYKGRLSQHENLPGEFVSFADLNHFPNTFXFRATPHAAL

SEQ ID NO: 157816 - protein, 140 aa, Triticum aestivum
  Clone ID: PAT_TA_52234.pep
VSPLVATDIPQITELDILQEEQVEKLTLHLLTALPRLNEKISHQLGLIINAQQSSRILIRQATSLVHPVDTSSVVTVEWKLRQPFQINVVRENEQSTDARSESQWLLRKLSRVEIDLLNEFNDRVQDAIQLVLESLALDI

SEQ ID NO: 157817 - protein, 127 aa, Triticum aestivum
  Clone ID: PAT_TA_52235.pep
GQFSNNRIGAMDTKIYDYELAFNVKFNLTKEERLLYKESLMTHAMVFTGVHLDKDGNPLRWRVENSWGIDTTGDKGFWVMTDEWFSSFVYQIVLEKNDIPRKLVSLLDNQPTVLPAYDPMGALACPY

SEQ ID NO: 157818 - protein, 104 aa, Triticum aestivum
  unsure (1)..(104): unsure at all Xaa locations
  Clone ID: PAT_TA_52236.pep
YHYSNCTEYHTSFIQRAKGLDREGATVPMIPSFVTGRPTGQETGSYLALDLGGTNLRVCEFELKGAGHYELRQQKYVISEELKXGDMRHLFDFIADCVDNFIFE

SEQ ID NO: 157819 - protein, 73 aa, Triticum aestivum
  unsure (1)..(73): unsure at all Xaa locations
  Clone ID: PAT_TA_52237.pep
ISPQKKTITFQTPLNKILTPKKPPLFFFFFFFFFFFIXXXFFFFFFFFFFFFFFFFFFFFLFINRLSLIQNQM

SEQ ID NO: 157820 - protein, 130 aa, Triticum aestivum
  unsure (1)..(130): unsure at all Xaa locations
  Clone ID: PAT_TA_52238.pep
NFKKKQPRELNKGHLXVFGLMGSNSFXXAXPXHYESKQIGYIKGYVRRFWQHSEDHRGTPEKPGRVVTLIPYDEWKNIESVEGHDKVTWGVAFKIPSDDAEATRAYLDHREKNGYTAHTVDVYSLEDDVT

SEQ ID NO: 157821 - protein, 61 aa, Triticum aestivum
  unsure (1)..(61): unsure at all Xaa locations
  Clone ID: PAT_TA_52239.pep
VESLYKVRYLGAGIRTQLNGEQKSIIYPFVISHPFSTPYNVHILQFXXXTXXINIKPLDIS

SEQ ID NO: 157822 - protein, 80 aa, Triticum aestivum
  Clone ID: PAT_TA_52240.pep
HYLQSNALAISITRYYLSLRVISHNLNHLFRYMNNAHTLHSYHSLISRVRNSYVRTYMTLATIYSESVIWKVMCVAHDWM

SEQ ID NO: 157823 - protein, 97 aa, Triticum aestivum
  unsure (1)..(97): unsure at all Xaa locations
  Clone ID: PAT_TA_52241.pep
GLFHREFXNLLAAADRYALDRLKIXFAPXKXCGXXVSVDTVATILAWAETYNCQELKNRCIDFFVVEENFKKAIFTDGYALLVLKFPEIIAEMKKRV

SEQ ID NO: 157824 - protein, 81 aa, Triticum aestivum
  Clone ID: PAT_TA_52242.pep
DSTYKYFEVILVDVAHSAVRNDPRINWLCKPVHKHRELRGLTSAGKKFRGLRGKGHRHHKNRPSRRATWKRNQTVSLRRYR

SEQ ID NO: 157825 - protein, 193 aa, Triticum aestivum
  Clone ID: PAT_TA_52243.pep
MAEIRRKLVIVGDGACGKTCLLIVFSKGTFPEFYVPTVFENYVADVDVDGKRVELALWDTAGQEDYDRLRPLSYPDSHVILICFAVDSPDSLDNVQEKWISEVLHFCQGLPIVLVGCKKDLRNDPNTIEELRRNSQRPVSYEEGAAVAQKISAYKYYECSAKTGEGVRDVFQEATRAALMVNKKKKKSGCTVL

SEQ ID NO: 157826 - protein, 194 aa, Triticum aestivum
  Clone ID: PAT_TA_52244.pep
KEYFQNAYKKHVNTIENSYRKQNLPIRRQSLQVFQKDYIIKKIPTQPEEKEKKQQHERRRCVSNPNLLLTVTSSKQQEDQEQPVKQSTAHKFVELLRPSKSEVTFSQKKKKPTENRLKHVFSRLQKKPALFNDQPVYTALLSCVSKEFSKRISLKPIAVKDGIEYHNTFTGSEAVDCLLNILKIRDRNFGLLIG

SEQ ID NO: 157827 - protein, 150 aa, Triticum aestivum
  Clone ID: PAT_TA_52245.pep
PNRKAFQKQAGIFQNSKDAKKRNQRWFKEVGNGFKTPKEAKVGTYIDKKCPFVGEVNIQGRILTGVVVSTKMKRTLVVRRDYLHYIPKYNRYEKRHKNISAHVSPAFDNQAIQTGDLVTIGQCRPLSKTVRFNVIKVSKAKGTAKAFNKF

SEQ ID NO: 157828 - protein, 191 aa, Triticum aestivum
  Clone ID: PAT_TA_52246.pep
QSFWADPSDFGDIFDVNHFIYSLRDEVKVIRELPQKFNGKVPLSMQPVSWSSEKYYLRQILPLVRKHKVIRFSRTDSRLANNGLPLRLQKLRCHVNYNALRFTPSIEALGNKMISSLRKTGSFVVLHLRYEMDMLAFSGCTHGCSGQETAELTRMRYAYPWWKEKEIDSEKKRLEGLCPLTPGETTLVLKA

SEQ ID NO: 157829 - protein, 76 aa, Triticum aestivum
  unsure (1)..(76): unsure at all Xaa locations
  Clone ID: PAT_TA_52247.pep
RRSLGLVLFVRDLVAGAGSSRSPPHXXLRXXPIRXGPXCAQAVAAPACAWLAAPGRGRPASARLRRRSRRRGARTL

SEQ ID NO: 157830 - protein, 117 aa, Triticum aestivum
  unsure (1)..(117): unsure at all Xaa locations
  Clone ID: PAT_TA_52248.pep
CILSRFHYTIDVLLALFITYMTWNVYLQYIREASMRYMFGFTRYASLDLFQSTMTDGAQIYQYLNWQPYLLGQDWIMTLCIYVDGLDXRXRSMGXLDEQGELVXSNIKXNXXMKTXV

SEQ ID NO: 157831 - protein, 52 aa, Triticum aestivum
  unsure (1)..(52): unsure at all Xaa locations
  Clone ID: PAT_TA_52249.pep
YIFSAYVHSLIPCPSNLQCHTSHERCLQHLYSMDPYAFYSIDHFALSVFXRD

SEQ ID NO: 157832 - protein, 194 aa, Triticum aestivum
  Clone ID: PAT_TA_52250.pep
TPRDGAPVEITGLLKSTLRWINELVKRKEFQWSSVDHIGKEDKTITYHDWNELLQTNFERVYYIPQDPAQDKDYDVISKIINRRGIYKDVYKATYAYTEYQLRPNFAVAMTVAPELFRKEHAQQTIKMCKDVLLGPLGMKTLDPADQQYRPYYHNSDDSEDFQTAKGRNYHQGPEWLWPLGYFLRAALHFHAIP

SEQ ID NO: 157833 - protein, 111 aa, Triticum aestivum
  Clone ID: PAT_TA_52251.pep
GGGFFFVGGPNHQWFRLPFKKGGLFFFPPGMFPPFPLDSGTSPKAMGLFLGEPFWGPSICPPALFPPKKGLVPQFFPKGGAPPVEACLGLLVFGTEGVFCLFFHFPPKVFE

SEQ ID NO: 157834 - protein, 98 aa, Triticum aestivum
  Clone ID: PAT_TA_52252.pep
GPLKQRGAVVRHGTVHWLIWDLVDFHAIDVDAVTGRVSLQKLPAPRPRDMEYHLYDTPRISVAADETALSSLCLFREPLRVETWTRGDGGEECGRDWA

SEQ ID NO: 157835 - protein, 137 aa, Triticum aestivum
  unsure (1)..(137): unsure at all Xaa locations
  Clone ID: PAT_TA_52253.pep
HAVRRXQIYLMPLTTVIKVTTANNNRTSTRPRYTSSPLLQRYQPRAEEQVVGKSRSRFSEYEDNIIRDGVAQGFTWGQISELLPHRKRATCFNRYRTLQGVRKSRKLGTDAISQPNDMIYQTKLSFSXVSENSXEIS

SEQ ID NO: 157836 - protein, 111 aa, Triticum aestivum
  Clone ID: PAT_TA_52254.pep
PQLSRQHGVGQGEILLLMERAGVGPREETPSPHRRPAAVAGGCLKHLTSLNDPRSLPACRLAHHPALKPSSPPYKVQSTASLSSSCWRTHSNMLSPTWTCNPSFCFHPIYC

SEQ ID NO: 157837 - protein, 120 aa, Triticum aestivum
  unsure (1)..(120): unsure at all Xaa locations
  Clone ID: PAT_TA_52255.pep
MLVYQDKLSGDELLSDSFPYRXXXXNXVLWEVDGHWGVQGAVDVDIGANPSAEGGGDDEGVDDQAVKVVDIVDTFRLQEQPAFDKKQFISHMKRYIKNLSAKLEGDDLXAFQERMLRSGH

SEQ ID NO: 157838 - protein, 193 aa, Triticum aestivum
  Clone ID: PAT_TA_52256.pep
LLPWFDGMIAADEAYFKAHGEPLFSSHMLDLSEEPVEENIETCLKYLQRMAPMGCLLEMEIGITGGEEDGVDNTGVDNSALYTQPEDIWEIYRRFSEITDLFSIAAAFGNVHGVYAPGNVKLHPELLGKHQAYVKEQLKAEDEKPVYFVFHGGSGSTREEIDVALKNGVVKMNIDTDTQWAYWKGLRDFYENK

SEQ ID NO: 157839 - protein, 125 aa, Triticum aestivum
  Clone ID: PAT_TA_52257.pep
WFKEGERKDSRVPALSQSARSGLQFPVGRIHRYLKSKGHSHSRVGAKAAVYTAAILEYLTAEVLELAGNATKDLKVKRITPRHLQLAIRGDEELDALIKATIAGGGVLPHIHKSLIGNTKTGKKM

SEQ ID NO: 157840 - protein, 120 aa, Triticum aestivum
  unsure (1)..(120): unsure at all Xaa locations
  Clone ID: PAT_TA_52258.pep
VVTVDEDKMPVFYGGGAHINLKVNGLDGIEVFFTIKRSTQLEXLMNAYCDRXSVDLNFIAFLFDGAMLTGEQXPLHDLEMEEGDQIDSLLNTTGGCFLGPYKELCCTLIDLCRTLPLELE

SEQ ID NO: 157841 - protein, 144 aa, Triticum aestivum
  unsure (1)..(144): unsure at all Xaa locations
  Clone ID: PAT_TA_52259.pep
SVPRSAQRPLLPHPTHTARVNFPPTTTRSELQHGRQCYPXXVSDEXYLAAVAKAKRKLRGFIAEKNCAPLMLRLAWHSAGTFDVATKTGGPFGTMKCPAELAHGANAGLDIAVRLLEPIKEQFPILSYADFYQLAGVVAVEVTG

SEQ ID NO: 157842 - protein, 80 aa, Triticum aestivum
  unsure (1)..(80): unsure at all Xaa locations
  Clone ID: PAT_TA_52260.pep
LAXCCXXPLXRXXAXGXSFLXSSXSLXPRGASVXPXXGXFPLXPXAAVVVPGXRLCSRXXXPPCXXXGPXPXXAVXVAPR

SEQ ID NO: 157843 - protein, 105 aa, Triticum aestivum
  unsure (1)..(105): unsure at all Xaa locations
  Clone ID: PAT_TA_52261.pep
MSSAPAPPPPPPXXLXPXDEGRXREATEVDDRVAFHVDPFLVEALXNPXHRLMILXVELVLLNFMXNVXLGEFGLQGFXACXLWCGGGGVXQVFGFEFCLVGLGG

SEQ ID NO: 157844 - protein, 68 aa, Triticum aestivum
  unsure (1)..(68): unsure at all Xaa locations
  Clone ID: PAT_TA_52262.pep
NKIIKKKKKTHKKKKTQKPKKKHPKQKQQKKKQKKPPKKKXKKTKKTPTKTXKKKKPQPPQKHQNHHK

SEQ ID NO: 157845 - protein, 141 aa, Triticum aestivum
  unsure (1)..(141): unsure at all Xaa locations
  Clone ID: PAT_TA_52263.pep
RPSGSPSVRTNLFFRNCLGSLVDNNLLGTGKYLXAAIYGHAGGVWATSAGFQCTFESRNMWGANPKSPAHGIHVAGEKTLXIRADERSIYGKKGADGICIVKTTQAFLVCTYKEGIQPGNCTKVVXEALADYLGSLWGFLN

SEQ ID NO: 157846 - protein, 143 aa, Triticum aestivum
  unsure (1)..(143): unsure at all Xaa locations
  Clone ID: PAT_TA_52264.pep
TTGFIIPFSGVSLCLLVSSMXLGSSAVPVSGKSGSSTTGPSLGIWDNSALPPLISSRGAPPSNKGSKSDLQAEPYYMQKNTEWYESHGGNLTSIGKRDDNLVGGMTLDLPSDAPPISLSGSTNSASDGGKVVAATTAQIQEFT

SEQ ID NO: 157847 - protein, 57 aa, Triticum aestivum
  Clone ID: PAT_TA_52265.pep
RNMNASPGLLPATFQNKLQMQLIKQLLIYCGPGRRQGSKLSITKVASVYLSYVDIYP

SEQ ID NO: 157848 - protein, 155 aa, Triticum aestivum
  unsure (1)..(155): unsure at all Xaa locations
  Clone ID: PAT_TA_52266.pep
MAMTKRSSSSMSSNSSIHSYSSASNVRASCYSVNAATASLHGFHYSTTPSAGAGWXPEVSSGIPSPPSSPPLAAKNASTAQGGKARRGGAAYTITGECERLFCETLRSVFLGEGSQHRQNSLVMGMPYDNTTTATTAITNDYGVDARRYSDSSTD

SEQ ID NO: 157849 - protein, 133 aa, Triticum aestivum
  Clone ID: PAT_TA_52267.pep
KKRGKNKKRGGKRREKKKKKGGKGKGKGKGKRARKKHTPRGKKTAKRGEAIAKGAVQMLGKGKKGGQMRKKQTGEKGKFFKKKKMGKSKVYSRKGGVKKKAKGVKLGAPKKKLNETQKRVSKLGTRKKDPPFF

SEQ ID NO: 157850 - protein, 62 aa, Triticum aestivum
  unsure (1)..(62): unsure at all Xaa locations
  Clone ID: PAT_TA_52268.pep
TILLEWTVRSLRAIACIGMVVLPEHEIVNISILITCMENNHQXTSSCNVSPQPALHELRCNV

SEQ ID NO: 157851 - protein, 181 aa, Triticum aestivum
  unsure (1)..(181): unsure at all Xaa locations
  Clone ID: PAT_TA_52269.pep
MSPXTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTYSKTFQGPPHGIQVERDKLNKYGRPLLGCTIKPKLGLS

SEQ ID NO: 157852 - protein, 135 aa, Triticum aestivum
  unsure (1)..(135): unsure at all Xaa locations
  Clone ID: PAT_TA_52270.pep
SSLGSVCVSDLACPDQFVVDSAVALAHLNLLIHIDFGTVPVANSADPRHQVDPGTPFAPHLRGFQVVPXFDMTWPSKTVTSMNXXPEPVAXSTTLPPRXVSCARFTFFPWXXLSCXCXRRWTWFLGCPPGVWLIV

SEQ ID NO: 157853 - protein, 139 aa, Triticum aestivum
  Clone ID: PAT_TA_52271.pep
KLVKSLYEGDYKTFFGALGEVETNFLSQDRYMYEHRGWYVREMRLRGYQQLLQSYRVVGLESMAKDFGVTVDFLDKDLARFIAADRIPCTIDRVKGIIETNRPDDKNKQYADVVKQGDQLITKLQKYGQAVRLRGSERG

SEQ ID NO: 157854 - protein, 135 aa, Triticum aestivum
  Clone ID: PAT_TA_52272.pep
RRGRTRGRTRGGSQDFFDLSVIDGFNTPMSFQPVAGAPCRAATCAVDITRECLPELQVPGGCASACGKFGGDTYCCRGQFEHNCPPTNYSRFFKGKCPDAYSYAKDDQTSTFTCPAGTNYQIVLCPARNDLHMDQ

SEQ ID NO: 157855 - protein, 75 aa, Triticum aestivum
  Clone ID: PAT_TA_52273.pep
YELLLDAHTQHKQNILIQPPSKDKLDLTSSQAVSTNRNNPKGITGAIITFSYRWSDAEEAVAVYWRMTARSSPAD

SEQ ID NO: 157856 - protein, 198 aa, Triticum aestivum
  unsure (1)..(198): unsure at all Xaa locations
  Clone ID: PAT_TA_52274.pep
LAIASSTLAQSTNACDPNTCKLPNCLCPSQTPPGGLSPKDVPQFVTITFDDSIQPQLLAXHKDLLNVKNPNGCAAKGSWYVSMQYTDFALVQQWYANGNEVADHTFTHVGSPSSQEIAAARAMLNQYGGVPLGKIKGFRAPFLNYTTDTLREISKQGFQYDTXVTADVDDCYWPYTLDYGLPNDCWNNVCGTQLKLPG

SEQ ID NO: 157857 - protein, 140 aa, Triticum aestivum
  unsure (1)..(140): unsure at all Xaa locations
  Clone ID: PAT_TA_52275.pep
RRTNQAFSSSESTLKTLTGKTITLEVXESSDTIDNVKGRRIQXTRXGIPPDQQRLIFAGKQLEDGRTLADYNIQKESTLHLVLRLRGXMQIFVKTLTGKTITLEVESSDTIDNVKAXKIQDKEGIPPEPSSASSLLGKQL

SEQ ID NO: 157858 - protein, 159 aa, Triticum aestivum
  Clone ID: PAT_TA_52276.pep
PTRPEYINALSSNVEYLASRDATIMGSRNGHAPIFLWYTLNRKGYRGFQKEVQKCLRNAHYLKDRLKDAGISAMLNELSSTVVFERPKDEEFVRRWQLACEGSISHVVVMPSVNVDKLDTFLNELVEKRVTWYQEGKCQSPCIAADVGQENCLCTLHKT

SEQ ID NO: 157859 - protein, 165 aa, Triticum aestivum
  Clone ID: PAT_TA_52277.pep
MPPKFDPSEVKIIYLRATGGEVGASSALAPKIGPLGLSPKKVGEDIAKGTKDWKGLRVTVQLTIQNRQAQVSVVPSASSLVIKALKEPLRDRKKEKNIKHSGNISLDDVIEIARTMRFKSLARELKGTVKEILGTAFSVGCTVEGQNPKDLCDAIDAGEVEIPEK

SEQ ID NO: 157860 - protein, 73 aa, Triticum aestivum
  Clone ID: PAT_TA_52278.pep
VTQLTHHGMLFVPVGYTHGAGMFAMDEVKGGSPYGAGIFAGADGSRVPSDAELALAAHQGKYFAGIAKKLKAV

SEQ ID NO: 157861 - protein, 78 aa, Triticum aestivum
  unsure (1)..(78): unsure at all Xaa locations
  Clone ID: PAT_TA_52279.pep
FVGVYIARQFHANYSDQFVSISRADVPSCRFYSIQLSQSFLLNHYSFSTFITSWTWQERAGYCSHFQAXXPEXXXLXX

SEQ ID NO: 157862 - protein, 135 aa, Triticum aestivum
  Clone ID: PAT_TA_52280.pep
VVLERQGDYVFTANQYGEYSFCFSNEMSTFAEKLVDFEILVEHELRPQFKKDEKEQPKTLTEMEESIFKLSTSLTNIARTQRYFRTRENRNSVTVFSTGDRLFWFFILSSLAIISMAALQIFIIKSFFNTKKGGV

SEQ ID NO: 157863 - protein, 155 aa, Triticum aestivum
  Clone ID: PAT_TA_52281.pep
MESLKKFQYAEFQPPKDFEWILSAIKLTAEYKTITEKNIGEEADMAQRGWRRLEAGLYTLQEIGAEGHNTLQPKKDPIRFKLKSYSRIDINENEGEGLKVAVRDVRAGTVFLIYFRISRNYFTLKPGEIYHYDATKAYVSPSFSIPASHVVMMIG

SEQ ID NO: 157864 - protein, 164 aa, Triticum aestivum
  Clone ID: PAT_TA_52282.pep
MGFDVGVVPFNPDGWGPPDAPGAAPLLGGAVATASIPFAPFSRSDKLGRIADWTRNPGHPGAHGHHAAAASRDSVFDFSSADDSLAAAAEDSSFSLVDAKPPPKHPRFGPKWRFNQRPQLPQRRDEEVEAKRREAEKERARRERHYQNHRSHHHQGFRGNQQNT

SEQ ID NO: 157865 - protein, 184 aa, Triticum aestivum
  Clone ID: PAT_TA_52283.pep
IYFIIKFIFLQFYPCFISFKAIKLNQQEDFVALLTFWIVSILFLSVEYFTDIFLFWIPFYTEIKLLILLWLILPQTQGAFIFYQRYLNPFFNQHEKTIEQTLISVQNSLKTMVLSWFKRVIPSSMITNEEIKEERTILNPYSLFSYSMKAEGKSSSIATSDSDNGDNTWSAYFSSWIWKNSKIE

SEQ ID NO: 157866 - protein, 195 aa, Triticum aestivum
  Clone ID: PAT_TA_52284.pep
LIYSRILLFISIVHTLELGQTCDPAPLYKSGTFEYDDSCSNIYLFCDPTTNKCNYKGCSNSDYIKNWDTRFRHIPTRCNSSSFCPDNNSQCTPLLSVGAHCELQRDDECAGSNAICLNSTCFIKGAPLGGNCGADTTVYYSQDADENMVQQTIIRDNCTDGTYCLGSTCVVSKPLNSACDQDRECLSGSCSNDGL

SEQ ID NO: 157867 - protein, 126 aa, Triticum aestivum
  Clone ID: PAT_TA_52285.pep
GLLTLCMRAFHLFLLCFLGFILIEPSVLLGWAPGLTGGGFGVSLFFCFSPFSLLASWGIGREGSPFPLLSIFFAFWDVVCRVVLALWGGGVWGICSVYFVSFLGPCRCLFSLFFFVLLGGFSPFCL

SEQ ID NO: 157868 - protein, 202 aa, Triticum aestivum
  unsure (1)..(202): unsure at all Xaa locations
  Clone ID: PAT_TA_52286.pep
IERYKERSQTASFYEYLVQLEDNTTFSSISEKSEFITCLLDDLRKQTDWDEKTSAKALSILKILGRNVDGSDPLFTKEAMNLLSKLAGLQQQKEILDTLTSREALKCIVNSIYLKSELKKYLEPTIESLQNLLCNDTSQETQFLTCRILFLLTVNRIDLVKQVMKLDIAKGIEKVLLENVSILKDKNSQPIDQNTLINPAXC

SEQ ID NO: 157869 - protein, 120 aa, Triticum aestivum
  Clone ID: PAT_TA_52287.pep
MAIKKGGAAGLKQILKRCSSLGRRQQQQGHGQEQRHWEEEEEAAPSDVPRGHFAVYVGESRRRFVVPIAVLDRPEFRSLLRRAEEEFGFGGAGDLLVLPCEELAFRSLCSASSLPCAAAR

SEQ ID NO: 157870 - protein, 68 aa, Triticum aestivum
  unsure (1)..(68): unsure at all Xaa locations
  Clone ID: PAT_TA_52288.pep
KRXFLEGGCLFRFLCCYWVLXQAPLNAGIAITSPVLSTEIKGGSNLQRGRLKKRAMKMVGEGSATDSY

SEQ ID NO: 157871 - protein, 54 aa, Triticum aestivum
  unsure (1)..(54): unsure at all Xaa locations
  Clone ID: PAT_TA_52289.pep
VPPLASRQEPHGELNRLRQFKPILTRFISLKSSCLNLILLVEPWNLXVANSENR

SEQ ID NO: 157872 - protein, 200 aa, Triticum aestivum
  Clone ID: PAT_TA_52290.pep
RFVWLYLCDTPMPEVLEKHGDYRTMFSIVFGLAAKDLDVTLTWDFFDVVEAQEYPSLKAIGNRTYDAIVLTGSKYNAHDNTPWIVKLVDFLKTMRVEYNQSVRLVGICFGHQIILRSSGGTTGRNEKGWEVGYTEIQLTSFGKTFFDTDRTFLRVNQFHQDHVSKLPDGFQTLAFTENNTPHHATVSDDRQCITVQGHPE

SEQ ID NO: 157873 - protein, 65 aa, Triticum aestivum
  unsure (1)..(65): unsure at all Xaa locations
  Clone ID: PAT_TA_52291.pep
HSIXSIXSTPXPSXQFINKTYIPPXXLIXXNIXXSSXHTXTKXGFXIXLXIPSFLILFTFSFLYL

SEQ ID NO: 157874 - protein, 85 aa, Triticum aestivum
  unsure (1)..(85): unsure at all Xaa locations
  Clone ID: PAT_TA_52292.pep
SEIRVDQRPQTTVQLRRRPPASTSAAPTATSSRSTSALKAARPKSAAEYPTLLSXNHRAPPTPSPTRSSASSTRRPTPRPPRPSA

SEQ ID NO: 157875 - protein, 80 aa, Triticum aestivum
  unsure (1)..(80): unsure at all Xaa locations
  Clone ID: PAT_TA_52293.pep
EAXPRHGDRGGRQLLHPSRFSKHVXPFHPDRYPPKLNPPTTLTASXQKLQXSGTGMGHRXPITWXPYLXFYHGTPKRGLT

SEQ ID NO: 157876 - protein, 194 aa, Triticum aestivum
  Clone ID: PAT_TA_52294.pep
IHFSPPPPATDPEGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHS

SEQ ID NO: 157877 - protein, 133 aa, Triticum aestivum
  unsure (1)..(133): unsure at all Xaa locations
  Clone ID: PAT_TA_52295.pep
MGKIKIGINGFGRIGRLVARVALQSDDVELVAVNDPFITTEYMTYMFKYDTVHXHWKHSDXKLKDDKTLXFXEKPVXXXXVRNPEEXXWGEVGADYVVXFMGVLIXKDKGGVDLKGGGXXVVYVWLWFRCGYV

SEQ ID NO: 157878 - protein, 154 aa, Triticum aestivum
  unsure (1)..(154): unsure at all Xaa locations
  Clone ID: PAT_TA_52296.pep
PPQKHHKHTPQPQHHHNTTQPPHNPQPPQTPQPQQDSAQQPTSLTQNNPPTSHHHPKNLRTHTLIXPSPIVKTLPTPEHEPRIIDLNSHXTFLTLTQWLYTLWPAPLLKKLLKSXGSSFPMTIXRHGXNGWVLLLATEGXGICRHSLVXLGFAX

SEQ ID NO: 157879 - protein, 68 aa, Triticum aestivum
  Clone ID: PAT_TA_52297.pep
KKKKKKKKKQKQKKNKHQQKNNQPKKKKTKKNKKKTTTNKKKQKNTNTINKKQHNLTINNPKNISPII

SEQ ID NO: 157880 - protein, 75 aa, Triticum aestivum
  unsure (1)..(75): unsure at all Xaa locations
  Clone ID: PAT_TA_52298.pep
FLILPSLPXYXINKXXHHKXKXXNKPXIHPXXXXXXXXXYNXNHXTXSHHFPFFFQTRXSIYISFSXISFFLVHL

SEQ ID NO: 157881 - protein, 104 aa, Triticum aestivum
  unsure (1)..(104): unsure at all Xaa locations
  Clone ID: PAT_TA_52299.pep
LFHKNNHINILKNILYKHIKHILILHLYNNPHQPTLTIIPNLLHXIHNKKPFXKXQPLPQTQQSSSXKYPSPSKPQHQHXXSQPTXTPFKLLLNXYFFXFQYFL

SEQ ID NO: 157882 - protein, 72 aa, Triticum aestivum
  unsure (1)..(72): unsure at all Xaa locations
  Clone ID: PAT_TA_52300.pep
SKKTXFXFLPHPPNIKRSSLGNLIIIXFHFHTQLTPXXNXXIITRXXTPNNFXSAPLGTALPQPXRXPRXPR

SEQ ID NO: 157883 - protein, 195 aa, Triticum aestivum
  unsure (1)..(195): unsure at all Xaa locations
  Clone ID: PAT_TA_52301.pep
SLFWVLLCIILTKVTAMVQHCIDPSNCQFFPLHSCFATEEGLVCKSRDKPGFEMSMDPAYTLLYSHIYLQNDTGLPCFSIPITDELINYVDYRGPDVIDVEDLPLIGNCSRLSFCDKKTKTCQPKRPVGSHCRHNMQCIVGDGGIPGHCSNKSICEVRHDLPAYYYDSTHQWKMGEEWXAATIALVVSGMIVLCI

SEQ ID NO: 157884 - protein, 111 aa, Triticum aestivum
  unsure (1)..(111): unsure at all Xaa locations
  Clone ID: PAT_TA_52302.pep
NHSHKITLHTNTTPFNFNQHSKHLLPIQPIILLSNTNILQPHLXKIFXQXILSNXXKFXXNNNXXTXXTXNXNLTLXTTQPNXLXXHXXXHKLIPFLIAXXYSPTNPTXPK

SEQ ID NO: 157885 - protein, 90 aa, Triticum aestivum
  unsure (1)..(90): unsure at all Xaa locations
  Clone ID: PAT_TA_52303.pep
LIKSMMRWAVKYLGEYTSIGGNGFNMLCRLVRKVFVLLEIYVSEGYTLLCVGGDWIGSLVLQGDRNLFLEXLXSXVXMFVFNWRMGWGIW

SEQ ID NO: 157886 - protein, 72 aa, Triticum aestivum
  unsure (1)..(72): unsure at all Xaa locations
  Clone ID: PAT_TA_52304.pep
PPPXXXTIVNKSTXXNFXXXSNLPTDIWPXVASTATSTSRLTKSVTPQQRPNTRSTHAXAXXLGXTRXXSGT

SEQ ID NO: 157887 - protein, 127 aa, Triticum aestivum
  unsure (1)..(127): unsure at all Xaa locations
  Clone ID: PAT_TA_52305.pep
XTIFFTQXGGGPXTVTGVSPDSGRAPGFHVHALGDTTXGCMSTXXHTXNPAGHVHGAREREIRHAGDLGNVTAGVDGVASINITDCHIPLTGPNSIVGRAVVVHGDADDLGKGGHELSKSTXKRWCT

SEQ ID NO: 157888 - protein, 57 aa, Triticum aestivum
  unsure (1)..(57): unsure at all Xaa locations
  Clone ID: PAT_TA_52306.pep
CNNCRSFSGVDVCDDAHPQCPKGCSXCXVVTPSPYKTFRCADMKSTVDGYWXGPCKK

SEQ ID NO: 157889 - protein, 147 aa, Triticum aestivum
  unsure (1)..(147): unsure at all Xaa locations
  Clone ID: PAT_TA_52307.pep
GVNTFSPEGRLFXVEYAIEAIKLGTTXIGVQTFEGXXLVVEKRVFFXLLEPSSIEKIMEIDEXLGCVVSGMTVDARIMIEHXXSXCXXHGFTYEEKLKVESVIXSVCDLVLRFGEGXEGEELIMSXFFGVXLXIGGXDENGFEVFYG

SEQ ID NO: 157890 - protein, 207 aa, Triticum aestivum
  unsure (1)..(207): unsure at all Xaa locations
  Clone ID: PAT_TA_52308.pep
KKKKKKIXKKKKKKKKKKKKKXXKXKNKKKKKKKXXKKKKKKKKKKKKKKKKREKKKXXKKKKXKXKKKKKKKKKKKKKKKKKKKKKKKKXKKKKKKXXKKKKXXKKXXXXKRKEKXNKKKKKRXXKNKKQXKNKNKKSIKSTXXNQSHPRENRTATHSNTKTERPTDANTRQQRDAHAPPTLRPRVPDAWADAWADAWADGGRPGG

SEQ ID NO: 157891 - protein, 187 aa, Triticum aestivum
  unsure (1)..(187): unsure at all Xaa locations
  Clone ID: PAT_TA_52309.pep
VTKVHARQIFDSRGNPTVEVEVTTAKGVFRAAVPSGAXTGIHEALELRDGDKSQYMGKGVTKAVNNVNSVIXPXLIESKIPVTEQKAIDDXLIXLDGTPNKGKLGANXILGVXFAVXKGXXGDKGXLFYVXFXDLVXXKKXXVFXVXVLNVMXGGFDXGXKFXMQEFMIXFSGAKRFKEVMKIGCEV

SEQ ID NO: 157892 - protein, 76 aa, Triticum aestivum
  unsure (1)..(76): unsure at all Xaa locations
  Clone ID: PAT_TA_52310.pep
KKTAGAVLAXXRRRRRLPSPRLPPATPTQAPTSSISITTPIFGGATTTSQPXXXRKAAKPPLELLLKANKTKLWSG

SEQ ID NO: 157893 - protein, 87 aa, Triticum aestivum
  unsure (1)..(87): unsure at all Xaa locations
  Clone ID: PAT_TA_52311.pep
KIKKPEXNKTVLQCKVVSLIRLEKYKEALTLIARQFRKADIDMSYEKIYCYYRTNQFVPAMELLEQVKSTNKDSSLLYLESTNSLTL

SEQ ID NO: 157894 - protein, 117 aa, Triticum aestivum
  unsure (1)..(117): unsure at all Xaa locations
  Clone ID: PAT_TA_52312.pep
GGSWWCALVLKVMGAKRTIEVGVYTGCSVLVSALVIPDDGXVSSRIDVWMEYLGGGLPVIKKVWVGHKGVFREGPVGPLLDKFMXVEDEGSFVFGFVDAVXFMYGFFHERVMLFGRV

SEQ ID NO: 157895 - protein, 90 aa, Triticum aestivum
  unsure (1)..(90): unsure at all Xaa locations
  Clone ID: PAT_TA_52313.pep
LTVLAVGDWGRGGQYNQTLVAEQMGVVGEKLAXDFVIXTGDNFYNDXLAGDNDTXXLMGCLTDXYTXCRLQKPWYMVLGXXDYTXEALXQ

SEQ ID NO: 157896 - protein, 118 aa, Triticum aestivum
  unsure (1)..(118): unsure at all Xaa locations
  Clone ID: PAT_TA_52314.pep
PSVRAVQLGRVRXVVVASPGAAKXVLRKNDLHCCSRPNSTRCKGMLXSYNFLDVAFGPYSDYWRAMRKLLVLELLSMRRVQSFAYARAAEVDRLVSSLAGTPPGTPVDLSEKLYALSD

SEQ ID NO: 157897 - protein, 186 aa, Triticum aestivum
  Clone ID: PAT_TA_52315.pep
PTRPHGSYHHPLARALQGERTLTKEMLMYPIFISDDENALEHIDALPGQYRIGINKLKEFIAPLYNKGLKSVMLFGVPLKEGVKDPTGSRADDPEGPTILSVRLLRKEFPNLFVGCDVCLCEYTSHGHCGILREDGTLNNDLSVQRIQQVAVNYAKAGAQCLAPSDMMDGRIKAIKEGLMEAGLAH

SEQ ID NO: 157898 - protein, 77 aa, Triticum aestivum
  unsure (1)..(77): unsure at all Xaa locations
  Clone ID: PAT_TA_52316.pep
KKPSNKPSFXPSILPTTKYIASYPPNCAPQPGPCLRGPRSRAGSTGVQSRWYQPRQHAPPITRAVAAAVPSRVTSGR

SEQ ID NO: 157899 - protein, 53 aa, Triticum aestivum
  Clone ID: PAT_TA_52317.pep
MPSANGSSDGYVGFGLYWTSDGYRVGLGMLSRSMFLLSWYCGMEGSSAKCSGL

SEQ ID NO: 157900 - protein, 91 aa, Triticum aestivum
  Clone ID: PAT_TA_52318.pep
PRGCWRQKATPGCLLSSDGAGAPIRVAPTEHAGHLIVQRRQASYHQGQLQGRQCGYERQRDPSPHSWARGVSYAHGKRAGGVCSCVYGTSA

SEQ ID NO: 157901 - protein, 135 aa, Triticum aestivum
  Clone ID: PAT_TA_52319.pep
FLSFTERGLLVLNCASFFRRSSTVCCCCSFLAEVYQVQNIILARSCPVLCLVLLSRMCAVVYFVVPVLETLAARCALPALFYLYEVTEDGSVLAGVELELPLEGVGAVSRRQFFWSTAWRGCVGAYDHAAVQAIN

SEQ ID NO: 157902 - protein, 175 aa, Triticum aestivum
  Clone ID: PAT_TA_52320.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHI

SEQ ID NO: 157903 - protein, 188 aa, Triticum aestivum
  Clone ID: PAT_TA_52321.pep
MAASLQAAATLMPARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEEKDGIDYAAVTVQLPGGERVPFLFTVKQLV

SEQ ID NO: 157904 - protein, 100 aa, Triticum aestivum
  Clone ID: PAT_TA_52322.pep
LQIQAIIYIKIQDIHVDKKIVFGALPLPSPLLSFTCSSIGHVFAFLSSILSSLMYGCIRLEIYNPMMVMGGLLQLQPRKSRNQGTHWHYSSSRCHIDLLL

SEQ ID NO: 157905 - protein, 191 aa, Triticum aestivum
  Clone ID: PAT_TA_52323.pep
ETVDDNEMDLPDDPANDDLQNAVQNSIEMENGSFNSQDETSVGSGPLSVAFGFVTRLASEIFARGKKHLDGSNSDAMDEVESQQSNEVSESGDDIDKNEDENRMAASESTTVTTNDTNAEKSVDVVMADEPADSDCLKHFDVLQCPPDHHYLENIAHGTGGRKWVKKVQQEWGILEKNLPDYIYVRVFEDR

SEQ ID NO: 157906 - protein, 38 aa, Triticum aestivum
  Clone ID: PAT_TA_52324.pep
LVWILRVYYDDDHIDQSIVNEIIEERAGYACALPPIFR

SEQ ID NO: 157907 - protein, 195 aa, Triticum aestivum
  Clone ID: PAT_TA_52325.pep
HASAVEIEAEDVIRLILQFLKENQFEETAATLESETSVKIDTIQNKDQFIREIKQGEWDIVLRHVVDLKIPAQKLIDLYEHIILELAELRELGAARTLLRQTEPMYILKQRFPERYLRLEHTLSRTSLDSREIYPNGMTKEKRRQTIAQALINEVTIVEPSRLMTLLGDCIKWQQQQGLLPMNEPFDLFRDSDKV

SEQ ID NO: 157908 - protein, 183 aa, Triticum aestivum
  Clone ID: PAT_TA_52326.pep
YVARDTCMYDSGTEKAADSAFDIDRYDDTGAVRYNGVNPYQNKLPSSGGKESSVKRYNKPEGAAGVRSGRSIAQDTHASSGPRPSEKILNISANNNTRNPPYHETARNVGTFEHQVPIGKKDVGSIKSNATGAHAKVTRMTDKSKDLVHSSSLLEAAKASSVAGGSTGQPESAPDFKTVFVSN

SEQ ID NO: 157909 - protein, 194 aa, Triticum aestivum
  Clone ID: PAT_TA_52327.pep
LKDKRVLIRVDFNVPMKDGAITNNNRIVQALPTVKYALDNGASAVILMSHLGRPNGEAVAKYSLKPVAAEVEKLLGKPVEFLNDCVGTDVEKTCQSAKDGKVILLENLRFHIEEEGSAKVDGQKVKADAEAVKKFRASLTTLADIYINDAFGTAHRAHSSMVGVNLSQRAARFLMQKELEYFAKALENPSRPFL

SEQ ID NO: 157910 - protein, 67 aa, Triticum aestivum
  Clone ID: PAT_TA_52328.pep
CLYPFSVLSLSLDPLISEVILVCDLLFYQSVSLQVLIIVIYIRQEQCQDTCEIESVACVLFFFPAWA

SEQ ID NO: 157911 - protein, 135 aa, Triticum aestivum
  Clone ID: PAT_TA_52329.pep
PRGPPGGGGSSFFPSSSGWLQTPPPPPLTPPWTNAATSRHLPRAPRPGPPLFEKFIPPPRQSVNCPRPITLFCCKALSELIHGPDSLWPPSFYHCPPGKKPPVLFFLDPSGWPHQDEFSFTPPGSVPPPPGEAPF

SEQ ID NO: 157912 - protein, 179 aa, Triticum aestivum
  unsure (1)..(179): unsure at all Xaa locations
  Clone ID: PAT_TA_52330.pep
MEFKAAVFTAAVLAVLLCSPASAQKSPPAPAPRYVDLAALLDVAGPFHTFLGYLQKTKVIETFQAQANKTDEGITIFVPKDSAFAALKKSTFSNLTSDQLKTLLLYHAFPKYYPLAQFRNLSSLNPVNTFAGSPYTLNLTDDMGSISVESMWSKPKISSSVYATKPIXVYFINKVLLPM

SEQ ID NO: 157913 - protein, 176 aa, Triticum aestivum
  Clone ID: PAT_TA_52331.pep
MFDATQEHKTETKFTFWSNSATSLSLVLLSIFEAAIVISLEAVIYANFSQTAFSKNNLGLGIPVYLLIFILSQIYQVFTAWDAIRAQNLIQVIAFLLFNLCCFAYAVFQFKQIADALDSKNQGLEEVASWLKSFIYRLLIAVAVITGVCQLVYLYLGARLYQEFGWVIYKRIGADP

SEQ ID NO: 157914 - protein, 137 aa, Triticum aestivum; identical to SEQ ID NO: 116400
  Clone ID: PAT_TA_52332.pep

SEQ ID NO: 157915 - protein, 169 aa, Triticum aestivum
  Clone ID: PAT_TA_52333.pep
KRVHIRFSPLLTVFPYYPHIFPSFLFLHMPDNNAGVEPLKKRAKIVSACAECRRKKTNCSGEQPCRTCQKSAANCLYPTALQNDEKRNGLTRVALESIEERLIIIEDMLTALSSNQSTIDPYLQRLPSIHNLSAPTAYDNKYYSTTLSGTQTSSTLNQITKKRKRNSKG

SEQ ID NO: 157916 - protein, 193 aa, Triticum aestivum
  Clone ID: PAT_TA_52334.pep
LASRLQQVTSHLVPSSNVANKIGVKSPEDVVIVAALRTAITRARKGGFKDTLPEEMLAGVFKGLIEQTKIDPAIVNDIAVGNVLPPGGGATNARMAALYAGFPETSSVSTLNRQCSSGLQAVVQIATAIQAGLIEVGIGAGVESMTKNYGAASLAPTSEKIADNCPSAADCLLPMGITSENVAAEFKVTRAKQ

SEQ ID NO: 157917 - protein, 174 aa, Triticum aestivum
  unsure (1)..(174): unsure at all Xaa locations
  Clone ID: PAT_TA_52335.pep
TPVVVLXSAMGKTTNNHLLAGEKAVSCGAPKASEINELAVIKKLHLRTIDELXGLDSSIVSGFLDELEQLLKGVAMMKELTLRTRDYLVSFGECMSTRIFSAYLNKLGKKARQYDAFDLGFITTDDFTNADILEATYPAVAKRLHGDWIDDPAIPIVTGFLGKGVGNHAAVHNV

SEQ ID NO: 157918 - protein, 47 aa, Triticum aestivum
  Clone ID: PAT_TA_52336.pep
PLVTIKTYIVDILYNIMRPCIYIAADSIHIRACFFAHASAHASADAW

SEQ ID NO: 157919 - protein, 193 aa, Triticum aestivum
  Clone ID: PAT_TA_52337.pep
MPPPSLPLLLPFSSPFLHPLPTSASRLRRSLSLSLSPCPRPLASPSPSFAVAAVNDDDYDYDDDVVLGDCLVFEDEAFEAPDLDIGRPSPRPSRAARGGGSLVPERWKDAVEEINLTKKEKRRIAHGLRFGSRLDRRVPSAVAAPDEYRAYREGRLDAELGHGARDYLVSPLESKSRAYSEVRLDTEPGRAVR

SEQ ID NO: 157920 - protein, 163 aa, Triticum aestivum
  Clone ID: PAT_TA_52338.pep
MWSTDSDLDESASTTTAATSSLSSSCSLQPQTPPPPRRRRSRNRRRAQRRVKNGPEVEESEAEAEAEEVWCGAQWEAAWPRRARPVVLAGEDAAPDRAGAGAGDSGVGRARSLTDDDLEELKGCVDLGFGFSYNEIPELCGTLPALELCYSMSQRFLDEHQPP

SEQ ID NO: 157921 - protein, 112 aa, Triticum aestivum
  Clone ID: PAT_TA_52339.pep
MTPRPSSSSRRLQMNLLLKEAAMVDVWTEVDAHTYNPAISPIVYECLINPLMRGLPTNQTVVDESLEKLKKVLEVYEARLSRHEYLAGDFVSFADLNHFPYTFYFMATPHAA

SEQ ID NO: 157922 - protein, 113 aa, Triticum aestivum
  Clone ID: PAT_TA_52340.pep
VFGVPLEELGKASENKIPQFISTLLAAIQQGSDTLAENKDQVWTTPCALDRVHAACLELNGPQGLLTVDMLSKYEPALLVAILRYFLLELPDCIMTYEMYEPVKTILSGSKRE

SEQ ID NO: 157923 - protein, 33 aa, Triticum aestivum
  Clone ID: PAT_TA_52341.pep
PLLQTKHASHFLLFEPNKEDYVRAYVATYRTRG

SEQ ID NO: 157924 - protein, 68 aa, Triticum aestivum
  Clone ID: PAT_TA_52342.pep
MGANGHPPPASADAQNGSHSSGGGGGGGGGGGGGGGANPSSGGTAAALRHDPGLSREWTPEEQAMLDE

SEQ ID NO: 157925 - protein, 73 aa, Triticum aestivum
  Clone ID: PAT_TA_52343.pep
ALWWGQLLARGVSNLWITRRHAMSVIQVMSAGLSVSVRPMPDHLGICRNTWKTPMNFNMLTTVMMITTNWPLG

SEQ ID NO: 157926 - protein, 179 aa, Triticum aestivum
  Clone ID: PAT_TA_52344.pep
NINAHEHIGEHSTATGTRSIFYTTDRPLAKLTKADGWHASSFDNFSPPFGIILYYIFTFVVMVILLNVLIALYNSAYEDITQNAIDEYMALFSQKTMQFVRAPDENVFIAPFNLIEMFFLILPFEWWMDEKRYDKLNDMVMAVIYSPLLVITAMFEQQEAWVVRDNRRRGEDDEDTTME

SEQ ID NO: 157927 - protein, 200 aa, Triticum aestivum
  Clone ID: PAT_TA_52345.pep
KIPSFVYMHGDDLFNDASLLDFLKHLFLTKVQMESIIGANVWQAQLIDDSVMDQGFVFSYVDLMIHCWLKTVFRKNDWINQRALIAIMDSLCRLAFILKRRKLIHPMLIEEYRRLERQGNQQLQQQQQQQQQHLGENNGSPNLARFIRSMVYEGNVVPTLLANNDEWFGLRGINISKAPGINSHHIWFVFEALIAETAVE

SEQ ID NO: 157928 - protein, 164 aa, Triticum aestivum
  Clone ID: PAT_TA_52346.pep
MSTDVAADVPAPEVEVAADPVVETTAEAAAGDAKPAKETKAKAAKAKKPSAPRKPRATPAHPTYAEMVSEAITALKERTGSSQYAIAKFVEDKHKAHLPANFRKILSVQLKKLVASGKLTKVKASYKLSAAAAKPKPAAKKKPAAKKKAPAKKTVTKTKAKAPA

SEQ ID NO: 157929 - protein, 159 aa, Triticum aestivum
  unsure (1)..(159): unsure at all Xaa locations
  Clone ID: PAT_TA_52347.pep
HDVRDDIVAHGGMHLWLHPASQHGYMQGYMPDLLYYLYASKDRNKALIKALIGALHKEGVKVIINLRINHHTDGHKDCWSIYCIFQGGTLDCRLDLSPHKNWPYDRGYGNRTXDPDTGADFGVDHLNHHLNTDVQKELNXLMNWIKVDIWFYGWRFDYS

SEQ ID NO: 157930 - protein, 137 aa, Triticum aestivum
  unsure (1)..(137): unsure at all Xaa locations
  Clone ID: PAT_TA_52348.pep
HRVASRPFDECPRLLNKFGANCXPRQLGSSTGTLLLGGNXLKYFGKSIPINLMLIDVAEGGLVGGAKCYKITKGLXFDYKLHPGGPXDPLGLSTDPDQSVFLNAKDIKNGRLAMFCMLGLFIQAYWTRQGPFANLRP

SEQ ID NO: 157931 - protein, 114 aa, Triticum aestivum
  unsure (1)..(114): unsure at all Xaa locations
  Clone ID: PAT_TA_52349.pep
MAPTVMASSATSVAPFQGLKSTAGLPVSRRSNGASLGSDNNGGRIRCMHVXWPIGGIKKIMTLGYLPPLQIXGLLGRDNYLDRFMGLPRTNRKRGSNRSIVSASRSRSALLLIR

SEQ ID NO: 157932 - protein, 43 aa, Triticum aestivum
  Clone ID: PAT_TA_52350.pep
MFALVIVMAVVAGNRGVFITCNYNPPGNFNGERPFLTLDAEAK

SEQ ID NO: 157933 - protein, 203 aa, Triticum aestivum
  Clone ID: PAT_TA_52351.pep
HASVSFSCWFTYFPLHYPFSYQQNNKSCITRTITVLIQQQHQQVPEEEHISNRVRWVLQESFVVNALPDATIRAQLAQELGVTERTVQIWFQNRRAKARKSSTLEPNVRTGWIDVPVAAVKPKQKEPDHQPFQATFRTLVTPECYEESSHIKKRPRSNSKPEKFVTTQSTTSLTPKRAMSEGVSRMTCTQENPSFLFLSLCFV

SEQ ID NO: 157934 - protein, 197 aa, Triticum aestivum
  Clone ID: PAT_TA_52352.pep
AGGTEQGMPGGVPPMLTSLSAPADPNQVQPYTAHMNGTSNANGTTNNTVVTPVLQTPPAPTIQESGKKKRGRSRRVQDTTTVPSVPPVQPVPTVPPVQPVPMVPTVHLVPSVPSAPPEVNNIVLQTPPSAVTQESGKRKRGRPKRVPDVSVLPTPLPAADGTPILQTPPASSVHESVTKKRGRRPKLVQDSPDTSTP

SEQ ID NO: 157935 - protein, 148 aa, Triticum aestivum
  unsure (1)..(148): unsure at all Xaa locations
  Clone ID: PAT_TA_52353.pep
QSSKTXLKELIAMFEAQLPEQTNSKPSPAKHNKTEAPAATALKTQTFAVDQEVMARWSGDGQFYKANITAIGGADQVFSVRFKGYNETEFVKAEDIKAIPNKKRVGIFENIKDSHSSNASSDENNKKRKAADQPKVSKKKQASENEHK

SEQ ID NO: 157936 - protein, 201 aa, Triticum aestivum
  Clone ID: PAT_TA_52354.pep
LKTDNKPEDTVVNSEAEESEVEEGHEESNEEGLLDEVPDDIDEIDLIHMKISDLPSLRLERFKQLERLYLRQNFIIDIDGLENLNNLQELDLYDNKISHIRGLNHLSQLTDLDLSFNKIKHIKNLDKLTQLKNLYFVSNKISKIENLDTFPNLKNIELGANRIRVIENLNGLVNLTELWLGKNKITKLENLSPLKNLRLLS

SEQ ID NO: 157937 - protein, 163 aa, Triticum aestivum
  unsure (1)..(163): unsure at all Xaa locations
  Clone ID: PAT_TA_52355.pep
ALGTDLENMFSKISRKRRASALEAHAQGETYLGAPTPAGEGLEPFEGFNDYDVDIDTGDFDRERFNQFQRDTENISVENGSFDSQTDESLHESTRRTFETIENHMQFNGTVKFAELAPTTTYKKADAARRFYEVLLLASKDKIRIKQERSXSDIQISTVTPVY

SEQ ID NO: 157938 - protein, 81 aa, Triticum aestivum
  Clone ID: PAT_TA_52356.pep
QAGRPFFVFVKLRMEYRLIELTLLKEMIHVLNGRGRPDHPTTIRTPPRTMLTLSLWTKPTLTEKSWVEHYAKLSYSQHAGC

SEQ ID NO: 157939 - protein, 196 aa, Triticum aestivum
  Clone ID: PAT_TA_52357.pep
HASDENEGYVDGILRGYYSGILNSSQYLNFTQCETLEDLRLQLGATDYGSLLQNEPSPIATSTITEKLTQSLVDEFQYIRSNAVQPLSKFLDYITYQYMIDNVILIITGTLHERDTHELLERCHPLGVFDTMPALCVATTVAELYNTVLVETPLAPYFANCLSAHDLDELNIEIIRNTLYKAYLEDFYQFCQSIGG

SEQ ID NO: 157940 - protein, 93 aa, Triticum aestivum
  Clone ID: PAT_TA_52358.pep
ASARRLASYRHMALMQAQPDVLRARRSRIRLLGGGGAASGGRGVGAIVPVHTGCDGRQINNGSAWTARALAARTGLRIRCCVGVVGCCERFGF

SEQ ID NO: 157941 - protein, 121 aa, Triticum aestivum
  Clone ID: PAT_TA_52359.pep
PAQLFPDLSVKTHSAAKNQILIQLRTVSTNRHIAHTTSDGSSIPYATIDNHSTDPTTYRSYTSTVDISCAYSTSRQTHTPHRYLFISTTATASCSIKCTLTSSARVSWDSMRPTYRIVCQG

SEQ ID NO: 157942 - protein, 82 aa, Triticum aestivum
  unsure (1)..(82): unsure at all Xaa locations
  Clone ID: PAT_TA_52360.pep
LSDVSIAVVEASSLADSAATDSEAETPTGNLVLQALRDTLQQDKELNIHNTSLGIVGEDKEFEIVEGDXLQRFLVLLGVESG

SEQ ID NO: 157943 - protein, 34 aa, Triticum aestivum
  Clone ID: PAT_TA_52361.pep
KKRSYARAVQYGEHTTIKLTCFISLKVNIFPKGK

SEQ ID NO: 157944 - protein, 87 aa, Triticum aestivum
  Clone ID: PAT_TA_52362.pep
MAHNQRWGIRNGYIYASADPRLVLEVKDNSEASGSQIVTSVRKVEENDFQQWKIVPYKEVTKEEQKEEEEEQEEEQEEEQEEEQEEE

SEQ ID NO: 157945 - protein, 74 aa, Triticum aestivum
  Clone ID: PAT_TA_52363.pep
RASQTTGATRDNTLSCIDARPAWRVSRGSLSARALSRLPDEGLVPARFEAAERGEVVRRAALRRSGLQALIPWG

SEQ ID NO: 157946 - protein, 195 aa, Triticum aestivum
  Clone ID: PAT_TA_52364.pep
QRPGARWTWEALTENIKYALGITPINTGSIKDVLSLPISQQLTLVRAISERLLGKKYPVNDRNNTFETVMNILGQLGPEYQELITVVTQPLITTFYNDIPKPYTNYVGHQFRTADGSQNSIMFPDVGKAGGNYVRTVRSLRNNNVNLPSAKEVFDKLLKRPDDEFTEHKSGINMLLLYLAILITHDLFHTDPSNP

SEQ ID NO: 157947 - protein, 95 aa, Triticum aestivum
  unsure (1)..(95): unsure at all Xaa locations
  Clone ID: PAT_TA_52365.pep
PAPSNAKKTPQEKNSKNSQFAQTISPLIMLSFLTQSTAFKFLTVKPTNLCYPFCQCKSPFNLNLLLLKKKKKKKPKKKKKKKKKTDACSXRNSDG

SEQ ID NO: 157948 - protein, 124 aa, Triticum aestivum
  unsure (1)..(124): unsure at all Xaa locations
  Clone ID: PAT_TA_52366.pep
QRTVGGGFHRRCEPKRNYXAQLYNSRVQELIDGMKKELNTRIVYLGIYDIIQELAEDGERWGFTETTHGCCGTGLIKVTNLCDSRFMAVCDDVSKHVFFDSFHPTQRAYKIIVDNMWDTYGHLL

SEQ ID NO: 157949 - protein, 67 aa, Triticum aestivum
  unsure (1)..(67): unsure at all Xaa locations
  Clone ID: PAT_TA_52367.pep
NPKKNPVXPKLAQLTSIHHPISPFTHTIEHFTYRSLPQTVKVELKSKPKKKPKKRIIRLSTQSSTNT

SEQ ID NO: 157950 - protein, 116 aa, Triticum aestivum; identical to SEQ ID NO: 134375
  Clone ID: PAT_TA_52368.pep

SEQ ID NO: 157951 - protein, 40 aa, Triticum aestivum
  unsure (1)..(40): unsure at all Xaa locations
  Clone ID: PAT_TA_52369.pep
RXPTITSREEQTSVRLVLPGELAKHAVSEGAKAVTKFTSS

SEQ ID NO: 157952 - protein, 170 aa, Triticum aestivum
  unsure (1)..(170): unsure at all Xaa locations
  Clone ID: PAT_TA_52370.pep
PGFDPRRSPAFPSTGEYARRQESQRREDGRPVAFRLFVRSQRGDAXQAIEGDENGKELSTGATXTVNEGXSARRXPAVGCXGVXLTGGQRGGXGGGLRRXRXWLTGARGGGGYXQGGGGGYXQGGGGFGGQCGGXGYGGGGGGFGXXGGGYXGQCGGGVSGGQWRNCVVG

SEQ ID NO: 157953 - protein, 108 aa, Triticum aestivum
  Clone ID: PAT_TA_52371.pep
QANIMSPLCVYYTNKRNPWLKRSSRIHTMWKAYQQHPQRAIRCNIAMTAMVGTGERTPMASMVHLLHVSHEFVTMQQLRSGRLQAQLQSLLKSGTTSTSNWPRPVFNS

SEQ ID NO: 157954 - protein, 191 aa, Triticum aestivum
  Clone ID: PAT_TA_52372.pep
HASENVDDEQEEILRENTRRFCLFPIKYHEIWQFYKKAEASFWTAEEIDLSKDQHDWENKMSENERFFISRVLAFFAGSDGIVNENLVQNFCDEVKIPEAKCFYGFQIMIENIHAETYSLLIDTYIKDNQEKEMLFSAIDTIPCIKRKADWAFKWISSNESFAERLVAFAAVEGIFFSGSFASIFWLKKRG

SEQ ID NO: 157955 - protein, 195 aa, Triticum aestivum
  Clone ID: PAT_TA_52373.pep
HASAGFPNGQYFFIKSRANGKVLDVYMGETTDDSNIIIWPQKPDDDNDNQLWRAEDGFLINKRSQLVMDIRGGDLKSDTYIVQYTRKMTMAHNQRFGYRDGYIYCLADPRLVLDIRGGGSKEGTKIILYKRKESDNQNQLWTIIPVGGPNVANQIPYYPPPDYPQPGRQQQPQSYPAYPSTGYGPPDNHPSSYGN

SEQ ID NO: 157956 - protein, 74 aa, Triticum aestivum
  Clone ID: PAT_TA_52374.pep
DRIISSQVYYIIDLPGNLDGVAHVYLVSEHHRCVRRNNMHINCLGQGDCSKAQCLYILKWLPDYTCVHPSGCYP

SEQ ID NO: 157957 - protein, 174 aa, Triticum aestivum
  unsure (1)..(174): unsure at all Xaa locations
  Clone ID: PAT_TA_52375.pep
MNVRISERANARGNRYKVTXTPHEGPDEGQDNMEDILMNIRKKSLLKKLLKGLQEEVHIHAAIVDNKLESLPDMVAGVYCEDNNLDIEVTTQVRTLFSIXRSLQMKQVIQXGIDSRFVHLFTKEDITQLQFELQWALTNIVSGTSYNTXDDIDDGVDHIFVKILANVIDDVSEH

SEQ ID NO: 157958 - protein, 59 aa, Triticum aestivum
  unsure (1)..(59): unsure at all Xaa locations
  Clone ID: PAT_TA_52376.pep
PPITSSPCPPPASSSLRSLRPCSPTTSRTAPAPRTRASPSRTXLGPPGSSPXPVPARXP

SEQ ID NO: 157959 - protein, 154 aa, Triticum aestivum
  Clone ID: PAT_TA_52377.pep
MGYLDPAPSKPLSLESLGPFVLDSKDLQIPRPGAIELLYSAEPLQCKQCGFRYPKTEKGQQKMDAHLDSHFRQNRKMKERVKRGLSRSWFVTVEEWIHGEGGESMSQQVPTFLHDGMGHAVKPNEGANSTEDVINPDDHTVIKQTDERIHVLFV

SEQ ID NO: 157960 - protein, 88 aa, Triticum aestivum
  unsure (1)..(88): unsure at all Xaa locations
  Clone ID: PAT_TA_52378.pep
AVALLPAAAPFTLCGPKWRRSGFVLLSSSSHQEGAGGGGAKICLAASAPGSRXPCMXNKNXAQXCQXEGWGXXNXDGXXXRCKCIRQC

SEQ ID NO: 157961 - protein, 123 aa, Triticum aestivum
  Clone ID: PAT_TA_52379.pep
NPDTGADFGAAPDIDHLNPRVQKELVEWLNWLRTNVGFDGWRFDFTKGYSADVAKIYIDRSGASFAVAEIWTSLAYGGDGKPNLNQDPHRQELVNWVNKVGGFGPGTTFNFATQGILNVAVES

SEQ ID NO: 157962 - protein, 97 aa, Triticum aestivum
  Clone ID: PAT_TA_52380.pep
KALSACGYSHYIRMERVKYSQKTGRASEMGPPQQMYCYTSETEMLNQVIIWCSLYSALGMWYWLPYINSWSSDVTVMSSVRTIVMHAYIYIYMMNKR

SEQ ID NO: 157963 - protein, 119 aa, Triticum aestivum
  unsure (1)..(119): unsure at all Xaa locations
  Clone ID: PAT_TA_52381.pep
APRXLPGLSRKXPKXGSNXKKKXNXGKKEQYXIXXXEKQKLGFXYGXTERQLLRYVHMGGEGKRXXGEVLLQLLEMGLDNXXFXLGXVXXIXGXXXLXXXRHILVDGGVVNIGGFGWKG

SEQ ID NO: 157964 - protein, 59 aa, Triticum aestivum
  unsure (1)..(59): unsure at all Xaa locations
  Clone ID: PAT_TA_52382.pep
NKQXXIFSFYIXHFNIHSFSXMCITXNXXLKLIYXSSDVKLLSFLXVAXVCFLQXTPLK

SEQ ID NO: 157965 - protein, 83 aa, Triticum aestivum
  Clone ID: PAT_TA_52383.pep
MDVDYDVIVLGTGLTECILSGLLSVDGKKVLHMDRNDYYGAESAYLNLTQFFNKLRPDQKAPESLGRDRNWNIDLIPKFMMAN

SEQ ID NO: 157966 - protein, 68 aa, Triticum aestivum
  unsure (1)..(68): unsure at all Xaa locations
  Clone ID: PAT_TA_52384.pep
MGIVFRRVFWWVFGKREGRILVFGLGNGGRSTIVYRVEMGEVGLRLEGXGVERGDGYWNNMKLEVWDL

SEQ ID NO: 157967 - protein, 196 aa, Triticum aestivum
  unsure (1)..(196): unsure at all Xaa locations
  Clone ID: PAT_TA_52385.pep
PRVRRREEGKGREEEITEPSARTGQQAPRSRTGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAXEITDKLGLHSLRQRHWYIQSTCAT

SEQ ID NO: 157968 - protein, 166 aa, Triticum aestivum
  unsure (1)..(166): unsure at all Xaa locations
  Clone ID: PAT_TA_52386.pep
FXFFFFFFFFFFFFFFFFFFFFFFFFFFFFFSKRTNGFIPGGGGGSPKGGGGGPLLKGGLGKKVGPNGKNGPQGSLNNSPPGPQIKTPHLLKGTPLFKLGGGGAPRTNPPLKFFFSKPIAFGGWPNPSWKGFFDKRKTSTLMVQKEAINPFKKTRRPKNKKIPRSF

SEQ ID NO: 157969 - protein, 151 aa, Triticum aestivum
  Clone ID: PAT_TA_52387.pep
FVVQDFADMHLAGQSLLTDETKKRVSFMQHSFFEPQPVGNAAAYILRACALNWCDQDVVTMLRSLVPGLERCEPNTPLLINDLILPAQGSVTRDFERGLRQIDLIMLVSFGGKVRTRDEFEALLKQADDRYEVRSFRPEGLMGLLEVYLQR

SEQ ID NO: 157970 - protein, 171 aa, Triticum aestivum
  Clone ID: PAT_TA_52388.pep
IMATNCEHCGYKSNEVKAGGSISDKGRRITLNMTEAEDLSRDILKSETCGLSIPEIDLELTQGTLGGRFTTVEGLLRQVHDELQGRAPFIQGDSGTDESKQKWANFLDSVNKVADGKMFPVTLIINDPLANSYLQNLYAPDDDPEMTIEDYERDWETNEELGLNDMKVDNY

SEQ ID NO: 157971 - protein, 142 aa, Triticum aestivum
  Clone ID: PAT_TA_52389.pep
VLKNVSLFKKFIFNPQFFIYFLKNWDVFQKNLSLLFQFEFLKQKLNPFFKTVKSQEKSPSFSKYPPSFKIPTPRAFFPLVHHSMGMTCIPLFFPFTHLKKCKAIFMPPLFLFNPPGIFSIYLIVLLLVNKKQGHLPLFDYFH

SEQ ID NO: 157972 - protein, 110 aa, Triticum aestivum
  Clone ID: PAT_TA_52390.pep
GCTRALIVCPTTLPSRLVASRQGLLWIWISWIFGLILPLRIMNYIFLTDNVGVCGKIKLFVKGLAIRLFWWVLNCPWRCLFPHHGFPMTALYSGLAQPAALTHWSIFLFW

SEQ ID NO: 157973 - protein, 125 aa, Triticum aestivum
  Clone ID: PAT_TA_52391.pep
YGGWGAHGGGAFSGKDWSKVDRFAAYTARWIAKSLVNAKLCRRALVQLFYAIGVADPLSIFVDTYGTFEKFQAELVEIICNNFNLRPGVIVKELDLFKPIYQKTAAYGPFGREEFPWDQPKEPKF

SEQ ID NO: 157974 - protein, 49 aa, Triticum aestivum
  Clone ID: PAT_TA_52392.pep
PTLPKSGNQPVVTRVVQSWVLSPMLTWLSVLPLVLSKLPLVNKHLFNIN

SEQ ID NO: 157975 - protein, 123 aa, Triticum aestivum
  unsure (1)..(123): unsure at all Xaa locations
  Clone ID: PAT_TA_52393.pep
LERIKQQYATRAAALEHADGSRLTARFKKEELKLEAWDPRQRTKLESGMKKLQDRAXKMRREAMQRMAIRLELVPRVAEETRASVVAEMGKQAARPVRKADFIRQTGWFAGSRILNCGCFCEP

SEQ ID NO: 157976 - protein, 132 aa, Triticum aestivum
  Clone ID: PAT_TA_52394.pep
ETLHAMKGHHDYSFASAWSPDGRTFATGNQDKTCRVWDVRNLSKAIHVLKGNLGAIRSIRFTSDGQFLAMAEHADFVQIFDARSDYTKRQELDFFGEISGISFSPDMDALFVGVWDRTYGSLLQYGRLHNNN

SEQ ID NO: 157977 - protein, 84 aa, Triticum aestivum
  unsure (1)..(84): unsure at all Xaa locations
  Clone ID: PAT_TA_52395.pep
FADISGMEPMARGLHNVDHVIEDGSLQEVVRKGSQSFAAQIGSMLRAGKGGFECAKKKGLXIWGEPTVPSVKQEQDEMLFQSAV

SEQ ID NO: 157978 - protein, 68 aa, Triticum aestivum
  Clone ID: PAT_TA_52396.pep
GGDPQRGPAPRGVVRQPSGAATVVFPVPPGPPLRGGNSQPPRGGPPPLLGPSRSPLFGAGRPPGHLGS

SEQ ID NO: 157979 - protein, 132 aa, Triticum aestivum
  Clone ID: PAT_TA_52397.pep
KVVFPNLGFGVKTGLPFFFKSFSKAGQAFESLKKWEGVKVLGNVLPFFELPKLSRAPVSVQDWVKELTGLFRQKLGPKKAIFPQTAHSLGEWAQLWEFPGAPNGENWAGALFSPQKLIFFFFGPLNFPMPPF

SEQ ID NO: 157980 - protein, 82 aa, Triticum aestivum
  Clone ID: PAT_TA_52398.pep
TFLDKDMLRMHEPKHHLLVRPNLTNHFKNTLTMKELISDSETLNHTNQNIMSAQEGFLILNLYHMHLQSDCKVEGILGCLCK

SEQ ID NO: 157981 - protein, 87 aa, Triticum aestivum
  Clone ID: PAT_TA_52399.pep
PPAADGDGGFAFTAGEPDVPPAADRNGGLAFTDHPSVALGLGVADEAGGKELADPSPFEWPSGCDLGSYWVAGVFADTDPALFLSPP

SEQ ID NO: 157982 - protein, 156 aa, Triticum aestivum
  Clone ID: PAT_TA_52400.pep
AADPAMLFFPKNMREKVGAESGYYGNCFGSQLVLATSGAVAGAEIRDLVKLIKGHADILDLLMDAGVASGNDLGRLMSSPRYHAIAVSSWQKLGLEATDLGRGKPARVMWQPEKAVGFFCVVCPPCKGEDGVNVLSRCVTPEHAEAFLRELAALDM

SEQ ID NO: 157983 - protein, 56 aa, Triticum aestivum
  Clone ID: PAT_TA_52401.pep
SLSDAEKAPSAAKAEKLKAEYTKKIDAYNNPQAGEASGDSDKSKSEVNDDDSEGDE

SEQ ID NO: 157984 - protein, 38 aa, Triticum aestivum
  Clone ID: PAT_TA_52402.pep
DGWSAIAFGSCIYVSPMIPPSVKNALILWAKEGPIYIL

SEQ ID NO: 157985 - protein, 165 aa, Triticum aestivum
  Clone ID: PAT_TA_52403.pep
MGIAFLITASVLVSEYYGYYCRPVMRNRYMLFTSLIGSIGIFAPFLKRWDTKEYRPLRIAVFVSMAVSSAIPVFHLIFLNGLKSTWDFFDLAALSVLMYILGVVVYANRFPEKMYPGSFDFIGLTSHAIWHVFVCFGIFFHYLATLQFYANRHTYGCGILPGRDH

SEQ ID NO: 157986 - protein, 106 aa, Triticum aestivum
  Clone ID: PAT_TA_52404.pep
QQGLGLKILARTYPQTGVAGPHRTGMTFTWGRRNRNTLGVVITAQAIFKRSEQIERMGLWEPGPITYAGWLFIRLTLGGNPRGMGCSSPTWGGTPWGSCRPCGAPL

SEQ ID NO: 157987 - protein, 47 aa, Triticum aestivum
  Clone ID: PAT_TA_52405.pep
FFRAADLKYNMAFKGSATEETSVKARQDIKVQGVKVPYRFHSASERH

SEQ ID NO: 157988 - protein, 74 aa, Triticum aestivum
  Clone ID: PAT_TA_52406.pep
IDDAPGMEDEEESEDVVNQVLDEIGIDLGQALGETPSGLQKNAVPEARVAQAVGGGGADPDDDDLQARLDSLRR

SEQ ID NO: 157989 - protein, 72 aa, Triticum aestivum
  Clone ID: PAT_TA_52407.pep
AFPPIKSITTGGGPPPLNPFSPGPEVFFFPVAPQKNPPQVNVAFFNPFGFGGPPPVVVFAPFHPFFPPPSKI

SEQ ID NO: 157990 - protein, 100 aa, Triticum aestivum
  unsure (1)..(100): unsure at all Xaa locations
  Clone ID: PAT_TA_52408.pep
PPRGRASEPRKRKGSQTTGPPPPGGVGGGPPQRKPGGPKGEPRGVLQQTRGGPRKNPKARPPPHPAHLGMXLKKPPAPPHKGPPCVSPPPPPQGANACRP

SEQ ID NO: 157991 - protein, 78 aa, Triticum aestivum
  Clone ID: PAT_TA_52409.pep
FTRPYNLTFQRGTHTSEGPYACSPCGRRFASQHGCNRPEKLHWGIGPYACHPCHKAFAGMDALNRPLRMENGCSVMQV

SEQ ID NO: 157992 - protein, 100 aa, Triticum aestivum
  unsure (1)..(100): unsure at all Xaa locations
  Clone ID: PAT_TA_52410.pep
PPPLARPGPLPGGFIKGXGPPKYYNRPGPLGFEPFFFPVFPPSPYGQHQGFWAGGFFFGGPPPPSQRGPFFPPRGAFGAIFNPENAHFFRVFLRGPLRPA

SEQ ID NO: 157993 - protein, 162 aa, Triticum aestivum
  unsure (1)..(162): unsure at all Xaa locations
  Clone ID: PAT_TA_52411.pep
PPGGPADARKPPPAPPPPPPTGPRSPPPPERPRQGLAPGGPFAPKGPFPGVPALPGAPPGGFGPGAPGAPAGPDPVVPRPSPERPVGPVPAPWSPLGNGXWAPPPPPAPPPPLSPPRPPPAPPPPPLPRPPRLVVPGPAPCLPVRQMCYPKEILKPHPKRML

SEQ ID NO: 157994 - protein, 91 aa, Triticum aestivum
  Clone ID: PAT_TA_52412.pep
PKRGGLALFFSQHKTSAPSFNNPASNKAKQLPKPRVHISKKSPFEPQTGQGNLSPTNYKRIAPKRGETCRGCKPQGAPTRGGGKRGIPPLA

SEQ ID NO: 157995 - protein, 119 aa, Triticum aestivum
  Clone ID: PAT_TA_52413.pep
MFGVLTGGGFFFPPVGVDEIQGPYPGRFELVGDLKAVGESNGGVSKRPFLKRGTLFGGAPIYKGGQGDFGGSIPGPFPIFYLGGGDPSGNPPWGKKRGGAKAPLRDVLWAGGGPLWFGL

SEQ ID NO: 157996 - protein, 111 aa, Triticum aestivum
  Clone ID: PAT_TA_52414.pep
PSPMSGPRSKPRGAFPRPSRAFFFWQPVGGWWPPPRLQHPEGVPPSPGAPPPWGPVISLSPAPLLLLSPGSPWGGPFVQGLSRLCKSPWVWFNGPPGPVVWGHPLRGHLPR

SEQ ID NO: 157997 - protein, 150 aa, Triticum aestivum
  Clone ID: PAT_TA_52415.pep
SDGFYYFSDRLGDTFRWKSENVATTEVAQALGEYPEIAEANVYGTLVPNHDGRAGMAAIVLKQGAAIDFKNLYHFLHQRLPKYAIPLFIRFIPAMEITGTFKHQKVHFRNQGIDLTQIPKSEPVYWHKDETYVPFTLEDYAKINTGQAKL

SEQ ID NO: 157998 - protein, 86 aa, Triticum aestivum
  Clone ID: PAT_TA_52416.pep
KRGVSPPRAQKLGQKTPGQGPPKNPLGFWGKTPLVFFWANFPPPKDAPLFVFFPPSLGGPLGPVMGFFSPGGGGLGDPPPPFPLKN

SEQ ID NO: 157999 - protein, 81 aa, Triticum aestivum
  Clone ID: PAT_TA_52417.pep
NYVPGTLNQFHPLRVTGVLRVVLRPKLLAHHGPHNKSLRVFVNYSIALGFPFPSTVHVCSSYEKMCMCHGVNHHLNKHVSI

SEQ ID NO: 158000 - protein, 90 aa, Triticum aestivum
  Clone ID: PAT_TA_52418.pep
GVAVLVGVPHKDAEFKTHPMNFLNERTLKGTFFGNFKPRTDLPNVVEMYMRKELEVEKFITHSVPFSEINKAFALMAKGEGIRCIIRMEN

SEQ ID NO: 158001 - protein, 51 aa, Triticum aestivum
  Clone ID: PAT_TA_52419.pep
KAEAAGPPLLFSPPPPPKASSGGMKMAAENGGFGCPQCKLGPSLGCSFCSC

SEQ ID NO: 158002 - protein, 165 aa, Triticum aestivum
  Clone ID: PAT_TA_52420.pep
TRVITNLIKTIWVEKNNNNLRNKLLETSTIEPIVELICTSQFPILKNDGIMALTLIFSDKENSSNIIQVIPLLTTNTYDVEGKGKMSLIQVLSNDICSNKSEIPVQIKCNACILLCKMVETVRSVPEKRSVIELIKSNTLNGLKQIKEDSELYKYTNALISALEK

SEQ ID NO: 158003 - protein, 47 aa, Triticum aestivum
  Clone ID: PAT_TA_52421.pep
SSRRRFCVTAKKKLCREQLNQTQPPLRPNQSWRCHQFRKECQAGQRP

SEQ ID NO: 158004 - protein, 131 aa, Triticum aestivum
  Clone ID: PAT_TA_52422.pep
PIQVAGYDIPAKTQVIVNAWAISRDPSAWKDPEEFNPERFQDTDVDFNGSHFEFIPFGAGRRICPGLAMGVANAEYILANLLYCFNWALPNGVSREGVNMEEEGVLTYRKKTSLMLVPTPYHPAQEKEEEY

SEQ ID NO: 158005 - protein, 156 aa, Triticum aestivum
  Clone ID: PAT_TA_52423.pep
LVERIDLHTMVTNLQPSGIPQLMTYELLNLWGYDKFFKHIETVSGFYRTKAEQFFECLERRMKGYGEWVVPTGGMFFWIKLLGGITDSSDLIMNTAIPKKKVLALPGKVFMPAGNKTPYLRVSFSNVSYEQMDEGLRRLAEAIQEAADRNGVEIKH

SEQ ID NO: 158006 - protein, 117 aa, Triticum aestivum
  Clone ID: PAT_TA_52424.pep
DRVRSPIKKISRFDVTKMDAITQLEVEGTGFLYRQVRNMVALVIQVGREGLPLEIVPTIIAAKACKELVKVALSAPPHGLYLMSVNYDKEILKPPVGSPPVSFGRTHQISRCKLIFY

SEQ ID NO: 158007 - protein, 51 aa, Triticum aestivum
  Clone ID: PAT_TA_52425.pep
PVLYSPPPNVPLLYKLGPGPPMLWAPGLPLWMCPCVAPMLCCPSLLILDLV

SEQ ID NO: 158008 - protein, 87 aa, Triticum aestivum
  unsure (1)..(87): unsure at all Xaa locations
  Clone ID: PAT_TA_52426.pep
RMAESLLRASQGXKGVIEPTFVDSPLYKDQGVDFFAFKVELGPNGVEKIHPIGEIDAPXKGFFEACLGDLKKNIXKGVAFVASSPGK

SEQ ID NO: 158009 - protein, 112 aa, Triticum aestivum
  Clone ID: PAT_TA_52427.pep
MPVTPVPRAAPAPAPAKKRRCEEYPALAREAERLTREALERIDDVTAWSLEMGASKKEQRRLRRMRKQYRQQQPAGGVPGGGRAEGGSKELASLIVKLLRGNHGPSAGNQRR

SEQ ID NO: 158010 - protein, 108 aa, Triticum aestivum
  Clone ID: PAT_TA_52428.pep
PLSPQEHMAPAGTFSWENAFFPPESPGKSSLMASRGDIPPKGIFEANPRGFFFCSTRCFYPPKWNKGPPQFTANHQKPPPKVHPQSLAGAPETCCFCSSGPPFFLCHV

SEQ ID NO: 158011 - protein, 75 aa, Triticum aestivum
  Clone ID: PAT_TA_52429.pep
ENNYYSLIARTRGAGTSHVPILGRPGSSKGLTVHSPLRAGAYLSHKYICPPRGGARARPRPPSEITHAGNFILFF

SEQ ID NO: 158012 - protein, 172 aa, Triticum aestivum
  Clone ID: PAT_TA_52430.pep
MFKVVPKKYPAAYLVLTEEAVENFGKSTLGFYASKGFFTRVEGIEDLAKNVLNVEKEEIESIFKEYDAHIDNATPDHFGKEIFPSRLLVPTTYWVALVTPVVHYTMGGLNMNVNASILAQDGKTTIQGLYGAGEVTGGVHGRNRLAGNSLLECVVFGRTAGRNAAIYAQSLN

SEQ ID NO: 158013 - protein, 87 aa, Triticum aestivum
  Clone ID: PAT_TA_52431.pep
QRTISENQAYQPMLAGGATAHNSLNTKNWILLTISINKTKGPCDPRENPRDYWTSLALASGYKQNKIWCNPPGWSSLANINSGHPPD

SEQ ID NO: 158014 - protein, 162 aa, Triticum aestivum
  unsure (1)..(162): unsure at all Xaa locations
  Clone ID: PAT_TA_52432.pep
YMGELTRLIAVDFIEAGLLFGGEMPKGFNQXWSFPTTYMSALESDQSETKEVGQRILTEFPTSEKPTLDDLNTLTRICHIVAARSASLVAVAIISLLEQQGLSDHMVVGINGSTYEFYPHMDQRVRQALDEWFGKEMSSKIILEVASEGGSVGGALIAMLCE

SEQ ID NO: 158015 - protein, 58 aa, Triticum aestivum
  Clone ID: PAT_TA_52433.pep
AQNCNCPGGICSTQWGFFGPGPDYLGPGSQSGPCPVATSGPPPWEGSGGKPVGSTPPP

SEQ ID NO: 158016 - protein, 181 aa, Triticum aestivum
  Clone ID: PAT_TA_52434.pep
IPVFFPPGGGPLQNGWPPPGGPAKYSVFIPEAGVRGGPASIKAVFRGIPGATVGRMREKVFRLFPRVVSPDPRGKLETFKDPFDFPVAGMLPRVARPRNYFIFSPQFWNKVLRPPFFPYSKVFSGGGPPPPPLRIGFGNYLAIPRIWFGPKKKKKKKKKKKKKKKKKKKKKKKKKKKKTHP

SEQ ID NO: 158017 - protein, 62 aa, Triticum aestivum
  unsure (1)..(62): unsure at all Xaa locations
  Clone ID: PAT_TA_52435.pep
EVAGALERAGVXXAIRRLVTGSEGAQMRARAGELKKVAKECTGEAGSSGLAIGKLVDHMLAL

SEQ ID NO: 158018 - protein, 175 aa, Triticum aestivum
  Clone ID: PAT_TA_52436.pep
NPTWNATLQFAVPPTAEEATGGCLHILLRVERIFGGDRDVGEVIVPLSEILSGVGHGADYGAHSMPQFASYQIRKVHRTEVRGLLYLTYRLGPIVLPEPHLEIPVDEWPVVAYPVKQVMPPPPPPPQAAWPGYVAAAPPAKPPAGYVAVPTAKPAGYLDVPIYAERAPGHTDWTA

SEQ ID NO: 158019 - protein, 120 aa, Triticum aestivum
  Clone ID: PAT_TA_52437.pep
SYTFDNATGDYQIELASSCYVWFGDHYVYFDKKLSGTISHGAITNLSGVMAKKLFIWVSITSMTAHLERGVIEFRAGFITEDVPASLFEKIPVCVDGVGEQLRGEAGVVRELGLLPVAEV

SEQ ID NO: 158020 - protein, 98 aa, Triticum aestivum
  Clone ID: PAT_TA_52438.pep
PWYPGAMVVPPDVDDPPQLKVSLWVRHTLNFQDMGIRFFRRELVLPEIIKVLKGLAIQYRILPLDVNVRNVPPFQSPRMPPTWSYALNGEPEGPKIPP

SEQ ID NO: 158021 - protein, 93 aa, Triticum aestivum
  Clone ID: PAT_TA_52439.pep
PKNLFELGFPPRVRGPPFPKTNVSPPVGPPQNPVGVPVSPPVFFLKKKGPGSKKKPPVLAPPPPPLKISGLFGGPPPREPPPLKIPGPKKPSL

SEQ ID NO: 158022 - protein, 89 aa, Triticum aestivum
  Clone ID: PAT_TA_52440.pep
MGPPCQGSTCVLSRTKDTHCRLQHAFTTAISLLGTLPHFAALPFEPANALLLPVGPNGRAPARGSSFSRRLLFPLLQRPNRLCVRERGV

SEQ ID NO: 158023 - protein, 94 aa, Triticum aestivum
  unsure (1)..(94): unsure at all Xaa locations
  Clone ID: PAT_TA_52441.pep
KKIKVDKPLGLGGGFPVAIDPTGRKVAKKGVSQFFYKXGAKVGGYSPFYPPGEWFYFGAPYPGGTPGFFFWAVPLAGLLGGGVLLVYNPGALPG

SEQ ID NO: 158024 - protein, 81 aa, Triticum aestivum
  Clone ID: PAT_TA_52442.pep
IYGSGNVLPGPVIDKKVSHPPDFDFYLGGHAVPKGVSRPVGYHVLWDENKFRANALQTLPTPLCYRYARGPFFVSVGPPVY

SEQ ID NO: 158025 - protein, 83 aa, Triticum aestivum
  Clone ID: PAT_TA_52443.pep
QGLKKVSSSTKFFRVLKKEFSCKGPVVRDPKLGRVIHLQGVQGKNVAPFLVRAGLPKKEGLKFPGFWAPPKCSCAVPKAWKLW

SEQ ID NO: 158026 - protein, 92 aa, Triticum aestivum
  Clone ID: PAT_TA_52444.pep
GGPRGRAGISLPGLSWVPSPKCFSPPPGFFPSRSRFKKKPPPGLGVFFPPSGSGICFQFHQPKEPPCVFVRALDPPLFWALGVNNPRPGQCC

SEQ ID NO: 158027 - protein, 57 aa, Triticum aestivum
  Clone ID: PAT_TA_52445.pep
TVGPVNTDRTGMFDLKGKPKWHAWKSVAAKSKKETMPDYITKVKHLLEESPTAAASS

SEQ ID NO: 158028 - protein, 153 aa, Triticum aestivum
  Clone ID: PAT_TA_52446.pep
HVYIPEKTSSKNSERIAYTEQYASLESSLSKDWSSMSLKTLKKRTSPLAFVIYILLMFQRDYGTFPCEENEDFIGEKINEYLESMGISDSTLFNAALFKEVCALFHTEISPVAAILGGILAQDILRTLSANELPIKNWLYYNGLDETGSLHHL

SEQ ID NO: 158029 - protein, 109 aa, Triticum aestivum
  unsure (1)..(109): unsure at all Xaa locations
  Clone ID: PAT_TA_52447.pep
FIFTLIFFFSGQCFCLVFIKQSPDGANTPAGLISAAIAHALXLGVGVPEGANILXGHVNPDATXSAFVGGNITLSRGVGYCLNQLQSSTGDCLHVHLYTGGLPTKHVGA

SEQ ID NO: 158030 - protein, 103 aa, Triticum aestivum
  unsure (1)..(103): unsure at all Xaa locations
  Clone ID: PAT_TA_52448.pep
ATRTVVKVRGKGGAKGDTKXLRDDIQGITKRVIHPVVRRGGGKRVSGLIYEQTHNETKVVLEDVLQDAVTYTEHSTRHTETYTDVSYAVKRHGQTLYRSLGEI

SEQ ID NO: 158031 - protein, 203 aa, Triticum aestivum
  Clone ID: PAT_TA_52449.pep
PASAKSFINKHIKRVAVIGAGPGGIAALRALSKEGTFDTITVYERNAQIGGTWIYDSKVDPPPAVPSTDALEVDYTLKVDKLCSPIYASLRTNLPKDLMCFRDAPFSKSLPYFPSHEQVLDYVKSLAVSEGLLPMIKFSTRVDKIDHQDNSWKIVSTNLETGEQFEDKFDAVAVANGHYNVPFIPNIPRIEQLNQNKNIQVMH

SEQ ID NO: 158032 - protein, 141 aa, Triticum aestivum
  unsure (1)..(141): unsure at all Xaa locations
  Clone ID: PAT_TA_52450.pep
HWPSGVGLFGSSRRNIFXAAFKPIVKKAPXATQAPIFLANAPLPFHISLESVLIFSTSDSAVAPALASAMIISFPSFRDADTSPSALSVRESGAYSMASCSTSSISLALLITPSPAVSRPSGAPSLRRTPSASPSWTEHLQ

SEQ ID NO: 158033 - protein, 204 aa, Triticum aestivum
  unsure (1)..(204): unsure at all Xaa locations
  Clone ID: PAT_TA_52451.pep
RRPTLFEFSIIASALLVASAVNARPFTTNEEGTIAPLFVPPKVETVQDSYIVILKNHLAGQDIEEHAQWINSIVKENQKDEMMLDWLNPHMTSHGIEHVYDTPFIKGYAGRFDENILNAIRQSEDVEYIEKDSLVYASELQRNAPWGLARVSHKDSLTFKNFENYEHNPNGGEGVKVYVIDTGINVDHIDXNGRAIWGHTVPNG

SEQ ID NO: 158034 - protein, 167 aa, Triticum aestivum
  unsure (1)..(167): unsure at all Xaa locations
  Clone ID: PAT_TA_52452.pep
IKKKKNKKKKXNKKQKTNTKKKXKTKKKKKKKPQKTKQKKNTXKKKKKKKKKKKKKKNKKKKKKKAKKKKXKQKKXKKKKKKKKNNKTKKKTKKKKTKKKKKKKENDQNKPKKKQXKKRQKEPQREPHKEPPRQKLKKVXXNTDHKTHHRXXKXXXTXXAPHTPATH

SEQ ID NO: 158035 - protein, 183 aa, Triticum aestivum
  Clone ID: PAT_TA_52453.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTYSKTFQGPPHGIQVERDKLNKYGRPLLGCTIKPKFGLSPK

SEQ ID NO: 158036 - protein, 100 aa, Triticum aestivum
  unsure (1)..(100): unsure at all Xaa locations
  Clone ID: PAT_TA_52454.pep
KPPPGPPAPAPPTXXQRPRTRPTTGXXAHPSPPXRXXSPXAXRTPPXXEAXGKNXRTXSTPACGXRRRKKTPPXARCXPPAGSSSCRSPXXARPPAPPQC

SEQ ID NO: 158037 - protein, 139 aa, Triticum aestivum
  Clone ID: PAT_TA_52455.pep
PTRPVKFFFNDIIRCGKGVLAKPNLDENIYARHLKLREEEKLYPLPGATMPYVDKVVHSEGVGEYKRNMKNISDFEEKDEVAMEFVQEILNASYNLYKTKQNIYEFESIFNDLYIYPYLKITANALFITRKKPTGVYSW

SEQ ID NO: 158038 - protein, 83 aa, Triticum aestivum
  unsure (1)..(83): unsure at all Xaa locations
  Clone ID: PAT_TA_52456.pep
IHRPFNICPINPRPIHTCLXIXRLFFCLDXCGYLLAAGVLILACXWLAGLFIFCWXXXLVFVVFFFFFFFFFFFFFFFGVAVS

SEQ ID NO: 158039 - protein, 172 aa, Triticum aestivum
  unsure (1)..(172): unsure at all Xaa locations
  Clone ID: PAT_TA_52457.pep
LPRVRAPPLPRGGSPPPGRPPSRRHPSRRRRIPPPPHPTGPPLPLPLPLPLVAVAAAPVVGGGAAAVVSPXFQDSRWVNGTWDLSRFGNTGXAVDWDSFFVAXVSRWKWFGDSLVACSIXYSVVFXTXFFXWWVWFWWFFFFVVFLLIGLAALVGXXLAXFFFCFVWLWGFV

SEQ ID NO: 158040 - protein, 117 aa, Triticum aestivum
  unsure (1)..(117): unsure at all Xaa locations
  Clone ID: PAT_TA_52458.pep
DSTTGGLGGGVSKDGPTREHALLAFTLXVKQMICCCXXMGASSPXVSLARXEEIVKEVVGXLXEVGSNPEKVPFVPFSGFXGAFLXGWSTLLGWFLGPSLLVALVLVFVPLWPLGLP

SEQ ID NO: 158041 - protein, 115 aa, Triticum aestivum
  unsure (1)..(115): unsure at all Xaa locations
  Clone ID: PAT_TA_52459.pep
WRASSAPAAGGPAASKDEDEDDDMDLFGDETXVDXKAAAXRXAAXPAXFYXCGXSSVLLGGGGWDDXTXLKKLXGAVVCVXMXGXFWGAXXLMXVGXXXXKFXXLLXXFXXLVFV

SEQ ID NO: 158042 - protein, 176 aa, Triticum aestivum
  Clone ID: PAT_TA_52460.pep
MERLSQIKSQLNLSSSLMSRQAPKDITREREACEFNIKELSNFWAGGEKRFDDLQKAFDFIKDDPQLVVQPPRSYLELSRDEMREFVMGQIYRVVQISKEKKDKKLIYQIIHALCIYSQDFYMRFFVHDSLFRNAISMLGSKEQQDKYVDDINKCSILGCFAMTELGHSSALPELE

SEQ ID NO: 158043 - protein, 171 aa, Triticum aestivum
  Clone ID: PAT_TA_52461.pep
HASGLHVLRPGLDDAAIAAVTSLQRQFLKEVVGFQVFGSNPKVSKLLFWRRYQRMLSMRRRQEEVFIPLIRACRARRNTYGESFEMDCYVDSLIGLRIPEEDGGGSSRHLTDGQIVALCTELLSGDDSTVNVLQWAMANLATRPEIQAKLRAEIHNFADGQVVEEHLPQMP

SEQ ID NO: 158044 - protein, 125 aa, Triticum aestivum
  unsure (1)..(125): unsure at all Xaa locations
  Clone ID: PAT_TA_52462.pep
RGVQDAGGGGSEDPPTSCSAGPVGXVLFLWLXSXXGPSVRPXSVVFFLVTFHLRGCWAFXPPKVXFRSRVWRPFFXRXGCLCLVFLLALWCPALSFSYVLLSLCSLLCDPYPVDPLVLGFASCAC

SEQ ID NO: 158045 - protein, 109 aa, Triticum aestivum
  unsure (1)..(109): unsure at all Xaa locations
  Clone ID: PAT_TA_52463.pep
LQHRXLVRLMGCCSXGEEXXLVYEYFFFKXLDFFIFGLGGXVLLDWEKRFXXVVGIAXGLXYLHKHSRLXVFHWDLXPXFXFLDXSMIAXXFDFGLCXFFILYTLMVFF

SEQ ID NO: 158046 - protein, 135 aa, Triticum aestivum
  unsure (1)..(135): unsure at all Xaa locations
  Clone ID: PAT_TA_52464.pep
HVDETPQISKPATLVEQAKYLQDSLSQDAALHILQQNDIRSGGGPRSSLYDGVIIKNPTAADQQRGQRTFQHRNSHGSNLDSXLSRITNNXMKNPQFRDFNKAIAGVMESFQSXANNIGDYSGGSXRPTFSDFPS

SEQ ID NO: 158047 - protein, 107 aa, Triticum aestivum
  Clone ID: PAT_TA_52465.pep
LGPSLLPADPYQRARARFWAAYIDNKLVAPWWKMFVGKTDKEKDEGTKQTLAGVEMLEGALRECSKRKPFFGGDNIGYVDAVLGGMVAWMQGTKALCGVELLHTTKC

SEQ ID NO: 158048 - protein, 162 aa, Triticum aestivum
  unsure (1)..(162): unsure at all Xaa locations
  Clone ID: PAT_TA_52466.pep
KKKNNQKKKQQQKTKKKKKKKKKKXQKKKKKKKKXKKTXKKKKXPKKKKKKXKXPKKKKKKTKKXKKKKQKQQNXHXKXKNXKKXTXXKQXTXNTNTXKHNKNXPKQXTNXQXXQSKKKTRRXKENPPPPSHQPANPPPPQQNHPQTKNTSAPPDPARRTRP

SEQ ID NO: 158049 - protein, 67 aa, Triticum aestivum
  unsure (1)..(67): unsure at all Xaa locations
  Clone ID: PAT_TA_52467.pep
ITIARARLNDTLYDQILYCEILHYDAPVTGSLPDCWPYTLXKCKLKTRMLNIGALRLVNGTMPVHNC

SEQ ID NO: 158050 - protein, 66 aa, Triticum aestivum
  unsure (1)..(66): unsure at all Xaa locations
  Clone ID: PAT_TA_52468.pep
EPTCKKQGSAKHTLHXVSQYMKGLVCLSAQGKLCCGGGLFGYGGLSXPVFHRKVXTLXXIVLXLXC

SEQ ID NO: 158051 - protein, 174 aa, Triticum aestivum
  Clone ID: PAT_TA_52469.pep
RKALYDFGATGPDELSFKTNDLIQVVEEVDEGWWLGELEGRRGIFPVNYTEPVLSGPPIPSRPPMVSSISSSTRIQTFVEEPEEVQDPFNQPSPHPSPVPHRIPTTRTPPPPPFSSSPVMQSSKSNTTIRTAPNTPQVRVATTDYFARCTECGCDEFTANVFKKGHCNNCFHKH

SEQ ID NO: 158052 - protein, 139 aa, Triticum aestivum
  unsure (1)..(139): unsure at all Xaa locations
  Clone ID: PAT_TA_52470.pep
SIPNCSGERCIIHRDVKASNVLLDANFQARVADFGFAKLIPDGATHVTTKVKGTLGYLAPEYAMLGKAKESCDVYSFGVLLLELASGKKPVEKINPTTKLTITEWALPLTREQKFKEMADPKLGDSXAEARVKRMVLVG

SEQ ID NO: 158053 - protein, 153 aa, Triticum aestivum
  unsure (1)..(153): unsure at all Xaa locations
  Clone ID: PAT_TA_52471.pep
WPTLGARQAPSLEKKSWARLSREEEEAQGSRLEAGGPSSPPLGCCASSSSAPIEPAVEAQAKQIEALSLSVPDDDGGGPEGPPLLDDSDDSQIQAVTSGGTVYESASTFXDVKLTPELLXGLXDEMGXXXPXXIQAFSLPMILTPXYXDLVAL

SEQ ID NO: 158054 - protein, 111 aa, Triticum aestivum
  unsure (1)..(111): unsure at all Xaa locations
  Clone ID: PAT_TA_52472.pep
SPPLSTEALLKXVDYLIRSKWVPCLEFSXVGFIFREHNASPGYYDGRYWTMWKLPMFGCTDATQVINEVEEVKKEYPDAYVRIIGFDNMRQVQCVSFIAFKPPGCEESGMA

SEQ ID NO: 158055 - protein, 121 aa, Triticum aestivum
  Clone ID: PAT_TA_52473.pep
SPPAKTRKNPPAKRGEHHHANQRGEPHGFPQSRTQEKDTHSTPHRRPYKKEDEGAPPPPTIFFSLNTAKNFFFFFFFFFFFFFFFFFFFFFFFFFFFFFFFGRVGGRVGARVAGRVGGRVD

SEQ ID NO: 158056 - protein, 195 aa, Triticum aestivum
  unsure (1)..(195): unsure at all Xaa locations
  Clone ID: PAT_TA_52474.pep
MDDIPSAFVDENTPLIHRDQAEERQETLKDLKGHIKPLLSALYMIVVAGLNDGTLGSIIPRVKQYYDIPNETVSLLFLCSSIGFFTSALMNGFIVHRIGQLNTIYMGSCMQLSAHIVLMMGFPFPVMASAMACAGMGIGLTDAAMNVFVASLPMATLMLNLLHAVYXVGAMISPFSATFFVRAQLYHGRGMYVFS

SEQ ID NO: 158057 - protein, 76 aa, Triticum aestivum
  Clone ID: PAT_TA_52475.pep
TAPLQEAVRTHLMHSHQENGMIRMPSVDLWIRCLRTASLWRCDGGRRLLFCIPLTLNRRLGCCYFGLSIYMLVCGD

SEQ ID NO: 158058 - protein, 178 aa, Triticum aestivum
  unsure (1)..(178): unsure at all Xaa locations
  Clone ID: PAT_TA_52476.pep
PRVRPLIRGRVGSYYRRATNSGCNAVLTPNYIKEELPLTEKSMTTIANARKEIQDIIRXKDDRVFAIVGPCSIHDTDAAKEYAKLLLEAKQKYQDELVIIMRAYFEKPITTAGWKGLINDPDIDGSCKINKGLRIARGLLCHLTDMGIPVSVELLDTISPQYIADLISCGAIGARTTE

SEQ ID NO: 158059 - protein, 52 aa, Triticum aestivum
  Clone ID: PAT_TA_52477.pep
VNRGSTTLGISSSESRRNALGTSLTSHHARAIATHPRELITHVSQSGGVPPI

SEQ ID NO: 158060 - protein, 186 aa, Triticum aestivum
  unsure (1)..(186): unsure at all Xaa locations
  Clone ID: PAT_TA_52478.pep
MSPQTETKAGVGFQAGVKDYKLTYYTPEYETKDTVFLAAFRVSPGGGVPPEEAGAAXAAESSTGTWTTVWTDGLTSLDRYKGRCYHIEPVAGEDNQWFCCXAYPXDLFEEGSVAXVFTSLVGDVXFGFXGLRALRLGGSSEFPPSLFLKFFSRAPFWVFPCWGGAFFWFLVFGSVLFFWGWVLFFA

SEQ ID NO: 158061 - protein, 181 aa, Triticum aestivum
  Clone ID: PAT_TA_52479.pep
MSTNVWDTKTQTFHGGQEHRFIENFVEDFSVTTNYLGTPKKALEAAKEAINDIHHYPAANQEPAKSCLAQFLWGSDYAQHHPRLLMGNGASELIDLVVRKALLSFMQKGITQPTWKGSPWDVQYREYQRSAETNGFKILDPSNPERADMLCIVNPCNPTGDYFSVEPLKKWIRDNVKQGGC

SEQ ID NO: 158062 - protein, 84 aa, Triticum aestivum
  unsure (1)..(84): unsure at all Xaa locations
  Clone ID: PAT_TA_52480.pep
IKFSLEHAIISNXIILIXFQGQXLPKGFXDXXPSELRTFEEGSDRPQASXPLKCLRVXHRAWEIGGSAHRQRHERARKXDRKRF

SEQ ID NO: 158063 - protein, 155 aa, Triticum aestivum
  Clone ID: PAT_TA_52481.pep
THADKTHNERRDRLTKKIIEEHAQALQERGAKQHFVDALFTLREKYDLSDDTVFGLLWDMITGGVDTTVISVEWAMAELVRNPRVQKKLQEELDSVVGRDRVMSETDFPNLPYLMAVVKESLRLHPPTPFMLPHKASASVKVGGYSIPKGANLNG

SEQ ID NO: 158064 - protein, 65 aa, Triticum aestivum
  Clone ID: PAT_TA_52482.pep
VLFFPRRYFLHITALRFMNFGLLLFFYFDVLQQIRSNSLNENECSTIKAAASLPVSSTIPPLPSS

SEQ ID NO: 158065 - protein, 195 aa, Triticum aestivum
  unsure (1)..(195): unsure at all Xaa locations
  Clone ID: PAT_TA_52483.pep
PTRPRRLIAEGFVSEKQGLSDEEVAETYFNQLIKRKIIRPVEHSSNGKIKSFQVHDMVLEYIVSKSSEENFITVVGGHWLVPMPTNKIRRLSVQSSGSEHGNSTKHMNLSQVRSLTMFRSLDQLHFHSFNNGILQVLDLEGCKGLKEKHLKDMCRMLALKYLSLRQTDIXKIPSKIAKLEYLETLDLRETNVSEP

SEQ ID NO: 158066 - protein, 131 aa, Triticum aestivum
  unsure (1)..(131): unsure at all Xaa locations
  Clone ID: PAT_TA_52484.pep
AWSFLPGKGGKAWTAFLGGCXAYSEAPLGSYMGDAPLGXGASXXLLFFSTXXXLSGFGRWPVWASRXPXSLVGFLCPGXSLVFGPRFXFCGTCVFFFPLWFLFVVXVPWLSGAVFRFLXAVFCSLVLXFLL

SEQ ID NO: 158067 - protein, 184 aa, Triticum aestivum
  unsure (1)..(184): unsure at all Xaa locations
  Clone ID: PAT_TA_52485.pep
PRVRGRVXKRRIYKKMNPDEFPSLGESVNNTENSNLGASWAKVAQPEQKEDKEKHRPGAWENEQDASYADIAGHEKKLTEEYPSLQEAVSDSTPTSSGVSDLLNKSESSATTESTQPPNPDKSFADATSNKGYPLPKHDESIKSDSLPPLSDLPDVKDMLKQPSVKPPPPPQSFAKMAAKEIPP

SEQ ID NO: 158068 - protein, 71 aa, Triticum aestivum
  Clone ID: PAT_TA_52486.pep
MEPATAAPRRPFLIPGGAAPMPAIRRPARSGHRVSRSTGGVGGGRPWDSTRMDQSTCTSSHWHDLTSSYRM

SEQ ID NO: 158069 - protein, 63 aa, Triticum aestivum
  Clone ID: PAT_TA_52487.pep
GPNKKNQFVCQHGVSKIGSPKTGPPFFFFFFFFFFFFFFFFFFFFFFFLFFFFFFFFFFGVYL

SEQ ID NO: 158070 - protein, 167 aa, Triticum aestivum
  Clone ID: PAT_TA_52488.pep
MAATNYPQNVGILAMEMYFPQRCVNQPEMESFDGVSAGKYTIGLGQEKMAFIDDREDIQSICLTAVQNLMEKYNIAYTDIGRLEVGTETIIDKSKAVKTCLMTLFSEHGNNEIEGIDTTNACYGGFSAFSNAVNWIESSSWDGRYAIVVAGDLALYASGSARPTSGA

SEQ ID NO: 158071 - protein, 53 aa, Triticum aestivum
  Clone ID: PAT_TA_52489.pep
LLEQSSSLLESEEARRGAHVVLHLNYRGRIDGVYRQVGALLPKAPPFHHAEFS

SEQ ID NO: 158072 - protein, 190 aa, Triticum aestivum
  Clone ID: PAT_TA_52490.pep
RGNPTVEVEIITAKGAFRADVPSGASTGIHEALELRDKIKADYCGKGVLQAIENVNQTIGPALVDSGLVVTDQKAIDTFLIDLDGTTNKSKLGANAILGVSLAVAKAGAAEKEVPLYVHFADLASSKKPFVLPVPSFNVINGGSHAGNKLAMQEFMIMPTGAASFSEAMKIGTEVYHTLKGVIKDKYGQD

SEQ ID NO: 158073 - protein, 105 aa, Triticum aestivum
  unsure (1)..(105): unsure at all Xaa locations
  Clone ID: PAT_TA_52491.pep
MGYKEGDVKKGANLFKTRCAQCHTLKEGEGNKIGPALHGVWGRXTGSVEGYSYTDANRAKGITWDENTLFXFLXNPMKYIPGAMMAFGGLLKVMVRFCLVSFMXD

SEQ ID NO: 158074 - protein, 156 aa, Triticum aestivum
  unsure (1)..(156): unsure at all Xaa locations
  Clone ID: PAT_TA_52492.pep
MASSGGLAGLAVLLTAVLCLQLPVHSRAQLRVGFYNTTCPNAEAIVRQAVTAAFATNPGVAAGLIRLHFHDCFVEGCDSSVLLSVNPGGGTTEREAAPNNPSLRGFAVVDAARAALEQSCPRTVSCADILAFAARDSVNITGSNAFYQVPXGRRDG

SEQ ID NO: 158075 - protein, 78 aa, Triticum aestivum
  unsure (1)..(78): unsure at all Xaa locations
  Clone ID: PAT_TA_52493.pep
PAPPQQPRPPQPXTAEEEAEEPPLRHHHXHGGHTTLDDGCPLTPMTRSSGAAKSPPGXKGNNRSSIVLRSPPRFTXRT

SEQ ID NO: 158076 - protein, 93 aa, Triticum aestivum
  Clone ID: PAT_TA_52494.pep
ESTGMVDNKVWKEDGDGGGESMTTSTPPGVEKRDENPACHTGPDAHTKETSIAPASIAPDEPPNGGYGWVCTICCATFTAHTWGSHQLLTGVF

SEQ ID NO: 158077 - protein, 190 aa, Triticum aestivum
  Clone ID: PAT_TA_52495.pep
VAVTALILGHYFLLRKRIKNRTKQLKPKKERVVILGCSSGIGKECALQYASRGAKLILFARRAELLQKLQVECKDLGASDVHFMDGDVTIESDLEKLAEFTKEKLQGADTVIYCAGMLSVRSFLESCGIEIDSKTKVVKTKTTEKNALSEALETITTINYFAAVWTAKLFLPMLIESSVSPNFLVSSIAG

SEQ ID NO: 158078 - protein, 131 aa, Triticum aestivum
  unsure (1)..(131): unsure at all Xaa locations
  Clone ID: PAT_TA_52496.pep
ASGDNPGGGGGRIHLVLXTVXIRSLRAHXCACXNLIGWXIIIFFXXQXMTSVCLGXVXKMGPXRDWNFWIXEXPYFLNXGTLLIXMXFTLYXCTVXDFRPFLCLILEIYIWIFFFVLLFYCSFLLASFCLL

SEQ ID NO: 158079 - protein, 130 aa, Triticum aestivum
  unsure (1)..(130): unsure at all Xaa locations
  Clone ID: PAT_TA_52497.pep
VNKSTFGSGTAPAFGSPSTLGVSSSAPAFGSTSAFGAGSAFGKPSALGSGSAFGQTSSLGGGSAFGQXAALGSGSAFGKPSALGSGSAFGXTSCFGCCSPAFGQSTSFGSFASSFCSTVAPAFGSASAGS

SEQ ID NO: 158080 - protein, 77 aa, Triticum aestivum
  Clone ID: PAT_TA_52498.pep
FLAMTQERRQRQMHKYSTKSYIHLIIHRSISSARHQDIQSVLPLSHRAPAIAFNAVTLRPTRRVPSLSFPSQSRAST

SEQ ID NO: 158081 - protein, 107 aa, Triticum aestivum
  unsure (1)..(107): unsure at all Xaa locations
  Clone ID: PAT_TA_52499.pep
KDPGGGGIENVKQKSQDXEGXPPDQQRLFFAGQLLEDGRPLSVFIIQKESTLHWVVGLRGGLPIFXLTLAGGTITLAVVSSACFVIVPLLIADLAGFPPVLLRLFFA

SEQ ID NO: 158082 - protein, 189 aa, Triticum aestivum
  unsure (1)..(189): unsure at all Xaa locations
  Clone ID: PAT_TA_52500.pep
MAEYLASIYGTXEKDKVNCSFYFKIGACRHGDRCSRKHVKPTFSQTLLIANMYKNPVHDAAFHLTESQLQENFDLFYEDVFMELAKFGEVEDMVVCDNVGDHLVGNVYCQYRLEESAGNAVESLNNRFYAGRPLYAELSPVTDFREACCRQHEIAECNRGGFCNFMHLKHPTLTMRPELYEGQRMDIIE

SEQ ID NO: 158083 - protein, 81 aa, Triticum aestivum
  unsure (1)..(81): unsure at all Xaa locations
  Clone ID: PAT_TA_52501.pep
RARRGKSSHGQDELQVHKXPAHSPNKSENVQGGVEKVPKVNSYTCKHKGRIQSPATQMKVQASENKVPAAHTRSWPTEIWY

SEQ ID NO: 158084 - protein, 148 aa, Triticum aestivum
  unsure (1)..(148): unsure at all Xaa locations
  Clone ID: PAT_TA_52502.pep
PQPKNKKKKRTKPQPKKKKKKKKKKXKKKKKQKKPQXKKRKKKKKXKKKKKARKKKKKKXKRRKRKKKKKKKKKKEXXNXRFIKQGPXRXXXXXKNPPPTPNVAXPHHLNPTKPHHVKKKNLVHPHQRHSNSVHGRRPRPPHHPHPPP

SEQ ID NO: 158085 - protein, 232 aa, Triticum aestivum
  unsure (1)..(232): unsure at all Xaa locations
  Clone ID: PAT_TA_52503.pep
EFAKGEKTKKEAKQRKKKKKKKKTKKKEKKTKKKKKKKRKKKKKKKKKEPQREKKKREKKKKKENKKKRKRKRRQRKKKKKKKKEKKRKKSSKKRKNKKQQKKKKKKKQKGKTEKQTAEKTKNQKEKERRKKQEGRRTRRKKRERGAKRQSRGXDREGNHHPGHGHDQKEPPDNQMRNVSPAKKTKEKSENPETRQPRTPTRSTPFTPKPIPQARGWMWGRPPPRHQSPRGP

SEQ ID NO: 158086 - protein, 98 aa, Triticum aestivum
  unsure (1)..(98): unsure at all Xaa locations
  Clone ID: PAT_TA_52504.pep
KKKKKHKKKKKKKKNKQKKKKKNQKIKXKSKTRXKKQRPKKKKKEKKKKTRIKIKKKTKNGKKEQKNEKQALKNDKKTTRRKKPQNTVKGLTRSIPSQ

SEQ ID NO: 158087 - protein, 85 aa, Triticum aestivum
  Clone ID: PAT_TA_52505.pep
QHSVPVGVVVRPLLMGLALDASTAEAPLLCHRAGGGISAGASVVGARTTVKAQGTVHAHGPVVVLRVHGPTAGHDEAVAARRPRM

SEQ ID NO: 158088 - protein, 86 aa, Triticum aestivum
  Clone ID: PAT_TA_52506.pep
MKSSTLVAILVLQAVMVMGILSHSLAADDNFPKCCDNCNSWSGAQFCDDVGPKCRDGCVNCHVVQTRPVKTFRCGDGRPPLPENPC

SEQ ID NO: 158089 - protein, 138 aa, Triticum aestivum
  Clone ID: PAT_TA_52507.pep
SEGVVMELRRGRRRCYGTLPRCAVLAMELQWSLVGRPSALQWSARRRYNGALPAVSQLLTGAAMERLPTLQWSSHRRSWSCNGALTGGLTTARWRSGAAMERFIRGLDTARWRCNEASPVLCCSIAEPPEHRRSCNEA

SEQ ID NO: 158090 - protein, 172 aa, Triticum aestivum
  unsure (1)..(172): unsure at all Xaa locations
  Clone ID: PAT_TA_52508.pep
MLPEIREEGGGAGTSATKAMSVSLSGKRGRYVRQVTGRHNDTDLHVAARAGDAAALRRALDEAAVVVAVGEGGEQLEAVRRAVAAEANEAGETPLLAAAERGHLEVVVELLRHLDAQGVAAKNRSGYDALHVAAREGHHAVLQEMLRHDRMFAKTFGPANTTPLISXATRGH

SEQ ID NO: 158091 - protein, 76 aa, Triticum aestivum
  Clone ID: PAT_TA_52509.pep
VLAVEGDEEREWHEDDAGAHQGAPGRGRGRGTSQVQVCRWVLIPGRLPMNDHISFRICMLAKFNNSQQKISIQASG

SEQ ID NO: 158092 - protein, 182 aa, Triticum aestivum
  Clone ID: PAT_TA_52510.pep
PWEIGIQVKQEAKDINTTILPKVGQLEDLSERDLYVKLKKLQRDIEFIELQEEYIKDEQKNLKRELVRAQEEVKRIKSVPLVLGQFLEPIDQHTGIVGSTTGSNYVVRILSTIDRELLKPSSSVALHRHSNALVDVLPPEADSSIALLGADEKPDVAYSDVGGLDIQKQEIREAVELPLTHF

SEQ ID NO: 158093 - protein, 198 aa, Triticum aestivum
  Clone ID: PAT_TA_52511.pep
EFSLVEVYVDESSADKATEIAPFDPTKKKKKKKVVIQDPVDEVDKLAEKTEGLSVTESGEASFVGLKKKKKKLVELDPSLVEAGDGEDTLDDQVGEDEQGEGIVLGGATQYPWEGTDRDYKYDELLGRVFNILRENNPDLAGDRRRTVMRPPQVLREGTKKTVFVNFMDLCKTMHRQPEHVMMFLLAEMGTSGSLDGQ

SEQ ID NO: 158094 - protein, 68 aa, Triticum aestivum
  Clone ID: PAT_TA_52512.pep
SIPTMQAGALIKFALPDTTCALAALSYQQGGCGKPSGRPAGKQGTLSPDGTPQASNGLHRWLCSRKRN

SEQ ID NO: 158095 - protein, 142 aa, Triticum aestivum
  unsure (1)..(142): unsure at all Xaa locations
  Clone ID: PAT_TA_52513.pep
XDGANIEIXDEIGEENIFLFGTLADQVADIRHRQKYHGVLIDPNLQVVLQAIQSGEFGESASVFGPLINTLTYGGDYYLISADFEKYLDAHDQVETVYKDRQAWAKKSILCTAGMGFFSADRATREYAEKVWQLEQVPIKNA

SEQ ID NO: 158096 - protein, 179 aa, Triticum aestivum
  Clone ID: PAT_TA_52514.pep
PRVRCAVCLAELSDGEAARFLPKCGHGFHAECVDLWLHSHPTCPLCRVDVDKPDALPLALPPLRPEPANYATNLPTNVLFWGSPDAVTTGRTVGGPSSSVGAAALIVIEVPEAAESALAPRDGDAGKSHGLARMRSIKRLWSRGIQEVGASSTATSCHQATAGAHTEDTLGVAARNFDP

SEQ ID NO: 158097 - protein, 98 aa, Triticum aestivum
  Clone ID: PAT_TA_52515.pep
ANTPSNLENLDHPPAKVAGGMRVKQPDPHRTPLKAQKHDEDEEKKDKDRLDKLDLEERRAQDMQNHTASFQANVTRNAGKNVHRQYNNPETQPRSLNH

SEQ ID NO: 158098 - protein, 183 aa, Triticum aestivum
  Clone ID: PAT_TA_52516.pep
VASPIDQSIAYEVSCLTQDQVSDAVERSQKAFLSWKKVPVSDRVAIMEKFCTLFEQKKDEVAKSITYQMGRPIRYGHGEVKGVLERARYMISVAEECMKDTVVEHTPGVVKRFLRKEPLGPVFIIASWNYPYLTTVNNVIPALLAGNTVLLKQSPQTPQCADIFVDTLREAGVPKDVIQAIHV

SEQ ID NO: 158099 - protein, 177 aa, Triticum aestivum
  Clone ID: PAT_TA_52517.pep
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVRYRLDGAKVIKIYLDPKERNNTEYKLETFSAVYRRL

SEQ ID NO: 158100 - protein, 75 aa, Triticum aestivum
  Clone ID: PAT_TA_52518.pep
KKKEDFFNRGDPPALRVHFTPGEFRPPLFYPRGLSYGPKGEFGDLFTWPNPPSGNSFGPKQIGVSGPVNACLKRG

SEQ ID NO: 158101 - protein, 54 aa, Triticum aestivum
  Clone ID: PAT_TA_52519.pep
CNIEVAVLPLGIAERGDDPCKRGLSANHSATYCNFFLQKNCRLICAPLYMACFL

SEQ ID NO: 158102 - protein, 182 aa, Triticum aestivum
  unsure (1)..(182): unsure at all Xaa locations
  Clone ID: PAT_TA_52520.pep
MVKIGINGFGRIGRIVFRASQEKKGVDVVSINDPFISLDYMVYMLKYDTVHGRFKGTVEAKDGFLVVNGQKIHVHNEKEPANIPWGKDGAQVVVESTGVFLSVEAASGHLKGGAKKVVITAPSPDAPMYVCGVNLEKYKPEENIVSNASCTTNCLAPLAXVIHEKFGIKESLMTTVHAATAT

SEQ ID NO: 158103 - protein, 71 aa, Triticum aestivum
  Clone ID: PAT_TA_52521.pep
SDPHDKACVQRVVLDTIDDKGFHNSYDVRLLAIEATIVSWFQSVVLSGTEKFFKRLTSCESIKRCQSKYHN

SEQ ID NO: 158104 - protein, 68 aa, Triticum aestivum
  unsure (1)..(68): unsure at all Xaa locations
  Clone ID: PAT_TA_52522.pep
ILFIRAEILYTAQLSSANIGTRNTKGKMESTRRPPANARKSLLTRRDKQPLLGRIMCPSTKPTPXPPX

SEQ ID NO: 158105 - protein, 118 aa, Triticum aestivum
  Clone ID: PAT_TA_52523.pep
RVRVLVRVLGHHRRDRRRVRAGHQGGHPRRAHTQHLREQVAEMGAAFALYLKLYEKNDPKNAHKHTIKHEMDDDVAVGAGGFAFHFLFHKHHDHKEDHEDAGEDNHHQLHYHLRLHHL

SEQ ID NO: 158106 - protein, 96 aa, Triticum aestivum
  Clone ID: PAT_TA_52524.pep
ENYAPHACYLMEDFLPHKRMHQTSNDALDVASMGGTSSSLVHLEPCESQFGGRANEPLSSATARVHQETAPAPHGKEPCTDAISSTDKTKRASLDE

SEQ ID NO: 158107 - protein, 157 aa, Triticum aestivum
  unsure (1)..(157): unsure at all Xaa locations
  Clone ID: PAT_TA_52525.pep
VEDLEARLLLSNKRADLALLEVLMPTPSVEPLTFAPISFVPKDGTTIAVGYCSPEDAAGPPRAPSVSPGKLLSKPKDTVNIGARATVSCVAVHGMSGSPVISKYGVMGVLIRGVXDEASRTVRTTTVCSETLGLVLAKWLGLPLIHTKSLKEMIAMI

SEQ ID NO: 158108 - protein, 113 aa, Triticum aestivum
  Clone ID: PAT_TA_52526.pep
EQTHTMSTYDHADMYYLATLGDQLRAHEEESLEEGDHLADQLIEDCDNNNDITFADAAWDKDFDFSGNTQRFSANYKDPSSFTEEEAFCANRRLKDDSVNRGRYRNIWASHST

SEQ ID NO: 158109 - protein, 162 aa, Triticum aestivum
  unsure (1)..(162): unsure at all Xaa locations
  Clone ID: PAT_TA_52527.pep
PTRPPTRPGSKAVKQASQQLLPLAVKAMQENNAELAKEATDVFIWCLTQSPESYKLWDKLHAENIQASVAVLRKITADWKTLSPKLNSEALKATLKSLKAKNEAALEEAEDSGEKASIKEADKYCKAIIGRLSRGATCLKGSLLVIALAAXPGFMLSPNLDL

SEQ ID NO: 158110 - protein, 56 aa, Triticum aestivum
  unsure (1)..(56): unsure at all Xaa locations
  Clone ID: PAT_TA_52528.pep
SSAARAQKNQQDQPLFVGIASGAEEGGSHDHHEGGPEAAAHQGVXCXXDAVGADPG

SEQ ID NO: 158111 - protein, 160 aa, Triticum aestivum
  unsure (1)..(160): unsure at all Xaa locations
  Clone ID: PAT_TA_52529.pep
PRVRRTYGKTCKTPKSAYEKERLDAELKLGLEYGLKRKRELWTVHNALSTIRNAVRHXLTLDEKNSHGIFEGAGLIRCMNRYGLLAEGHYKLDYILDMTVENFLARLLXTVVLKAGMEKSIHHASVLIMQRHMKVGRQIVNVPSVMARNESDKHMNFSLT

SEQ ID NO: 158112 - protein, 193 aa, Triticum aestivum
  Clone ID: PAT_TA_52530.pep
GDTSKGPMPNDHYCWMRPEDIDYKRPVIECHSCSDLAAEMAAALAAASIVFKDSKTYSDKLVHGAKALYKFGRLQRGRYSPNGSDQSLFYNSTSYWDEFVWGGAWMYFATGNTSYLTIATAPGMAKHAGAFWIGSPNYGVFTWDDKLPGSQVLLSRLRLFLSPGYPYEEILRTFHNQTDNVMCSYLPVFNSFN

SEQ ID NO: 158113 - protein, 196 aa, Triticum aestivum
  unsure (1)..(196): unsure at all Xaa locations
  Clone ID: PAT_TA_52531.pep
MSGVFRASTMNPAYRLASKNMVLGSTRHFATQAPKKGGSKLLLATLLGVGAVAGLTFNQTKATVRPALDEAKAEAKPETTQFNAPDFTPLKLVSVQKISHDTSVFRFALPENQNAGLPVASCVIARHQVEGDKPIIRPYTPISYEDNIDHLDFVIKRYSTGKLTPIIHDMKPGDTLEFKGPIPKYDXEKDQKAMWV

SEQ ID NO: 158114 - protein, 153 aa, Triticum aestivum
  unsure (1)..(153): unsure at all Xaa locations
  Clone ID: PAT_TA_52532.pep
SLDKAIAHYCSKGNFRRAATHKQNLAELFEVELGDNTRAAAAYEEAAGWYESDNAEALANKLWLKTADLVALEGKDYYKAIELYEKVAKTSISNNLMRWSVKEYLLKAGICQLCTGDQVGVTTALERYRELDPSFQQQREXYALLVDLAAAVT

SEQ ID NO: 158115 - protein, 40 aa, Triticum aestivum
  Clone ID: PAT_TA_52533.pep
LLAHQPRRFFQRSIMHDELPWSSPCINGTTFTFQRSCIID

SEQ ID NO: 158116 - protein, 64 aa, Triticum aestivum
  Clone ID: PAT_TA_52534.pep
GDSSSLTCPPSFSTRGEEAPVVPPPARRPHLHEYEWVLLSSTMIEMRSAQLKVLRELKETTDQV

SEQ ID NO: 158117 - protein, 110 aa, Triticum aestivum
  Clone ID: PAT_TA_52535.pep
HQFYVSIISVSRSPCISLSAHDDGCSAVAEGSASKVGESEGASSGAAGSTTGGLDWTENAPSSSRNRGLLGLAAPEEHAAACGEHGLGRASHLHLLSILSVSLARSLALA

SEQ ID NO: 158118 - protein, 173 aa, Triticum aestivum
  unsure (1)..(173): unsure at all Xaa locations
  Clone ID: PAT_TA_52536.pep
GYLMNAINGFVVYTIHVTPGDGYSYASYHVMDMDAXDLVYGDIHNRXVLRCFGPSEXSVAVTIFGGPRXHTVNCGKKLEAEAYDCNNGLQHELPCGGMLIYQSFADNQEVXVCTGXRRPDFHCYEGHSAHSHPVXRNASFANFYXWRAQEDFLLEGAVLSSLMSFACPSTHFG

SEQ ID NO: 158119 - protein, 148 aa, Triticum aestivum
  Clone ID: PAT_TA_52537.pep
MSFLRSAIKTSTFLRPTVNWYTPSFARWISTEMKTRLDKDVKSNDVVLFMKGTPDEPMCGFSRAAVQIMQVQGVDFNKVNAYNVLEDPELRESIKEYSEWPTIPQIYIKGEFVGGCDILLNMHQSGDLEDLLVKEQIVPPVIEEEETK

SEQ ID NO: 158120 - protein, 181 aa, Triticum aestivum
  Clone ID: PAT_TA_52538.pep
NMDCEFNNTSDILFPSDTGLPKLASPLDYKVPEAIDWASQDFMFTFHDKSTNELNNFLCFKQYIPVQPQEQEQQEEKQILSQMNQRLAVGNTELHDSLKAFFHSIQSSMQLHSQPELALPGLSWAEEANEYYGGNDIGNLDSVQELEGKRTLVAPVVDDDDDVQIDLSTQSSLSDIIMIPR

SEQ ID NO: 158121 - protein, 120 aa, Triticum aestivum
  Clone ID: PAT_TA_52539.pep
SLPRPKTVTIGQFKLGLCHGHQVVPWGDLDSLAMLQRQLDVDILVTGHTHQFKAYKHEGGVVINPGSGTGAHSSITYDVNPSFVLMDIDGLRVVVYVYELIDGEVKVDKIDFKKTATMHG

SEQ ID NO: 158122 - protein, 189 aa, Triticum aestivum
  unsure (1)..(189): unsure at all Xaa locations
  Clone ID: PAT_TA_52540.pep
IMQFSNVLSIFYLEHFFKSKASVTIKELTGRSRFFERETFVHALSSQGFIWDNMDLNNLYLDLGINFASPQRGLTGLWSTGEEKDSQPILELLFDDTSFHKSMYRHDPFCGHLGIGGFKYGNRKSGLIRVSAYSHCKQPFYSRSSYGERHGKDXNADEVFKVSPGFMKHVSKIKHCLSLMKSKSYGVRL

SEQ ID NO: 158123 - protein, 49 aa, Triticum aestivum
  Clone ID: PAT_TA_52541.pep
INSSAKASLVMHPSSKGMFKLIALTWESLVSSQFTASLMCDQVTGIGWP

SEQ ID NO: 158124 - protein, 74 aa, Triticum aestivum
  Clone ID: PAT_TA_52542.pep
AILLKWSFFYISRSGVYSSNAMALAFSSHASMSAATDTIDVRRPYLSRRLERTVKVKSYLAKVTPTLSSPTLPG

SEQ ID NO: 158125 - protein, 181 aa, Triticum aestivum
  unsure (1)..(181): unsure at all Xaa locations
  Clone ID: PAT_TA_52543.pep
PTRPSSYSDGYVAPLYAPAETETVSGSYIIMLKNDLSVEQIQDHAEWVSSMVASHAFNTGELLDSSFTAGIKHVYEIPNLKGYAGHFDKKVLDAIRRSEEVEFVEEDSIVYASELQRSAPWGLARISTRNALTLRNYNKYNYDEKTAGEGIKVYVIDTGINVDHVDFEGRAXWGKTIXTDN

SEQ ID NO: 158126 - protein, 111 aa, Triticum aestivum
  Clone ID: PAT_TA_52544.pep
LTNTVILLSDRGESMRSLLVLSLVVVAAACLAAPRGAHGAGECGRTPADEMALKLAPCASAEQDPNSAPSSGCCTAVRTIGKQSPKCLCTRMLSNTNKSAAIKPEAVLCIP

SEQ ID NO: 158127 - protein, 52 aa, Triticum aestivum
  Clone ID: PAT_TA_52545.pep
SYVSQTHKAFHRLLAQIFRRETKKTGSGRQQSGSFNRPGSNTHRPERGTKPV

SEQ ID NO: 158128 - protein, 135 aa, Triticum aestivum
  Clone ID: PAT_TA_52546.pep
MSHQKAPSTNPRISLKFKQKEAALYKTEFCRNWVELGQCRYGSKCRYAHGEEEIRIVPRHARYKTQICRAYHSDGSCPYGTRCTFIHDSDSPIDRKEANPSLMTASNTNGSTDNIDFIWNGKLTFKSNSMKQTFP

SEQ ID NO: 158129 - protein, 165 aa, Triticum aestivum
  Clone ID: PAT_TA_52547.pep
TTSGTQTPLLPSAANHLKFSTSVPKSQVLADSFVKRAAAISWDFGAVLPESPVSCRRGGVRLLPRRRHRRSRPTNQPPNFLGVHRHARHIIWIRLCVPFSSLGWRRSCHASRSSPRRHLVGETKRGASGLHLGGRWSEAFHFQVTRTSGVAQPHAALTCFRRKTP

SEQ ID NO: 158130 - protein, 31 aa, Triticum aestivum
  Clone ID: PAT_TA_52548.pep
LSCFAFLRPAFKGQECRRLTLIILARVSSGG

SEQ ID NO: 158131 - protein, 94 aa, Triticum aestivum
  unsure (1)..(94): unsure at all Xaa locations
  Clone ID: PAT_TA_52549.pep
MPASIAFGRFDDSFSLASFKAYIAEFISTLIFXFGGGGSAIAYSKVSGGAPFDPSGLIAVVICHGLGLFVXVVVGADICGGHVNPVVTLGLGVG

SEQ ID NO: 158132 - protein, 143 aa, Triticum aestivum
  unsure (1)..(143): unsure at all Xaa locations
  Clone ID: PAT_TA_52550.pep
PSVRKIDDALCTDTFLGNLINFLPTKDDNLTLMQKFLEGPPEACDELDIPEQFTIEMFRMYRYEQRIHFMLFRVQFWERIDQLENSMSVAIEAXYALKNSKSLKNVLWVILLIGDYINAQGLCGATWTCARLESCIAILHPGL

SEQ ID NO: 158133 - protein, 119 aa, Triticum aestivum
  unsure (1)..(119): unsure at all Xaa locations
  Clone ID: PAT_TA_52551.pep
MMETNTADDGLTWNTTREYHKEPSATYWLPKDEEEQMRLTGLQFAVKEGFKGNILPSVAKSLNFEDNLAILDIGCGPGAWIMDMSTDYPNCTYAGXDIADMIHDKKPSLLTLGLGYDAN

SEQ ID NO: 158134 - protein, 71 aa, Triticum aestivum
  unsure (1)..(71): unsure at all Xaa locations
  Clone ID: PAT_TA_52552.pep
VSASSTAPPHGEEVEVEXLPLLXSHRLRAPXTATVLLLLLLLLLVELVGADMPRRHGPDAPAQPREREEQK

SEQ ID NO: 158135 - protein, 84 aa, Triticum aestivum
  Clone ID: PAT_TA_52553.pep
AGGGAPGAQRGEPRGVGAGAEGAPPHAVREQRRADWARGCSPACERAPQGRHRRQPGLELGLGGRVGNRGGHRPPTQRVETDAG

SEQ ID NO: 158136 - protein, 95 aa, Triticum aestivum
  unsure (1)..(95): unsure at all Xaa locations
  Clone ID: PAT_TA_52554.pep
MRSPACLAAALLLLAFRLPAPAVAGRPLVARDRKPAPSEAAATVRWVAAQNTWGVLSTISSDLSGAPFGNVVSYSDGVPGESHGIPYFYLTTXXP

SEQ ID NO: 158137 - protein, 138 aa, Triticum aestivum
  unsure (1)..(138): unsure at all Xaa locations
  Clone ID: PAT_TA_52555.pep
AAAFHRGGVQEERPNAIEFFKNGKNDVLVATDVASKGLGFPDVQHVFNSDMPAELENCVRGIGRTGRCAKTGIVSSFISXNPTETTLLDLTHLLSGAWHALPPVLAXLVDPLEVAAAIALLSGVLGCSLCGGLGLRLL

SEQ ID NO: 158138 - protein, 72 aa, Triticum aestivum
  Clone ID: PAT_TA_52556.pep
GKAPGVDVKPLLMNSGLPTDQLAQVWRLADFDNDGYMDIDEFCIAMHLISAAQNGAHLPEKLPATLLPNRKF

SEQ ID NO: 158139 - protein, 143 aa, Triticum aestivum
  Clone ID: PAT_TA_52557.pep
MSENNTEEISSVSTTDWDKDTQVLPRLQIIDENQKFTEELPTYLEKWDLQDAGFKYNVVAVFGSQSTGKSTLLNGLFGTSFDVMSETQRSQTTKGIWMSRGRGMHVLVMDVEGTYGLERGEDQDFERKSDLNTMATKEEIIIN

SEQ ID NO: 158140 - protein, 140 aa, Triticum aestivum
  unsure (1)..(140): unsure at all Xaa locations
  Clone ID: PAT_TA_52558.pep
MARGLKKHLKRLNAPSHWMLDKLGGAFAPXRGGGPHKARECLPLILILRNRLKYALTYREVQSILMQRLIMVDGKVRTDKTYPAGFMDIISIPKTGENYRLLCDTKGRFRLHSVXGEDAGFKLCVVRSVPFWPGRASPFP

SEQ ID NO: 158141 - protein, 107 aa, Triticum aestivum
  Clone ID: PAT_TA_52559.pep
RLPTSPRATRSPSLPALPSALRTRPRPRTPCPPTLPSSPPALPSTLLPLPLRPPERRPSPPPPWSTSPLPRSPPPTTLLLPLLPPARLPSQPPPPLLPLPLLPAEDT

SEQ ID NO: 158142 - protein, 130 aa, Triticum aestivum
  Clone ID: PAT_TA_52560.pep
PSTSPVVSSSSSFLLLPNRQRRFRTMWERYCRGVTAILYVVDAADRDSVPIAKSELHDLLTKQSLSGIPLLILGNKIDKSEALSKPALVDQLGLESIKDREVCCYMISCKDSVNIDVVIDWLIKHSKTAN

SEQ ID NO: 158143 - protein, 65 aa, Triticum aestivum
  Clone ID: PAT_TA_52561.pep
PSVRVDGEPRHVLCNAVEKHHADLLVVGSHGYGAIKRALLGSVSDYCAHHAHCSVMIVKQPKSKN

SEQ ID NO: 158144 - protein, 158 aa, Triticum aestivum
  Clone ID: PAT_TA_52562.pep
SCSVKWFVRGNDVSKELLQFREICKEERTKGEKLRSSIDELALNSVFFISSKHNKYTGISESTYKAMIQELEEKYDVGEEVDLDELDQLEVEELRKIYKLAKKDIEKAKRGANNLMFDVEGMKEKMCQSIVNFLNEHGSPLSSRYNEDIFTKKFVTSL

SEQ ID NO: 158145 - protein, 109 aa, Triticum aestivum
  Clone ID: PAT_TA_52563.pep
QRPPTRPPTRPPTRPPTRPRLQNDYNVDEACLVLKLGLLCAHPFTNARPNMQSIMRYLDGDLQLPDLTDTDMSFSLLSQMQGQGFDRYALSYLSVNTSIGTISGLSGGR

SEQ ID NO: 158146 - protein, 203 aa, Triticum aestivum
  unsure (1)..(203): unsure at all Xaa locations
  Clone ID: PAT_TA_52564.pep
PSVRADTXKIQKLPFHMNEQLKQSIRFERQTNDSSLDGLSIQFSHLFSGQNDFAAIDKMFLDAEGAMKTKEDQQVLSDLKHQITRLIRPASNLASPPQSPEREIKRASWSSVVMSEPAKKNSGWEETREFYRQIKSSHHGAPERVEHEKFRQVVNGREQAVERTSQTRRGHPSESQQTRPHSQLQPKKDTKHRECGPTTASAT

SEQ ID NO: 158147 - protein, 168 aa, Triticum aestivum; identical to SEQ ID NO: 124109
  Clone ID: PAT_TA_52565.pep

SEQ ID NO: 158148 - protein, 188 aa, Triticum aestivum
  Clone ID: PAT_TA_52566.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTYSKTFQGPPHGIQVERDKLNKYGRPLLGCTIKPKLGLSAKNYGRA

SEQ ID NO: 158149 - protein, 79 aa, Triticum aestivum
  Clone ID: PAT_TA_52567.pep
PNTPRTRPQQARSAKITKTNERPPLSEKNRQAAYRCRQKKKRWVQELEEESDFSERKNKELQELVTQLRDESVNSKFRK

SEQ ID NO: 158150 - protein, 120 aa, Triticum aestivum
  Clone ID: PAT_TA_52568.pep
PPFFFFFFFFFFFFFFFFFFFFSFFFFFFFFGPQRLMNITNVLHGENNLSGGKLSPGGVQDSPQNYLLTRRGPRQPYLVPSRDAAAQKHKDVGSPGARLFAGLELHQALGVVWVQTTSAW

SEQ ID NO: 158151 - protein, 180 aa, Triticum aestivum
  Clone ID: PAT_TA_52569.pep
MVYKSKLKSIEEPKIGIIQFIFSNKYNTPESKPILIDALNPKRHITYGQLKELVLQFAAGLQDVCGFTSNDVLALYAPNQYNYSVPLLGGVAANGAVTTANPNYNVQELTYQLEQTNAKVIICHEENLDTALAAAQKVNIPKKNIFIFGDKPIKGVQPFQTALIKQRKATLVDLSYKETK

SEQ ID NO: 158152 - protein, 145 aa, Triticum aestivum
  unsure (1)..(145): unsure at all Xaa locations
  Clone ID: PAT_TA_52570.pep
YKQSEKDHAGESNLKEAELVVRXTEVDAHTXNSSILSIVYKCLINQVMRGLRTKHSVLDHSLEKLMNVVNVYEASVCKHEYLGVDLLSFXEIKHFRYTFYFMATGVRGQYSTXYPHVKAWWQTIMAMAPAMNLCVHMRSQEVVIR

SEQ ID NO: 158153 - protein, 194 aa, Triticum aestivum
  Clone ID: PAT_TA_52571.pep
GRVGSVTRASIKPTRIASRAFVSTWNSVPQGPPDAILGVTEAYKRDTSPNKMNLGVGAYRDDGGKPYVLTSVKKAEKVMMEKNLDKEYAGITGVPAFTKAAGELAYGEDSSVIKDNRLVISQSISGTGALRIGAEFLKAWYPHAKNIIVPNPTWGNHIPIMKNAGLSLEKYTYFDKNTNGLNIDGMLEDLHKAP

SEQ ID NO: 158154 - protein, 103 aa, Triticum aestivum
  Clone ID: PAT_TA_52572.pep
SPDGGEDGLEWLPWIDVESELLVMVSTLQGMKTDDDLEQIKTVVSDEALFNVSESGTQGIRESVFSLAAADFSSAPLHRCERHQQRAEPQVLQLSPFRHHRGC

SEQ ID NO: 158155 - protein, 187 aa, Triticum aestivum
  unsure (1)..(187): unsure at all Xaa locations
  Clone ID: PAT_TA_52573.pep
MGCTTSRQARHDLRYCPXPLPLPRCQSFPARFDAGVHLVRLTSSTLGSLEVDKAAGPRAPEVADAGARAPRKMVPRTPTMTPPNEPEDIDAWALMAGLEEHSPLLAAPFGRHSFSFPIAATAQQEFAASSKVTPLPMRMPSVNDEEMASKAKAPPRKAVLYFTSLLSVRATHDDCSLARAILKATGC

SEQ ID NO: 158156 - protein, 187 aa, Triticum aestivum
  unsure (1)..(187): unsure at all Xaa locations
  Clone ID: PAT_TA_52574.pep
KKVLANKLNTWSKLQEHYDAEGKNLVIKELFEKDPQRFEKYHRVFKGSDKTKSSILFDFSKNRVTDETLKLLLELAKEAKVEEMRSKMFTGEHINFTEDRAVLHIALRNLSDRPIYDNGADVMPEVREVLAHMKQFSEAVRSGEWKGYTGKTITDIVNIGIGGSDLGPVMVTXEALKPYAQEGLKGS

SEQ ID NO: 158157 - protein, 191 aa, Triticum aestivum
  Clone ID: PAT_TA_52575.pep
KFAVRSVGRKSLLNASYVARAHYSSQSRITVNNPVVDLDGDEMTRIIWADIKDKLIFPYLKLDTKYFDLGMEHRDATDDQVTVQAAEAIKLYNVGIKCATITPDEARVKEFNLKKMWKSPNGTIRNILNGTVFREPIIMDNIPRIVPGWTEPIVIGRHAFGDQYRSTDFVTDKAGKFEMTFPPPDGSEAQK

SEQ ID NO: 158158 - protein, 113 aa, Triticum aestivum
  unsure (1)..(113): unsure at all Xaa locations
  Clone ID: PAT_TA_52576.pep
SAPLELPAPSALGGSYDAHPLCWNSXATHEAILPLATTGTLRPLPRPVPLSACELLSLSSFHLRTFVSLNLPATGPHPSIRLPASRVLPAGHEHDTCRCVLMYXRPLSKERXL

SEQ ID NO: 158159 - protein, 104 aa, Triticum aestivum
  Clone ID: PAT_TA_52577.pep
KKKRNKKKRKKKKKKKRETEKKNKKRREKKKKRKRRKKKKKADKQKKKKKETNKSQGRKNTKKQRTKEKQIEKKISTKEDKKNHRALQTKKQGNEKTNAQEWQQ

SEQ ID NO: 158160 - protein, 69 aa, Triticum aestivum
  Clone ID: PAT_TA_52578.pep
SYYALTIIEYIDAVNGLVHCDTGPSLVSRCRLYPDCFPDYKITPTTLVSYLEALHPPKDDVQLRLTHII

SEQ ID NO: 158161 - protein, 103 aa, Triticum aestivum; identical to SEQ ID NO: 107316
  Clone ID: PAT_TA_52579.pep

SEQ ID NO: 158162 - protein, 78 aa, Triticum aestivum
  Clone ID: PAT_TA_52580.pep
FSHPPPTVSHRAFIIIPIRFIAWTVSTPGPISAIQIIITSSSSLSFSSSLLWLFWFAFILLFLECLQFSITIFFGYTK

SEQ ID NO: 158163 - protein, 156 aa, Triticum aestivum
  Clone ID: PAT_TA_52581.pep
MQMTHKVETRSKEEILLEPYNYLISHPGKDIRSKLIAAFDYWLNVPKDALKIITKTIEMLHTASLMIDDVQDDSDLRRGVPVAHHIYGVPQTINTANYVYFLALQDILKLNIPEMVAAYTEELIHLHQGQGIELYWRDSLTCPSEGRYIDMVNNKT

SEQ ID NO: 158164 - protein, 96 aa, Triticum aestivum
  unsure (1)..(96): unsure at all Xaa locations
  Clone ID: PAT_TA_52582.pep
CLMSLRIYGRYIPDSISHDDIEARHSIIKSMDRNLNFMRASLLASVSPLXATDIPQITELDMLEEEQXXKXTLHLLTGLAXXNXKIRDXRGGDHGR

SEQ ID NO: 158165 - protein, 54 aa, Triticum aestivum
  Clone ID: PAT_TA_52583.pep
CILGMLWISNPILNWRTRINNLSICYLPSLFYPGTCAHFTFDRLYINIKPFRYF

SEQ ID NO: 158166 - protein, 40 aa, Triticum aestivum
  Clone ID: PAT_TA_52584.pep
APHFGGVPPPTPWGTGPPPSFRGGPPPPSQALNFLVPPPP

SEQ ID NO: 158167 - protein, 61 aa, Triticum aestivum
  Clone ID: PAT_TA_52585.pep
RRDGPTWSCCSKGCETPIVCYHNVAQYSAAERFLSSCFMTRTQFFVVRLNTLVSCSLRSES

SEQ ID NO: 158168 - protein, 96 aa, Triticum aestivum
  Clone ID: PAT_TA_52586.pep
QFHSFFIYGHGTPSYPWAPHRESLYAGKSRFGKKGPGPRVPKKLCALRGISHYWGARVRGHHTKKTGRCGRSVGVTKKKINNNRQLEKSIRVLHLG

SEQ ID NO: 158169 - protein, 157 aa, Triticum aestivum
  Clone ID: PAT_TA_52587.pep
DLITQFLIQLNHQVGLSDNTFHLQQLSNRILPFKGPELELLNPKRQLVMRGKMKRTKSTSLQLFLFDNYLVVCKVKLVQQLEYYKLYQKPIPLEDLQVSIPNTHQYNESFPITFKNTCTNDQHLTLFTMTDSTRKLWFDTIKKHQQNKHYYLEACGQ

SEQ ID NO: 158170 - protein, 137 aa, Triticum aestivum
  Clone ID: PAT_TA_52588.pep
TVLDFAAKHPEWIKSDQDSSSLWSFVQDPFTKTFNGCHLWNNLQIANVGFYRGEKYQAFFNYLDESNGIFYERWGDPVIQSLGATLFLTKSDIHFWDTVGYRVANFFTHCPTDYAKCTCRPEQNFDFNGYSCLRFYF

SEQ ID NO: 158171 - protein, 69 aa, Triticum aestivum
  Clone ID: PAT_TA_52589.pep
VSVVSIRIRQGMLSESELHIIQADFDLSRAEIDGKVIIKLGPRYNVGHLIPEGFKVAAHGKDYTVWHLI

SEQ ID NO: 158172 - protein, 110 aa, Triticum aestivum
  Clone ID: PAT_TA_52590.pep
GMLFVPVGYTPGAGMFSINEVKGGSPFGFGPFSGKKGGRTPNDPELALAGPPGKFFPGLPQKLNPVLTCNCPGLPHVCGLFPVAPFVFLTISTLFPAFISCFEKIIMPLG

SEQ ID NO: 158173 - protein, 76 aa, Triticum aestivum
  unsure (1)..(76): unsure at all Xaa locations
  Clone ID: PAT_TA_52591.pep
PPPPPPQKGNPLPHFPAPCTWPKKGQTPIPLXAKIYPLSKIFALTKGCHPPPQCWSPHLSNFKFLKTFLIILGFPL

SEQ ID NO: 158174 - protein, 60 aa, Triticum aestivum
  Clone ID: PAT_TA_52592.pep
AAALLFFFFFFLHGQTFSSEYSFFEEHIADLRATIAHELSKFNQPARGGRTFHRSLLLGT

SEQ ID NO: 158175 - protein, 67 aa, Triticum aestivum
  Clone ID: PAT_TA_52593.pep
CRASLIRQRKLTVRWVRQYSLLRYVAEFKYLTIQLTPPVVHLQRMLVLETSSQGRDSLYFRRTLAKA

SEQ ID NO: 158176 - protein, 182 aa, Triticum aestivum
  unsure (1)..(182): unsure at all Xaa locations
  Clone ID: PAT_TA_52594.pep
SAITDIVFNFXDYKPVKGAKVHAGFLSSYEQVVNDYFPVVQEQLTANPTYKVIVTGHSLGGAQALLAGMDLYQREPRLSPKNLSIFTVGGPRVGNPTFAYYVESTGIPFQRTVHKRDIVPHVPPQSFGFLHPGVESWIKSGTSNVQICTSEIETKDCSNSIVPFTSLLDHLSYFDINEGSCL

SEQ ID NO: 158177 - protein, 124 aa, Triticum aestivum
  Clone ID: PAT_TA_52595.pep
MVRFEEEKGAIADYIEMWDYVGGIRFRGFVAQKEDERAMFIFFDESVINGDLKAGLMALLELCEVDYFSCDRLVLCIDRDVDQAALANVTKDLGWIGFGLTTLDEFSQGEELTSKKWLFMDMEI

SEQ ID NO: 158178 - protein, 133 aa, Triticum aestivum
  Clone ID: PAT_TA_52596.pep
SLKNFGIMFSIPPKPIKGDWNGPGSHTNFSTLEMRQKGEIVAIEKAINKMGLRHNEHIAVYGEDNDQRLTGRHETGHISQFSYGVANRGASIRIPRHVGIEGMGYLEDPPPASNIDPYKVTSIIVESTFMPDV

SEQ ID NO: 158179 - protein, 56 aa, Triticum aestivum
  Clone ID: PAT_TA_52597.pep
MGPSNVWTSPPKNYGPGSRVCRVCGTSHGLIRKYGFMCSSQCFPTNPKAIGFIKSR

SEQ ID NO: 158180 - protein, 130 aa, Triticum aestivum
  unsure (1)..(130): unsure at all Xaa locations
  Clone ID: PAT_TA_52598.pep
TPLGPGGKRPTPGPRSPFSNKPPPWGKKKTPPSPGFGRFFKPGGPPFFFIWKPPFAPPPFIFFPPPLXGPRAFPFRPPAPTFFGFGKGFPFPPXGPLFSSLAPPLIPPPIRKIGPPPRPRPDFPGTPPGP

SEQ ID NO: 158181 - protein, 58 aa, Triticum aestivum
  Clone ID: PAT_TA_52599.pep
CPGGMLHIYGQKTPPSRPMYPPLIKGLCMYVSPPPHDQTRCPPMHVTPPLNKISRGFP

SEQ ID NO: 158182 - protein, 52 aa, Triticum aestivum
  Clone ID: PAT_TA_52600.pep
LFSYKFIWGMAFREGLKKKPKKGQWGGAPRGFLGKGIRNLLLSPFFFQKLGF

SEQ ID NO: 158183 - protein, 117 aa, Triticum aestivum
  unsure (1)..(117): unsure at all Xaa locations
  Clone ID: PAT_TA_52601.pep
VGWGVLLWGDSPPTPSSWGIFFFQIWVGMPGVPPGDSAGVPVCHRPFLTPFFGPFSGGRFGAGXVGSLWGPAPGAAPNPPPFFACVQAPNLGCAPARYVFFFIPPPSKGGLFLTASL

SEQ ID NO: 158184 - protein, 70 aa, Triticum aestivum
  Clone ID: PAT_TA_52602.pep
WKGKIGTGLDKKKPGFKGKKNQGRIPKRVRREKLKGGILWGSSRWELAKMGRDILGGSRIVPGGKYYGNN

SEQ ID NO: 158185 - protein, 83 aa, Triticum aestivum
  Clone ID: PAT_TA_52603.pep
FSGLKSLQFFVGESRHHDGGLVFPPPGAGFVGPPFLFFAHGLKGFPCPWPSYAKFFGVGGIFGPRKEWGPEASPILVPVPVLC

SEQ ID NO: 158186 - protein, 87 aa, Triticum aestivum
  unsure (1)..(87): unsure at all Xaa locations
  Clone ID: PAT_TA_52604.pep
RAGARRPARLIMSNVNVYRMIGACRSYCARGSREATPSGQCCAALRGANLRCVCRRRAXLASAGNIDARRAMQIPSKCGIGNVPSRC

SEQ ID NO: 158187 - protein, 75 aa, Triticum aestivum
  Clone ID: PAT_TA_52605.pep
NFGEAVNRAKERLFGDIGNLLSSSSSSRRSLCSREVKNQGRTGQSVDDLFRFFGLGREVPAQGTQAGEGASQHGV

SEQ ID NO: 158188 - protein, 53 aa, Triticum aestivum
  unsure (1)..(53): unsure at all Xaa locations
  Clone ID: PAT_TA_52606.pep
PCASGKVFGPYXQVVWGGLTNIGWARVVCNNNRGVFFPCKYKPPGNVVGQKPY

SEQ ID NO: 158189 - protein, 158 aa, Triticum aestivum
  Clone ID: PAT_TA_52607.pep
MCELLRILLPSLGSQKAHLLPRIPLKLNLVFISIHTKELATGRLLGTGTVHDGLYYLDEGSDEVAFASCLSPSQELLLHHRRLGHLFFAALLRIYPSLFKLCPKELLVCDACELAKHTRGSYPSIGLKSAKPFEMIHSDVWGPCEVRSIFGHRWFVPF

SEQ ID NO: 158190 - protein, 105 aa, Triticum aestivum
  Clone ID: PAT_TA_52608.pep
LHPASAVASTDAKYRHLVPNNCDRIWWDPVGGQCLCSNRICVYQNTAVPVNTNVFSSNNQTSKGVFFFFFIFQKASFERSSEAVKIAGPFFGFALTLAMTVIMAL

SEQ ID NO: 158191 - protein, 62 aa, Triticum aestivum
  Clone ID: PAT_TA_52609.pep
GEIKKYAGHVCLISAYSASLIGCCGNFYIILARYANMYPTMYYMATLYNNKYACIVLKQIPG

SEQ ID NO: 158192 - protein, 87 aa, Triticum aestivum
  Clone ID: PAT_TA_52610.pep
KAGLDLLSELEGHTKGWDNIIKIPEQIPPKILSLSRGKVVIYQQGLSESENALMKELKEKRNVKLKSLNMSEFIKADRSLTCCSNLV

SEQ ID NO: 158193 - protein, 63 aa, Triticum aestivum
  Clone ID: PAT_TA_52611.pep
PGLTYFLKFIQICCPTAASSNPTRHNARPQPGTNKKQTKRGPPDNPIEGHKKTTDLGPQKHKQ

SEQ ID NO: 158194 - protein, 100 aa, Triticum aestivum
  Clone ID: PAT_TA_52612.pep
KIFTVECSPEEESTWIVLPPAETEEELGYEVVWDDPVRLKHVPTRVNLHTHGIQSAVSGQQEVSGFGDDETSDENDVWKVQQFNGVDGQYDDVSRKELRG

SEQ ID NO: 158195 - protein, 28 aa, Triticum aestivum
  Clone ID: PAT_TA_52613.pep
GGPVLLKFQHMDFHDSTISMSVPLCVRT

SEQ ID NO: 158196 - protein, 134 aa, Triticum aestivum
  Clone ID: PAT_TA_52614.pep
GIASFALLLIGVVAASAFNQAAAAGRGLAAIEKFAELEPKPETKPEPMPKPTPHPEPEPCEPEPMPKPKPKPEPKPGQKPKPKPMPKPKPKPCSKPKPLPKPEPMPKPEPKPEPKPNEPKPKPPPKCKPPTAHN

SEQ ID NO: 158197 - protein, 117 aa, Triticum aestivum
  Clone ID: PAT_TA_52615.pep
WSLFQGPDVFHVIKAWLWGVLGTPVVVFVLLALGLLWILHKSQSKKEPAKIMKFFGDNEKFSKYALLNDQEEVTSIRPSVFFLPPPAFLKFQALSPSHKNPFSMGFPHPKPRANQGQ

SEQ ID NO: 158198 - protein, 73 aa, Triticum aestivum
  Clone ID: PAT_TA_52616.pep
TGAISETELGCCGWLGLEFCDWLGFEIVRFFFCFDCIFLDIIIGSQLMISISRVVVICLFMNSRVCAQLKLHL

SEQ ID NO: 158199 - protein, 138 aa, Triticum aestivum
  Clone ID: PAT_TA_52617.pep
SNLWTSTNATANTAAVCETYFILCDEDANNFTKQVGYGNAIGYLVNKGIPVELPNDEQQQADENINPITGQYISAEDAGPSLADMTDEEKEREAEKLFVLFERLKKTGVVDVENPITKAKREGKFEHIQDNDHDSDSD

SEQ ID NO: 158200 - protein, 107 aa, Triticum aestivum
  unsure (1)..(107): unsure at all Xaa locations
  Clone ID: PAT_TA_52618.pep
ASKQAPMGLVRTAAGELGRHGVRVNLVSPGGVTTPLSCXVVGVGPEEMEAMTEAHNVLRGKVLRAADVAEAALFLASDQAGFISGHNLVVDGNTTAVNPAVLRSIGL

SEQ ID NO: 158201 - protein, 69 aa, Triticum aestivum
  unsure (1)..(69): unsure at all Xaa locations
  Clone ID: PAT_TA_52619.pep
GPPPPPPQTNEXTLPKNPPAGKKKENARPTSSVRPPPPLYPCLVVPPPPEFAVLWPLWTFEKWIGNPPA

SEQ ID NO: 158202 - protein, 69 aa, Triticum aestivum
  unsure (1)..(69): unsure at all Xaa locations
  Clone ID: PAT_TA_52620.pep
PPRLCCTCWPANISGPTVXSSFFHGXCTPAYSYPXPLATSMFTRAAGTYQQVIFCPCVTMPGSWAHSRE

SEQ ID NO: 158203 - protein, 81 aa, Triticum aestivum
  Clone ID: PAT_TA_52621.pep
EKARRSTGLHSRITKISHKLVLYGPALDSPPGGVLLIPLYILKKDYFIELEICNSPHYIANRTPAWSPIGSFFLFYQERGK

SEQ ID NO: 158204 - protein, 112 aa, Triticum aestivum
  Clone ID: PAT_TA_52622.pep
MLYSRLPLCGVPICSFRKSRQPVLKSILKKPNRKRWSTCTLQKKLAQLHFDSHISVYETYSRQEYDRSSDAEAVCTRLTPMIAQEIKQELNHFKLYEMPIHESSRMNTPFFI

SEQ ID NO: 158205 - protein, 43 aa, Triticum aestivum
  Clone ID: PAT_TA_52623.pep
YSVSCDLCMGASLIRLHLHDCFTPRLRCICYAVWHGTLARLRT

SEQ ID NO: 158206 - protein, 62 aa, Triticum aestivum
  Clone ID: PAT_TA_52624.pep
FRARSPHTMRHVCGAPLVCFESISPGIRRSVGHSIQFVVRASSCKSVYDPDLGRPHPVNLLL

SEQ ID NO: 158207 - protein, 118 aa, Triticum aestivum
  Clone ID: PAT_TA_52625.pep
EKNFICLLRGHWARDDTHHPNALLQGGAPGRKPAVLEMGRFWGALILGASLIFEGLGMGGGIPPPHFWGRPYLRYLTHEGWAISRWGRISPLLKGGWGLEEGQGTMNPRPGSPWGRGP

SEQ ID NO: 158208 - protein, 110 aa, Triticum aestivum
  unsure (1)..(110): unsure at all Xaa locations
  Clone ID: PAT_TA_52626.pep
QKSIMSRPLGVALLIAGVDENGPQLFHTDPSGTFMKYQAKAIGSGSXGAQTXLQKEYHKSMTLKEAEKLALSVLKSVMEEKLNKTNVQIASVTPENNFRIYSEEELQTVI

SEQ ID NO: 158209 - protein, 178 aa, Triticum aestivum
  Clone ID: PAT_TA_52627.pep
EDPTDAQAVAGLIAAYAQVDPAKAEQYGNALPEIALNHLDIDTLEKVVPGVKRGYVKKDPNSVHVKKPKEKKKRTPLLPKNMDPNVQPDPERWLPKQERSTFRMKGKNKKAANKGPQGAAVEGGGIGGTGSANISGVKKSNSTEQPAAAVVESIPKPTTVSTNKSSSKKKKGKGKSKW

SEQ ID NO: 158210 - protein, 41 aa, Triticum aestivum
  Clone ID: PAT_TA_52628.pep
TQGILDHSALAPAVEGDVARAAHLKNSAFDLLSSMMYPSNH

SEQ ID NO: 158211 - protein, 149 aa, Triticum aestivum
  unsure (1)..(149): unsure at all Xaa locations
  Clone ID: PAT_TA_52629.pep
LKYLKMVXKENFRLHPPRTLLXPRETMQSCEIAGYSVPAGTRIHVNVWAMGRDPDIWDRPEEFFPERFEEAHVDFRGLHFELLPFGSGRRACPAIAMGVANVEVVLANLLYCFDWELPEGMKEDDIDMEETGQLVFRKKVALELVAVKR

SEQ ID NO: 158212 - protein, 72 aa, Triticum aestivum
  Clone ID: PAT_TA_52630.pep
WGGQTPSLNPAANGSFEGYGGFGPSWPPHGHRGGLGMFNRTPFLLFWDGGKEGSSPKCSGLSDPEKPFYRSF

SEQ ID NO: 158213 - protein, 54 aa, Triticum aestivum
  Clone ID: PAT_TA_52631.pep
IGGSSVARSGDNLERVMRGRDSMCYLSVGRSVVFVGDAAIPSVMEWDVMLESYV

SEQ ID NO: 158214 - protein, 84 aa, Triticum aestivum
  Clone ID: PAT_TA_52632.pep
VVVLHVQRHGGEEAKHAVWAKSGSPLIPLSEYREPEVMKNYGVTCDAEVLDMLDTAARQLELKVVAKVYWGDAREKLCGIQKTQ

SEQ ID NO: 158215 - protein, 207 aa, Triticum aestivum
  Clone ID: PAT_TA_52633.pep
WERLQRLFGSAAAGLGQGMQPGMDTPTVDNAEMVYISSLALLKMLKHGRAGVPMEVMGLMLGEFVDDYTVRVIDVFAMPQSGTGVSVEAVDPVFQTKMLDMLKQTGRPEMVVGWYHSHPGFGCWLSSVDINTQQSFEQLNPRAVAVVVDPIQSVKGKVVIDAFRLINPQTVMLGQEPRQTTSNIGHLNKPSIQALIHGLNRHYYSIA

SEQ ID NO: 158216 - protein, 154 aa, Triticum aestivum
  Clone ID: PAT_TA_52634.pep
IPGAQNWPRFARNESEQFEGRTTLVKIEDNTKSIFFNGMEGSILPIAVAHGEGKATFKSDEEYNQFQAQGLSLSTYVDNYGKTTQQYPFNPNGSTGAIAAIGTPNGRVLAMMPHPERVVLKESNSWYPTDQNWGQVGPWLKMFRNARTWVGDNY

SEQ ID NO: 158217 - protein, 154 aa, Triticum aestivum
  Clone ID: PAT_TA_52635.pep
ASGSTSWVSVPLSVAASGSLVSSTVGAAGASSAASSAWTASCSASLVSSVVAAGSFSSSVTSGVAASSLASSWGASSAGSTASSAASSTVATAGSTISSAISVVSSVVSSAGSTASSAASAVSTAFSAAGAGASSTGMAWVTAWTWTSAIGEEF

SEQ ID NO: 158218 - protein, 120 aa, Triticum aestivum
  Clone ID: PAT_TA_52636.pep
QALIPGLNSHYYSIAIPSRKNDLEEKMLLPLPKKGGPPGLPLENFSDPPGVNEKSVASMLPLAEASTKFVQEELPMPPDHLKPRHVGKQAPKRPLEDKVEPVMGKKIVRALGPMIERAGF

SEQ ID NO: 158219 - protein, 94 aa, Triticum aestivum
  Clone ID: PAT_TA_52637.pep
DIAGVDPEKMYEFGEKYCDFARIEDWKRELLVSIIANMDNDMETFRDRADDGENVRKGLQRWHGAAAQAQEDQTTVAAVEADVDAQVIAKLRLN

SEQ ID NO: 158220 - protein, 64 aa, Triticum aestivum
  Clone ID: PAT_TA_52638.pep
LCSCLVWQALTGRMVDGSVVLLVACMHGSVGAIRRAYVRLENSICLLCLSLNYVVRSISIARSC

SEQ ID NO: 158221 - protein, 129 aa, Triticum aestivum
  Clone ID: PAT_TA_52639.pep
YSMFYFIKGYTVFVAVPEDGIKEPQATLSDGWSAGWIRHHPTKNAAGHAEKTPTQRATGGPANTGRPSEKHGGPKGTKRPDTRKNSDANKTGELPTGNYKENRRDWATEIPTAIRGQNPAGDPRTRPNT

SEQ ID NO: 158222 - protein, 36 aa, Triticum aestivum
  Clone ID: PAT_TA_52640.pep
KNYKILPMTPPLIDMLKQANQKRGLKGFQIPRNKGR

SEQ ID NO: 158223 - protein, 76 aa, Triticum aestivum
  Clone ID: PAT_TA_52641.pep
ENMIKLHRRCFRINVHSTFVVLLSEHLGNVVPNESIISSKLGIEVCPAQFMFLLSFVGLLLRYPYINLKARPALQD

SEQ ID NO: 158224 - protein, 113 aa, Triticum aestivum
  Clone ID: PAT_TA_52642.pep
MAAAAGSGGGGVVKHLVIVQFKEDVTPERLDGLIRGYAGLVDKVPSMKAFHWGTDVSIENMHDGFTHVFESTFESTEGVKEYVYHPTHVEFATDFLGSTEKVLIIDFKPAAGN

SEQ ID NO: 158225 - protein, 165 aa, Triticum aestivum
  Clone ID: PAT_TA_52643.pep
MGCFGCFAPAARRGAGDLKPSKLAHHCTDDDSVADAQRKVAPDVGSGCAHSFTFKDLLVATGYFNEANFIGEGGFGKVYKGKISKTNSQMVAVKQLARESVQGRKEFLVEVLMLTVLSHPNLVSLVGFCAQGDERLLVYEYMPFGSLESHLFDVPHGKPPLDWDT

SEQ ID NO: 158226 - protein, 147 aa, Triticum aestivum
  unsure (1)..(147): unsure at all Xaa locations
  Clone ID: PAT_TA_52644.pep
KRPSSFFLQISFPLWTSEPARWLSTSWDDICKKKTVELLEVLGLPKGLFPMDDIEEVGHNCESGFVWILXKNKKKHMFNKLNQTVFYDTEVTAFVEKGKMKKVTGVKVEEFSLVEVYVDESSADKVIIKTDTGLADTHDAVVFALGE

SEQ ID NO: 158227 - protein, 137 aa, Triticum aestivum
  Clone ID: PAT_TA_52645.pep
DVNIDHNKLLNGNKVDLRKRDLIFDPLVRDNAVSVADDAKTKVNIDHNKLLNGNKVDLRKRDLIFDPLVRDNAVSVADDAKTKVNIDHNKLLNGNKVDLRKRGLIFDPLVRDNDVTILKDADTTVTVKDNKIGNDNH

SEQ ID NO: 158228 - protein, 67 aa, Triticum aestivum
  Clone ID: PAT_TA_52646.pep
RTTSRRRTARRSGNNNFYFACVMFVLSLSLGQMKAFLLYFNPSSIIFADSGPLRYTFFFSQITDCHV

SEQ ID NO: 158229 - protein, 88 aa, Triticum aestivum
  Clone ID: PAT_TA_52647.pep
MSHRITAMRKALFDHLAQLQTPGTWHHITVQIGMFSFTGLKAPQVKVLKEKYSIYLTDNGRVSMAGLSSKNVEYFAKAIDDVVRNVSV

SEQ ID NO: 158230 - protein, 106 aa, Triticum aestivum
  Clone ID: PAT_TA_52648.pep
GPKIQKGNPWGGPYNPRGGQSGGGVIWQKSPKNLGRGWNQPTTGKNQRGKKKKKTKRGGGNFMKFGRGFFKTAFWRDFKKFKKVQGGKKPTDRANFFGRAKGGLKE

SEQ ID NO: 158231 - protein, 84 aa, Triticum aestivum
  Clone ID: PAT_TA_52649.pep
QGKKPGINLLKKRAESHTSKGAGFSPVGPCLAPKNFNITNRVHFKQPLYQGISFFLGGGLHILGFFSTLAFKSLDRRFWSFFSH

SEQ ID NO: 158232 - protein, 49 aa, Triticum aestivum
  Clone ID: PAT_TA_52650.pep
GMTQGNSTHIYFWYKLKRLNVAGVKKEHTDTTHTHTHMQIKASKAHVNI

SEQ ID NO: 158233 - protein, 162 aa, Triticum aestivum
  Clone ID: PAT_TA_52651.pep
HNAFVNSVVYTSEYTRAISASSDGEVRIWDISSGGCISCYPKDNITIHALLSIPDDPNHVILVNKSNQLHLMNGRGEIIKSYKHNNNTKDFIAGTVSHQGSLLYAVSEDCTMYCFSTKTAEIIGETKLSQNSEIIGISHHPLSNIIAANDDVGRVHLFKNSE

SEQ ID NO: 158234 - protein, 74 aa, Triticum aestivum
  Clone ID: PAT_TA_52652.pep
GSGGGGLRPVLSVGLLPPWVPRGLHPVLPGPQGCPGGHGPPLGAQLPNYLAMAWLATRTHVLEASFFRGPFRIK

SEQ ID NO: 158235 - protein, 83 aa, Triticum aestivum
  Clone ID: PAT_TA_52653.pep
SQVLEDSKVSGQLKSQVAEVKLEAAGEGACVAKLRVEYERLDGSGALSAEDQAALVAGYLDLLKMVEAYLVAHPAEYASLNQP

SEQ ID NO: 158236 - protein, 91 aa, Triticum aestivum
  Clone ID: PAT_TA_52654.pep
KRARPPLTGGLLNFITGHRAFIIHQHYGPSPTRGKQDKNTFKNFKPDPLNFSSTRGPIFSPIFLLIGVTQPQTFLFLNREEGWIKILPPAR

SEQ ID NO: 158237 - protein, 107 aa, Triticum aestivum
  unsure (1)..(107): unsure at all Xaa locations
  Clone ID: PAT_TA_52655.pep
QGLDCGEQSTKLFREEILKSKPIVWNGPSGVFEFEAFSNGTKAVLDAVIEATKXGATTIIGGGDPATAALKWGAEGQVFHISTGGGAPLELLEGKELPGVTALSRKN

SEQ ID NO: 158238 - protein, 141 aa, Triticum aestivum
  Clone ID: PAT_TA_52656.pep
FFFFFFFFFFFFFFFFFFFFFFFFFFFFFNGRKQNFPKGYKFLAPKQGCLATKKGPGGDLGNDKKNPGGEGRHMRKRANTFPFFGGNHIHYEPTLVAQRWHKKKRKGKKKQKFIQGNTLFKKPRETLPNKELNTWVLRAMK

SEQ ID NO: 158239 - protein, 97 aa, Triticum aestivum
  Clone ID: PAT_TA_52657.pep
GRKREQQREEKELAKFAQLADAHRKQQKEKQDQPEISGEQATPKNLPTPGNQDQRRTLKFGFSKMTPSKAPVGSMSKKPKMATKVPSVFGNDSDDEA

SEQ ID NO: 158240 - protein, 146 aa, Triticum aestivum
  Clone ID: PAT_TA_52658.pep
KLDFFFFLGYSIQYLVLVLKPHDYEFPLTIVALPVTCLILLLAVYAVRHESKWLISLFFLGLCAGVAYFIFKLYRIYDATQAYKYKYVSEFLTFFASVSLVLVVLTIINAAFCLSNFGKGLKPHLTAQYSKSSTPEEFNERTLSLD

SEQ ID NO: 158241 - protein, 81 aa, Triticum aestivum
  Clone ID: PAT_TA_52659.pep
GERGRKSFVFCIGGVSEINNHEQQWTKKDLPCCFNDAVFSEFALEEKKFGQLIRGVNNIYYHKPLGPKGYEWVGIFGNLGQ

SEQ ID NO: 158242 - protein, 88 aa, Triticum aestivum
  Clone ID: PAT_TA_52660.pep
CARALGHKSFQLTRIVPIIGDSRMGPPIALADNREDWALVSLPNSTSRRADQIQRYLQTIVFLLATSGKKCPTAPLNIKLGLDEASFT

SEQ ID NO: 158243 - protein, 158 aa, Triticum aestivum
  Clone ID: PAT_TA_52661.pep
FHLPGSSPPGYASQVSHGPPPVLLIKRKPAQKYGLPIIGKYITSAVVGVPPKIMGVGPAYAIPVAVERAGLKIEDVDIYEINEAFASQSVYSVEKLGIPFEKVNPKGGAIAFGHPLGCTGARQIATLLPELKRQNKKVGVTSMCIGTGMGMAAVFESE

SEQ ID NO: 158244 - protein, 70 aa, Triticum aestivum
  Clone ID: PAT_TA_52662.pep
RIPRYLEVASCSCCLRLSGSRPLVVRSSSVYGTSPSSLSISFSFELPTTLIKAIVPSFPSLLIHYIHSTL

SEQ ID NO: 158245 - protein, 95 aa, Triticum aestivum
  Clone ID: PAT_TA_52663.pep
APKFAGQKLASSAIQPKAIHTLELYLDYVCPFSAKMFKTIYETSLRKTILEKYSDRVVTIFRQQIQPWHPSSTLVHEAAYAVQKGRQVPKFWDFF

SEQ ID NO: 158246 - protein, 86 aa, Triticum aestivum
  unsure (1)..(86): unsure at all Xaa locations
  Clone ID: PAT_TA_52664.pep
ASSYERQQVYSSHTYSYTSSQKGNSYSYTSSSYDDSSDPTFTQEDYSXXPNPNYPXCHLXXQXTQNSPQKGGGXXXXXXPPPPPXT

SEQ ID NO: 158247 - protein, 87 aa, Triticum aestivum
  Clone ID: PAT_TA_52665.pep
HASDSFSKTPPTEEQPYPSPFPTSLAPRPYTSQSKETSTTSASFINETFLMTNFVKDKSLFPPRITGSENSSSSSHSSRRIDRFNPI

SEQ ID NO: 158248 - protein, 62 aa, Triticum aestivum
  Clone ID: PAT_TA_52666.pep
LWLRNMGLPPVAVLSLNLIPVGLVVARVLYLVHFTGYMTPTIVQEVDATNLALSLGAEPRTK

SEQ ID NO: 158249 - protein, 78 aa, Triticum aestivum
  Clone ID: PAT_TA_52667.pep
VHMAIAPPDNVYVFQTGGSLVVVNNYGQGSTNTITVKAGSFSNGDTLTDVFSNKSVTVQNNQITFQLQNGNPAIFQKN

SEQ ID NO: 158250 - protein, 149 aa, Triticum aestivum
  Clone ID: PAT_TA_52668.pep
VKNVSVKDIRRGNVCSDSKNDPAKEAGSFTAQVIILNHPGQIGAGYAPVLDCHTAHIACKFAELIEKIDRRSGKSLEATPKFVKSGDSAIVKMIPSKPMCVEAYTDYPPLGRFAVRDMRQTVAVGVIKSVEKVDKAGKVTKAAAKAGKK

SEQ ID NO: 158251 - protein, 129 aa, Triticum aestivum
  Clone ID: PAT_TA_52669.pep
AYAVQKVDSSKFWDFSQKLFAEQKDFFDVSLVNETRNATYKRLAKIAGSVGVDEAKVYGLLEISDKPGEDGALNSGNGVTDDVKVQVKANRLTGVHVTPTVVFDGVVNNEISSSWTAEQWEEWLEKNVK

SEQ ID NO: 158252 - protein, 164 aa, Triticum aestivum
  Clone ID: PAT_TA_52670.pep
GCRLTAIFDSCHSGTVLDLPYVYSTKGEIKENNLFKHAGMGILSAGIQYARGDKDGALSSIMSLGKQLLESRQISDGVRERNTTLADVIMFSGCKDDQTSADAKEAGRATGAMSYALTTSLRQDPYQSYHQLLNSLRQILRDKYSQRPQMSASHPIDVNLPFKC

SEQ ID NO: 158253 - protein, 56 aa, Triticum aestivum
  unsure (1)..(56): unsure at all Xaa locations
  Clone ID: PAT_TA_52671.pep
PFFLKVAVDEFKPIFXQFSVGAMPPFLFLKKGNFKARVVGAIKEELPPKVGVPPAP

SEQ ID NO: 158254 - protein, 79 aa, Triticum aestivum
  unsure (1)..(79): unsure at all Xaa locations
  Clone ID: PAT_TA_52672.pep
XGGSSWAXTASRALWSCSCSTLGLSLDWGLGGSPCDSLCLLVTLSLTCASSHNLVHLTVIVLQLVLIPRLIAINVVSES

SEQ ID NO: 158255 - protein, 125 aa, Triticum aestivum
  unsure (1)..(125): unsure at all Xaa locations
  Clone ID: PAT_TA_52673.pep
MAAATAPTTATKLAADEXTAELAGVPVGAPMGAPVGVAETADGVIAEGASVVGAGGDAIGDGDAAVGGVATGAGAVAGDLAGGAGSGAIRGAGMGPCAAAPTARRARMAATTAKRAIRFLSTVKA

SEQ ID NO: 158256 - protein, 54 aa, Triticum aestivum
  Clone ID: PAT_TA_52674.pep
SKESFSTSASFINETFLRNNFVKNKNLFPPRITGSETSSSSSPSPRRIDRFHPI

SEQ ID NO: 158257 - protein, 63 aa, Triticum aestivum
  Clone ID: PAT_TA_52675.pep
SVIRSIYKAESTAAGLMDQLRIIPTRQSLELRAEVASMASDLKNRRHVLEERVNRISEYGVRV

SEQ ID NO: 158258 - protein, 179 aa, Triticum aestivum
  Clone ID: PAT_TA_52676.pep
MANVHNVLLRALNAIYHQAPFIQLAGDVADLMLYVTAWADTVHHHHSLEETMFFPKIEQIAREAGIDGWEGMMGGNVDQHHEFEPKITGLVKWAEEVGTGERTYDAAELKSLIDEFAPILTQHLHDEIDTLIRLEKCDGEKIKQAMKEVADEGAKTADPNLVIPLVLGCVDRSYPGSGS

SEQ ID NO: 158259 - protein, 190 aa, Triticum aestivum
  unsure (1)..(190): unsure at all Xaa locations
  Clone ID: PAT_TA_52677.pep
SAPLRSTDRARLASQRLTGPLLQAGAHRSLRGASRQELANHQQTLAAAPAPDAELDGETGEQHGKLLALRLYKALNARHARRAQELXAPDLQWWYHGPPAHQDMMRLLTGTGTXPSASSATAPATPSASPLFTRGAQTAPAHFYTRTTLEPAGSDGVCTQLREYFNTDLTVTRLSAAATNNASAGSPSHS

SEQ ID NO: 158260 - protein, 179 aa, Triticum aestivum
  Clone ID: PAT_TA_52678.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTYSKTFQGPPHGIQVERDKLNKYGRPLLGCTIKPKLG

SEQ ID NO: 158261 - protein, 40 aa, Triticum aestivum
  Clone ID: PAT_TA_52679.pep
MHGFVIFILIFIFSFFSFFFIFFFFFFFYISFFFFFFFLL

SEQ ID NO: 158262 - protein, 63 aa, Triticum aestivum
  Clone ID: PAT_TA_52680.pep
FDVNAFDYHNLPRQMLRLRVTSMNTSGRVKQCSQIRGSRNVYKACLGLYCRGKLQLQKLHEPQ

SEQ ID NO: 158263 - protein, 43 aa, Triticum aestivum
  Clone ID: PAT_TA_52681.pep
KTEHRGKFWNWKHNGTNPDLDEQFAPQFTIHTGNRLKNPQIKG

SEQ ID NO: 158264 - protein, 33 aa, Triticum aestivum; identical to SEQ ID NO: 157923
  Clone ID: PAT_TA_52682.pep

SEQ ID NO: 158265 - protein, 96 aa, Triticum aestivum
  Clone ID: PAT_TA_52683.pep
YVLEQEEEEQESDVTLINQSASHSPGSLQTRSYSAYTTKKSTHQHSNKIETAATERALVTARHKANRTYSSLPPPFTLLSPCMPSLLACSFGNALS

SEQ ID NO: 158266 - protein, 145 aa, Triticum aestivum
  Clone ID: PAT_TA_52684.pep
YICQRSNIILDKRMIVAPDIAERFQQLYYAMWLWLGHNELLKHDYDLQQLPTHYNVDRLKLCYLRTEDEQPWYDESLYWVDLVDRNRLLQEFMQYPWESSERFRTKGKSEDCSTSSLKSRRSKMTSESTAAPLPPVYFREPNKVT

SEQ ID NO: 158267 - protein, 101 aa, Triticum aestivum
  Clone ID: PAT_TA_52685.pep
DHGDACTSARRTINCSGSIIIIIYIYLPTYSLRSKLRTLRGFCSNCNLKQREYMSMHVDRNTAKQVLLATQLQIRGQNDNVIALAKKNDTVIGNQVAFRAQ

SEQ ID NO: 158268 - protein, 68 aa, Triticum aestivum
  Clone ID: PAT_TA_52686.pep
DTSPSPHIYVTDDNQQRNNAATSNVLTVGVQASSNFTQAKDYILDTARYIVVSSSPHVTHGNQPVNRK

SEQ ID NO: 158269 - protein, 78 aa, Triticum aestivum
  Clone ID: PAT_TA_52687.pep
RPLLETPWSKSYPPPQIGCSACRCPFNARPPPSVFYAHKRALYAAACAVCFCPGKVLEYECSARVFYQGQKPHVRSDF

SEQ ID NO: 158270 - protein, 39 aa, Triticum aestivum
  Clone ID: PAT_TA_52688.pep
LFRCPPMFTPTLPHLLSPGSSLFVLDPAPPDYLLLFSCP

SEQ ID NO: 158271 - protein, 106 aa, Triticum aestivum
  Clone ID: PAT_TA_52689.pep
AWDRHPRIPGLLCWPSGCGVMIYRVRRGPSYFIGKGSIFGFFKHGHPGKPLPRDVFSSEVKFEVFFFGDGEHFLFFSSVILSDLFIFLLEKKKKKGKNKTTKKNNK

SEQ ID NO: 158272 - protein, 77 aa, Triticum aestivum
  Clone ID: PAT_TA_52690.pep
PCTPKALSLRRQYPHLHILVDGGLSLVTIDASAEAGANVIVAGTGIFKAEKPDEVISTFKEKVNKAQARFAKEAGIA

SEQ ID NO: 158273 - protein, 76 aa, Triticum aestivum
  Clone ID: PAT_TA_52691.pep
YTMLRIKPFAAIYIMIFFSRRVSGLPARVPCGSALVCALPKGGSFTYTPASGQHHILIVIGKGTTYFGAEHQDLKS

SEQ ID NO: 158274 - protein, 86 aa, Triticum aestivum
  Clone ID: PAT_TA_52692.pep
PLTELIYVHKAEMATKFPGPPLRRSNQIHSWLLADHLVEAAIANEETAPVFVQNHVRSLVDYGGGGNGVGIGVMDYHWLLGIWVVV

SEQ ID NO: 158275 - protein, 93 aa, Triticum aestivum
  Clone ID: PAT_TA_52693.pep
GGTPAIIGPRRTFTFFTPKRQIKGSLCFLGGIFLVLSQYPFLGFPVKKFGFLNLFGDFFPVVFGFLLRLPIIGPILFHPALSKVVPTQSRPRV

SEQ ID NO: 158276 - protein, 52 aa, Triticum aestivum
  Clone ID: PAT_TA_52694.pep
KNAQVYSGGGNQTTFKGNPRVYSLTGGRVPQLNPEPEKGGPGPPTLPQSWRG

SEQ ID NO: 158277 - protein, 73 aa, Triticum aestivum
  Clone ID: PAT_TA_52695.pep
PTKRGPTDDHSYHGGGVPKRGRGLTGANYICHNRGGVVGLGGWELGDGLGALGDRGLGGLPGGALAVGGLVPP

SEQ ID NO: 158278 - protein, 75 aa, Triticum aestivum
  Clone ID: PAT_TA_52696.pep
SNPPLVAATVSPSSAAYSTVRTGGPGVTEPTIVDELVSVFLAFALFFTTVWVSSCQMYELYSTREKKQTKNSTTA

SEQ ID NO: 158279 - protein, 66 aa, Triticum aestivum
  Clone ID: PAT_TA_52697.pep
PWASSPQRLQFKYSLSHKIFAIMQKPAFVFDGRNVVDAEKLREIGFIVYSIGKPLDGWLKDMPAIA

SEQ ID NO: 158280 - protein, 85 aa, Triticum aestivum
  Clone ID: PAT_TA_52698.pep
ILICVEVKCKFCPYLFPFPFSSSGRVIPMLPIHFFLESFIILTLFLIFNFLLLSSLRLIPMPLNHFFLTKLHYFELRPPSRWKQH

SEQ ID NO: 158281 - protein, 131 aa, Triticum aestivum
  unsure (1)..(131): unsure at all Xaa locations
  Clone ID: PAT_TA_52699.pep
LLSIQSNRLTKIEXLEELDKLEEIYLSHNAIAKIEGFQNNLKLTIIDIANNALTTIENLSHLPALEEFWANNNQFDNECYQQVEEELGKIKTLETVYLEGNPMQQKNKATYRNKIRLALSNIKQIDATPVR

SEQ ID NO: 158282 - protein, 83 aa, Triticum aestivum
  Clone ID: PAT_TA_52700.pep
FFFFFFFFFFFFFFFFFFFFFFFFFFLEFYPALFFIHTERGSHQKYWHFGRPQNTPITPTPTHTQARARWGRPEHIKGRIFPT

SEQ ID NO: 158283 - protein, 86 aa, Triticum aestivum
  Clone ID: PAT_TA_52701.pep
HQKKPCLAFFKRAQTTFSKTPFWLPTPGKPTTGGKTFSAPDHHHHGLHLKFRFLGKRLKRQRQGCSATSETYYNNYHRPGPWAVGK

SEQ ID NO: 158284 - protein, 167 aa, Triticum aestivum
  Clone ID: PAT_TA_52702.pep
NGKRRAAQQYYEIVVDLYANTNQEEPIRVASCSSAQLVVRGRSPGHYADSHTRFRSSAEHFSSPPYSLPNSPPHDVYSPPYPLGHFPPPPPPPLTQSMVYPSSSIYFPSSSSSSTVYFSSSSETHSSQVYDTTYTKEKNDPVKQTYWPHQDNLYQLYERQENYSIQS

SEQ ID NO: 158285 - protein, 155 aa, Triticum aestivum
  unsure (1)..(155): unsure at all Xaa locations
  Clone ID: PAT_TA_52703.pep
YQFCXSIGGPTAEVMGDILRFEADRRTINITINSFGTELPKEDRRKLFPTIGRLYPEGNARLAIADEIDQVKSVCEIFHEYRSFFDTTTSNKTLEDRFFETEVFLNRQAFQQQFNYGVFYAYIKLKEQEIRNIVWIAECISQNQKDRINSYIPIL

SEQ ID NO: 158286 - protein, 76 aa, Triticum aestivum
  Clone ID: PAT_TA_52704.pep
LFLFILFLFFIFFIFFFIFFFFFFFFFFFFFFFFFFFFLGTQRGTKKKQAGVWSGGGTPTRGGGPPKGVGFLTHKL

SEQ ID NO: 158287 - protein, 70 aa, Triticum aestivum
  Clone ID: PAT_TA_52705.pep
SANGEQLEVLNRVFDRTFFPSTQVRAELGRQLGMSPRTVQIWFQNRRQAMRTKERQRLIKLRNESKAKSA

SEQ ID NO: 158288 - protein, 81 aa, Triticum aestivum
  Clone ID: PAT_TA_52706.pep
GGARAPSTHIKSKTFGRAKPQKRDVTNPPIVPKHGKRGRPIMGKKTRQIEPNTQGKNPPHQSSTRGDKTIYSIKRRHANGL

SEQ ID NO: 158289 - protein, 85 aa, Triticum aestivum
  Clone ID: PAT_TA_52707.pep
QRKRIERGWRIPRKEFYSRRNLRINTSSKPLGASFRTNPLPRKSKYITKSGRLYSPCGAGLAQDIVELAWATDLSSRRGNLTTVP

SEQ ID NO: 158290 - protein, 168 aa, Triticum aestivum
  Clone ID: PAT_TA_52708.pep
NQEEKFAANPPRPVHDDIVIAKLRPGQEMEMELHCQKGVGREHAKWSPVATASYRLLPEITILEPIIGEDAEEFKNCFVEGVIEVVEENGVKTAKVVNPRKDTVSREVLRHDKFANKVRLTRVRDHFIFKVETSGVIPAEQIFLSALDVFMEKIKDIQPLVDRVISNE

SEQ ID NO: 158291 - protein, 170 aa, Triticum aestivum
  Clone ID: PAT_TA_52709.pep
KYAVLTSLISMKRVDIKKRVLDAPEVLEVISDIPHLEDYMNSLYNCQYTQFFRSLAAIEQAHLRSSRYLLPHMRYYIREMRILAYAQLLESYRSLTVTSMAQAFGVSEDYIDRDLYKFIAAGRLNCVIDKVNGIIETNRPDAKNAQYQSVIKHGDVLLNRIQKLSRVIDV

SEQ ID NO: 158292 - protein, 66 aa, Triticum aestivum
  unsure (1)..(66): unsure at all Xaa locations
  Clone ID: PAT_TA_52710.pep
YXLLXFGEGSLTLMPQEGTPRDVVKLPEGVLGEKIQEDFVGGRALLVPVVPPLGEDLALPSREAPK

SEQ ID NO: 158293 - protein, 103 aa, Triticum aestivum
  Clone ID: PAT_TA_52711.pep
PPPPPPPPRLPPQPAYPRSPPPPSTSFGSCPNLQVCVNVLNLPILSLGLFANECCPLLYGLADLQAAGCFCDVLDGILGLHLDVVLLLNQCNIRCESTYTCPR

SEQ ID NO: 158294 - protein, 137 aa, Triticum aestivum
  Clone ID: PAT_TA_52712.pep
QVEQFSKGVLSASPRSLLCTNLSPSFNWDAAGLNDNDMGSYIANLGKLGFVWQFITLGGLHANALASATFAKSFKESGMYGYVSQVQRKEREHGVDVLQHQKWSGANYVDELMKMVTGGVSSTAAMGKGVTEDQFKH

SEQ ID NO: 158295 - protein, 126 aa, Triticum aestivum
  Clone ID: PAT_TA_52713.pep
FRTEGVHLCDKMSTSTTTIDERTNSRAKIQVIFSLFLSFLQTRCTVLQEETHEFNAGRIANPKDAYTHYFRRDLAKCSLAVARAWLIVCSVNDPAPSNPWPDTFSAITFPSVSRTIPPSTTSSRHK

SEQ ID NO: 158296 - protein, 51 aa, Triticum aestivum
  Clone ID: PAT_TA_52714.pep
DATQVINEVEEVKKEYPDAYVRIIGFDNMRQVQCVSFIAFKPPGCEESGKA

SEQ ID NO: 158297 - protein, 115 aa, Triticum aestivum
  unsure (1)..(115): unsure at all Xaa locations
  Clone ID: PAT_TA_52715.pep
KPGGVGEHPGEPPPHPRQKGGFFFFPPKPQNQVEHPFLGFFPGFSSPRGRXAPPGFTGPPPRGGWGVFSPGGRPPPGPGKTGRPDSWANPPKKKGVGLSFNPPPVSQKEKKPPPP

SEQ ID NO: 158298 - protein, 52 aa, Triticum aestivum
  Clone ID: PAT_TA_52716.pep
QASGERALPIGHVGAPARTPGREMSWSSDPKEIKLSKLSAWELSRSTIPCNA

SEQ ID NO: 158299 - protein, 145 aa, Triticum aestivum
  unsure (1)..(145): unsure at all Xaa locations
  Clone ID: PAT_TA_52717.pep
NEFRKFLNLPTLETFEDFSEKLSVQQALKELYGTPDRVELXTGLMVERTKVTGLRLPYTMSRAILSDAVNLLRGDRILARELTPTNLTNWGYEYKLGDPNTNKRVFPEMLTKLFPDVHPFSGGFTPQEVKKLFIPPQFIQKENKE

SEQ ID NO: 158300 - protein, 86 aa, Triticum aestivum
  unsure (1)..(86): unsure at all Xaa locations
  Clone ID: PAT_TA_52718.pep
KGVLILPDILANSGGATVSYFEWVQNIQGFMWDEEKVNRELKTYMTRAFRDTKEMCRSHXCDLRMGAFTLGVNRVARATVLRGWEA

SEQ ID NO: 158301 - protein, 79 aa, Triticum aestivum
  Clone ID: PAT_TA_52719.pep
IGSGPMTNQPDGPLNAARHARASGTLTQHHLLSEGLSGRTRLPSIQTDRQTSRDEIGILNQATKKSRRRVRYVSECTKH

SEQ ID NO: 158302 - protein, 121 aa, Triticum aestivum
  unsure (1)..(121): unsure at all Xaa locations
  Clone ID: PAT_TA_52720.pep
CSGFRNCLPKMFVEIGLKCCFRGGIYQVGGLGKFLNSQALFSRMGRDFRLKPVCLGLAPRESPVLSGSIGIPPWLIMKCQKKKKKKKKKKKKKKKEKKXKKXKKEKEKKGGVPLLEDSIDL

SEQ ID NO: 158303 - protein, 76 aa, Triticum aestivum
  Clone ID: PAT_TA_52721.pep
VELRHVHATVVSSRSDSSALPHKLRIKAKAMQIKVEAFDNEFEATQKLSSPIDMTSKRHFELEKHSAPSMVPPSAP

SEQ ID NO: 158304 - protein, 162 aa, Triticum aestivum
  Clone ID: PAT_TA_52722.pep
MAFKFNWPEFDAEFYQEARSQLETALNKGNKPKNIVDYISVTELHMGTTAPELEILEIGELSTDKFRGIFKLTYCGDAYIVIQTKVQANPMHAKESDLPRHTQPTVLAANQPLIVPMLLRISDLKLRGIIVLVVSKTKGITLDFKNDPLESIVESSTFDSMT

SEQ ID NO: 158305 - protein, 76 aa, Triticum aestivum
  Clone ID: PAT_TA_52723.pep
KYHSALILSLIERHMDLKEAKVYTSATSRPRELCLKKISTCLFPTLKHNILWVDLYDRSSFQFLHNFVRREYGFLE

SEQ ID NO: 158306 - protein, 71 aa, Triticum aestivum
  Clone ID: PAT_TA_52724.pep
KKKNPPHLGPNLTESKHNTPQQFNQGPATNLGPGGKKTLGLGSPAKEEALPPPPVLGKPSNLANNLPKKPF

SEQ ID NO: 158307 - protein, 41 aa, Triticum aestivum
  Clone ID: PAT_TA_52725.pep
LHGVLRHRTGVLFSLLPGVDDLEEYIPPVLYPKWNVPVPGN

SEQ ID NO: 158308 - protein, 105 aa, Triticum aestivum
  Clone ID: PAT_TA_52726.pep
MAFGMAFKTALLCLLGMLIASPAIAVSDSGIYYQIGLMWPGAYCAQTTGGCCMPKSPVVPAADFYVSGFTVFNATTDAPETSCSVTHTLVGCLRLLEAQYLEANA

SEQ ID NO: 158309 - protein, 152 aa, Triticum aestivum
  Clone ID: PAT_TA_52727.pep
KLKYKNVFEEGRLFFIKSQFNGRVLDVEDGSTEDDANIIVYTQKYEDCWNQLWRYENGYFINAKSAKVLDIRGGEMQPESQIIQYAQKMVEEAANQRWAIDEEGYIFCEARPDLVLDIQGAEDNDCVPVILYERREGEVSSNQRWELVPFEG

SEQ ID NO: 158310 - protein, 173 aa, Triticum aestivum
  Clone ID: PAT_TA_52728.pep
IEAVFERKIKQAEVQKRIAQSNHINKTRLKILQERQQVLDDLFEEANKRIHQVSDDQDTYRTLIEGLILQGAYALMEPEIDIRCRQQDVDAVTSTLETVADRYEENLKSRPNFTISEDHLPESSAGGVILSGHHGRITVDNTLDARLEIAKEEMLPQIRVALFDHSPNRTFFN

SEQ ID NO: 158311 - protein, 65 aa, Triticum aestivum
  Clone ID: PAT_TA_52729.pep
PQQAIESKIFMAAMAATGQRPLMASMVLLLHVWHEFLKTHQHRSADRQAQLQSLLNQEPLQLELA

SEQ ID NO: 158312 - protein, 64 aa, Triticum aestivum
  Clone ID: PAT_TA_52730.pep
TCRAPWGAPPAGSPTSGGWRSPRVFLLASLTPPVSPSACRTPAGVRGRCCGLLQQTIMYPLKIG

SEQ ID NO: 158313 - protein, 77 aa, Triticum aestivum
  Clone ID: PAT_TA_52731.pep
PGLWAPPPRKSPPGRVPGYGFFPKVFTGGIKSGLGQNPKVPDRIGFSKRYCDFLGLGSGKTLDCSTQLSFTFGLPAQ

SEQ ID NO: 158314 - protein, 69 aa, Triticum aestivum
  Clone ID: PAT_TA_52732.pep
ENGRCRLQARSVYRILYYAGFILSFSLSCNARLGRGASGGLREAPCAILYASGKLDFCQFSKSIPPQFW

SEQ ID NO: 158315 - protein, 84 aa, Triticum aestivum
  Clone ID: PAT_TA_52733.pep
VTFALSPCISYARGNGANPPGACCKGVRSLAGAARSTVDKQTGCKCIKSAVGGLNVGKAPGILSKWGVRVPYAISSFVDCFKIR

SEQ ID NO: 158316 - protein, 172 aa, Triticum aestivum
  Clone ID: PAT_TA_52734.pep
KILATAAAIERAFLNVYSINKDLKTGLGTAIGRYPEDVYDGYEKSKGNLWFLATAAYAELYYLAIEEWKQKGIEINKVNKPFFERIAPFDYGTYAPNSDQWQQIISKVSTEADKFLATVQFHQQTNGSMSEQFNRNTGRMQGARDLTWSHAAFISAVKAKEGLPITPVITSK

SEQ ID NO: 158317 - protein, 115 aa, Triticum aestivum
  Clone ID: PAT_TA_52735.pep
LFTHIRKQPSQQGVKDIFVEAVGIEQEFLSDALPVALIGMNAPLMGQEIELVADRLRVALGFAKIYNATNPFGFRGMISLQGKANFFEKGVFDYQRAGVMNKTPVEKTFPLDGDF

SEQ ID NO: 158318 - protein, 73 aa, Triticum aestivum
  Clone ID: PAT_TA_52736.pep
LLGPVDELFFDMYDRYEPVNEPSLDNCFVSSSYDATTHFETTVTDVLNMYTLITGKTVDLSVDLSAASAAEEY

SEQ ID NO: 158319 - protein, 95 aa, Triticum aestivum
  Clone ID: PAT_TA_52737.pep
KGLGKGGAKRHRKILRDNIQGITKPAIRRLARRGGVKRISGLIYEETRNVLKVFLENVIRDAVTYTEHAKRKTVTSLDVVYALKRQGRTLYGFGG

SEQ ID NO: 158320 - protein, 92 aa, Triticum aestivum
  Clone ID: PAT_TA_52738.pep
TVACVSVNDAFVMKAWKESFGLGKDVQLLSDGNIELTRALGVEMDLSDKPMGLGVRSRRYALLADDGVVKVLNLEEGGAFTTSSAEEMLKAL

SEQ ID NO: 158321 - protein, 138 aa, Triticum aestivum
  Clone ID: PAT_TA_52739.pep
YIVTICPSLVIGPLMQSTINSSSKILLNYLKGEHDTVENKSRDIVDVRDVADAILLAYENPEMSGRYICNAPAIKVCDMVNILKTLYPTYTYPKSFTEVEGNLVYSSEKLQKLGWTFRPVEKTLGDSVESYRASGLLN

SEQ ID NO: 158322 - protein, 86 aa, Triticum aestivum
  Clone ID: PAT_TA_52740.pep
SPLMLVEVKNVGPQEKTRCPFCLGPGSLPCARCFATKMLLGPKRFSLFPIERCSNCSGVGKVFCPPCLCPGMAMASGLAPRLDPFA

SEQ ID NO: 158323 - protein, 170 aa, Triticum aestivum
  Clone ID: PAT_TA_52741.pep
SDLARLAETSALIQRTTANIQSLQASLTLYAQQRLPSTERIQILQVASQERLHCLTGQVSTQLQQVMEYLKAQSTETPEWLKTRVYSLVEIAHKQVDLVRTEYAREDISSVDKAKNVAQGLQSQVLPVLQTIQAQLNHYTQLARQRASHDLKVPFEYLGLSHAPKLAQAQ

SEQ ID NO: 158324 - protein, 180 aa, Triticum aestivum
  Clone ID: PAT_TA_52742.pep
CKAVVEITDENFSNMVQKNDEWLIDFYADWCGYCQRFESTFYEAERQLQLSSYKHVQVGVVNVDTNPGLAARFFISRLPTVIHVKNHEVRVLTSIKTVNDIVGFVTLENWRQVDPKSGFLSPFSLFGKLLGFVGKTVKMASNYSSPWTLIGVLTGFLILVLFLPIIIDKLNKKTDKVKEQ

SEQ ID NO: 158325 - protein, 146 aa, Triticum aestivum
  Clone ID: PAT_TA_52743.pep
YCVDILVSSGEGKVRLLKTRTTIYKKTDIRYQLKMATSRAVLSEIQAKAGAFPFSLRDLEDERKARMGIVEAAKHQTVLPYDVVYEREGAFVAQYLTTLFVTKKGNVMVTNPRFDAVSVQTEKSVKDEEIVKLLASEWEVPKKAKK

SEQ ID NO: 158326 - protein, 75 aa, Triticum aestivum
  Clone ID: PAT_TA_52744.pep
WALAQSRWLRRQGRACTLAPWGRDGSGLCDQGDGVVLTAPLLGVGLQVIDVPLAVFSFWELLGEISEFWIHDAVW

SEQ ID NO: 158327 - protein, 153 aa, Triticum aestivum
  Clone ID: PAT_TA_52745.pep
GFNWAQEKKVVPVFRGPTPFSRGGNRAPIFKIGENMGQNFFQFDPGPGQIEPNPRGKTPDNFLEWGGCLFLTFFPPGGVCRFLPLKNGIPLGGLGPPPPLFLFGDFGCPFSGPLGPFLKALPWGFFLDPPFGLFPSQKRGPPKKSSRTIFLPL

SEQ ID NO: 158328 - protein, 70 aa, Triticum aestivum
  Clone ID: PAT_TA_52746.pep
RRSSTGASTEASPKNSGDKSETTATPCQDPRSRGNGGEPDHDGDRPEGVAGRRIAGHEASLFTLAYLRSA

SEQ ID NO: 158329 - protein, 101 aa, Triticum aestivum
  unsure (1)..(101): unsure at all Xaa locations
  Clone ID: PAT_TA_52747.pep
SPQIFGEGPSPSVGSGDXFFNGRLENPNFPFLLKNYGFVSETNPGEGSPLNARGVFPFPPKIFFPPPRGYFCFQSFFWGGRLGLLSPFPKFGGPPPSKKRA

SEQ ID NO: 158330 - protein, 38 aa, Triticum aestivum
  Clone ID: PAT_TA_52748.pep
APALVQAQRDYFGAHTYERVDMPGSFHTEWYKIANSKI

SEQ ID NO: 158331 - protein, 116 aa, Triticum aestivum
  unsure (1)..(116): unsure at all Xaa locations
  Clone ID: PAT_TA_52749.pep
NVARQDHTTAVKQRFESVXDFGGVIDITKTLFEVSKETAQLEAQAFELEQKTAIAAEAKSVLDSWVRYEGQVKQRQQKELAESIIAKIEKELENPKTLKQILDQSVTDIERIVQKA

SEQ ID NO: 158332 - protein, 61 aa, Triticum aestivum
  Clone ID: PAT_TA_52750.pep
FFFFFFFFFFFFFFFFFFFFWFFFFFFFFFFFFFHPKKKTLLFFLKGNPSPSPPINRDPKF

SEQ ID NO: 158333 - protein, 112 aa, Triticum aestivum
  Clone ID: PAT_TA_52751.pep
ILCSSIRTYGYGSWSHKYVTCQVYHERHRTIYLLWETGFQFVSLVRAHQGAQEGQARIPVFDDRLDAAVGLAEGALLATKSHRVWVIIEREKTIGGVSLTDEMRAIAPPAMV

SEQ ID NO: 158334 - protein, 100 aa, Triticum aestivum
  unsure (1)..(100): unsure at all Xaa locations
  Clone ID: PAT_TA_52752.pep
MPCLSPPNKFKFLGGLKKITPTRVGFNPKRQATFPPRPPKLTQMPLPFPPPXNGGPPVVDRGPPGSAPPPPAREALPLAPPPLAPGNRPLNSPGPLALSW

SEQ ID NO: 158335 - protein, 76 aa, Triticum aestivum
  Clone ID: PAT_TA_52753.pep
LFIDLPLLREEQKYIWSLQHDPDERNGAPEFTHLINSLTRLQAFMLKSCERANQALGRRILRGKTTSACMHVARWG

SEQ ID NO: 158336 - protein, 86 aa, Triticum aestivum
  Clone ID: PAT_TA_52754.pep
PRYISYLAGPPGVYRGPNQPKIFFGFWQPYKSITFLGGNMGYKHASWDMARDHFDHRGPCHILCPGTPKAGHCFKGKGLGKQTGGT

SEQ ID NO: 158337 - protein, 94 aa, Triticum aestivum
  Clone ID: PAT_TA_52755.pep
MKAPESPPRPPGCEKTGVGHFQRGLSIFLFIMFKCKPPLWAFVSPLFSPGKKSQRKFCYFRPFFPWPILFAFLESFHLCLGWVFPVKDICFVNI

SEQ ID NO: 158338 - protein, 114 aa, Triticum aestivum
  Clone ID: PAT_TA_52756.pep
VHTFFQPLGALSGGAALFTHHHRFCLILHKGKTGELLHWLGLFGFFFPPPPFLTRLFIFTFGPRALLLLLPLSSPSAQEHLDYPSTWGVRRRPYWGWLTGYNPGAPRRATSKAF

SEQ ID NO: 158339 - protein, 96 aa, Triticum aestivum
  Clone ID: PAT_TA_52757.pep
LPPFAGDAKLWVKRFPFPKDPKAPPAVGLQFFGGWPPGNGPRLWPCPGFPSRAGPTSPPGFGRPPFFRYSFPKRALGSPARVRPFRPSGGFFFLTV

SEQ ID NO: 158340 - protein, 188 aa, Triticum aestivum
  Clone ID: PAT_TA_52758.pep
MSSNLRIACVMVGLPARGKTYISQKVCRYLTWLGINTKVFNVGNYRRKLHGAHLPHTFFDPHNTLGEQQRREAAAAALEDMIRWFNEDQGIVAIYDATNSTMARRRWLCDKLGKEDIQVLFIESICQDEELILANIKDVKLSSPDYADTDPDEAAIDFMARIDHYKEQYETITEPELTYIKLINVGSQ

SEQ ID NO: 158341 - protein, 199 aa, Triticum aestivum
  unsure (1)..(199): unsure at all Xaa locations
  Clone ID: PAT_TA_52759.pep
MSTQANDVGVKSAPNSETVDLLALAQQVTQHTQAIADYLVANKHASPTFASDCIDRPETIEYAELHGNLKRSLEDLQYLVEGPKRHFRALCCQGYELAAIQVALDFNFFSIVPAHGNISLEDLAKHAGVDLDRTSRIVRLLITESIFREPAHGYVAHSPSSYLLHHDEXIRSTVHYTVDEMLKAASSTADNVKASPLEY

SEQ ID NO: 158342 - protein, 104 aa, Triticum aestivum
  unsure (1)..(104): unsure at all Xaa locations
  Clone ID: PAT_TA_52760.pep
PVQQSFRFFVLVLRVAELELNPPKSSTNLVAESRAINRYIATKYGAALLPTPSAKLEAWLEVESHHFYPPARTLVYELLIKPMLGAPTDAAEVDKNAXDLAKLL

SEQ ID NO: 158343 - protein, 187 aa, Triticum aestivum
  Clone ID: PAT_TA_52761.pep
MASAAGEGRSRVLVIGGTGYIGRFIVAASAREGHPTAVLVRDAAPADPAKAAVLQGFRDAGVAIVEGDMYDHESLVTAIKSADVVISAVGYQQLPDQTLIISAIKEVGHVKRFFPSEYGNDVDRNHAVEPAKTVFGGKARIRRAIEAEGIPYTYVSSNFFAGRFLRSLAQIGVTEPPTEKVLIMGDG

SEQ ID NO: 158344 - protein, 179 aa, Triticum aestivum
  unsure (1)..(179): unsure at all Xaa locations
  Clone ID: PAT_TA_52762.pep
PVRYRSWYLVHWSPTARPTGGTAMDTPGYAEPVPYGMMHGNIDGRYRGRPMTAKTYWKIYCRSNLNYPMCVRNLKVVLPPDNSKDXIQDLMKDMRLNNKVKDHEFYLVFNVANKAIKHSIKHSLRQCQAARMVHYKQDYLXRRCMRTESKDFSNGLMGKHMENNIYVNFDDLNRDEVHG

SEQ ID NO: 158345 - protein, 88 aa, Triticum aestivum
  Clone ID: PAT_TA_52763.pep
VGYHDDTVVKVRNLHHVHIGRSRPVAACTVDSQGHGIGQALFIDHIKISAFDRTYSSLLCRRLVILETKQDVLFRGRCAPYQFDLRIL

SEQ ID NO: 158346 - protein, 36 aa, Triticum aestivum
  Clone ID: PAT_TA_52764.pep
YAIVHVKHTEHVLPTTVVLTCSIKLARGITTQHSGT

SEQ ID NO: 158347 - protein, 197 aa, Triticum aestivum
  Clone ID: PAT_TA_52765.pep
SNTFLFTSESVGEGHPDKICDQVSDAILDACLAQDPMSKVACETAAKTGMIMVFGEITTKANLDYQKIIRNTIKQIGYDDSEKGFDYKTCNVLVAIEQQSPDIAQGLVQKSFNIEDIGAGDQGIMFGYATDETPEMMPLTCVLSHKLNSRMSELRRDGRLGWLRPDSKTQVTIEYKNENGAMVPLRVDTVVISVHTL

SEQ ID NO: 158348 - protein, 48 aa, Triticum aestivum
  Clone ID: PAT_TA_52766.pep
FSRDAYWRAAISLAAMSARISHLSNGLRAHSSTTSVTTGFFPLFGIVG

SEQ ID NO: 158349 - protein, 53 aa, Triticum aestivum
  Clone ID: PAT_TA_52767.pep
LFCSLYLTMVLRSATTYSAYISVALSTSSAAMNTDSTGAWPTSSIKCTSPTMS

SEQ ID NO: 158350 - protein, 187 aa, Triticum aestivum
  Clone ID: PAT_TA_52768.pep
PRVREAPKKDVLDTVLDKEGEWKQEGSLLSHDVMRALLSDLYGAGASTTAALIEWGMVDLLQNPEVMRKVKEELATVLGDKPLMEESDIARLPYLQVVVKEILRLRMVVPLVPRKAEADIEVNGYRIPKGTNVILNAWAINRSADAWSDPDKFVPERFIGGETKNFQLGQDFDMIPFGLGRRICPGM

SEQ ID NO: 158351 - protein, 192 aa, Triticum aestivum
  Clone ID: PAT_TA_52769.pep
PASAHASAMAGRLVAGADDDVYLNISCTGEGVPFVAASASCALEQAMTAPSMGLLRELTVRYPGELCRLSDALLLMQVTEFTCGGFVVGVTWNHVMADGAGIAQFLQAVGELARGMGAPSVAPVRSGATIPPIPTPVVAALRSQMQVLTEELASLDVTIPSGLISRVKAECGGDCTTFEVVAAALWRSRTRA

SEQ ID NO: 158352 - protein, 183 aa, Triticum aestivum
  Clone ID: PAT_TA_52770.pep
TSPSAALLLMPSWCAHPSLPYLALKAVTSFPAISPHRPSIHATVSLFSSASGVPLAFVDGSALTLLRTAAVSALAASLLVSPSRPPSTLALAGAGALAPYLAEAHLSALPSLFRILVWNRTKAKSAALVGKLRDAHPGVAVEEVDGMDEAGSAADIVSCATGSQEPIVRGELLKPAAHLDLVG

SEQ ID NO: 158353 - protein, 193 aa, Triticum aestivum
  Clone ID: PAT_TA_52771.pep
MMRSTAFSTATSSDSKVRSRSHSISSHILSSVNKKIKEIEDADRTHILQYVDNQVHETWDSTKAAMIGAQRLLEFYELPKEWQENEYILSGYRFYQTSQACLKSIFMIHNETANIWSHLLGFIFMSCLCLYGFNSHFPDASWSDRTVLITFCVASLKCLFCSFIYHTFICHSHRQIKLFTATLDYMGIAFLIT

SEQ ID NO: 158354 - protein, 53 aa, Triticum aestivum
  Clone ID: PAT_TA_52772.pep
TRYTLSFSSIQVKLSNDGNPPRKGEPVGGLCHKLQILHDRSLAQPSVHRLSNK

SEQ ID NO: 158355 - protein, 43 aa, Triticum aestivum
  Clone ID: PAT_TA_52773.pep
ISFSAFANVSSATVDLKAIINFESAAIKNVSVSLSYHCGRFVP

SEQ ID NO: 158356 - protein, 150 aa, Triticum aestivum
  unsure (1)..(150): unsure at all Xaa locations
  Clone ID: PAT_TA_52774.pep
PTFALHFRAQGWHHAWPGAEILHDCRLRIAELNSNRIHXRFVTYMLDNPKDAIVYLTGARDGPCXDLTNTLPENNWGFRSIGSNFTTPCVLPHSSILYIPWSTDMAEVIHHMNCASPGDTPIRTLDGIPILMHSTDPKEVRLDLLYEHAH

SEQ ID NO: 158357 - protein, 166 aa, Triticum aestivum
  Clone ID: PAT_TA_52775.pep
FTSPEQYQGYSMNQFDSLLDFLPKVSYPSPCESPLANDVSLMTPNNNTPQPVFGVAGGFLNDSMLMVPPIDQFKYYTNFEKLVYEPKMLDIDYLDKFIAQHEAALNMPELEEDENQMPEEEEEEEEEEAWSHCSSPKHSPTKKDEEEIIILQDRKTNRIIKKSPGR

SEQ ID NO: 158358 - protein, 156 aa, Triticum aestivum
  Clone ID: PAT_TA_52776.pep
ICSSPFERLQVDEEALPFPENSIEAVVSSLSLNWVNDLPGSLIQIKNSLKPDGVFLGAMFGGDTLFELRTSLQLAEMERESGVSPRVSPMADSSDMSRLLTRAGFSLPTVDVDEIQVNYPSMFELIEDLKAMGESNAVLTRRPFLKRDTLLAAASI

SEQ ID NO: 158359 - protein, 180 aa, Triticum aestivum
  Clone ID: PAT_TA_52777.pep
LIYTSGTTGLPKAAIVQHLRVYGSMAVLGKTAGIKKDSRVYCVLPLYHSSGLLVSFTSTLHAGGTFVLGRKFSASRFWKDCVNYKVNVFTYIGEFCRYLLSQPPRPEEKRHQVKVIYGNGMRPDVWERFRERFNIPTICEFYSATEAPSSMINVNTSELGAGAVGSRGRLIRLLQNEIQI

SEQ ID NO: 158360 - protein, 52 aa, Triticum aestivum
  unsure (1)..(52): unsure at all Xaa locations
  Clone ID: PAT_TA_52778.pep
WCLYAWPXSRSRCSDLRLSGAGPRGATRPVTSIAGGSCPRPPRSCAMVCWYA

SEQ ID NO: 158361 - protein, 176 aa, Triticum aestivum
  Clone ID: PAT_TA_52779.pep
MVDSIWVVLGQLDMWSVTDRHFAGAIRATCTAHAAYLNALVLGTSADRSRCKDIGRIVVKHKDLLGFEVRMHFARAMLPEMDATSSALMLFDDEPHALEMLIDRSQLLTDSLRYVSEAASHVLHGRLFVEFLDEEAIGEGVAREWISLVCRALFDPRHGLFSPCPRDRRRFFLNRA

SEQ ID NO: 158362 - protein, 52 aa, Triticum aestivum
  Clone ID: PAT_TA_52780.pep
FNRYCLDIKVLARASRSFRTKVAKSDGSNEYYQGVHGAAQPDRLPPPLPLSC

SEQ ID NO: 158363 - protein, 73 aa, Triticum aestivum
  Clone ID: PAT_TA_52781.pep
ARPSDRAMRLTIRLWLLHWLSTSCLLWPSLSCWASYCWMHWWLAPGLGDRLSHRHNLEEKHGETHCTCIHHML

SEQ ID NO: 158364 - protein, 202 aa, Triticum aestivum
  Clone ID: PAT_TA_52782.pep
PRVREFRRQQSVFRDCIEADANAKFAAEPDRYHLYISWACPWAHRTAIVRQLKGLDKIIGMSVVDYLMLDKGWKFSTEQECPGAIPDTVNKSSYIRDLYFKVNPNYEGRFTVPVLWDKKLQTIVNNESSEIIRMFNTAFNSFLSKEQAELNYYPESLQKEIDETNEWIYDTVNNGVYKSGFATTQQAYENNVYNVFKSLDRI

SEQ ID NO: 158365 - protein, 115 aa, Triticum aestivum
  Clone ID: PAT_TA_52783.pep
SRCCQPWTQWYYAVDSVREPVKDSVKVSKRFHKRYRKEDTKEVIKDGHWDRHHGLRHGLRQAHLHAHHHHHQQHHLIFRLNLRCDMTRGWTTLMGAFKQVIYDFIEEDIVHGIFI

SEQ ID NO: 158366 - protein, 79 aa, Triticum aestivum
  Clone ID: PAT_TA_52784.pep
IGPPFPEPPTVFPPFFFPKVIFFKLKSFFDHFRVGALPPFFFLKKGNFKARFFGPFKEDFPTKFWFPPAHFSPTGFFLA

SEQ ID NO: 158367 - protein, 203 aa, Triticum aestivum
  Clone ID: PAT_TA_52785.pep
MDYQQYISELSKTRQPSAIRALTPYLHEENMISLGAGQPNPSTFPFKSMSVTLESGETLQMDQQLFKRCLSYDLSSGLPQLNEWLKNLQEIEHKPSVKGYSLSVGVGSQDLLTKAFEMVIEPGTALLVEDPTYTGAIAHLRTQPCELIGVATDAEGVKPDALDKILTEWSSAPTSKGNGKKPKVLYTIPCGGNPTGATASLGR

SEQ ID NO: 158368 - protein, 61 aa, Triticum aestivum
  Clone ID: PAT_TA_52786.pep
SEHTCSPLNVVFVPPPACSTARRLPSTTEMFLPASKASARGGVAIRRTAVTQHIPLLYLMS

SEQ ID NO: 158369 - protein, 176 aa, Triticum aestivum
  Clone ID: PAT_TA_52787.pep
MVFLSNAISNARIEESHSKGELHHDAVETTIYGTRWASEDIPRFDLPEDEMPSNVAYRLIKDDLALDGNPALNLATFVTTYMEEEAEKLMAENLSKNFIDYEEYPQSVELCNRCVNMIARLYHAPMHSADEEALGCSTVGSSEAIILATLAMKRRWQNARKEKGLPTDKPNLIFGA

SEQ ID NO: 158370 - protein, 195 aa, Triticum aestivum
  Clone ID: PAT_TA_52788.pep
VKGYDPTPSGLASCLKGSDIILIPAGVPRKPGMTRDDLFNTNASIVRDLAKACAESAPDANLLIIANPVNSTVPICAEVYKAKGVYNPKRLFGVTTLDVVRASRFVSEIKSTDPKDENITVVGGHSGVTIVPLFSQSNHPDLSSNNELVNRVQFGGDEVVKAKDGAGSATLSMAMAGARMAESLLRASQGEEGCN

SEQ ID NO: 158371 - protein, 169 aa, Triticum aestivum
  unsure (1)..(169): unsure at all Xaa locations
  Clone ID: PAT_TA_52789.pep
MSGEAGAGGGGEANGVQPNVTIYINNLNEKIKLEALKKSLNAVFSQFGKIIEVLAFKTLKHKGQAWVVFEDVASATEALKRMQDFPFYDKPMKIQYAKTKSDVIAKADGTFVPREKRKRNDEKPEKKQKREQHHDVNQAGVGMHAYPGAYGXAXPLSQLPFWCGTKSHD

SEQ ID NO: 158372 - protein, 169 aa, Triticum aestivum
  Clone ID: PAT_TA_52790.pep
MASAPTASEHAPPASATAPVPVPVRPVDLPPPVVPASTAAPVDGSRLSEQDEAVVLQSLRAHLWSHGDLPRGADLVDIFFGRLSRADYSLWDIEAKIRALRRRFREADAALCTGTGCPAPGHGLRMYALSLEVWGATPAVVAPPRRDPVPDKDAASTAVTAVGNRMPVT

SEQ ID NO: 158373 - protein, 202 aa, Triticum aestivum
  Clone ID: PAT_TA_52791.pep
VIVVGGGLAGLSAAIEAHDQGNTRVILIEKEDKIGGNSMKASSGINAIENTTGDSREAFIQDTLKSGDGLSSEELVIKLVDESQSSLDWLIHQSEFDAGKPTLDLSLVSRCGGHSFGRTHRCPPENGRPVPVGWKLIDTLKKRLTSLPHTQVMTQTRVLGLLSDASQRVCGVRLESDEEITADAVILTSGGFGGQTGTYLTD

SEQ ID NO: 158374 - protein, 186 aa, Triticum aestivum
  Clone ID: PAT_TA_52792.pep
KNFILSRQQLEPIVKGFDQEYKMGLKTPSKGLATMIPSFVTKMPKGNETGTFLSLDMGGTNLRIAAVELKGAGKSIVHELKRCPSIELKTGEGAMFFDWIADAVRDLITIEAKHLFTQNQVEGKETLALGVCWSFPVDQTAVDRGTILRMGKGFTLKNTEGNDLADMFHEAFKRKKLNVKVTAILN

SEQ ID NO: 158375 - protein, 175 aa, Triticum aestivum
  unsure (1)..(175): unsure at all Xaa locations
  Clone ID: PAT_TA_52793.pep
MERVSPWLLLVVLLVAAASGRSARGDPQVPCYFVFGDSLVDNGNNNDIASLARANYPPYGIDFPGGATGRFSNGLTTVDAISRLLGFDDYIPAYAGANNDQLLSGVNFASAAAGIRDETGQQLGQRISFGGQLQNYQAAVQQLVSIXGDEDSAANHLSQCIFTVGMGSNDYLNNY

SEQ ID NO: 158376 - protein, 172 aa, Triticum aestivum
  unsure (1)..(172): unsure at all Xaa locations
  Clone ID: PAT_TA_52794.pep
MRQLAKPGAPKGRSRRAVAGAKEKAVAGSFRRLCFAAVLAVTFFLYYRFSQLDDPCRGRYIHVCKLPPRFNTDMTRDACRGDGRWPAGACESIDNAGLGPPLADPADGVLTGEDGWYGTRQLALDIIFHNRMKRYECLTNHTXVATAVFVPFYAALDFARYAGQNNVTRDAA

SEQ ID NO: 158377 - protein, 47 aa, Triticum aestivum
  unsure (1)..(47): unsure at all Xaa locations
  Clone ID: PAT_TA_52795.pep
SSAXNSSXXAHFSTGLKKCAPTIRSWDFVFSPIRLRSIVADAWADAW

SEQ ID NO: 158378 - protein, 151 aa, Triticum aestivum
  Clone ID: PAT_TA_52796.pep
TVFLRYDNLKIYYPNSVLATKPIFNFYRSPDMGEGIDFSIHVATPVEKLALMKERILRYIDGKKEHWYPGAMVVLRDVDDTNKLKVSIWLRHTLNFQDMGMRFVRRELVLQEMIRVLKDLDIEYRMLPLDVNVRNVPPLQSTRMPTTWSYA

SEQ ID NO: 158379 - protein, 85 aa, Triticum aestivum
  unsure (1)..(85): unsure at all Xaa locations
  Clone ID: PAT_TA_52797.pep
KHMPTEFKLGAXTRCLCTPRGCVPCRCRFKRRDLPWLWVIICPSSSSICFQFQQRKESACASVRALDSALICALVVNKQRTGQCC

SEQ ID NO: 158380 - protein, 70 aa, Triticum aestivum
  Clone ID: PAT_TA_52798.pep
GRWRCICFFLSHDTIIDIILAYHTHVLSLNTNKFEVLLSQAHLTTGVYYFKHALPMVICHILTVSFLRRK

SEQ ID NO: 158381 - protein, 110 aa, Triticum aestivum
  unsure (1)..(110): unsure at all Xaa locations
  Clone ID: PAT_TA_52799.pep
METSKLNPDGSANYCDSLYTYYYAQYYSETETETSPEPFTAGFYTRSSHLSEPSTHCTFIPCLXHYTNYSTSSKTYSENGTEYGTQYRAGLLERVIIPDTLTVGRVQGLD

SEQ ID NO: 158382 - protein, 109 aa, Triticum aestivum
  Clone ID: PAT_TA_52800.pep
REAAIYDRQIRLWGLDAQQRIGKAHILIASVRALSNEVCKNLALAGVASITLLDHEIVKEHDLGSQFLLHEDDIGKNRAESAARNIQLLNPRVHVYVDTEDISEKPDSY

SEQ ID NO: 158383 - protein, 184 aa, Triticum aestivum
  Clone ID: PAT_TA_52801.pep
KWRQEIRSQQRSIQKQISAIDNEEAKVKRSIKQVAKKGDTKSCKMLAKELIRSQRHKNRLYTSKAQLNSIVMQLEHQLATLKVAGSLQKSGEVMKLVNQLARLPELSLSMQQMSMEMTKAGIMEEMIGDTMEMMDDDDIEEAADEEVNNVLFQITDGLLGEAGSVGPILETKPAQEEEEEEEEE

SEQ ID NO: 158384 - protein, 200 aa, Triticum aestivum
  unsure (1)..(200): unsure at all Xaa locations
  Clone ID: PAT_TA_52802.pep
IFETNLKLIFAVLIAHYFISALNINVTNYIINSRLVYTLKTLFILRCCYNLWYSTKHITTPIVASYKFPLSKYLFAPSPLTKSILNFIRNLFNILRKPQPVSTEPTKSPAKQPISMVDTFQKAEQMFLANVKNTKTSTLNFLNSNTNSVYRDSLTDIKEASKASKLERDSLKEQVFGTESTHLPTLRXVPCIQAPTTPLV

SEQ ID NO: 158385 - protein, 60 aa, Triticum aestivum
  Clone ID: PAT_TA_52803.pep
VHQQAPLVSVYLIIHHYCHHLFISMHKSIHYVSRSHSVLPNVMGDRNSVRDNADTDADAW

SEQ ID NO: 158386 - protein, 162 aa, Triticum aestivum
  unsure (1)..(162): unsure at all Xaa locations
  Clone ID: PAT_TA_52804.pep
LLGRCLIHIPGEKKPPTHQTNTTTGGGGKAGPTHTTESKRTRAQRPAPHRPKKGHQPPGHPQPSRHPPAPPPGPPPXGAPPQTRTHPGRQTNHPPGKPDETPPEKRTNPGPGGKKNAVTNPHTKQTGSKKCKPRGAQRTSQLTKKERRGRPNSQPGNKKGQP

SEQ ID NO: 158387 - protein, 103 aa, Triticum aestivum
  Clone ID: PAT_TA_52805.pep
GVASNDTLNDTERIEYLKSYMGSTLKAVRNGANVKGYFVWSFLDVFEFFAGPQSRYGLYRVDFNDEARPRQAKLSARWYSGFLKNNGSYVQNELDSTESRALQ

SEQ ID NO: 158388 - protein, 100 aa, Triticum aestivum
  Clone ID: PAT_TA_52806.pep
RGKGGKGLGKGGAKRHRKILRDNIQGITKPAIRRLARRGGVKRISGLIYEETRNVLKVFLENVIRDAVTYTEHAKRKTVTSLDVVYALKRQGRTLYGFGG

SEQ ID NO: 158389 - protein, 65 aa, Triticum aestivum
  Clone ID: PAT_TA_52807.pep
NPPNPSKAGNRFGKKPTPGPPSSPPSSSPPGPGLAPSMGPPKPAPPSNPFVIGKKPFFPFSWAPL

SEQ ID NO: 158390 - protein, 163 aa, Triticum aestivum
  Clone ID: PAT_TA_52808.pep
SRTHYHKLNEALLKHIFRPLLKSIESFEIVLSNSGQNIVTCDPKFMAITMLLPEFNNNENFLFNLSEIHQLITINGRTDAESKKYTLERVKELSSSQRMAAFRGIPKIKGMPSDAEIIFYIVRTYLKMREPHIVPPLLPLEGDVFKFLLIYIKMTPELSWGVF

SEQ ID NO: 158391 - protein, 149 aa, Triticum aestivum
  Clone ID: PAT_TA_52809.pep
FGTGYLFSYPFLPFQKGNLIQTGQKVHNLLHYMFYKHNPTLCFIGLPMRVVPFPLMQLQSTVMARYWCHKIPMLPFEESAKGTDDKKDFIMSLEQEFHYSDMLSAWSEGWLDRPLEEWQSNDAVTGRLSDKWKYLRENAFKIRKERLGY

SEQ ID NO: 158392 - protein, 173 aa, Triticum aestivum
  Clone ID: PAT_TA_52810.pep
SLKNRIQPYVDGKHKEFGDWASAEAERLSQAAFGEAMLHTIGYIYVRQAARELGKSKMYMGVPFIAEWVRDKGHHVKSQVNAASGAIALIQLQEGMKKIEDGDNKEEQILKSIEEKKGAMLNSLWKINVVDIESTLWRVCRAVSTVHICSSKIFTVACTCAYICIFIMFMCRQ

SEQ ID NO: 158393 - protein, 177 aa, Triticum aestivum
  Clone ID: PAT_TA_52811.pep
FFFFFFFFLFFFFFFFFFFFFFFFFGRGGGRGGPPGKTRTGPGGPTSPPEGGGEGRGGKKGPKRRAGKNGHPGTSPKKKRAERKKGKAGGAKRGNKQKKKGGGQPPTKKGENPAGQQKKKNGQPPGRGGSQKGRRGGFFFNQKNGQRGRALNRPARKEGQQAAQGGRPQGEKTPVGG

SEQ ID NO: 158394 - protein, 126 aa, Triticum aestivum
  Clone ID: PAT_TA_52812.pep
KERLVSNLIIKEWRSWLAVQFDNRASFGAVSVEGTDIERFQILQNKISEAQHFSDETNVKATEVIKAAPDKGSAKDLLAKEIQWIAKLKAISDQIKAKESLMVSAGLMDHGDDLDKAKKLLEDQNK

SEQ ID NO: 158395 - protein, 119 aa, Triticum aestivum
  Clone ID: PAT_TA_52813.pep
EKWGPRWGLGSSPPGILEGLWPPLLGLKPAVPPKSFNRRGVFFFPPGQKPNGGQTRFFLGFGGGAHGGPPPPRGPVPGENKSSFRVGLPGAPFLFSPIFWGPLFKNQGPVSVFLFCSGA

SEQ ID NO: 158396 - protein, 107 aa, Triticum aestivum
  Clone ID: PAT_TA_52814.pep
GLSQTFPFPPFRTLEARGFFSFRDPIFAPAFLLPFGFGPRVGKFPPPKKKVKNGPPPGTSGPLALFCYSSRNSRASSRFFLALCWKRGSPPPPFCFRFYVVQLGPIF

SEQ ID NO: 158397 - protein, 80 aa, Triticum aestivum
  unsure (1)..(80): unsure at all Xaa locations
  Clone ID: PAT_TA_52815.pep
VGPFGIFPPFVGFGPHDPKFYMADPFGFFSAWKANPLGXAFNXVCDFLEKNSPQDLEKKNPVYFPPQFFLGVVPPGAKNF

SEQ ID NO: 158398 - protein, 62 aa, Triticum aestivum
  Clone ID: PAT_TA_52816.pep
RGPGTSQDVIFKETQVLFDIVIMGVDGVDRDEHHWKKIFVEAGFGDYKIPPGGHRPPIEVSP

SEQ ID NO: 158399 - protein, 79 aa, Triticum aestivum
  Clone ID: PAT_TA_52817.pep
WAPAPFVASPRGYSGDAWVPAGAGRPFACPADTARWMRRRPSPPERGPLAWAKKNYMRYNYCDAGWRFPKGFPPECSRG

SEQ ID NO: 158400 - protein, 97 aa, Triticum aestivum
  Clone ID: PAT_TA_52818.pep
KKTNNKRGYWPENGGKGPGPTGLFGGENPLAQTPRLAVTIWGAVWPAPTQTLGPRTVNLIGAYFRGDNLVGPETPKGGPRGSPRKFGPGPGGGPSFP

SEQ ID NO: 158401 - protein, 153 aa, Triticum aestivum
  unsure (1)..(153): unsure at all Xaa locations
  Clone ID: PAT_TA_52819.pep
WLFWICGRVDNVNNVFGHRLSPAEIESAFIFFPSVAKTPVVGGPNYLTGPCIHAFAFFKPHFXAFKGFXKELVFPVCKVIGPFATPKGIYVVSDFPKTRSGKILGGILRKIVDGEPGSFGETFPLAGPSVFGPLFQPVFNQKKLKIGLVLFLP

SEQ ID NO: 158402 - protein, 105 aa, Triticum aestivum
  Clone ID: PAT_TA_52820.pep
KQSRGPSPGAGSRGQKPKTGLSRGHPGNHRNRHGPPGGKKTHGPLQNVQGSGAPPSKKDPGAGAPPGPGGGEKPGRGEQRGGGGVPRGVHRERVLFGAILFGGGL

SEQ ID NO: 158403 - protein, 50 aa, Triticum aestivum
  Clone ID: PAT_TA_52821.pep
VASCHMTAAMNPADAGSAGQCAQPFGCTLWPGAASPLRLAPLLSITYLSA

SEQ ID NO: 158404 - protein, 154 aa, Triticum aestivum
  Clone ID: PAT_TA_52822.pep
DLQNDVKNIELINFSNDLNRITEEGDYFNWFTAKCDLRVIKGQTKVLQGLLIPQKCAELKITSISFDLPSRWQVELNYTVDQISESQITGRRKWLESVSELDGKPTFKVLDGRGVLYSTNIMQKPPSIDIVFDHNAPALLDELFKLDITIKNTE

SEQ ID NO: 158405 - protein, 152 aa, Triticum aestivum
  unsure (1)..(152): unsure at all Xaa locations
  Clone ID: PAT_TA_52823.pep
TFLAAKLLLSSSVHAWYLANRFSGSSFFDGFTFFTXQNPTHGFVKYVDQATAKSSGLIYNQGSTVIMRADNTTDSPNGRXSVRITLKSSYSNSALVLLDLEHMPVGCGTWPDFWMVGPNWPNSXEIDIIENVNEATVNQVTLHTKNGCTMAG

SEQ ID NO: 158406 - protein, 117 aa, Triticum aestivum
  Clone ID: PAT_TA_52824.pep
KKGQLAPKTHLNLNQISNWFIKAKKRFFPPMLEKKERKKNGFYPQKNDPPLFPTKRFLSDIQSPPVKKKRILECFFILLPWPGASSLIPPPFISFFIFNPSILLFAYLLIKNGPHSP

SEQ ID NO: 158407 - protein, 152 aa, Triticum aestivum
  Clone ID: PAT_TA_52825.pep
MAAKCYPTVSDEYLAAVAKAKRKLRGFIAEKNCAPLMLRLAWHSAGTFDVATKTGGPFGTMKCPAELAHGANAGLDIAVRLLEPIKEQFPILSYADFYQLAGVVAVEVTGGPEVPFHPGRQDKPEPPPEGRLPDATQGSDHLQQVFSTQMGF

SEQ ID NO: 158408 - protein, 130 aa, Triticum aestivum
  Clone ID: PAT_TA_52826.pep
FTLAGPGTHQYQKEGHSNYGDHENNEDLLKHIQEHFKEIPVTEMPEMTGKDIIFYLFVVQELNGDGYLDGHEIRCAYTDFHFKNNSPSLNEVTDMVDHVLEEDDLNGDGLISWNEYLESQAYHLDVFNKG

SEQ ID NO: 158409 - protein, 131 aa, Triticum aestivum
  Clone ID: PAT_TA_52827.pep
QTLVKNAIVQVDAAPFKQWYLTHYGVEIGRKKKAAAAAKKDAAEGQESEVAAAATEEAKKSNNVQRKLEKRQQGRTLDSHIEEQFSGGRLLACISSRPGQCGRADGYILEGKELEFYMRKLQKKKGKGATA

SEQ ID NO: 158410 - protein, 64 aa, Triticum aestivum
  Clone ID: PAT_TA_52828.pep
ARQGLFPPDATVFTNSRAPGLVDKLQDKGVFFAPFKNSTKGRGQKGVLPGARGQIRNKGKVVNP

SEQ ID NO: 158411 - protein, 91 aa, Triticum aestivum
  Clone ID: PAT_TA_52829.pep
NQYNSFFFYFQKNLDTELHFWSVCYQKDGMFGLWRETNLKIKPDFGDKCDLVPELIQFCWETKCILEASIKLLWLLNKNISVSNQSIDTIL

SEQ ID NO: 158412 - protein, 121 aa, Triticum aestivum
  Clone ID: PAT_TA_52830.pep
EVLGHEEMCRGSGRIWEEKKRRLCFVSGVVDGRDWSWGGGVGGGRERHHLPVAAAAVRHFLSLSFFLRVAESRRRREEGEKRLTCIQRVSLVAVSNHFALFVAAISGFRLRTIFCFIPNYI

SEQ ID NO: 158413 - protein, 74 aa, Triticum aestivum
  Clone ID: PAT_TA_52831.pep
IIQPAIPRQGLIIMGGNREPHPSMRGGKRIITMHVCIGRGLIGQILIGRGIHHRALGDADVWWRCRCLPLPDAW

SEQ ID NO: 158414 - protein, 46 aa, Triticum aestivum
  Clone ID: PAT_TA_52832.pep
RLLLWTVSCPAKKVFSLIRPHSEKQANVHFTPKSNALDVANVTGII

SEQ ID NO: 158415 - protein, 143 aa, Triticum aestivum
  Clone ID: PAT_TA_52833.pep
MHGAAFMFDVCAEKFGQPIGTPHIEPSVLAIMKKLTALWGLCILYTYSDQGIKENYLTPDHIKSIEKVYFKLCKSLRSQVVGLTDSYGLPDFVLKAPIGKYDGNIYESYFDSLLLAPKSTGVPPYHEKYIKPLTEQSNSKSNK

SEQ ID NO: 158416 - protein, 115 aa, Triticum aestivum
  Clone ID: PAT_TA_52834.pep
VAVNFTLGDMPMDRKVWPDPTRFRPERFLAGGEGEDLDLTGSKEIKMIPFGAGRRMCPGIDISLLHVNLLVATMVRAFQWSEVPGEPVDFTDTLELTMVMKHPLRAKVVPCHATS

SEQ ID NO: 158417 - protein, 157 aa, Triticum aestivum
  Clone ID: PAT_TA_52835.pep
ASNECCKTIISLPTIQLQQQGLSIIADVPSEIYLGEPFTLSYTIYNPTEHITEYTASIELSEAFVFSGYKQVKGSVLPLSRKMYHYTCYPLLAGKVKLPKLKVVASQQHHGEKEIPVEMVGTGTTFTLNNDLQPRQASPSDNIQQPILAFVHAKRKF

SEQ ID NO: 158418 - protein, 131 aa, Triticum aestivum
  Clone ID: PAT_TA_52836.pep
DVFSFGVLVLEIISGKKNSHECGAFINLIGYAWQLFEEERWIELVDAALIPNGDSSEMMRSINIALLCVQEDAIDRPTMLDVVAMLSSKTMILNKPKHPAYYSISVGNKEASDSAKCCSFNDVTISTITPR

SEQ ID NO: 158419 - protein, 180 aa, Triticum aestivum
  Clone ID: PAT_TA_52837.pep
FQFPASVMRIHNPEDSNDLDWHLVEQRDIETFPAEQAKPLHQNDKKINYEKDKPLPPLKKQSSILFESKLPQVPVTYVPANPTPPKPTIKYRIEDLLSDPELQSPASKASASAKLKLILSDEENAQTSQSTPQEVFRSSSRKRSSYNVSKTLPAAEGENTIDPLDAKNVDNRKTYEFDLI

SEQ ID NO: 158420 - protein, 83 aa, Triticum aestivum
  Clone ID: PAT_TA_52838.pep
QAKKEPHSFSRVPPKNNHHNFLGERCGGPPPQLTTGAHVDQHQRPNNEGERAMGPEKKKHAPTNKASYFGGAPGSPITAIGRE

SEQ ID NO: 158421 - protein, 121 aa, Triticum aestivum
  Clone ID: PAT_TA_52839.pep
FRVGPRGRGPSLLPGGPFQRVRGGFWGAYIGNKLVAPWWKMFVGQPAKEKGEGGKPTLAGVEMVKGAFREWSQRKPFFGGDNIGFVYPVLGGMVAWMQGTQGLCGVGVFSPPQGLRMALDR

SEQ ID NO: 158422 - protein, 167 aa, Triticum aestivum
  Clone ID: PAT_TA_52840.pep
LHTKNGCTMAGVPRTQTGKSLTDNCYVNAAGQANNAGCGVQATNTNTYGKGLNNIKGGVYATRMTASQGVQVWFFPRNNIPSDISSGSPNPPSWPAPIASFPFQSGSCSISYFSQLQIVFDLTFCGDWAGSVYSSSGCPSSCNDYVANNPRSFTNSYWSINYVKVYQ

SEQ ID NO: 158423 - protein, 120 aa, Triticum aestivum
  unsure (1)..(120): unsure at all Xaa locations
  Clone ID: PAT_TA_52841.pep
PPALGGGHHQGVDDQAVKVVDIVDTFRLQEQPAFDKXQFLSHMKRYIKNLSAKLEGDDLDVFKKNVESATKYLLSKLKDLQFFVGESMHDDGGVVFASYKEGAADPTFLYFAHGLKEVKC

SEQ ID NO: 158424 - protein, 101 aa, Triticum aestivum
  unsure (1)..(101): unsure at all Xaa locations
  Clone ID: PAT_TA_52842.pep
KSDVYSLGVAILGLITKRGAPPFEKNSLVKSFLXPVRTKKKRLXLFSKEIPIPEDLELFYTPPGIPVKSLTLYVDQSPPIMGVAHRPPLLSRSRKMQNVCP

SEQ ID NO: 158425 - protein, 68 aa, Triticum aestivum
  Clone ID: PAT_TA_52843.pep
KKEGPLMGNLFIFKKEIQMTGGALAPFLLGSLGFFSLGGGLIRFIREIRGPQGQMGFQQWHKRGRALG

SEQ ID NO: 158426 - protein, 92 aa, Triticum aestivum
  Clone ID: PAT_TA_52844.pep
ACAAVPTLSFPSLLALPQAIVDCCLQKWTNRALVTINFFLGYRISGVCELLSWMGHYYGISILAIALIMLTSLHDLIFARRSLTMAFKSFLV

SEQ ID NO: 158427 - protein, 72 aa, Triticum aestivum
  Clone ID: PAT_TA_52845.pep
PRGPGWFSPSFFELEVPAITPVVKDLCGLANVEKYLEPQGGSKKNQPNFPFGKVNYNESLIGEPSCKGPWAP

SEQ ID NO: 158428 - protein, 162 aa, Triticum aestivum
  Clone ID: PAT_TA_52846.pep
MSVHLEKKKLRTFSPVILFHDHHYVEAGDIHHIHIPYNDKRHLDLHKKRINEMLEINGKYWLDVITYSRDHPEPHSPVPSLVSSPSPPPVNKHMTGNNKRRRGNLPKAVTAILRDWLCKHKKHPYPTEEEKAQLAAETNLNLNQISNWFINARRRILQPMLE

SEQ ID NO: 158429 - protein, 73 aa, Triticum aestivum
  Clone ID: PAT_TA_52847.pep
MKDIFNVHDLDMKAVAASFCFKNPPKVNLDLESSASKRRKTRKVDGGARRHGINAANPYGWKGGDDNRQFARF

SEQ ID NO: 158430 - protein, 188 aa, Triticum aestivum
  Clone ID: PAT_TA_52848.pep
RDLELDKLEEGMNQFKEYQSLRKKLESRRLDYDAKLARLQKSKKEKPELEQEMQAAKMKYEEAEYDVIQKLASLQEFEDEHCQALEQLLELQTQYLTRSLEIVKQVKSNWGRGTPSVLSARQTKMTSVSRSELSVPRQASTDSLSHLSPRQPSTDSTSHLSPRLVPTPIARKLSFTQEEQPRNIPPPV

SEQ ID NO: 158431 - protein, 112 aa, Triticum aestivum
  Clone ID: PAT_TA_52849.pep
QTTGGGGGGFPFKKHGVGPLQKRGGFPFKKPPGGGGPPQGPRRPQKGPPLQPGLKGPPGKGKLKIFFWLKKNGEERPRALCFQNRGGSFFFLRGPCRGGGGGAKKKKKKKGG

SEQ ID NO: 158432 - protein, 68 aa, Triticum aestivum
  Clone ID: PAT_TA_52850.pep
TFLKNPQRMGWPLKIFIPGKKPPPIKTIFFKTGTNQMGSLIKRGGIFLKRKARGAPFYFRPPQEPLPL

SEQ ID NO: 158433 - protein, 131 aa, Triticum aestivum
  unsure (1)..(131): unsure at all Xaa locations
  Clone ID: PAT_TA_52851.pep
PEAHVFKADLPGVKKEEVKVEVEDGNVLVVSGERTKEKEDKNDKWHRVERSSGKFVRRFRLPEDAKVEEVKAGLENGVLTVTVPKAEVKKPQVKAIEISGXVDAYRRRMMIFXPEPVWLMCVRVLQPKIML

SEQ ID NO: 158434 - protein, 197 aa, Triticum aestivum
  Clone ID: PAT_TA_52852.pep
RYVCYSYSYPGHRLGGEEYNPTLGLEHFDGYKFAPIRESQVSREMVTRYMNDMLHYAESDVVIVGCGSAGLSCAWELSKDPSLKIAIIEQSVSPGGGCWLGGQLFSAMVVRKPADKFLDELEIPYDEKDDYVVVKHAALFTSTILSKILMRPNVKLFNATAVEDLIVKNNKVAGVVTNWTLVTLNHDTQSCMDPNVI

SEQ ID NO: 158435 - protein, 185 aa, Triticum aestivum
  Clone ID: PAT_TA_52853.pep
PTRPPILQEEANKEESPAPAAAPEAAPAPAPAEEKKDEAAADQDPKKEEPPAADPPSPPPPVPVILGVEVHCTGCAKRIRRSLLRCKGVEAVHVDMSANQVTIKGAVDPQALCDRLRAKTKRDATLISPLPPPPPAEGEEPPPPPPPAPPLVSEARTVELLVNMHCEACAQQLQTKMMRMKGVVS

SEQ ID NO: 158436 - protein, 107 aa, Triticum aestivum
  Clone ID: PAT_TA_52854.pep
KKKNRGRGLLPPEPKKRRGNMFVRHCFGIFSGPGRFRSLPQKFLRSPPLFAGPTKNLGLLRKGSTPAGHWGTQPVFSGGGAKKMLRAGGGTKPDTPGGLPFPRERGK

SEQ ID NO: 158437 - protein, 117 aa, Triticum aestivum
  Clone ID: PAT_TA_52855.pep
SCMDPNVIEAKVIVSGTGHDGPMGASGVKRLESIGLIDQKKGMLSLDMNAAEDDIVRYTREVVPGMVVTGMELAELDGAPRMGPTFGAMLISGQKAACAVRASLARQAKEEQLAASA

SEQ ID NO: 158438 - protein, 167 aa, Triticum aestivum
  Clone ID: PAT_TA_52856.pep
YTYLTEGRHGDIISMGRVISGYWAGLASGRILLGYLASKFGEKLMITIFTAMIVGCLSIMIISADIVVKTSALIFIGLLLGPMVPTTISIASKVLPRSYHATSIGFISALGAGGAAFFPFITGIISGKLGILSMPYVCTVMTIAMIVLWAMIPSDKPFFVYFQKKIK

SEQ ID NO: 158439 - protein, 160 aa, Triticum aestivum
  unsure (1)..(160): unsure at all Xaa locations
  Clone ID: PAT_TA_52857.pep
AIDGIGAAAAPHHFLGINNLGTISITHTTGNPDCHIILRGGNKGPNYEASYVQETKQMLEXAGLPTSIMMDCSHGNSTKDHENLPKVAQCIGAQISQGQXALVGVMLESHLVEGKQSVPEXGTCALKYGVSITDGCINWQDTESVLMNLALAVSAMRNKE

SEQ ID NO: 158440 - protein, 41 aa, Triticum aestivum
  Clone ID: PAT_TA_52858.pep
SIKMGGLFWGASQLLPVGYGPKKLPIFLPLFFALVSVAPFF

SEQ ID NO: 158441 - protein, 66 aa, Triticum aestivum
  Clone ID: PAT_TA_52859.pep
EHRGIAQRIRRPPARSVRTNYQSISRRRGQGGRTSRGSRAGPGPAPGRRRRRSCWRAPPRGQGGCV

SEQ ID NO: 158442 - protein, 147 aa, Triticum aestivum
  Clone ID: PAT_TA_52860.pep
TGARIIPNPRTKEPTPPNPLFRGPSKGPGGRGPPPRALPGTKKKPPHMAATPPRGKTPRGAPKGGGSFSPGPPQLNPAPTGGPQLWPQPSPDRTKREHGPGGGGKGHGGGRVPDPPPPGQGGLGRAPPRGGPGDPREPPDDPEPPGD

SEQ ID NO: 158443 - protein, 121 aa, Triticum aestivum
  Clone ID: PAT_TA_52861.pep
KKQVPWSVNGPALKFVKAVVQDSEYLKKTWEKTSRLRFYLIQQLFNLDASKDWVYPGKSFLSWVWVDMKSKKAASKAVYLARETGGPVRNGKPGYGCETFVKVSGGKKEPVQGVIKAWKAL

SEQ ID NO: 158444 - protein, 54 aa, Triticum aestivum
  Clone ID: PAT_TA_52862.pep
GGAKGKFGKTFLIKIYRTTGGARGLFPFKKHGLGHLRGTHSGRFTHIHYPPPVR

SEQ ID NO: 158445 - protein, 185 aa, Triticum aestivum
  Clone ID: PAT_TA_52863.pep
KPARPFFFLFYLFYFYFIFYFFLFFFFFFIFFFLFFLLKKILGGEKQCLKRCVFLRPQKKKKRGKNPGQKKRGGKKGVKKKNKPMGNKTQKKKGKNLGNPPGPPKKTPKKGGEPPPKKKKTGPNTPQKKNKGGGPPQRNEKQNRAPGGKTPIPHPGGRTPRQGPPQKGKNPGGPKNPKGPGPGPP

SEQ ID NO: 158446 - protein, 71 aa, Triticum aestivum
  Clone ID: PAT_TA_52864.pep
NNNILSGDHHVVSGSNHIVTNSFNKVTGCTNNVSGSNHTVSGSNNTVTGSSNTVSGNNHVVSGSNRVVTGD

SEQ ID NO: 158447 - protein, 71 aa, Triticum aestivum
  Clone ID: PAT_TA_52865.pep
GMHHPRQTHSTAHILAVLNYTNTSTCSSYHACLDENSTSHHNHFSNLSAKETGHSAYHPWPCTMLPKNFST

SEQ ID NO: 158448 - protein, 102 aa, Triticum aestivum
  Clone ID: PAT_TA_52866.pep
FLKVKVLNFGPKPVTLPFSAIGLQGSINGLGSPPPVFPFGSVMDENPFANPNKVVPVPIKLRNPPEEMEVTLPPPPLRAFDLALGQSRLVTEILSEFPGVGE

SEQ ID NO: 158449 - protein, 151 aa, Triticum aestivum
  Clone ID: PAT_TA_52867.pep
EKRDRVLPGSKKGPGEDKKRGVFCSKQTTKKWVPGLSPPTFWGKRGLICRGGPLGGTPICQKGPGDGEPPGIQTGGVSLNSSPKQTGGGEPKIPLDPPQGSGRNSFEFPPHLASMGHVAPRGSIKHKTGPKNRVAVRVHVVAQEHGFGVFK

SEQ ID NO: 158450 - protein, 140 aa, Triticum aestivum
  Clone ID: PAT_TA_52868.pep
GYPLLTILPAAYLMHIRLSPLSSPYSFPFIYRSLFDLISLPIYTKNLSYALTYKTPMLHQPKDQVIRMVKEYGSNKDGLGYWDGIRAIGHNERLRWWQLSRWAVHRIQWTLTYAMLYDPSNHMVTTPTLISLNQAIHHHP

SEQ ID NO: 158451 - protein, 138 aa, Triticum aestivum
  Clone ID: PAT_TA_52869.pep
HTQANKSKQGAGGHQPVETNMQETQISNETRGFACTKRSLACLFPDALDIILSTFALSLPRLFYLAHARNGLPQAHLGHGATGHGGMPALLDAGGAQGARRPARQAAIRPVNSQTGWRGDWSSSARHFCEKRPGASTN

SEQ ID NO: 158452 - protein, 92 aa, Triticum aestivum
  Clone ID: PAT_TA_52870.pep
GGNPEKGDKRGHWTNKANRGSFSKTTGEIPKKGKKIKTPKITNPPKQGKSQHPNQFPKRGKTDPNLGVPKPKKPKRPPDGEKKNRPNFGGPR

SEQ ID NO: 158453 - protein, 125 aa, Triticum aestivum
  Clone ID: PAT_TA_52871.pep
KQIGNMYTAAVWAGLASLVSEVDSETLQNKRVLFYSYGSGLAASMISFRINSSTEKIKNTLNLRERLAARTHSKPEDFSEAMKMRELTHNARDFSPKGSLEHIASGVYYIEKIDDKWRRFYKRKD

SEQ ID NO: 158454 - protein, 95 aa, Triticum aestivum
  Clone ID: PAT_TA_52872.pep
IPRTPATNPIRCAPSIPPPEKKPFPPRLGLFPQRPPPPPSQSSLRGFTPFFREVTPPQPRPPIKFFFPNPSRGKTPCTNLVSSPHYCPPPPWPLF

SEQ ID NO: 158455 - protein, 147 aa, Triticum aestivum
  Clone ID: PAT_TA_52873.pep
PIASIEDAFDQDDWENWAHLLETSEFQLVGDDLTVTNPLRIATAIEKKACNALLLKVNQIGTVTESIQAALDSQAAGWGVMVSHRSGETEDTTIADLVVGLRTGQIKTGAPCRSERLAKLNQLLRIEEELGSSAIYAGENFRKAHEL

SEQ ID NO: 158456 - protein, 101 aa, Triticum aestivum
  Clone ID: PAT_TA_52874.pep
PASAGASPPAEQNCISPPPDQGVGEPGFSPRTTQKMLWLPPQTPAQSTPLKTPPLPSFEGDPPFWGPKLSHALSRGRVGRRRGRESPESLFFHTPLLPPPR

SEQ ID NO: 158457 - protein, 55 aa, Triticum aestivum
  Clone ID: PAT_TA_52875.pep
KQIILWGPLVEITPDGPPKVYFKSKVGMGGSFPPPPFAEGEDPPPPPPPGANANQ

SEQ ID NO: 158458 - protein, 84 aa, Triticum aestivum
  Clone ID: PAT_TA_52876.pep
SFAKVDENAALSLPGVLGKAPPEPLVYMYKTGWAHSTHFLSLQGGSINRLGWGILHEGEQGVPFLVLFETAEGHFGARDVLFGG

SEQ ID NO: 158459 - protein, 75 aa, Triticum aestivum
  Clone ID: PAT_TA_52877.pep
GCKALLERDTYIGRGFLKAGENRWGFQNRQQPVHAEAFPGRHSSKPKYITKPGGGLKKNTCKQQGGKKKGGTGFY

SEQ ID NO: 158460 - protein, 107 aa, Triticum aestivum
  Clone ID: PAT_TA_52878.pep
IMNRHQALYQPLVFSPPVSVIGLPRRSPNSRWVSRRWSATCPCRSACPPRATVLLLGSTKVIFYRSPSVLLTVARQMRMQREEGAAHQVHSHGRGLAGHNDPMVKHS

SEQ ID NO: 158461 - protein, 119 aa, Triticum aestivum
  Clone ID: PAT_TA_52879.pep
SIFAYVVIIFSLAKNANAIGLYASQAAIVSALFNLGQAFGRPPIGYFSDSIGRINMAGMMTLLSGVFALLMWVFAKSYGVLVFYALIDGTVAGTFWATVAPVTAEVVGLRDVPSALNLI

SEQ ID NO: 158462 - protein, 105 aa, Triticum aestivum
  Clone ID: PAT_TA_52880.pep
GRALCEAALSLHLLSVEALGCALMPQLNAWEVLPRLPPWHIVSGPPALCCLSAYPAAVPVPHLLLYLTAVSLCDCALTPLLNLLAAIYVCHSLACLYQKKKRRPP

SEQ ID NO: 158463 - protein, 100 aa, Triticum aestivum
  Clone ID: PAT_TA_52881.pep
GYVWMRQGKPYEHHFRATGTRVRYDAEVTAYVEEGRMKRMTGVRSKQMMLWVPIVEMSLDGADKVYFKSNVGIGRSFPAAAFADEDDPAAAAATEANDKQ

SEQ ID NO: 158464 - protein, 64 aa, Triticum aestivum
  Clone ID: PAT_TA_52882.pep
CLDCWQNSCLSRVAPALYDLRSRVLGACVFLYPNQRPLTYVSLLPQQTSVLAQDLVSGRQLYAL

SEQ ID NO: 158465 - protein, 57 aa, Triticum aestivum
  Clone ID: PAT_TA_52883.pep
GILPKMDKVTLLQMAANLPMDPFEPVMALPSEGCKAFPPSTRKVLLENPNQLECQRG

SEQ ID NO: 158466 - protein, 58 aa, Triticum aestivum
  Clone ID: PAT_TA_52884.pep
GGPGLIPGYFHPGKVLECLFCGSQKKSCRSPFQKIQQWPWGPSPIMGLGICPRRGFQC

SEQ ID NO: 158467 - protein, 109 aa, Triticum aestivum
  Clone ID: PAT_TA_52885.pep
HPAVFGIGSAFGKPRALGNGSPFGPPSSIGSSSPPFGQFTLFWKLANNPSSTAAPAFGSPPPIGSPHPAFGSSNPFNGGPFGPTHFKNGSPFWPPPSPPFFDPKGDPAL

SEQ ID NO: 158468 - protein, 68 aa, Triticum aestivum
  Clone ID: PAT_TA_52886.pep
EACCYHFGGNPRPSSGASRNKGNCIDIGQRARLDLYIFSPPPPPKAGCQSFFRRSSCARLVPAAVLVL

SEQ ID NO: 158469 - protein, 135 aa, Triticum aestivum
  Clone ID: PAT_TA_52887.pep
FNSTVMRSLPPKNKQWGTFNLAGSIRGQMSMPPPGAKGHRVTRGKNDKKRWGRQAENIPGPGAILGNTRERVCPFGAPRLKGLKHGTTPASVARINVKASALFNQGRFYFQRVTTPFRHRGSWIITPTRVFLCPP

SEQ ID NO: 158470 - protein, 138 aa, Triticum aestivum
  Clone ID: PAT_TA_52888.pep
DTAIILIKGRRSSLLQTYHHSGAMITMWSGIRYKAQPIWIFVVFNSLIHSIMYMYYAFTSIGLHPPGKRYLTSMQISQFLVGMSTAISYLFVPDCLQTPGQRFAVGLNIAYLLPLTYLFVDFARKTYGKRKAAAKKVN

SEQ ID NO: 158471 - protein, 94 aa, Triticum aestivum
  Clone ID: PAT_TA_52889.pep
IKGEPRTNIPNMAQAKKLVVSVFGFKPHFGGGKTTGFALINNILEAHNKFEPRFRLVRNGLAKPPKGGRKQRKEKKNRENKFRGVKKTNKVRKE

SEQ ID NO: 158472 - protein, 128 aa, Triticum aestivum
  Clone ID: PAT_TA_52890.pep
MQIFVKTLTGKPITLEVESSDPIDNVKQKIQAKEGIPPDQQRFIFAGKQLENGRTLSDYNIQKESTLHLVLRLGGGIIEPSLKALASKYNCEKMVCRKCYARLPPRATNCRKRKCGHTNQLRPKKKAK

SEQ ID NO: 158473 - protein, 141 aa, Triticum aestivum
  Clone ID: PAT_TA_52891.pep
ERNIQVMDLPFKDGGVPPPQVVREWLQLVEKNKEIADSIKDDGPIPMIAVPCVAGLGRAPVLVAIALIEMGMNPLEAIEFIRSKRRGAFTNPQIAYLDSHKRILNPKSSTSNYSLRPSLGGMFKPGGSSPRPPNNTLSQLP

SEQ ID NO: 158474 - protein, 162 aa, Triticum aestivum
  Clone ID: PAT_TA_52892.pep
NFGEIVFNTWDTAGQEKFGGLRDGYYIGGQCAIIMFDVTSRITYKNVPNWHRDLVRVCENIPIVLGGNKVDIKERKVKAKTIPFHRKKNLQYYDISAKSNYNFEKPFLWLARKLVGNPQLDFVAAPALAPPEVQVDENLMTQYNNEMAEAAAQPLPEEDDDL

SEQ ID NO: 158475 - protein, 76 aa, Triticum aestivum
  unsure (1)..(76): unsure at all Xaa locations
  Clone ID: PAT_TA_52893.pep
PRPPPAGAREPPTGRGPSQGGAPPRARGASSPPKGSXEGGSPGPGGGQGGILGGWGVWQKPVTGREKEQGSGAHGF

SEQ ID NO: 158476 - protein, 119 aa, Triticum aestivum
  Clone ID: PAT_TA_52894.pep
LFSIRIGGPSHLMPESKRRMHPTDLIGERPTANWLASIHLPRCCSTVTTLAPSPLAPGPPMHPALAAVTPLNIPHTLPTRSVLDHRQARYTLQEHCQPYFHNCTSLPHALLCPELTISH

SEQ ID NO: 158477 - protein, 74 aa, Triticum aestivum
  Clone ID: PAT_TA_52895.pep
PGSPQGSRNGWANAWANVWFKFFNTPPPKCPKGCWGSRVVSPTPKMWRCGNIKSPVGGPWGGPSKKYCWVHPGI

SEQ ID NO: 158478 - protein, 127 aa, Triticum aestivum
  unsure (1)..(127): unsure at all Xaa locations
  Clone ID: PAT_TA_52896.pep
PPPPPGRGGHFPQGXGPMQLLARGPIFGQRGPPGPRGRGEXPRGAHRARENVPGWGGPPXPPPRIPAPPRAKKTVPPPPPDGPKINKKAPPRWPDPPGVGDRPGAPAPPPLRDSCCCPPHNPGGRFL

SEQ ID NO: 158479 - protein, 96 aa, Triticum aestivum
  Clone ID: PAT_TA_52897.pep
ACPLCCTGALPQLHWSVAGAAMKLRRRCRARMSYVLHWSAAGAAMKLREVALGVALERLPAAPVPGEVAGEGATAEVLRCSASSTVFRGSVSNTLY

SEQ ID NO: 158480 - protein, 133 aa, Triticum aestivum
  Clone ID: PAT_TA_52898.pep
KSGFPKTNYTQPKELYQKYTQENFQILAFPCNQFLRQEPGSDQQIQKFACTRFKAEYPVFQKVRVNGPDAAPLYKFLKANKPGLFGSRIKWNFTKFLVDKNGKVINRYATATTPFSFEKDIQKALAKYPRCNI

SEQ ID NO: 158481 - protein, 145 aa, Triticum aestivum
  Clone ID: PAT_TA_52899.pep
KDINNPDKYNEVALYAISKISNILFTRELSKRLESKGVTKVYANCNHPGVVRTQLFRHVYSIGSIMDRIKDFFSISAEDGALTQLYLATSPEIEEKSIKGQYYVPLGAPSTPKGIAASDEHLLELWDYTENLIKEKIPDYEGAPI

SEQ ID NO: 158482 - protein, 79 aa, Triticum aestivum
  Clone ID: PAT_TA_52900.pep
KPGFGRLYAPFPPGCLFPTEGGLKSFEPPLNRLKGFPGVDNEGFLLGPNFKVGAFPKINSMPRVGSPPNWAPPWGDPPL

SEQ ID NO: 158483 - protein, 87 aa, Triticum aestivum
  unsure (1)..(87): unsure at all Xaa locations
  Clone ID: PAT_TA_52901.pep
PPAFKGGPFIYAFASLKYIGIXLWPVKSGTFFFNIFFPYDVALAQTFFXKTWAQHKEAXKGCFFPGXKKKEKGDASQAGWGDYSLDF

SEQ ID NO: 158484 - protein, 92 aa, Triticum aestivum
  Clone ID: PAT_TA_52902.pep
TSPHNLWGVPEKPLFLARRFCFFLLSKPLVGFIWGPLAGWFLPGFFPPPPAGFFFPVFLCGFGVGFFFFYGGPLGLFFFSPTLMGGEFSWGP

SEQ ID NO: 158485 - protein, 96 aa, Triticum aestivum
  Clone ID: PAT_TA_52903.pep
ILPKLISSAPLPVEKKFFCPKLFGFPPKGFKNFFLKTNPTPKFFLVPFSPPFPKTLSPPCFPFFLAPFPNPPPFEKMKTSFCLFLPSKKKFCLPNN

SEQ ID NO: 158486 - protein, 172 aa, Triticum aestivum
  unsure (1)..(172): unsure at all Xaa locations
  Clone ID: PAT_TA_52904.pep
VRDVFRLARXNSPSIVFIDEIDAIATKRFDAQTGADREVQRILLELLNQMDGFDQTSNVKVIMATNRADTLDPALLRPGRLDRKIEFPTPDRRQKRLIFQTVTSKMNLSEEVDLEDFVSRPDKLSGAEIAAICQEAGMHAVRKNRYVILSKDLEKGYKANVKKEDSNFDFYK

SEQ ID NO: 158487 - protein, 177 aa, Triticum aestivum
  unsure (1)..(177): unsure at all Xaa locations
  Clone ID: PAT_TA_52905.pep
VVLGSKGGDQGQGQLSDILRAEAVICARCAGANNAGHTMAVNGIKSDLHMLPSGXINPNCVGLDWSXGLVVIDLLFLKKTQKLEAKGLDCQGRLLLYDRAHLVFDLHSKXDGLKEVELCRGSIVSTGKGIGPIYSSKAYRSGIRVHHFFQSEEFTAXFRSMVENMRKRYGNFEYDVE

SEQ ID NO: 158488 - protein, 186 aa, Triticum aestivum
  Clone ID: PAT_TA_52906.pep
LAVRDRLLEDWNLTEEMMKAKNPKRCYYLSMEFLIGRALDNALHCLKMKEAYRQGVQDLGFRLEDLLEQERDAALGNGGLGRLAACYMDATATLDYPTWGYGLRYQYGIFKQLINKEGYQTEMPDYWLDPNINPWEFPRNDVLYEVQFYGYVATKMNDKGESRMSWEGGQKVQAMAYDVPIPGFGT

SEQ ID NO: 158489 - protein, 126 aa, Triticum aestivum
  Clone ID: PAT_TA_52907.pep
IIFQVDDVPVRTFKKYDDLPYPSSQPMTVHATLWDGSYWATRHGDVKIDWTQAPFVVNYRGYSSNGCVSNGGSSACPAGSDAWMNTELDGKALGTVAWAESKYMSYDYCTDGWRFPNGFPAECNRN

SEQ ID NO: 158490 - protein, 101 aa, Triticum aestivum
  Clone ID: PAT_TA_52908.pep
GMVNMIGTHFEENHIATGFGNHMAIPILRGEWREDMTFEEAVKLIEKCLLVLLYRDRSSINKFQIAKITTEGSTIYPPYALKTNWGFAAFENPSKGAVGTW

SEQ ID NO: 158491 - protein, 139 aa, Triticum aestivum
  Clone ID: PAT_TA_52909.pep
IEKGAKPLIEPFAEDKPDTAYVGPQILINVNHDMLVMKEETFGPVLPIMKVSSDEEAVKLMNDSKYGLTACIWTTNEERAVEIGDQIETGTWFMNRCDYIDPALAWVGAKESGLGFSMSKQGFSQYTRPKSYHLKLSQQ

SEQ ID NO: 158492 - protein, 109 aa, Triticum aestivum
  unsure (1)..(109): unsure at all Xaa locations
  Clone ID: PAT_TA_52910.pep
EKMATXHADDXGRCPEPMSTPDAFMGGFCAFNFTSGPAAGSFCWDRQPDYSAYRESSFGHGILEVKNETHALWKWHRNQDLYQGAVGDEIYIVREPERCLLKSSIAAYF

SEQ ID NO: 158493 - protein, 118 aa, Triticum aestivum
  Clone ID: PAT_TA_52911.pep
LATKPGVPVIPGSPSGGPGNTRVSFGGLKGENPGLPGKRLRRGLQKLVPDGMVQYHQPPVCKPVRVHFSIRIPRVRFFCRNDSAGIGSFRGGKAPYTQVFVSNRGPAGGPPWDRQLGA

SEQ ID NO: 158494 - protein, 94 aa, Triticum aestivum
  Clone ID: PAT_TA_52912.pep
PGAGEEKKFSFKVILPSAPKFPLKLFRVPEGAPFPRGFKFPPGGLKVPPQTRAFFPKEGVGFTPPQSAGTVFFKQGFKLALIPPHKVGAPGGFF

SEQ ID NO: 158495 - protein, 156 aa, Triticum aestivum
  Clone ID: PAT_TA_52913.pep
KLKKPLIKMCKEGPFWGLFSGVFVGMEYGVERVPGKYSWKNAFFGGFPKGPLIFFASTTKGTKFPKDPFPGGAFPPPLGFFNPPPQLWAQRQGNFFFLPPSRIRPFCLKPPPPPPPPLCVNNWSRFPQCFSLFGCRRFHVHVVTSLFSCEKILCAG

SEQ ID NO: 158496 - protein, 76 aa, Triticum aestivum
  Clone ID: PAT_TA_52914.pep
NDLQSKKTALQAKKTSITGAHLSTPHFFATKKLPYASVIGDTDLAHTGKDRRLSRADVTETPEPYSAYVTWASRIN

SEQ ID NO: 158497 - protein, 79 aa, Triticum aestivum
  Clone ID: PAT_TA_52915.pep
MSTNPSKYVFNHTMIRVKDPKASIKFYTEVIGMKLITSADYEQSKFTLYFLAFIDSVPESEEEKKKLAFSIPGVLELTQ

SEQ ID NO: 158498 - protein, 96 aa, Triticum aestivum
  unsure (1)..(96): unsure at all Xaa locations
  Clone ID: PAT_TA_52916.pep
PPPSPPGPAELHPTTPPPPQDPLFPGGHPTPRSPRRPGPPRRPPPPXRPPPNGAPPARSPTPNDRQPPPPPKILPSFPEPQPHQMACFSPFSPPPK

SEQ ID NO: 158499 - protein, 98 aa, Triticum aestivum
  unsure (1)..(98): unsure at all Xaa locations
  Clone ID: PAT_TA_52917.pep
MPKAGGGGGEGKVSFKXILPSDPKLPFKVFRVPEGAPFPAVFKFPPEEFKVPPQTRAIIPNDGVGINPQQSAGNVFFKHGFELRLIPPDRVGAPVGSF

SEQ ID NO: 158500 - protein, 73 aa, Triticum aestivum
  Clone ID: PAT_TA_52918.pep
SSRPKKHSKEFGTVCLKEILQLVVVNLHLFMKVMIGFLQATLVRPIKLFILFPSFRYSVISATFAFYSKKCYL

SEQ ID NO: 158501 - protein, 88 aa, Triticum aestivum
  Clone ID: PAT_TA_52919.pep
RDLELVESLLPFAIITGLFTVTATGLNITRYYSNDRKPTRYGLDLWEKQMMERDRRLTGSLRGQTSEPIAPAAFATNSIWYLEKQRNH

SEQ ID NO: 158502 - protein, 94 aa, Triticum aestivum
  unsure (1)..(94): unsure at all Xaa locations
  Clone ID: PAT_TA_52920.pep
LTKRSGAPTDRAPSMAPAAGQARSPEPFRASGSDEVGPLKESPDKMSSQGAQACVWGVLXGPPHVNCHRRVLGNVFPPPRKAGGACTWSPILRP

SEQ ID NO: 158503 - protein, 58 aa, Triticum aestivum
  Clone ID: PAT_TA_52921.pep
PPPPKKPVRPCLVDGPLIPPKRGPLSPLARSSLPPLPGGPPGPPLFPLFIAGPPVFLA

SEQ ID NO: 158504 - protein, 61 aa, Triticum aestivum
  Clone ID: PAT_TA_52922.pep
MPAPVHGAAPPPVCVPPVGPPCPPPPAPPPVWGPPPPRCSPAPFRRPWPLAFVLLINLPPH

SEQ ID NO: 158505 - protein, 80 aa, Triticum aestivum
  unsure (1)..(80): unsure at all Xaa locations
  Clone ID: PAT_TA_52923.pep
PKTLYKGDILVFPQGFFPYQKNGGSFPGVALFWFKGPTPGLQIPHYAFFSHNLPSPVFXKVPFFAPPPVKKLKSVPGAPG

SEQ ID NO: 158506 - protein, 49 aa, Triticum aestivum
  Clone ID: PAT_TA_52924.pep
GGLAALEPPVCLCPPLKANVLGFVLNIPLKVTLLLNYWGKPPPQGFQCP

SEQ ID NO: 158507 - protein, 94 aa, Triticum aestivum
  Clone ID: PAT_TA_52925.pep
PIPAQKSPQRGPISLPRRVPVFEKMLPFVSNLPRNPFRVFFFPLFSNFNPIPYLVCSLAPFLVLNFIKSLVPMAFFNHFPVPPHFFPFLCSKPS

SEQ ID NO: 158508 - protein, 72 aa, Triticum aestivum
  unsure (1)..(72): unsure at all Xaa locations
  Clone ID: PAT_TA_52926.pep
PPXGGLLRRRLDRPPPIGMPRAGRASSIISIYYSHTMYPPPDRGPLSRPLAGISSRVPCHDCNRAPLNKISS

SEQ ID NO: 158509 - protein, 72 aa, Triticum aestivum
  unsure (1)..(72): unsure at all Xaa locations
  Clone ID: PAT_TA_52927.pep
GGPGPFGQCXDGVKNPHNQGGSQRDRQRACNSLKGVACGIPNFKEGKARSIPPKWGVNLPNPISFNIDFNRV

SEQ ID NO: 158510 - protein, 111 aa, Triticum aestivum
  Clone ID: PAT_TA_52928.pep
QGNQEELNPPMDQKVHGVEKVYPGTAARAPPNGVLISGGQTDQPSGDATPPKGLSYGAFSNPIQAILPEKAGKVSPKELVLRAPGLLSNQGSNHQPGLYCSARPPEVAFIC

SEQ ID NO: 158511 - protein, 175 aa, Triticum aestivum
  Clone ID: PAT_TA_52929.pep
SVINGLLQLLLEKNDIIRVAQTKPGLAFLTMLLSRAEILKQGGGALQGFAQPTAEEMAHWQELYTVLFNMLKGRYLGVFPSLYYLEPISPNTSMLQISLAVDDMYVWQFLAAMAVGASMDQQHILVTEVRDRVMENIVLAKSNRLPLDQANHRIANVNLFLHALGLDASQVSVPM

SEQ ID NO: 158512 - protein, 69 aa, Triticum aestivum
  Clone ID: PAT_TA_52930.pep
GEQTGYIELGLFKGATRHKTGMVQGFTVQDRGKRGPREPCLSYMQGSFLMGWQQGRGYIVTHTSSKHYS

SEQ ID NO: 158513 - protein, 61 aa, Triticum aestivum
  unsure (1)..(61): unsure at all Xaa locations
  Clone ID: PAT_TA_52931.pep
LQFALLVLLRGLXESHRLNFSLSLPLMSGLKTAFVGQVSYIRLLTIFVSTVIDNYVLSDRV

SEQ ID NO: 158514 - protein, 138 aa, Triticum aestivum
  unsure (1)..(138): unsure at all Xaa locations
  Clone ID: PAT_TA_52932.pep
VANHSLYLYWQYYARNISSDYIGVVQAVYCADLQLNRGLAQAEVNSGGDAGGVKSDQLPSCPGACAGHDGHPEDPGRAGRGTDERCLADAQHAFSGVRPYQLADASAHXHSXLRGSLPFXXXWGPSAAGRGRXGPAXG

SEQ ID NO: 158515 - protein, 118 aa, Triticum aestivum
  Clone ID: PAT_TA_52933.pep
WGASERQALPLIPSGPPVSFYCELNGPALNRLQGFLHPFRQGVVRATGSVWLQPVCYGGCFYSCPTLRSVVASWQPPLPCWGGQLATSLTRWLSRAPFCMVFFVVPQRPLYCRRKKTC

SEQ ID NO: 158516 - protein, 54 aa, Triticum aestivum
  Clone ID: PAT_TA_52934.pep
ITTVATPWLDNKHTVFGRVVKGMDVVQQIEKVKTDKNDKPYQDVKILNVTVPKT

SEQ ID NO: 158517 - protein, 42 aa, Triticum aestivum
  unsure (1)..(42): unsure at all Xaa locations
  Clone ID: PAT_TA_52935.pep
NKRHPYPKVHNXIPRYNSNKQXGSFSQNPKKDNLGCSLGENI

SEQ ID NO: 158518 - protein, 83 aa, Triticum aestivum
  Clone ID: PAT_TA_52936.pep
RNTMINDLKVINDKADWGMFIDSCFTHCQTLFRISWSSPTSPRLGNKNIAKVVGDWYFGRSQGVKEIDCEYPCNPTCNSLPPP

SEQ ID NO: 158519 - protein, 33 aa, Triticum aestivum
  Clone ID: PAT_TA_52937.pep
GRFSLVPTAQTLFHSVLSSSPITLWHTPSFFVV

SEQ ID NO: 158520 - protein, 70 aa, Triticum aestivum
  Clone ID: PAT_TA_52938.pep
APSVPTVPTVPGVPTLPMPSVPGIPDLPLPPMPSIPDLPKVPLPPMPSVPGVPKVPLPPVPSVPGVPAVP

SEQ ID NO: 158521 - protein, 71 aa, Triticum aestivum
  Clone ID: PAT_TA_52939.pep
GVASFFSCAHWFLQFLNTRAKLLTVLGYGFCPSMVLLFEIVQTFILANFCYYYLKIFVGGQLVLRLPFGVV

SEQ ID NO: 158522 - protein, 62 aa, Triticum aestivum
  unsure (1)..(62): unsure at all Xaa locations
  Clone ID: PAT_TA_52940.pep
KIXYYPPIFIFPIXFPFKPLIPKPQTFLPQFFSSLPPKGSTRFPRVPPPXPPFFSYFLKGPL

SEQ ID NO: 158523 - protein, 69 aa, Triticum aestivum
  Clone ID: PAT_TA_52941.pep
STGWGLAFKGSANRRRVTAGPKGPPGKVIKPHSWGPENGSGPASPTGWEGLPAKQRTGVFVYNCAKRGG

SEQ ID NO: 158524 - protein, 92 aa, Triticum aestivum
  Clone ID: PAT_TA_52942.pep
KKRFKAAPKILGGFSPPGLPGEISPPGSWGKKEFVFFRKGIKAPQRPISSKSAQNWNPFSDPEEEKPPQAVLGGGGGFFPPTPKNGPPKRCH

SEQ ID NO: 158525 - protein, 164 aa, Triticum aestivum
  Clone ID: PAT_TA_52943.pep
NTRPNLNFDPGMDAEPIDLTTKENYYWDHAVSYMTGYGFSNDCVVPFANLVRHELINKFSKWDKYCKDKESYQKLLAYGSNFFCVKDYLSEILKDNHYKISNSKYGKQQIESLLLPSYYKILDNTKAVAFQHPSSSWKLLQSRACYIILCVNNPHLKSDLVRFR

SEQ ID NO: 158526 - protein, 106 aa, Triticum aestivum
  unsure (1)..(106): unsure at all Xaa locations
  Clone ID: PAT_TA_52944.pep
RAEKATTAEPAPNRRTATFQTRQTRDXPHRLRIPPLDGRNRTNPRRTAMAHPGAVSAISEQAEPGHTQAIKKRSQTRLQRRIRFPKNPIFIKAYNNPSLLSEYFLM

SEQ ID NO: 158527 - protein, 113 aa, Triticum aestivum
  Clone ID: PAT_TA_52945.pep
YKRLGYKIWFSNFSRAGGLNWGFFWNFSRGPKGNGGLGWFCFKFTRESYGLGPRIQREIFTQVPRDLFVVRIALFEITQLGITLLTGRNRSLFFTIKGSGFPFGYIGTTSFSL

SEQ ID NO: 158528 - protein, 174 aa, Triticum aestivum
  Clone ID: PAT_TA_52946.pep
MFSFYFLCFIFYSCLIYFSLLLMECRRKPRDKRPENRKKPKGKGGGKNKKKEKKKAKKKEKKKKKNRKKKDTKNKKKGEKQANKRAQAGGNSTQTKKGRLKKKKKAASGRPKTRQREERTKKETHTNPEKEEQPESGHQGGRRTPEKLQPETRAKKGKTALEPQEKNRGQTNSF

SEQ ID NO: 158529 - protein, 143 aa, Triticum aestivum
  Clone ID: PAT_TA_52947.pep
ITKFQFFFFLCFFSVSVQQLSNCFSTTDGMYRMHPRVARARVPPTKQSWQIIDLQASRGETKQRAASGRKPRQANPEPRSSLGGGFGLNTRGKNLPGTNPSETAGCPPDRRAVPAGAPISRIGQGIPCRWTPRGPRPAPENGW

SEQ ID NO: 158530 - protein, 113 aa, Triticum aestivum
  Clone ID: PAT_TA_52948.pep
GIPNPAIRRLARRGGFNPLSGLINEKTPRVLKFFLENFIPDPFPSPEPPPRKPFPPMDVVYALKPQGPPLYGFGGLEPPALSARPWPPTPASRSKKWRKGKTFILSGSPPFYD

SEQ ID NO: 158531 - protein, 53 aa, Triticum aestivum
  Clone ID: PAT_TA_52949.pep
VRADQLCLHTITSSTKRKTASYRPGITTRWIRQYNYAIRRVHTGARAIHGHTA

SEQ ID NO: 158532 - protein, 185 aa, Triticum aestivum
  unsure (1)..(185): unsure at all Xaa locations
  Clone ID: PAT_TA_52950.pep
PXXPLPPPPPXSPRPPPPPPPPPAXAPRGPPPPPPPLXPLPPLAPPPPAPPGPPPSPVPCRWPXAXPGGPAXGSRGPAGRPXPPARGLXPRPXSPPVVLAGSGPLLPPPPAGRRRRPPPVCPLSGRPSPXAXRVSCLPPPVLRGWFRVFGGLFGPLALRPAALVSLLCLLLSCRLPLPSAVPPPP

SEQ ID NO: 158533 - protein, 75 aa, Triticum aestivum
  unsure (1)..(75): unsure at all Xaa locations
  Clone ID: PAT_TA_52951.pep
PSPPTPATDNKRKKRSXNAPKRSGARTTSSSXKQGAQPTPPRRRGRQETPAQLNFQNCKLWADQPLGKGFPLLVY

SEQ ID NO: 158534 - protein, 63 aa, Triticum aestivum
  Clone ID: PAT_TA_52952.pep
LVRWNLTEGKKKDKNPRRSTYQPRENRIGRARENARHGLKMKEAYRTGRARTALPAGRETGKG

SEQ ID NO: 158535 - protein, 50 aa, Triticum aestivum
  Clone ID: PAT_TA_52953.pep
QKKGVSKECPFCGALGHRLPDCPKLEPQKPVAIPGPKRDYHAGGGSRGEI

SEQ ID NO: 158536 - protein, 171 aa, Triticum aestivum
  Clone ID: PAT_TA_52954.pep
QDDIDAHFKRAKDDTLKLIKLFSKIDLKEEEDLEIESTEDFDFDQSLTVLSEAKQIDISNRFKRECDAFYLEAKRSIVSTTAKIPSWAIAAMVFLGWNEFMAIIRNPIYLILFVLLITFGYVIFALNLWGPLERIITTVAGEATRIAKERIADSVEKAKELKHSTEKDKKE

SEQ ID NO: 158537 - protein, 140 aa, Triticum aestivum
  Clone ID: PAT_TA_52955.pep
TPALTARFLPPASPPWSPSTTFFTVDGSGRSPACPVLRMYAAARPRAGTTRVRPAPLRSSPPTGTPRLVVLPPRVSGVAPLHKQVPTPVLRVYGGSNSFTVDDRAAWRSNSRRGLSRWLETYSFLLYLTGPNLFIFPALF

SEQ ID NO: 158538 - protein, 70 aa, Triticum aestivum
  Clone ID: PAT_TA_52956.pep
RRVQASASPPYSSRTSCLCRRGEVLWPPQMSRRCLTLVDYLEEFKQALPHLTARGRAVCAGGEKCYGRPA

SEQ ID NO: 158539 - protein, 71 aa, Triticum aestivum
  Clone ID: PAT_TA_52957.pep
QEPCYWPPPARGLLPSSRPLRRRPAFPPRAPPPSARPMGSGHHRWPLPSWMQENARSGRGWLAEASATLTR

SEQ ID NO: 158540 - protein, 169 aa, Triticum aestivum
  Clone ID: PAT_TA_52958.pep
KTTEANTTTSSSNHVVLPTRRVWRCIFREQTTAPAPGKLCGGILIWETAMEFLRCGAHGALVMVSYLLEGEREALGLEAAREVRHPGELLAGAAERAPLQRGRHVGRHHPHHRLPLRADAVLLLRVALVGAGAAVLREPGDAEQRPDDAAPAPRLDTGLLLPHSRVSEA

SEQ ID NO: 158541 - protein, 79 aa, Triticum aestivum
  Clone ID: PAT_TA_52959.pep
QVTAAGVASMMLGASMALMLCGSVTFMLGFFLMPWVVGLACVFLFVGFLTNLSGIWRAILCWPAACSSSSPHKDASTCT

SEQ ID NO: 158542 - protein, 185 aa, Triticum aestivum
  Clone ID: PAT_TA_52960.pep
MSKVCVTGAAGYIASWLVKKLLERGCTVHGTLRNLGDEKKTGLLKGFPGAAERLVLFEADIYDAASFEPAIQGCEFVFLVATPLQHNSGSSKYKDTTEAIEDATRAILQQCERSKSVRRVIGTGSVITASPLHEDGKGYKEFANESCWTLLGLPIDHNNEFMDDYLSSKCIAEKELVKYNDRPSE

SEQ ID NO: 158543 - protein, 165 aa, Triticum aestivum
  unsure (1)..(165): unsure at all Xaa locations
  Clone ID: PAT_TA_52961.pep
SRHATGRPPPPDLPTPPPTAGAAATPGRCPTRVARRAPSVGATGHAPLMPRADPQRQIRSDPARDEPAPLPPPTRATSTXPHPAVESNRRAATTPTTSATTRAAPIVRTSRSTTSPSQPPPPRAATGHPRRRRPDLAAPDRGPRAPRARPRAAIPVIPMGRAQEP

SEQ ID NO: 158544 - protein, 190 aa, Triticum aestivum
  unsure (1)..(190): unsure at all Xaa locations
  Clone ID: PAT_TA_52962.pep
GGVLSYQVWDACLTEADRRFLARFLPPGSDAEEAVQDLLTGENXHFGNPLVTWSSALCCGDLHPDAVLNKEQQIRADKKAYHAHLKNYHSDMTDTVTRWRDKWLTCDNPKSLFRDNLAKQRRGDRQSSGENVIFSNAPKNAIPMKVVRNGDVTKYMSYIKVSRAQHDLVKRMKQSGDGIQTRHLVGVIGD

SEQ ID NO: 158545 - protein, 184 aa, Triticum aestivum
  Clone ID: PAT_TA_52963.pep
MCGWCCCLECIHNIPPLNLLFLHFSSAPRTGSEGEEGARTLSPMASISVPNPAPSPTEDAESIRKAVQGWGTDENALIEILGHRTAAQRAEIAVAYEGLYDKPLLRTLQDELSSHFKGAMTLWAMDPAARDAKLAYKALRKKGGDRHAWVLIEVACASSPDHLVAVRKAYCSAYDSSLEEDVAA

SEQ ID NO: 158546 - protein, 68 aa, Triticum aestivum
  unsure (1)..(68): unsure at all Xaa locations
  Clone ID: PAT_TA_52964.pep
SPSPNPKTPQHPFNPLPPPTPFPLTXPNTSSTYTSHKNILLLLINTKYLNPITQHTTIKACTFXXRVR

SEQ ID NO: 158547 - protein, 183 aa, Triticum aestivum
  Clone ID: PAT_TA_52965.pep
NPKTNKWFKSFFQEIGTLSVDQIHGRQSHCPACQNGPGAIAWFKGLESLVRHARTMGSRRVKLHRELAALLEEEMSRRGSSVVQPGEHFGKWSGLTESTDRQIVWPPMVIVMNTRLEKGEDDKWLGMGNQELLGYFSDYAVIKARHAYGPLGHRGMSVLIFESSAVGYMEAERLHKLFVHQGT

SEQ ID NO: 158548 - protein, 92 aa, Triticum aestivum
  Clone ID: PAT_TA_52966.pep
REVVDVADEHLELGADVSVQTMIQLKERIRDAPLACRASPLPPQSSRPPSSEAMAPHLQYMSRREVPTLASSSKPMPFHQRLFQEANGKSGG

SEQ ID NO: 158549 - protein, 75 aa, Triticum aestivum; identical to SEQ ID NO: 106874
  Clone ID: PAT_TA_52967.pep

SEQ ID NO: 158550 - protein, 153 aa, Triticum aestivum
  Clone ID: PAT_TA_52968.pep
MDQDERQHPEPPAMEKELSADALACDYCSGPQAVVYCRADSARLCLPCDRLVHAANAVCSRHLRALLCAACRATGAVFRHAGTEFLCSNCDFGRSRDAELPLHDRCTVQGYTGRPSAHDLAALLGVPDFDKPSAGKADDGWWAIWEEPQVFRL

SEQ ID NO: 158551 - protein, 150 aa, Triticum aestivum
  unsure (1)..(150): unsure at all Xaa locations
  Clone ID: PAT_TA_52969.pep
PPHKTGFFPPGGKPAGGAXQNSRILAGVEGQPLFPVSQVKKKTPLGPNNQTPSPRGLGDSFMRRGRQVFPLERGPFAQPNFFGLVPPLGPPGFSLFFSGWFFFWNFYPVSIFPREHFFPFFPPTFLPLPIGKSCSPPRPRPEFPGRPPRP

SEQ ID NO: 158552 - protein, 78 aa, Triticum aestivum
  Clone ID: PAT_TA_52970.pep
WCAYVTILLPRLFANLLLAQLSNTRIYNLTFSLSSCHRAYISKASIHVDVKSNTEQRCTEEAHEFGQQYFPSWATFTM

SEQ ID NO: 158553 - protein, 108 aa, Triticum aestivum
  unsure (1)..(108): unsure at all Xaa locations
  Clone ID: PAT_TA_52971.pep
WGSEAVTRKTRLLDVVYNSSNNELVRXAAAATEEAKKSPNVQRKLXKRQQGRTLDSPIEEQFTGGRLLACISSRPGQCGKADGYILEGKELEFYMRKLQKKKGKGAPA

SEQ ID NO: 158554 - protein, 33 aa, Triticum aestivum
  unsure (1)..(33): unsure at all Xaa locations
  Clone ID: PAT_TA_52972.pep
LTLDSYISANTVFAHQKFRTLXATIEQPATGYY

SEQ ID NO: 158555 - protein, 78 aa, Triticum aestivum
  Clone ID: PAT_TA_52973.pep
MSVLPDKKKKKKKKKKKKKKKKKKKKKKKKKKKKKKKKKKKKKKKKKKKKKKGGPVLKDQILLPRACNVKVFFWGPQI

SEQ ID NO: 158556 - protein, 191 aa, Triticum aestivum
  Clone ID: PAT_TA_52974.pep
APKSPDFFDDGCLSPPVQQNQSNMLSCNGITQSQRTASTGNIDSTSLKSGNSSLADLFFDFENVHRTQQSNNSAAPSFVAFSAAVNGTKEDLYSQPNLQQQPVTGYPSVDLFANMPHTASSADKIPLEAHPSVDLFANMPHTASSADKMPLEAPSMGNAGWATFDTPPKDKQPGVTGPSPVADVGNHKQIL

SEQ ID NO: 158557 - protein, 149 aa, Triticum aestivum
  Clone ID: PAT_TA_52975.pep
MKPLYLRGSGSFKRLLLSLSPHRAKRVHAPPDVEHASAQTEAASPPPPERRPEWECFSYEEVRRATGGFRAANLVGRGGSSEVYRGELADGRAVAVKRLLGASACERRERDFLAELGTVGHARHPNVCPLLGCCVDRDLYLVFAFSARG

SEQ ID NO: 158558 - protein, 190 aa, Triticum aestivum
  Clone ID: PAT_TA_52976.pep
IERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVK

SEQ ID NO: 158559 - protein, 73 aa, Triticum aestivum
  Clone ID: PAT_TA_52977.pep
MELKWGAKKKKSIGEGQGRGRKSWVHKKGPPLFFFFFFFFFFFFFFFFFFFFFFFFFFFFFFFFFFFFFFFFF

SEQ ID NO: 158560 - protein, 181 aa, Triticum aestivum
  Clone ID: PAT_TA_52978.pep
HGLVCCLQTCNMSNQRPAMLVFVASILLPAAATLAGASSGRSVSLPSCPDKCGDVPIPYPFGIGTHCAATSLSSYFNLTCNGTIDPPRPMVGNDEAVVEITDISLEHGEMRVLSPVNHICFTSDTTFTKFLGGYELQLTPFLPSPSRNRFMVIGCNTLGLISGYKGTASQYVAGCYSYCEG

SEQ ID NO: 158561 - protein, 189 aa, Triticum aestivum
  Clone ID: PAT_TA_52979.pep
SHQYDRAQELYSGDEGSSAYDKREYSQCATMSMSPRAGLPEFSHLGLGHWYTLRELEHSTNGFSNEYIIGEGGYGVVYHGCLVNGTDVAIKKLFNNVGQAEKEFRVEVEAIGHVRHKNLVRLLGYCVEGSHRMLVYEYISNGNLEQWLHGAMRQQGVLTWEARIKITLGIAKALAYLHEGIEPKVIHRD

SEQ ID NO: 158562 - protein, 147 aa, Triticum aestivum
  Clone ID: PAT_TA_52980.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTSTKSPKKKTAATKE

SEQ ID NO: 158563 - protein, 140 aa, Triticum aestivum
  Clone ID: PAT_TA_52981.pep
KIGEAFFGGPWLYVPCFAALYISFLGPPFFIFWAALFPLVAWEPLGVPPFVPPAVSPLFMPRVFGFEAPPGPPFHRWSPLLGPGVSPWVGPLFPAVLWFPSRGPRPLCPPLWPRFLPLFASFFPPFRGFSPRFFFLGVFF

SEQ ID NO: 158564 - protein, 173 aa, Triticum aestivum
  Clone ID: PAT_TA_52982.pep
MGSQNKMRASESARELLMMAAREGDSARLNHLLGNHDATVVVPMPEVVVNIHDIDSLTVSRVEDSVLHVVAASARGDNAEFLESASVIHSKAKHLLDASNSKGDTPLHCAARAGRIKMVSHIIYLATAEEGGDARVKAVLRKQNKKGETALHEALRLADRKMARAMVDTLMEV

SEQ ID NO: 158565 - protein, 141 aa, Triticum aestivum
  Clone ID: PAT_TA_52983.pep
MSLARLGQSLIRRLHRPLHLPPAPPTDHHAAVSRSLALIHANTSVRGFSSLTYNGGGLIAGKFGGPSPLHAVQVLELVVHLNHARQMSSGAVAPAPAGPTPSGAPVTPPSVAKGVPVGAKKVGLKALMMSPARGDEPYWGR

SEQ ID NO: 158566 - protein, 192 aa, Triticum aestivum
  Clone ID: PAT_TA_52984.pep
IYPYEGKGRFRYLDGFYTLEAAPLNGDLLPGELAMDDLDEAGTRASSPSCCGSGSSQRLLAAAQSLLQQLAGAAPADPVRSASGPRRRNPAATSPGRGGALRLPPAAASHLPPRALGDELLPRPSGRGAALRLPPAAASHLPPTPPTRNPPSAACGVEVAVSAHGSGLGGWRSTGPEGERRGKVDGVVPDAW

SEQ ID NO: 158567 - protein, 117 aa, Triticum aestivum
  Clone ID: PAT_TA_52985.pep
FAQDWAAQRAGDCRLQHSGGPFGENIFWGSGQSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 158568 - protein, 93 aa, Triticum aestivum
  unsure (1)..(93): unsure at all Xaa locations
  Clone ID: PAT_TA_52986.pep
PPANRLLQKKMGFLWEKKPAKTFQRVFVPKDPVPNQIQKGPFPINIFFSLGPGLFSRGARPPFSLPPRXGVEANNLFPXVKYPPVGDFLNRFL

SEQ ID NO: 158569 - protein, 124 aa, Triticum aestivum
  unsure (1)..(124): unsure at all Xaa locations
  Clone ID: PAT_TA_52987.pep
HQGEKGPPLFPIHKPGKPTPPPPLCQKPPKKHILPRSKRERKIPSSHPSRQPNGRPLILYTIPNNPPKPPKKXILRSGGPPKPEIEPRKSNPPPPKSPGQKHHPKPGALTQPLHCQKKNPQGFG

SEQ ID NO: 158570 - protein, 182 aa, Triticum aestivum
  Clone ID: PAT_TA_52988.pep
SALLVTVSFTAAFTVPGGYRGEDAQQKGGTPVLAQNYSFVVFIVANNLALLCSALSLASLMYAGFTSIDLRIRSKAFVLSIVFLNSSGRSMVAAFSVGIYAVLAPVARTVALITMACSTIMLLDIGWFVYMATAAQLVHFNRLRMRQCFRFALTMVATLLVSLWPYAITVSILIYTRIYGIH

SEQ ID NO: 158571 - protein, 78 aa, Triticum aestivum
  Clone ID: PAT_TA_52989.pep
IRTLRARMIGLDKNDLDKAFIQLTLEFVTKQKFEAYNSKGEVVSGDKSKEVLVKDIWVFERSLFHPGAYWRVCGRITL

SEQ ID NO: 158572 - protein, 179 aa, Triticum aestivum
  unsure (1)..(179): unsure at all Xaa locations
  Clone ID: PAT_TA_52990.pep
GQCHITTQPXXXXXTSXKNGPPPXXXXXXPXPXXXXXPXXXXXPXXPXXXXXXXXXPPPPPPPPXXPXXPXXXXXXPPXXPXXXPPHXNXXXPPPHKHXXPPPPPPPXXPXPXPPXXPPXXXPPXXXPPXXXPLSXPXPPXPPPXXXXPXXPPPPPPPPPPPPPPPTPPPXPPXXPPPH

SEQ ID NO: 158573 - protein, 62 aa, Triticum aestivum
  Clone ID: PAT_TA_52991.pep
ELAKLVLIYFALAIKSVNPSCHDAGDGQLARPVPMAARMGTRHRHTGSSYAPGPPPAFQGRR

SEQ ID NO: 158574 - protein, 185 aa, Triticum aestivum
  Clone ID: PAT_TA_52992.pep
RVKQGCTATAPRVSLASEAGESSVVTIGSRRVGGGGNQAQTAHVSDAAGDDSVPLPLIRNRKEARDSRSYHSASATLTSSSTWSRPSGTSKRKQSEGPSEVMQDVESNSADVTCETAQKPTTAKRRRAAQVHNLSERRRRDRINEKMRALQELVPHCNKTDKASMLDEAIEYLKSLQLQLQLMWA

SEQ ID NO: 158575 - protein, 141 aa, Triticum aestivum
  unsure (1)..(141): unsure at all Xaa locations
  Clone ID: PAT_TA_52993.pep
HHERARPXXXPXALLRFVWRKGRSXGGGAXERDRQRRLPRGRGRGRPGXXHGPAALLEXXTXRQKRAPPAGELRPXESTRVRPRHRXRRTPRALCPXRRARRRAGRRRPWXXSPKAPGLEDAXGPWEAARGGKHKGARGDP

SEQ ID NO: 158576 - protein, 197 aa, Triticum aestivum
  Clone ID: PAT_TA_52994.pep
CDLKPGNVLLGDDMTARIGDFGLAKLLLLNAAGGTESTIGIRGTIGYVAPEYGTTGSVSTAGDAYSYGVTLLEILAGKAPTDRGLGDGTTLPEFVAAAFPERIEQVVDPALLPMEELDRSVSVSASMSTMSTVSTSYSEDSEVRVTARDCVVAAVRVALSCCRRAPYERMGMKEAAAEMHLIRDACLRACGAKKPVV

SEQ ID NO: 158577 - protein, 152 aa, Triticum aestivum
  unsure (1)..(152): unsure at all Xaa locations
  Clone ID: PAT_TA_52995.pep
PSGRPRRXANXEATAGTRXREGEESGTGKRRGXXRGRXDXXTGGXTAXTTGAQXGRDXGXXRHSHXARQAASERQKNHGRHXRAEXKAXXRAGGEQSHAGTEXGKXEGEREXXXGKAAGAREERREKERARGTHPTQDGEARPGARPGARGG

SEQ ID NO: 158578 - protein, 179 aa, Triticum aestivum
  Clone ID: PAT_TA_52996.pep
ATPTPGAGGAASASFAGGRRFPGGLDVPNLKKRGGGTRSWIRVEAATASVQTLEVDKATMMRRCELPARDLRLLDPLLVYPSTVLGRERAIVVNLEQIRCVITADEVLLLNSLDSYVFQYAAELQRRLLQRAEGDELPFEFRALELALEAACSFLDAQAAELENEAYPFTGMELTSKKL

SEQ ID NO: 158579 - protein, 95 aa, Triticum aestivum
  Clone ID: PAT_TA_52997.pep
PRPICFLCRLPLWLQGFTLAVKGFTQEQTDIRCCSTLNQNKINLSPLNFHCHLSDLCFLCRLPLWLQGFTLAVKGFTQEQTVPTGNDINKFAICV

SEQ ID NO: 158580 - protein, 145 aa, Triticum aestivum
  unsure (1)..(145): unsure at all Xaa locations
  Clone ID: PAT_TA_52998.pep
RFQTRGCQLTRRLTRLNEQATTKLPPLSPVRTDDKPRAPAASVVLKGQDSSRAEAYEQYLRLPXLSRLWKAACCPGWPDEGLVKPALEALEITFRFVSDALSDPRGYASHRELARGLESLAPRDVEVVARLCXGDRGAPLHELSL

SEQ ID NO: 158581 - protein, 108 aa, Triticum aestivum
  Clone ID: PAT_TA_52999.pep
CPSQFFVSCHVGRSIFFKRLFGRAGWDASGASSTGTKGRRGGAGRLQRGLSIPDSADREEKIPSELGNHRGHHYKSEWWIGEGSEEEEANRLSADAGRTRGRPGIAVR

SEQ ID NO: 158582 - protein, 127 aa, Triticum aestivum
  Clone ID: PAT_TA_53000.pep
EHTAVHFRVYKSEQKYIILMCSDLRRSSLRPGLYTPAYGGFFEFDLENEKRISLRTLIDRSAVESFGSGGRICITARVYPVALVDDGAAHMYAFNNGSTTVRVPQLRAWSMKRAQVNVMKGGSVIDA

SEQ ID NO: 158583 - protein, 65 aa, Triticum aestivum
  unsure (1)..(65): unsure at all Xaa locations
  Clone ID: PAT_TA_53001.pep
VFYTTKGGPEKMSHEMGVPFLGKVPMDPQVCKAAXEEGRSWFADQRCMRXAPAFKRIIDQLIKAK

SEQ ID NO: 158584 - protein, 105 aa, Triticum aestivum
  Clone ID: PAT_TA_53002.pep
VHAVSSVHNDLVYNKSQELMDELAVEAFKESLVHTKARIVEGDAGKVICREAERLKPAAVIIGTRGRSFIQSVLQGSVSEYCFHNCKAAPVIIVPGKEAGEQSVL

SEQ ID NO: 158585 - protein, 72 aa, Triticum aestivum
  unsure (1)..(72): unsure at all Xaa locations
  Clone ID: PAT_TA_53003.pep
NQLIPFELLLTTPTFVVAIFXVVPGVFGINFETHVFSIQNAFQWVLIITGVVGAFIFWFFVWFFKDKKLMPL

SEQ ID NO: 158586 - protein, 100 aa, Triticum aestivum
  Clone ID: PAT_TA_53004.pep
GKGNHHFFWAQLGGGNPQNFPYWGIKKSQRRGTTGAFLYFGPEQLVFLKVKGKKQLYTGPKRKTPPKKILNKYSQPIPPKLYKTPRKTFFGTKPWKFRFF

SEQ ID NO: 158587 - protein, 96 aa, Triticum aestivum
  Clone ID: PAT_TA_53005.pep
PTRPICFFCRLPLWLQGFTLAVKGFTQEQTDIRCCSTLNQNKINLSPLNFHCHLSDLCFLCRLPLWLQGFTLAVKGFTQEQTVPTGNDINKFAICV

SEQ ID NO: 158588 - protein, 130 aa, Triticum aestivum
  Clone ID: PAT_TA_53006.pep
RIMRGDKHIVNCIEPYPHFPFLATSGIDSTIKIWTLSSSKVMQLPQYANKVIASNARERQFYASRGEMTLSADVMMRILRLQNTQSELYANHEPSAADFATGGDETFFIGLGDGDGNQRSNSDPRERIVT

SEQ ID NO: 158589 - protein, 118 aa, Triticum aestivum
  Clone ID: PAT_TA_53007.pep
ELAIVVMDHLCGCAEGRLELVAHPAGLAVMARAVTRVSAAGTESAVRALHAVARHSATPAVLQEMLAVGVVVRLLFLVQTGAAGDRPRERAREMLKMHARVWRGSPCFTPQLDASYPS

SEQ ID NO: 158590 - protein, 99 aa, Triticum aestivum
  Clone ID: PAT_TA_53008.pep
NADSNSANEYVIRLSNLLAPAKRKQVGRRTTSREKAPYEGLSKRTGFCVICRQQGHKRTTCPEGGDIPKQPRKPARCKNCGVEGHRRNNCHKAAELRLR

SEQ ID NO: 158591 - protein, 145 aa, Triticum aestivum
  unsure (1)..(145): unsure at all Xaa locations
  Clone ID: PAT_TA_53009.pep
GADGRAKIADFXVARAVGSSDRPIGGTPAFMAPEVARGEEQGPAADVWALGCTVVEMATGRAPWSDMDDVLAAMHRIGYTDAVPEVPAWLSAEAKHFLALCFARDARDRCTFVLGAPRTTHVMILRFRTKCLFLKERKAKCLVSK

SEQ ID NO: 158592 - protein, 105 aa, Triticum aestivum
  Clone ID: PAT_TA_53010.pep
VKKVKARNYMLYLSLFDIFGRTELSQLEAYQTLQLLFRDHPDLHEGLEKFRPPMPTKHAAANSNLWPWVFACAAVPLVAMSLIPALGNPVLWLVQQTLGEKVRAA

SEQ ID NO: 158593 - protein, 98 aa, Triticum aestivum
  unsure (1)..(98): unsure at all Xaa locations
  Clone ID: PAT_TA_53011.pep
KRRAHQPKEEGAARSTEQSQARXXXSQGAGHKKRTGRXGRAGRRGRKKRRASTTTQRGKQRQRRKRQXXQPRTAKKKKEKKKKKKKKKKKGGPAKSTQ

SEQ ID NO: 158594 - protein, 134 aa, Triticum aestivum
  unsure (1)..(134): unsure at all Xaa locations
  Clone ID: PAT_TA_53012.pep
HNRSTRKGTKRTRETQAQHSRRRKXDPQXPRRRPQRRRNHSTGGXTDRXRDTANRTQGNRETGXPGPKPEAKRPTHNTGDTGPGAGPTHRTRRKQDEGDKERQGHGQPHSGERRSGEXQGPGKETTERPTGHKT

SEQ ID NO: 158595 - protein, 142 aa, Triticum aestivum
  unsure (1)..(142): unsure at all Xaa locations
  Clone ID: PAT_TA_53013.pep
PAWTAEVLRTARRRASPRPRRSXRRRPPSWQPSRPRRRPPRSQSHRHPPASTSRPHRRRRRRRHERRSXPTLRDRKXRQERRLHRRRRRRGYGRRRGVGGRRRRSWSGGACTRRATSQRRRRRRGKGMGCGWRSDGHGHGAS

SEQ ID NO: 158596 - protein, 196 aa, Triticum aestivum
  Clone ID: PAT_TA_53014.pep
SDKLAKFIVNNPPELKKGGKDKKAMRRAEKERLKEGQAADEEMKKLKKDGKKKGASSKDSTAKGVAAKKNATAGGSDEEHATSSTYSQAVDFPAAADDDYDDDDDDGVEWQTDTSAEAARKRMEEQLNAATAEMVMLATEETEKKKQHAKMSPYDELVEEIKANVGNAATPAQIKAVLSSSTLPAKDVTDALFEAL

SEQ ID NO: 158597 - protein, 95 aa, Triticum aestivum
  Clone ID: PAT_TA_53015.pep
RSVSARAWEDFAIAMNQIPDDGTLKDQASLWRKKNRIIAAGPAIIEQIARDCRTDNPMVKARDSYHMCHLNKNSCPNERAGAINPVQHPHEGGNH

SEQ ID NO: 158598 - protein, 116 aa, Triticum aestivum
  Clone ID: PAT_TA_53016.pep
PPGPPPRPGGARPPPRGPPPSPKRCSRSRTTPVASPPLPGMEGSSSPSKGSNFKGPSSFFPFEVADGPFINDYANPPFLWGVGIFFCSLEGVYQIVVWASPPCFPFLFTKFCFPPP

SEQ ID NO: 158599 - protein, 77 aa, Triticum aestivum
  unsure (1)..(77): unsure at all Xaa locations
  Clone ID: PAT_TA_53017.pep
FXFFFYFFIFXFXFFFXFFFFFFFFFFFFFFFFFFGGGLYFQQTSKKAQKGSKKPRTQPPKRGSKKLKTEKKTLESF

SEQ ID NO: 158600 - protein, 74 aa, Triticum aestivum
  Clone ID: PAT_TA_53018.pep
MESTTVIARCEGMRPSLKNKLKGYPSDFKGLIEECWDTHPMARPTFSEMIVRLDKIYAHCMKHGAWKESLKIWK

SEQ ID NO: 158601 - protein, 87 aa, Triticum aestivum
  Clone ID: PAT_TA_53019.pep
GQRRPRPGLRQPPQPVQQRHPTGVPRTLSSPSLFFGSGFGFSPRACCGEWRGCCMLRDDHLEHPIPFISSPPSSKSAIMVLGALSLF

SEQ ID NO: 158602 - protein, 106 aa, Triticum aestivum
  Clone ID: PAT_TA_53020.pep
RRAPWFFKTCRMFLSWGKKPLSSGGIKLLFLLSPSRFLFFSARFWFGFCSPGRRGPFLAVLFYSVYALPLFFLPACFGYPFKGFFVPPFWNRILKFQNVKHLSCKG

SEQ ID NO: 158603 - protein, 70 aa, Triticum aestivum
  Clone ID: PAT_TA_53021.pep
MPKGPAGPKKGGRGRPKKGRGPPAGGLGINRPKGGPWGNGKNHPGGPRGGPKNSPLGWAPKRIADPKTAS

SEQ ID NO: 158604 - protein, 164 aa, Triticum aestivum
  Clone ID: PAT_TA_53022.pep
HLTVVPASWPASDVLNLKPDGVLFSNGPGDPAAVPYAVKTVQEIVGKVPVFGICMGHQLIGQALGGKTFKMKFGHHGGNHPVRDNRTGRVDISAQNHNYAVDPKSLPEGVQVTHINLNDQSCAGLVFPKMKLMSLQYHPESSPGPHDSDLAFGEFVELMKNNRL

SEQ ID NO: 158605 - protein, 254 aa, Triticum aestivum
  unsure (1)..(254): unsure at all Xaa locations
  Clone ID: PAT_TA_53023.pep
EILLGILGIEWRPPSVNFAVGPTYDATTGEYQIIPVTDPDRWEPLPEITDFIELEPENEAISDDTDSEYNGMDDYSSEGEQGIWGGHASGASYSSAEIDGSNLNSTANLRRSRRKKKRCDADLVTSSDRRVKKRNLDGHGVATPSRPHRGRKSKTGRATKRKISPKSRRLXPQRRATHSTHSFFLKIETSTEEEDGSASSLSDNELNTESTEAEQSAWHGLPRFGRETTNMSKMLPDLLSSLEPRENILPISRN

SEQ ID NO: 158606 - protein, 86 aa, Triticum aestivum
  Clone ID: PAT_TA_53024.pep
GFVGGRVGGRVGGRVGKKKKKKKKKKKKKKKKKKKKKKKKKKKKKKKKKKKKKKKKKKKKKKGGAVLKVQILLPLACNVLFFFWGP

SEQ ID NO: 158607 - protein, 166 aa, Triticum aestivum
  Clone ID: PAT_TA_53025.pep
MSAAEGRKTACVTGGSGYIASALIKLLLQKGYAVKTTVRDPGDMEKNSHLKDLQALGPLDIIRADLSEEGSFDQAVSCCDYVFLVAAPLNLMSADPERDLVEATVQGTLNAMRSCARAGTVKRVILTSSSAGVSRRPLQGDGHVLDESSWSDVEYLRASKPSTLGY

SEQ ID NO: 158608 - protein, 178 aa, Triticum aestivum
  unsure (1)..(178): unsure at all Xaa locations
  Clone ID: PAT_TA_53026.pep
YSLAPTVMASSAXTSGAPFQGLKSTAGLPVSRRSNGASLCSVSNGGRIKCMQVWPIEGIKKFETLSYLPPVSTEALLKQVDYLIRSKWVPCLEFSKVGFIFREHNASPGYYYGRYWTMRKLPMFGCTDATHVINEEEEVKKEYPDAYVRIIGFDNMRQVQRVSFIDFKPPVCEESGKA

SEQ ID NO: 158609 - protein, 243 aa, Triticum aestivum
  unsure (1)..(243): unsure at all Xaa locations
  Clone ID: PAT_TA_53027.pep
EEEEHRGGGGGTEAVAGKKRQYFNLYFFTMGFAVLLALTVVVYIQENVGWGWGFGIPAIGMLVSIVVFVVGYPLYVRLKPGGSPFTRLAQVVAAAYKKRRAPLPEDPRMLYQDKELDALISTNGRLLHTNQLTFFDRAAIVTPGDMAGSGKLDLWRLSTVHRVEELKSIVRMLPIWSAGILLVTAGSHNNSFTIQQARTMDRHVTQHXQIPPATMSIFTTTAMLVTLGLYDRAFVPLARRFTG

SEQ ID NO: 158610 - protein, 72 aa, Triticum aestivum
  Clone ID: PAT_TA_53028.pep
QNQNMIDQGSLKVTKPQLVRSQNTYTILYKYLNRANSRLQVHFKSEYYISISRHKSEYYTRFTSRFSEICKK

SEQ ID NO: 158611 - protein, 206 aa, Triticum aestivum
  unsure (1)..(206): unsure at all Xaa locations
  Clone ID: PAT_TA_53029.pep
RFVVAAYDSATSNGXVRVKGILITNPSNPLGTDGRTRRERWASAPRTLSRTGVARCAACSLRTMIYCGVRGVAQPACLSLAEVIERDAPCADRDLIHIAYILYMDFGLPAFRVGFVFSCIDAVVACARLMSSFRLVFSQTHLFLAKMLGDEEFMAAFLLESARRLAARLELFTLGLLEVCIGCLGGIAGLFLWNDLRGMLSVEDGG

SEQ ID NO: 158612 - protein, 160 aa, Triticum aestivum
  unsure (1)..(160): unsure at all Xaa locations
  Clone ID: PAT_TA_53030.pep
GLKSTGSLPVRRRFNCASLSSVSSRRRIRSVQVWXPLEGIKKEETLGYLPPFKNTGXLLKQGEYLIRSKWVPCLEFSRAGSILSEHNTSSANYDGRHCTMCKLPMMGCTXTTQVINKVNEVKNELTDAYIRIIRYHNMHQVQRDQIMDFXPPRCEEYGKD

SEQ ID NO: 158613 - protein, 90 aa, Triticum aestivum
  unsure (1)..(90): unsure at all Xaa locations
  Clone ID: PAT_TA_53031.pep
MAALPLATAEACDANARMITSGELRALQPVFRMYGGRRLFAGPVVTVKVFEDNVLVRGILEEKGEGRVLVVDXGGSXXRALLGGNIAMLA

SEQ ID NO: 158614 - protein, 177 aa, Triticum aestivum
  unsure (1)..(177): unsure at all Xaa locations
  Clone ID: PAT_TA_53032.pep
MASPRVFXDMTDGGAPAGRIEMELYKDAVPLTVENFRALCTYEKGVGNSGKPLHYKGNVLHLVIPDFMCQGGEFTTSNVTGCEFIYREKFAYXKLVHKHTKPGILYMVNAGPNTNGFXIFIXTEPCNXIDGKHMVFCEVPXGMDFFKIIENVGSRRWTCCKHVVIADCGQLYIRPGA

SEQ ID NO: 158615 - protein, 241 aa, Triticum aestivum
  unsure (1)..(241): unsure at all Xaa locations
  Clone ID: PAT_TA_53033.pep
MWFRGMVSVKEEVDEAVTARFKSRYGDSAFLRAGGGQYINLLDDTFKKDILRKPLGGFGLEMDRSAYSLASESSKLLASKMNRSVVSLASFNGFAKKFSCSGVFIKGEACSATILTSASLFRVPGSSHMIDDNLRIEVCLPNQYRVVGILNCYNLQYNVALVDIMGFWRPRTIKIHGHPVTSSMDVIAVGSLFACRKLMAVEGKVLIGKHSILDCKELCVSTCKITKAGIGGPLFDXDGNF

SEQ ID NO: 158616 - protein, 129 aa, Triticum aestivum
  unsure (1)..(129): unsure at all Xaa locations
  Clone ID: PAT_TA_53034.pep
FVGGEGETGAAAMANVGDLANIAQLTGLDAVRLIGLIVKAAATARMHKSNCRRFAQHLKLIGGLLEQLRVSELKKYPETREPLEQLEDALRRGYLLVNSCQDRSYLYXLAMGWNIVYRFRTAQTEIDNY

SEQ ID NO: 158617 - protein, 181 aa, Triticum aestivum
  Clone ID: PAT_TA_53035.pep
RGDRGTRRDDRDGYSKPPVNTKPTKTLFVINFDPINTRVSDLERHFGHFGRISNVRIRKNFAFVQFETQEEATKALDATHLTKLLDRVISVEYAFRDDSEPGDKYDRPSRGGGYGRQDDSSYRRSVSPMYRRSRPSPDYGRPVSLQYGAYGRSRSPVRDRYRSRSPVQRSRSPAPNRRGYD

SEQ ID NO: 158618 - protein, 237 aa, Triticum aestivum
  unsure (1)..(237): unsure at all Xaa locations
  Clone ID: PAT_TA_53036.pep
EAQGISPNIVTFNTLMSVYVEQGKIQEVFRVYDDIEGRGLVPTAATYSTVMSAYKSAGDGFAALKFFVKLRERYKDGELVGNPADWKQDFVKYEKLAIRVCHMAMRRSLTGADNPAGAALKVLLAMDEAGVRPDRSYYERLVWACTGEEHYTIAKELYQRIRERDDGGVISLSVCNHLIWLMGRAKKWWAALEIYEDLLEKGPKPNNLSHELIRSHFNVLLSAAKRRGIWXWAVRLL

SEQ ID NO: 158619 - protein, 97 aa, Triticum aestivum
  unsure (1)..(97): unsure at all Xaa locations
  Clone ID: PAT_TA_53037.pep
IWSFKSGPPFFFFFFFFFFXXFFXXFFFFFFFFFFFFFFFFFFFFFFFFFFFFFFTPNIGAVTKKQQSILLLTITLRTEVASVVSNERTDYLAGIGT

SEQ ID NO: 158620 - protein, 84 aa, Triticum aestivum
  unsure (1)..(84): unsure at all Xaa locations
  Clone ID: PAT_TA_53038.pep
ASXWGQRLTRLRQCSLSPRVFRSDACWELETRSCEVPVQGRAYSDRASRXVRGTAHDRSDRLCQVPSSTQSSLARLKSTYAEHV

SEQ ID NO: 158621 - protein, 233 aa, Triticum aestivum
  unsure (1)..(233): unsure at all Xaa locations
  Clone ID: PAT_TA_53039.pep
MAHRLLRDAQADGWERSDFPIICESCLGDNPYVRMLRAEYDKECKICARPFTVFRWRPGRDARYKKTEICQTCCKLKNVCQVCLLDLEYGLPVQVRDTALAINSNDAIPRSDVNREYFAEEHDRKAAAGIDYDSSYGKARPNDTILKLQRTSPYYKRNRAHVCSFYVRGECTRGAECPYRHEMPETGELSQQNIKDRYYGXVNDPVALKLLGKAGEMPSLQPPDDETIRTLYI

SEQ ID NO: 158622 - protein, 52 aa, Triticum aestivum
  Clone ID: PAT_TA_53040.pep
KLPPKTTLYFETSLCSCVVDGQCIYLFKSWLFPPSFSCQHGARSLTIVQLYL

SEQ ID NO: 158623 - protein, 99 aa, Triticum aestivum
  Clone ID: PAT_TA_53041.pep
GRTWFGYIHFRSYGPFKKHTHRLRAHEGKILQGTKTPIGNHTTGPTKRGGGVSFFGLDHTRDNHQKRINRLDLNSCKGRTWSWGPNYRRGGAYRTGGPS

SEQ ID NO: 158624 - protein, 99 aa, Triticum aestivum
  Clone ID: PAT_TA_53042.pep
DAFIVNVGDQIQVLSNAAYKSVEHRVTVSAAEERLSLAFFYNPRSDVPVAPMAELVAPGRPALYPEMTFDEYRAHIRQRGLSGKAQLQSLQNANNSVAS

SEQ ID NO: 158625 - protein, 76 aa, Triticum aestivum
  Clone ID: PAT_TA_53043.pep
KPAFRPVGDQLFRGGGQKLAFTGPTHSRYSSFGPKRGLNHPPGGFTRPLPSIRTNNKRAGGSTKIRGPPLVPHKLG

SEQ ID NO: 158626 - protein, 82 aa, Triticum aestivum
  unsure (1)..(82): unsure at all Xaa locations
  Clone ID: PAT_TA_53044.pep
GGRQQQEXRTRGHEXXRARNGGNRGGPGRGHNGQKGRGGGXEXXTGQPGGXGGAGEGXGRGGGTGHGKGQDTTREPQRGTGG

SEQ ID NO: 158627 - protein, 137 aa, Triticum aestivum
  Clone ID: PAT_TA_53045.pep
MRGLSFTRSSNPHPAKAPPNFQNIARGGAGEPGPPPGTFGLQDNPTKFGPLPQETFFGAPGKLHLLKRPEKQRQGAPGGSKPFQKGGGPLPSRGKKILAQNTPKKNGFTHFPPPFKSRVRKALARTPYFKKVHPHPL

SEQ ID NO: 158628 - protein, 140 aa, Triticum aestivum
  unsure (1)..(140): unsure at all Xaa locations
  Clone ID: PAT_TA_53046.pep
GGGRXSETKAKMGHTCTDTGGQEMRESTPHRHQGLQTTRGEKRGQSGGRRRKNEGGGCPPTISEAWLGNCHAQPLLRLDTRCKRHAGKGKTPVRLGQVMGHSTEPAWRADHRHRAKGGRGTMPDGGSIGMHALTLWREDN

SEQ ID NO: 158629 - protein, 63 aa, Triticum aestivum
  Clone ID: PAT_TA_53047.pep
RMLQGVRSWPPPLIVEALLSSQNRLQDYPPPLAGVQGVQRRRCSTWSLSPYLVAYRKRLVGWG

SEQ ID NO: 158630 - protein, 66 aa, Triticum aestivum
  Clone ID: PAT_TA_53048.pep
PPLAAPGFPLYASGLPLLWPCARVTSSPPRQLCPRRRPLFPRLPLGEAGPPPGTGPAFPGPPPRPP

SEQ ID NO: 158631 - protein, 84 aa, Triticum aestivum
  unsure (1)..(84): unsure at all Xaa locations
  Clone ID: PAT_TA_53049.pep
TSTLDYYLLLHTHSWXAEHKARKPRFSRHFLTHTTSFFWGGXXSLRSXGSTSTLKTXXXXXGTFATSTWGTTTFFSTFCFFPPF

SEQ ID NO: 158632 - protein, 186 aa, Triticum aestivum
  unsure (1)..(186): unsure at all Xaa locations
  Clone ID: PAT_TA_53050.pep
PPPPPPPPPPPXPPPPPPPPPAAPALPPRPPPPPPPGLPRPPRPGPARGXAPCPPPPGPPGRAGAXGXGPXPPPGSPAPARGPSRVAXPRPPGXRSPPAXXXPPLSRGPXAPXXRAPVLSGXCXSPAPXXAAAAXGLRGRXXCSSLPRLLXGLXGAAPXAPLFPGXXPXXRPPPPXFPWRAVCAFV

SEQ ID NO: 158633 - protein, 101 aa, Triticum aestivum
  unsure (1)..(101): unsure at all Xaa locations
  Clone ID: PAT_TA_53051.pep
AKHVAHTGWAGSTSTTSSVRSWNRAAPPPGTTAPATASASTSVSASSXAAPPPPQAQQKKMSARQFELAMAAQASAATTGTTASTSGTGTTRAARRHRHYS

SEQ ID NO: 158634 - protein, 49 aa, Triticum aestivum
  unsure (1)..(49): unsure at all Xaa locations
  Clone ID: PAT_TA_53052.pep
KQHTKISFLPLLCSVSSSPNGSSERSFHARRXGTVXHXAYSLGTEPMPA

SEQ ID NO: 158635 - protein, 114 aa, Triticum aestivum
  unsure (1)..(114): unsure at all Xaa locations
  Clone ID: PAT_TA_53053.pep
KVKLFGVILKDXXXRKRGXXXEXGAXEXXMKMTRXGDPRPASRHXAXXVAAAGTDARFXVGGGXHKAGARDVLHLYERMGSMATLMASWQQSQHWFHFINVVLQKALRKRSLRT

SEQ ID NO: 158636 - protein, 58 aa, Triticum aestivum
  unsure (1)..(58): unsure at all Xaa locations
  Clone ID: PAT_TA_53054.pep
PRAAKTCHAXALPPHGYNCCSSKKNEESPPPTVCLVHNKIWYKSCCLCNPSPLLVLIL

SEQ ID NO: 158637 - protein, 156 aa, Triticum aestivum
  unsure (1)..(156): unsure at all Xaa locations
  Clone ID: PAT_TA_53055.pep
RGRTKPXPPRQXXGXAGPKPXXXKTPGXGQEXPGTGGATTPERXKEXGXXXPTXRRPAEETQRXXETPPXGXXAXXPXPXPGRXXPXPATPQGRAQXPPXPXXPPTRAXXPTRXPRTPRXPAGPRRKGXTTXGPXRRNXPAARASHGAAGTRPPHG

SEQ ID NO: 158638 - protein, 71 aa, Triticum aestivum
  Clone ID: PAT_TA_53056.pep
KKKIFFFLKKLPPPGKHFLRKKKKSQFCFFPLQKKGGYILEKKKKGNFFSWQKKKNLRLKIFFSFAHLPNH

SEQ ID NO: 158639 - protein, 58 aa, Triticum aestivum
  Clone ID: PAT_TA_53057.pep
AHHSFVESSYNISPSMLVAELPKLEPAYPSWWIPSSFVYSCAWTSRKPLGSKNFCSRF

SEQ ID NO: 158640 - protein, 74 aa, Triticum aestivum
  unsure (1)..(74): unsure at all Xaa locations
  Clone ID: PAT_TA_53058.pep
PPQHKKQTQKPXSSPQNRHQSAFFRTVKKRPPHIELYAPNALQPSTQYGSTKSQIVMYTKRATTLTRPCSTRST

SEQ ID NO: 158641 - protein, 137 aa, Triticum aestivum
  Clone ID: PAT_TA_53059.pep
PKNFGNINGVPLKWLGGRGSPQKCRERLKCGVCGIAGPFPLWKQPRFAPLKAVVAFFFWQQWVHLWEGGKCAPIMVGASLPSVVCPSGGAIRVGLPMWRVGLALFVSEPVFARFLVINWAPFFLINETGKAFASCFP

SEQ ID NO: 158642 - protein, 121 aa, Triticum aestivum
  Clone ID: PAT_TA_53060.pep
NNNQSSQSTNNQEIPGSKQHAHPHTLFACVPFFFTPTPPCAFDTHSSYQAGSSSCCFKRLYAVMLLHAPLTNYDGESLCISHLTLWRSSLFVCLFVCCDDRSLYGIGIGIGIGIGKKTHRP

SEQ ID NO: 158643 - protein, 149 aa, Triticum aestivum
  Clone ID: PAT_TA_53061.pep
RSLGPPFFYNKKQAWAAPWIFWFGPFNGAALAAIYHVVFIRAIPFKTPANSANHFSKCEESLLVFVEFFPLPLKCIFHRKAYFRGKFPKPGKINVKFFWNPNPPIPKQGIIPKNFKGLFGVFCPKKKKKKKKKKKKKKKKKKKNKKKKK

SEQ ID NO: 158644 - protein, 85 aa, Triticum aestivum
  Clone ID: PAT_TA_53062.pep
WQHVGAYVNLGSFNLLGIPMAMLLGFVLKMGAKGLWMGVVCGSISQTTLLSAITFFTNWQKMADEARERSLSEKAMESESRSLLE

SEQ ID NO: 158645 - protein, 94 aa, Triticum aestivum
  Clone ID: PAT_TA_53063.pep
PVFLFAKRALGFPAFILGCAPPFVPLVLPFFFSPCIFCLIFPALLFPQGSPFPPFPPRSYLPPFWAPFFPPRYRSGFSRSPPGSRYKGTKPHDP

SEQ ID NO: 158646 - protein, 36 aa, Triticum aestivum
  Clone ID: PAT_TA_53064.pep
WVPITFACVPSSLQDGLKRIKSFCQRNKKKNSINGC

SEQ ID NO: 158647 - protein, 61 aa, Triticum aestivum
  Clone ID: PAT_TA_53065.pep
IHEVYVSFSQQQQNPPISLQQTPMMAACERIGHLDQLSRLLFRKQNTPLMLAGERTGRMRA

SEQ ID NO: 158648 - protein, 65 aa, Triticum aestivum
  unsure (1)..(65): unsure at all Xaa locations
  Clone ID: PAT_TA_53066.pep
NAGENXLQDPDKRFWVKKPAPPPSRKELPERSRRXFSSAYEQREKISVRLKLVIKVLGAQGISKL

SEQ ID NO: 158649 - protein, 54 aa, Triticum aestivum
  unsure (1)..(54): unsure at all Xaa locations
  Clone ID: PAT_TA_53067.pep
SDQNLSPDLYASLTAPSPPKXYWHIQGNGDVGKQKEDESLPCDFITVVRQDYFV

SEQ ID NO: 158650 - protein, 81 aa, Triticum aestivum
  Clone ID: PAT_TA_53068.pep
RGFLAMPFPVGARSVFALECDPSFGFEIGPLFVFEKGSFIFLALRFLVLDRPWLPFCSRPLFMCLSLFPPFMTAPGFGFRS

SEQ ID NO: 158651 - protein, 70 aa, Triticum aestivum
  unsure (1)..(70): unsure at all Xaa locations
  Clone ID: PAT_TA_53069.pep
MAVRKLPLEGFFFFFFFXFFXFFXXFFFFXFFFFFFFFFFFFFFFFFFFFFFFFLGGAKKPIFLGGPPKN

SEQ ID NO: 158652 - protein, 95 aa, Triticum aestivum
  Clone ID: PAT_TA_53070.pep
TNDYYIKRLKPEIGMEFENDDIAYEFYNTYAGHVGFGVRKSWHVLPGTMTSVPQPHNYNLQVLKHGLPPLSQADTASFQQLLGLRPQQPYFYHST

SEQ ID NO: 158653 - protein, 64 aa, Triticum aestivum
  Clone ID: PAT_TA_53071.pep
HEFDKKHILSRFKKKKKIYRFATMRAYLLDGIYFFFHYILTSHMPRLKRIFSSWGFPKTEIGAR

SEQ ID NO: 158654 - protein, 91 aa, Triticum aestivum
  unsure (1)..(91): unsure at all Xaa locations
  Clone ID: PAT_TA_53072.pep
GTSEGQEAEVDPAATEQAKKSINVHSKLDKRQQGRTHXSHIEEQFSGERLVACISSRRGQCGRXDGYILEGKDLKFYISKLQKKKGKGPTA

SEQ ID NO: 158655 - protein, 62 aa, Triticum aestivum
  unsure (1)..(62): unsure at all Xaa locations
  Clone ID: PAT_TA_53073.pep
DFYGDLPAPPEXXPFLNKXXGFXXPPFSLXLXXXXXCVYYCVVVVVKLILLHLIYKKHPNPP

SEQ ID NO: 158656 - protein, 44 aa, Triticum aestivum
  Clone ID: PAT_TA_53074.pep
IRLTFFNNIGNYKCNLFIILKDSCFLPTYLTLWTIFLHSLEWSR

SEQ ID NO: 158657 - protein, 68 aa, Triticum aestivum
  Clone ID: PAT_TA_53075.pep
DDERIVHLCRKRRRIDLEATEFVLSSSSSEHLQRDDPRDDGDDDNRRVKVLKLCPSTPAEELDLELRL

SEQ ID NO: 158658 - protein, 63 aa, Triticum aestivum
  Clone ID: PAT_TA_53076.pep
PPNAVPKEAFKGSGTRLRGLRVKVVAFDGYPQLKSVLWALPVIIHVADAQDLCPQRAHRRVHV

SEQ ID NO: 158659 - protein, 84 aa, Triticum aestivum
  Clone ID: PAT_TA_53077.pep
NPKRNPIKQEPAGQVILPWNAFQHLPGNQYPSRGKEGEFKKSGINAACTPCRAGLNICTCIDQIFACPLRPLGGMNNKKERGYL

SEQ ID NO: 158660 - protein, 67 aa, Triticum aestivum
  unsure (1)..(67): unsure at all Xaa locations
  Clone ID: PAT_TA_53078.pep
QIPCVFISSCFCFRSRASCHLQALPRTSFSXGLSTLFFXXSSSARRCXLFLGCPSXXLRDQGVPXAW

SEQ ID NO: 158661 - protein, 66 aa, Triticum aestivum
  Clone ID: PAT_TA_53079.pep
KWFLHLIYMWPISFLQSGMLALPCKLLFKLWGQLGPGPTNSTILETHLVISAPKMAPGNFPGVAAP

SEQ ID NO: 158662 - protein, 44 aa, Triticum aestivum
  Clone ID: PAT_TA_53080.pep
YCFLVPGKHPDETPHVRLSYYALCSKQQFFSPRDDPLSDVNPFA

SEQ ID NO: 158663 - protein, 54 aa, Triticum aestivum
  Clone ID: PAT_TA_53081.pep
YHGVDMWSQLVEMFCRSFNFHGTMAGLSQLLRFITLVKSSTVVILLSFLLMQPV

SEQ ID NO: 158664 - protein, 87 aa, Triticum aestivum
  Clone ID: PAT_TA_53082.pep
IWEAQCPSTGKMLRMCRQVACVPFVSPRCCLFRWNWQLVQILVYILTRFIQSIFSGSPPICLLLRRSPSYVQLDFAVPFPLCVAGFF

SEQ ID NO: 158665 - protein, 108 aa, Triticum aestivum
  unsure (1)..(108): unsure at all Xaa locations
  Clone ID: PAT_TA_53083.pep
GDCRLQHSXAPFGENIFWGSGQSWTAADAVKLWVDEKQNYHLDSNTCDAGKVCGHYTQVVWRKSTRIGCARVVCAGNRGVFITCNYNPPGNFNGERPFAFLTLDAEAK

SEQ ID NO: 158666 - protein, 83 aa, Triticum aestivum
  Clone ID: PAT_TA_53084.pep
SLPSLPSSLQELKIECCGAIKSLSNGLPSSLEILNICRCDAIKSLPKDSLPSSMRELDVHLGNSKELKRDCRKFIGTIPIVRT

SEQ ID NO: 158667 - protein, 166 aa, Triticum aestivum
  unsure (1)..(166): unsure at all Xaa locations
  Clone ID: PAT_TA_53085.pep
MAMAASWWALLAAAAVVAAAGCGEAAPTAAAEAAHDVLQTHGLPRGLLPAGIAAFSHDPATGRFEAVLESPCTSRTEVGLRYNITVAGQISYGRIAELSGVDAQDLFLWFAVRSIRVDVPSSGVIYFDVGVVYKHLPLSFFEAPTPCVPTPLIXLQPHQIRGHGSV

SEQ ID NO: 158668 - protein, 198 aa, Triticum aestivum
  unsure (1)..(198): unsure at all Xaa locations
  Clone ID: PAT_TA_53086.pep
MEVASLYRRVLPTPPAVEFASPEGRRLFAEALEGGTMEGFFSLVSHFQTQSEPAFCGLASIAVVLNALAIDPGRRWKGPWRWFDESMLDCCEPLHVVRSQGITFGKVVCLARCAGASVRCFRADHATVHDLRAHLARCASSRDCHLIASYHRGHFKQTGGGHFSPIGGYHAGTDMALILDVARFKYPPHWVPLTLXLE

SEQ ID NO: 158669 - protein, 198 aa, Triticum aestivum
  unsure (1)..(198): unsure at all Xaa locations
  Clone ID: PAT_TA_53087.pep
MSWLGKLGLGGGGSPRASEASAALAQGPDEDKPAPGSEFAQFGAGCFWGVELVFQRVPGVTRTEVGYSQGAFHDPTYEDVCTGATGHNEVVRVQYDPAACKYDDLLDTFWARHDPTTPNRQGGDVGTQYRSGIYYYTSEXEKAALESMEKQQKAQNRKIVTEILPAKRFYRAEEYHQQYLAKGGRFGXKQSTEKGCND

SEQ ID NO: 158670 - protein, 135 aa, Triticum aestivum
  Clone ID: PAT_TA_53088.pep
IRSAILKGYHGVKPGWTRVAFAYYLPPEEFRFILAAIDFVAAHGHRFLPLYNFDWATGNWTFRLRAVKHHLMMEELLHGHGSSNTKMKGNKSAGDSNKFESYLEFATKIALSLPETCDEQQIPEGIDPSIVLFRV

SEQ ID NO: 158671 - protein, 75 aa, Triticum aestivum
  Clone ID: PAT_TA_53089.pep
DPRLHTYTPPLRASKIKISTPMAGLRLSYTHICENIMCATYYLSLNKSYLMYQCTTRVWNLYMSICMYTSFVWIY

SEQ ID NO: 158672 - protein, 128 aa, Triticum aestivum
  Clone ID: PAT_TA_53090.pep
KNPGVKIEGLQSYGGTSLSFKVRSFEVKECILWLSIVFITILCTPQPTVIRWSTTPPVSADVLHQWKGFCALIANAYYTKGMAWLPVKTLQLEQMAVTGSSEEPSLVASRMQLVFSTLEVVSPQWPRV

SEQ ID NO: 158673 - protein, 234 aa, Triticum aestivum
  unsure (1)..(234): unsure at all Xaa locations
  Clone ID: PAT_TA_53091.pep
MGSSRRRALLLLLAALLASSLCDGSAAERLAAERTRRKDPLDGLRPYHRGWNISDRHYIASVAFSASPVFAAGAVWFVGFALAALVACCCRCCRGSPTRDDDYSYSRKTFAASLLLLLAFTATAIVGCAVLYDGQAKLDGSTSGTLRYVVRQSDGAAASLRGFAGFIEMAKASGGAAMPRDLGAKVDQVASRXGAAXDELAARTXSNARKIRTVLDTXRKILIGVAAVMLVLAF

SEQ ID NO: 158674 - protein, 208 aa, Triticum aestivum
  unsure (1)..(208): unsure at all Xaa locations
  Clone ID: PAT_TA_53092.pep
YTLFFNTSSDINECELRRSPXSTIYKNMYPCHGGRCHDREGEYECKCNFGRRCDGKSHKGCELVVSTTAAAVIGTIGVIALLAVLLIFLHMENEKRKLRDCFNKNGGQLLKSLKXKIFTKEKLDHITNNYRCIIGQGAFGKVYKGATGARDNVRVAVKCSIPINEDWKKESFANEITIQSNISHRNLXKLLXCCLEXXVPMLVYEVRA

SEQ ID NO: 158675 - protein, 135 aa, Triticum aestivum
  unsure (1)..(135): unsure at all Xaa locations
  Clone ID: PAT_TA_53093.pep
LVPPRPRAPSSSSGSSLPSAHPTSPCPTIMSKVEACVETAKSMVIVKEIDGTEYCSGFIAITEARQGTYVVTDAEFVMDRKDNLMVFFSDNTELPASFIETYGPFCFLKTKFHSACEQIELMEANITPLPXIXFP

SEQ ID NO: 158676 - protein, 51 aa, Triticum aestivum
  unsure (1)..(51): unsure at all Xaa locations
  Clone ID: PAT_TA_53094.pep
MRECISIHIXQAGIQXGNAXWELYXXXHXXXXDGXXXXDKTXXGGDHPRPG

SEQ ID NO: 158677 - protein, 149 aa, Triticum aestivum
  Clone ID: PAT_TA_53095.pep
MALLLRHSRKLRRVHGVLDCERGSIARHFSVAAAKEDAVTSSSVHGEYGKKVGRSSIFLDRQSEKDLHTFKVSTREARGSYSSKRMPIAATGVNSLFSCGQVVSARHFSSGADLPPHEAIGMPSLCPTMTEGNIARWLKKEGDKVGPVE

SEQ ID NO: 158678 - protein, 168 aa, Triticum aestivum
  unsure (1)..(168): unsure at all Xaa locations
  Clone ID: PAT_TA_53096.pep
MAGGGGGFLNLERHFAFYGAYHSNPVNVFIHALFVWPIFLTALLLLHLTAPFPRAAAVFTAVYGAFYVSLDRRSGALAAVLCLLCWAASSALAARLGFSLGWKVVLVAQLFCWTMQFIGHGVFEKQAPALVDNLVQALMMAPYXVLLEILHKFVGXEPYSXFHAGQLI

SEQ ID NO: 158679 - protein, 122 aa, Triticum aestivum
  Clone ID: PAT_TA_53097.pep
MGSEADAAEMKGPLLAGVPAAAEVVPPWREQLTVRAIVVSAILGVLFCLVTHKLNLTVGIVPSLNVAAGLLGYCLVRTWTAALGMFGVVSKPFTKQENTVIQTCVVACYSLAELDDRVYVSS

SEQ ID NO: 158680 - protein, 53 aa, Triticum aestivum
  unsure (1)..(53): unsure at all Xaa locations
  Clone ID: PAT_TA_53098.pep
MKLNIANPATGCQKLVECEDDRKLIPXMDKRMATEVAXDSLGDDXKXYXXKIT

SEQ ID NO: 158681 - protein, 113 aa, Triticum aestivum
  unsure (1)..(113): unsure at all Xaa locations
  Clone ID: PAT_TA_53099.pep
YGLSCFRFSLPWGGDEKSTERAGEGTTPHTDGGVRGRRRVRVKALAGCASLLLSPVLHTRHVHLDSPSSPPXTMHALLFASEGRCAAAATVGTLSVALPTPRAVSLRSPGVWT

SEQ ID NO: 158682 - protein, 85 aa, Triticum aestivum
  Clone ID: PAT_TA_53100.pep
MKGTKLAAILILQAVLVMGVLSHVNADYFPKCCNNCRSFSGVDVCDDAHPKCPKGCSACRVVSTSPEMWRCADMKSTVDGTCGGP

SEQ ID NO: 158683 - protein, 106 aa, Triticum aestivum
  Clone ID: PAT_TA_53101.pep
RLVAPIFFLGLEFPPPLEAHAGGIPIQGPRVKKESAGAEPKAPVGSRVPGDHRGSEPLGEDMGPSKQALRVGANPMAVDEPGNVKPESGSFSKLPGPPPFFQKPCL

SEQ ID NO: 158684 - protein, 25 aa, Triticum aestivum
  Clone ID: PAT_TA_53102.pep
DHVSPLPAGARVDPITTLLYQLTVR

SEQ ID NO: 158685 - protein, 102 aa, Triticum aestivum
  Clone ID: PAT_TA_53103.pep
GTDVYLHGLRGAGGWGGARSWPPLPFLLFFLLARFCPVYSVAFGVCLVSRVDDGEGLWGGELCEHLLRDADDRREVLLDGGRKARVVELLAREDAVTKGVDH

SEQ ID NO: 158686 - protein, 225 aa, Triticum aestivum
  Clone ID: PAT_TA_53104.pep
NARGKRHTCSNLTLTNVTEKPTLLPWHEDRNDGDAPVRGELRCTYGMQSIQVRASPPVPPRRPPGAFFSTGDIKMPQPYPHGLTFRRIKRKIQPARAGQTQEAGGQLRRRRLTLVAKGPLPASLVSLSWPSPPRASPAVARPRPSAPWRVSPAGPCRSAVRRRLLAWLSSPSPEGRPRQAARPPQSRRRHDRRFALPGHGSRAWRLLAAATGLAHHRGRRRAQVP

SEQ ID NO: 158687 - protein, 59 aa, Triticum aestivum
  Clone ID: PAT_TA_53105.pep
PQLIKFSPILLSEQGVYHLKYVASQPISSTWSSLNYMCMICGCNMNPRLYLYRYSEDLC

SEQ ID NO: 158688 - protein, 254 aa, Triticum aestivum
  unsure (1)..(254): unsure at all Xaa locations
  Clone ID: PAT_TA_53106.pep
LGSFVFPESSXXGKKLRLTARVKRQVLTTRVQEAITDPFVVKDRRSELNKKSYPPSKEEAVHCLEKISLKGKHCAILVEKNITTVKHLMRQYHRDESVLQKLTGMKKGDWNTMIKHANTSVPGDEIYSYWVPEDNCEILFNDFYDLVGKMTDNYVPYSVNNVNQFPQHKVNNWKKSAYKKFDERESSGGLTPDYFMNDGRPVRAMHLNNDAGPSVQARTTWQYPNSMAAQHEGDRRPLNGFSRAAVLSNNDAGP

SEQ ID NO: 158689 - protein, 192 aa, Triticum aestivum
  Clone ID: PAT_TA_53107.pep
MFGFGHHGHHGQNPPAHAPAAAGGNQPTFKIFCKADEGYCLSVRDGNVVLAPSNPRDEHQHWFKDMRFSSQIKDEEGNPAFAIVNKATGLAVKHSLGQSHPVKLVPFNPEYLDESVMWTESSDVGKGFRCIRMVNNIRLNFDALNGDKDHGGVHDGTTVVLWEWAKGDNQSWKILPWGEEAYAGGSANAPRG

SEQ ID NO: 158690 - protein, 78 aa, Triticum aestivum
  unsure (1)..(78): unsure at all Xaa locations
  Clone ID: PAT_TA_53108.pep
QDGVGGLQVRLRDGRWADVPPEPGALLVNIGDVLQGGLNDEYESVXHRVVIKSCEDARVSIALFFNPAKAQXSDLFGP

SEQ ID NO: 158691 - protein, 174 aa, Triticum aestivum; identical to SEQ ID NO: 132872
  Clone ID: PAT_TA_53109.pep

SEQ ID NO: 158692 - protein, 49 aa, Triticum aestivum
  Clone ID: PAT_TA_53110.pep
AHAHLTATQPMLAYFSLGNANVFVLSSFFWHTKVLLLYMPTVHYELRRT

SEQ ID NO: 158693 - protein, 70 aa, Triticum aestivum
  Clone ID: PAT_TA_53111.pep
QRFFFPTIFGVGLTDLLNPPPLVFKRGPPYVHGFSKKHGKPPTSNTGAMTLLSQGQLPCPPLPCAPRNQP

SEQ ID NO: 158694 - protein, 86 aa, Triticum aestivum
  Clone ID: PAT_TA_53112.pep
TAKDATDDFEDVGHSTTARAMMDEYYVGEIDAPPIPPKVKYTPPKQPHYNQDKTPEFVIKILQFLVPLAILGLAVPVRIYTKADFV

SEQ ID NO: 158695 - protein, 160 aa, Triticum aestivum
  unsure (1)..(160): unsure at all Xaa locations
  Clone ID: PAT_TA_53113.pep
MKSSAAAMAHKEDKKPEGENKVEKEAEKTPGGXKPKVEKRLPAGKTASKEAGGEAKTRSRKKGSKAKKGVETYKIYIFKVLKQVHSDICISCKAMSIMNSFINYMFKKLAGESAKLARYNKKPTITWREIQTFVRLVLPGXLAKHAVWEGTKAXTKFTFS

SEQ ID NO: 158696 - protein, 137 aa, Triticum aestivum
  Clone ID: PAT_TA_53114.pep
MAKAKPSSSSAKKLAAKSQGAQQGGGAGHAAPSGLARYLDPDAPWDKDRLLDAVHWIRQAVGLACGLLWGAVPLVGAAWIVLFVAISSGIIYWYYAHLLKVDEEEFGGHGALLQEGMFASFTLFLLSWILVYSLAHF

SEQ ID NO: 158697 - protein, 173 aa, Triticum aestivum
  Clone ID: PAT_TA_53115.pep
VLPNGPPHDGLHLRLVVVVKLRVETAVAKPRPCGRGGRTRSPLPSLFLWPPLVLPFSLLLISLFSHTYPTSCRSRRPSCSSGEDGGPGRIRVDLDGMDPFPADLAWRRPDLARLRASGAMALLEVPVQQERETEVRGDREEGGKGRGGGARRRCGVAGEAACGGEGSSGRTRG

SEQ ID NO: 158698 - protein, 153 aa, Triticum aestivum
  Clone ID: PAT_TA_53116.pep
RQWPLSLFTCWNKKAITYIINGQCPHKRHIFWVSRLGLLYILYYYTPNNFPKETPKSYTFAGLLPACFLSAADVHSNHRVHLPLVNMASKKLLKLWLEPVTPPKDQSNKPSASMRSNIRRASSSVEGTTLRMLTPFFRASLPTRFFGAQALLH

SEQ ID NO: 158699 - protein, 86 aa, Triticum aestivum
  Clone ID: PAT_TA_53117.pep
IAFCSCLIVGEVFIPRLIVNIYELVVKKKKKKKKKKKKKKKKKKKKKKKKKKKKKRAKKKKKKKRGPTHSKKKNFFYGGLKKNKIV

SEQ ID NO: 158700 - protein, 30 aa, Triticum aestivum
  Clone ID: PAT_TA_53118.pep
SMKNLPSTSKWDINIFLRQIHPRKGSAPKF

SEQ ID NO: 158701 - protein, 66 aa, Triticum aestivum
  Clone ID: PAT_TA_53119.pep
SSRSRAERPFFSADVTNTLALLCNKKTKPIPPDPKIIKDDNNPTNKKTPNLQRGGLTNPNKWGGPF

SEQ ID NO: 158702 - protein, 50 aa, Triticum aestivum
  Clone ID: PAT_TA_53120.pep
FLFALSQQPADACEITLPPPPSVHGADWCGGATTTTTTAGAAHCSGDDGS

SEQ ID NO: 158703 - protein, 87 aa, Triticum aestivum
  unsure (1)..(87): unsure at all Xaa locations
  Clone ID: PAT_TA_53121.pep
GREKMQIFVQTLTGKTIXTLEVESSDTIDXVMAKIQXMEGIPPDQQRLIFSGXQLEDGRTLADYNIQKESTLNLXXRLRGGSVIKVV

SEQ ID NO: 158704 - protein, 70 aa, Triticum aestivum
  unsure (1)..(70): unsure at all Xaa locations
  Clone ID: PAT_TA_53122.pep
AHISGGAEPATRSLVPTGEKXGQNKQTPLFWRGGQLLSLRPCKAFWSGKPGQMKAFLLYFNPSSKIFADS

SEQ ID NO: 158705 - protein, 56 aa, Triticum aestivum
  Clone ID: PAT_TA_53123.pep
QQRGKPLSPFFSTRRAHNNLLFQQNPCITGGIQLETPFHERGFQMPPTGSFFDPTC

SEQ ID NO: 158706 - protein, 108 aa, Triticum aestivum
  Clone ID: PAT_TA_53124.pep
NCHGQTKPIADASYWGSTSRAMLRVTGEVLPASARVPVGVVNVTQMSEYRRDAHTQVYREQWAPPTKEQLADPKSYADCTHWCLPGVPDAWNELLYWKLFFPANDQAL

SEQ ID NO: 158707 - protein, 72 aa, Triticum aestivum
  Clone ID: PAT_TA_53125.pep
MATSAATPARALPAAESSSATGANAGDSKPSGESEGAMMGDSSGAMDGAGSGAIGGNGVWAIIGASIISRER

SEQ ID NO: 158708 - protein, 53 aa, Triticum aestivum
  unsure (1)..(53): unsure at all Xaa locations
  Clone ID: PAT_TA_53126.pep
AVPALRXSLGARFSLXXGPPPPVXPFWVAPGSCVLAVFCLACCCLLPPVXCLP

SEQ ID NO: 158709 - protein, 44 aa, Triticum aestivum
  Clone ID: PAT_TA_53127.pep
ALNYIHPQPKELAFLLSKQNQARQLINAPSTYLPNLDTETGTWV

SEQ ID NO: 158710 - protein, 38 aa, Triticum aestivum
  Clone ID: PAT_TA_53128.pep
PPFTLREIQTSVPLVLPGELPKHPVSEGPKAVPKFPSF

SEQ ID NO: 158711 - protein, 80 aa, Triticum aestivum
  Clone ID: PAT_TA_53129.pep
PTPRQGFAAPKGGAPARASPHPEKKCFGPECHFQNPFRGLLGKNKGLGVIFLLCEPLGGLCVGPPEVLIKIWALQGLSCS

SEQ ID NO: 158712 - protein, 100 aa, Triticum aestivum
  Clone ID: PAT_TA_53130.pep
APQGRREQVVQKERQQDRYSERAVMRRQKGSQLSASEPKKGPAKRPRATFTPGATGRSPPSADVATCAARARTAVPAGDPSTEVSIPYVFLASKTNKDGR

SEQ ID NO: 158713 - protein, 45 aa, Triticum aestivum
  unsure (1)..(45): unsure at all Xaa locations
  Clone ID: PAT_TA_53131.pep
FENNXMNHHVALQSGSMGKXNYIARAGQHSLQDTFLELKFQGIKK

SEQ ID NO: 158714 - protein, 100 aa, Triticum aestivum
  unsure (1)..(100): unsure at all Xaa locations
  Clone ID: PAT_TA_53132.pep
SNLKCQVCSKFGHNALHCRNGFXHAFQTDEQCERSCNSVNTNTGSAGYTVHMDWYADTGATDHLTSDLDRLGIHERYGGKDKVHAANGAGPSNQDSSSSR

SEQ ID NO: 158715 - protein, 92 aa, Triticum aestivum
  Clone ID: PAT_TA_53133.pep
DKTYPTGFFLWNQKKKKGGPFFRRPYTRVTFKNNSRHPSFGLPASPLQFTFEGGRAPPLKPNFTGEQRKKNKGGKVTAFRHLIKKGLEKIKG

SEQ ID NO: 158716 - protein, 96 aa, Triticum aestivum
  unsure (1)..(96): unsure at all Xaa locations
  Clone ID: PAT_TA_53134.pep
IQPKIRWRYGKQIEEAPKFLKSXDSGFVKMIPCKPMVVETFAQYPPLAVYTVRDIRQTGTVVVTKSVQKKNPTGASGDRACVPRTNAMVAGSCTAC

SEQ ID NO: 158717 - protein, 83 aa, Triticum aestivum
  unsure (1)..(83): unsure at all Xaa locations
  Clone ID: PAT_TA_53135.pep
MVSSVNFTRSSIRAYGAICMVKAKPLIXVESKDHWKRISPMPFXFYKNIVLGKDTPASFTPATTCTMASSCASYYHMFPVKNK

SEQ ID NO: 158718 - protein, 107 aa, Triticum aestivum
  Clone ID: PAT_TA_53136.pep
STMQELGLQPDFILCVGDDRSDEDMFEVITTAVDGPYLSPSATVFACTIGQKPSKAKYYLDEPADIKRMIRALASVSDQELAMEEGEDPPYPFLAGDGTSSDDTWLD

SEQ ID NO: 158719 - protein, 163 aa, Triticum aestivum
  Clone ID: PAT_TA_53137.pep
FALPIVMTVVIDVSAQNTPQVFVNLHNRARTVNGVGPVAWDNNVARFAQDWAAQRAGDCRLQHSGGPFGENIFWGSGQSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 158720 - protein, 93 aa, Triticum aestivum
  Clone ID: PAT_TA_53138.pep
AGGLWTAATTLGVIVFFGRVTAVLFLCSCMYGARWLGAARTDARGGIADGGSSRRLGDRVALDYLCAEEHKKVVMCGLLDRAGGKRPSSRFCI

SEQ ID NO: 158721 - protein, 74 aa, Triticum aestivum
  unsure (1)..(74): unsure at all Xaa locations
  Clone ID: PAT_TA_53139.pep
IVFIYTIVLSFTFSIRCKKHTNFGSNLVHPTDILRPRYVYLRERGALXTNYRREATTHRCLLATTDFLDSAKLR

SEQ ID NO: 158722 - protein, 47 aa, Triticum aestivum
  Clone ID: PAT_TA_53140.pep
KSPPRLGYGTLYSTSECITLCAFSMILYHLCTRTLLFCRWNNTVYLS

SEQ ID NO: 158723 - protein, 79 aa, Triticum aestivum
  Clone ID: PAT_TA_53141.pep
RQTSLLLMPHKQATIHRRYTQHANSHDRTSVLYFTLASVTFFHVGGTCSSARRDDPSGDHARAAACCRSPACRRSVRPL

SEQ ID NO: 158724 - protein, 102 aa, Triticum aestivum
  Clone ID: PAT_TA_53142.pep
LKLRLKCKSVDDRTMLSEMDPGSFKTSDTSYYRHVAKRRGLFRSDAALLLDATTKDCVQRIATGKFDSEFFRDFSESMIKMGDVDVLTGAEGEIRKKCHVLN

SEQ ID NO: 158725 - protein, 110 aa, Triticum aestivum
  Clone ID: PAT_TA_53143.pep
DCPEWVVPFHLFKLLAEEYDLELVLMKNFHEFVHEYLQKPESADLMRRLGALGDGRSVQSTLSQDEWEVSYLYLAFVLRKRGPPPSQRRANNANRGKTFLAEEDIEFLSI

SEQ ID NO: 158726 - protein, 69 aa, Triticum aestivum
  Clone ID: PAT_TA_53144.pep
GIHICSIHYFIQQENAMQGHAIVPLRIHIFYKTLTMYSMYYIFLAASPLCKQPSPTLYKHLMWTMPGPD

SEQ ID NO: 158727 - protein, 84 aa, Triticum aestivum
  Clone ID: PAT_TA_53145.pep
DWSRAPGAVRAKYLRAIAAKMIERKSDLARLEALDCGKPLDEAAWDMDDVAGCFEVFAGHAEALDKRQSAAGALPGNRKCRRAK

SEQ ID NO: 158728 - protein, 67 aa, Triticum aestivum
  Clone ID: PAT_TA_53146.pep
TPTTSSSPPTCCIRLVPQGYHLLGFIRPLTFFTHTFFCTITICIFFKLLRIVRRRIICEAVALFLCV

SEQ ID NO: 158729 - protein, 47 aa, Triticum aestivum
  Clone ID: PAT_TA_53147.pep
PPSPPVCAREWPNAPVSAFSLSRQCFQTGLLFVHQSELALYSICNRV

SEQ ID NO: 158730 - protein, 51 aa, Triticum aestivum
  Clone ID: PAT_TA_53148.pep
IIMWLSVYYIYFFPVAMHNVCMFSCSICFDILSFVHVCFFSIKSNKISSAL

SEQ ID NO: 158731 - protein, 94 aa, Triticum aestivum
  Clone ID: PAT_TA_53149.pep
KWPTVCTWPNWLVVLRQMSIKSLYFPAKNNNDCQYELKYIIYRKCTLHVTIETGCVFSVSYTRLSRRNYTRQSLCPSVKGSYKPISLTYGWRGS

SEQ ID NO: 158732 - protein, 77 aa, Triticum aestivum
  Clone ID: PAT_TA_53150.pep
PLGALSHNMPPSGNRSLHTSRPLSTPVANRPLSPHLPLKKPQLSATFSISHRIFGAALGAAIISIPLATRFGVMFEV

SEQ ID NO: 158733 - protein, 103 aa, Triticum aestivum
  Clone ID: PAT_TA_53151.pep
RHTPPPPRVVLLKLLNGSKSVLHTMSKGQQSLVTWVTPRLSEVKVKQCIDPKLNNDYPPKAVAKLAAVAALCVQYEADFRPNMTIVVKALQPLVGARPGGGDH

SEQ ID NO: 158734 - protein, 66 aa, Triticum aestivum
  Clone ID: PAT_TA_53152.pep
SITKTKHSVSESECHLKEAHHTINTSILCINRRPPDGCETSRMPPAVTCAPLLLLPRAHVVYCWLL

SEQ ID NO: 158735 - protein, 53 aa, Triticum aestivum
  Clone ID: PAT_TA_53153.pep
IENPLCTHDNICSSLEPLYSQHLIKDVSTSVTSPINCLFIRPFNPSSTIGHSA

SEQ ID NO: 158736 - protein, 133 aa, Triticum aestivum
  Clone ID: PAT_TA_53154.pep
GTKALVYHYTKRLYNPFYMRTIWLLGRKRNIRPYMTHQRLPGGRYGHASARPGKEKKTHLIHKLAPGPPRLHTSIASDTRAPSGGLQGPEQDLVSPRLFKFFFTRVPGENRPAPAPRAPPGCPYVGHRRGHRS

SEQ ID NO: 158737 - protein, 186 aa, Triticum aestivum
  Clone ID: PAT_TA_53155.pep
AQGRGVRGWRIHVHAGARHMHAIGCRSHFDRPPVHAQSKGVDTAVTCCTCTPYTPIRAYPSVPTSHIPGDPSWACMAFTVGCIVGHRSDRSSCRGVTIGACPPHLSVIHRQQLRSPTVRASRSPAEPPHALLICSDPPFWSLSLFLVHMAMRARLRWRRVEEEADRRAIIDGVAPPLAPSGADGAL

SEQ ID NO: 158738 - protein, 77 aa, Triticum aestivum
  unsure (1)..(77): unsure at all Xaa locations
  Clone ID: PAT_TA_53156.pep
QFKAPEXFLNRNKVHKPGRFSQVVTNPVDIKLRHHLEWLKKIRNHCGLRHHRGVRVRGQDTKTTGRRGKTVGVSKKR

SEQ ID NO: 158739 - protein, 107 aa, Triticum aestivum
  Clone ID: PAT_TA_53157.pep
GDFRLQHSGGPFGENIFWGSGQSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 158740 - protein, 58 aa, Triticum aestivum
  Clone ID: PAT_TA_53158.pep
RKTKFQMAKLEFWYINNFRIISTSVMTNTLLSYNGWQDRTIFMKICTNQLMKDKEHLM

SEQ ID NO: 158741 - protein, 44 aa, Triticum aestivum
  Clone ID: PAT_TA_53159.pep
DRLGPSFEQQNKSEDVCLHLHAPQSRMVAYRPEWGLIYVRAGHW

SEQ ID NO: 158742 - protein, 95 aa, Triticum aestivum
  Clone ID: PAT_TA_53160.pep
PVQGALVVNVAAFLQIVSNDRFKSVEHRVVSQSIGPRVSVACFFRRQDVATSTRVLAPIIADGEARYRSTTMAELVRHNRAKGLDGSSALQHLRL

SEQ ID NO: 158743 - protein, 84 aa, Triticum aestivum
  Clone ID: PAT_TA_53161.pep
DNAHGVATYIHSIFLTSESILHSATVLLHYMALIIFPNRLNNLASPGGWTAYIVFVWVGFMSACRLEKGRCGVVRSFCQALLCA

SEQ ID NO: 158744 - protein, 53 aa, Triticum aestivum
  Clone ID: PAT_TA_53162.pep
MVVSFTSQNSGIVFVPLTLLGFNPPIRTPVLTKALRVEAGVVELLKSKFAAGF

SEQ ID NO: 158745 - protein, 86 aa, Triticum aestivum
  Clone ID: PAT_TA_53163.pep
IFNDSGTMALSGQHVNTKTTSSGYCYKLTCSISFTNSTSSSEFPITILRTLQAKFPDADVVFTVRGHDFLHAHRQAGDWWTFVLAN

SEQ ID NO: 158746 - protein, 59 aa, Triticum aestivum
  unsure (1)..(59): unsure at all Xaa locations
  Clone ID: PAT_TA_53164.pep
GPKPWVGSQLGLVKIRTIGGGQSNRITHGFLLFLGGGGGKSFLGXLPXKEFDXGKGQGG

SEQ ID NO: 158747 - protein, 82 aa, Triticum aestivum
  Clone ID: PAT_TA_53165.pep
HKMHQSDPISQEQKQMLQKLQLLPKEIVTNQCNPCIHASTVQCILVEHHSSLITHPLATFSSWLYKQWPKPQPFSATTASNS

SEQ ID NO: 158748 - protein, 88 aa, Triticum aestivum
  Clone ID: PAT_TA_53166.pep
VSVVVHLLYLPALVPVIPFISLVHQSLLSFHRADTPGFMPFCSLLLVWIVVLHFIHKMIPYDYFVLRASTGLCNIVLCQRPQCGPCNT

SEQ ID NO: 158749 - protein, 110 aa, Triticum aestivum
  Clone ID: PAT_TA_53167.pep
SSSSNKSFPVWVDAPTMEGALVVNVGDFLQIVSNDRFKSVEHRVVAQSTGPRVSVVCFFRRQDAPTSTRVLRPIVADGEARFRSTTMAELIRHNRAKGLDGSSALQHLRL

SEQ ID NO: 158750 - protein, 27 aa, Triticum aestivum
  Clone ID: PAT_TA_53168.pep
SDNSSFTYNYMHELLYSNTSSALKLAS

SEQ ID NO: 158751 - protein, 48 aa, Triticum aestivum
  Clone ID: PAT_TA_53169.pep
NRWVSCILFKRETQNTSHWHRTYLPVQRRTGQETGQATVTCSVLPNGG

SEQ ID NO: 158752 - protein, 50 aa, Triticum aestivum
  unsure (1)..(50): unsure at all Xaa locations
  Clone ID: PAT_TA_53170.pep
GTSRPRLIYLYTYPCDVQTYILTHAMHESSPSISIIWLGGGAXKEKESRL

SEQ ID NO: 158753 - protein, 77 aa, Triticum aestivum
  Clone ID: PAT_TA_53171.pep
VRIPPPQGRFARGSSPKFQPRGPHSFFIKAALVKKRTLFFPNHVEQGGDFVGRVGFSSPVVMSFKRPEWVYVLAPVP

SEQ ID NO: 158754 - protein, 82 aa, Triticum aestivum
  Clone ID: PAT_TA_53172.pep
KPPQPRQVLLARCRHVTQDAGWVAGVPLVTFSICACVPPPPACLSNWHSLLNCVTWRNDLEHGTGDAKYGYKKESPPTDRNE

SEQ ID NO: 158755 - protein, 101 aa, Triticum aestivum
  Clone ID: PAT_TA_53173.pep
RAFLSHTNMINRMAVEHREGARTKPTEGSILAGCSSRVKDRRYGRISDELMKIDMVDGHAPWRSSGDVVDADHRLGAELGFTWSFIIGVFAAALTAPWAAY

SEQ ID NO: 158756 - protein, 71 aa, Triticum aestivum
  unsure (1)..(71): unsure at all Xaa locations
  Clone ID: PAT_TA_53174.pep
LKRPGSNCTLACGGPVLVRPKTFGDHLAYVGEPLSAITQAFGLFGAELGVGSACGALGPGLGWGRGXGGGG

SEQ ID NO: 158757 - protein, 41 aa, Triticum aestivum
  Clone ID: PAT_TA_53175.pep
FFFFFFFFFFFFFFFFFFFFFFFFFFFFFFFFFFWAEKKIP

SEQ ID NO: 158758 - protein, 148 aa, Triticum aestivum
  unsure (1)..(148): unsure at all Xaa locations
  Clone ID: PAT_TA_53176.pep
ARRPPVPPPPPPPPAPPRPPXRPPPPPPPPPPPPXXPPXPAPPPPPPAPPPPPPPPPXXXPPPPPPPXPPPPPPPPPPPPPPPPXPXSPVPXPPPPPPSPPSPLRLLGFPPPFLLAVPFVLSLCPPRPPCCCLFPVCPAVFVLLPPPP

SEQ ID NO: 158759 - protein, 179 aa, Triticum aestivum
  unsure (1)..(179): unsure at all Xaa locations
  Clone ID: PAT_TA_53177.pep
MPSSRLVPPKDGEWGGGGVALEVTVLSGESLRLPPTYSPLPRRLRPYVAVSSSSSAGCSTGVAPATSGAGEHSWEDAGEDARLVVPVGAGFLEGRDDVRVAVLSESGCARLVGDTPLGWCRVPAADVLDGLRPPRALRXLSYSLRCPRRGGPGHGVVHLAVRVLRDVRVGPRPGPAPAA

SEQ ID NO: 158760 - protein, 105 aa, Triticum aestivum
  Clone ID: PAT_TA_53178.pep
VDRTHKINLDQNMIKKLKHGTRCARSIPYVREDATIIFRYTVTHETFMAQHRTLNWTDMTVITCKPNGLYLCVLAPVDSIILKMRQIKQTMACVCDTISDYHSDA

SEQ ID NO: 158761 - protein, 192 aa, Triticum aestivum
  unsure (1)..(192): unsure at all Xaa locations
  Clone ID: PAT_TA_53179.pep
MASATEMQPLAPSGYRRAPEMKEKVEASSIDLEAGNGETLYPGISRGENALRWGFIRKVYGILCAQLVLTTVVSAITVFYPTLNATLSNSPVLALVLAVLPFILMIPLYIYQHRHPHNLAILGLFTLCLSFSIGVACANTEGTIVLQALVLTSAVVVSLTAYTFWAAXKGKEFSYLGPFLFSALTILVVISF

SEQ ID NO: 158762 - protein, 87 aa, Triticum aestivum
  Clone ID: PAT_TA_53180.pep
GIPKQIIHVHDPKLQGLCAAWGEGVHKAVVSCLVEIQESGRLGDRNIVPEVWNYKCKRKATHSESIEYLFGQVKRLSDAKSRTRSAR

SEQ ID NO: 158763 - protein, 95 aa, Triticum aestivum
  Clone ID: PAT_TA_53181.pep
QPTRIFVLASSIIPPFYSLQRKEILQLPPCRHNERITQLRWAAPRPTWCKKDSYPTRYVSFELAIPFVSRRRRCLLRQSSRSCGATREQYQSVSA

SEQ ID NO: 158764 - protein, 155 aa, Triticum aestivum
  unsure (1)..(155): unsure at all Xaa locations
  Clone ID: PAT_TA_53182.pep
MHNTHTSWLLKXEKKLLRMXAMSPGLPTYXKSLIGSSNVNKQSFVVEKSKDQYIKDVRSCLDYIRDGESYELCLTTRMRRGIEYINALQLYLKLRKQNPAPYAAWLNFSSENLSICCSSPERFLRLDQNAVLEAKPIKGTIARGRTPEEDECLRL

SEQ ID NO: 158765 - protein, 219 aa, Triticum aestivum
  Clone ID: PAT_TA_53183.pep
MGKEKTHINIVVIGHVDSGKSTTTGHLIYKLGGIDKRVIERFEKEAAEMNKRWFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARCEEIVKEVSSYLKKVGYNPDKGPFGPICGVEGDNMMGRGTNLGWGRALPLLGL

SEQ ID NO: 158766 - protein, 147 aa, Triticum aestivum
  unsure (1)..(147): unsure at all Xaa locations
  Clone ID: PAT_TA_53184.pep
TQXPRASGXPXXSPSGSEGTRSXXRPETPTAGPXXAPPXXPAPPRPXEPGKPXXEXGXEGPAAXXGGGGPAAXPPEXAXAPPPXXXAXTXXPGNXRXPXRXSTTADEGXXXXXDGXXXHAQTRXGAASXXXRPPAAXXPXPXRRXPT

SEQ ID NO: 158767 - protein, 174 aa, Triticum aestivum
  Clone ID: PAT_TA_53185.pep
VEMEVSSSTMLKPAYSTPHLAGEMVPLTLFDRATLDIFVPLILVYPAPTPSNDALTEGLRRAVAVYPHLAGRLAVDHRGRRFIHVNNEGVLVVEAAVPVDLASAVTDGSFVTDTDGLYPAVPPPEESIGAALLQIQLNRYKCGGLAIGLSSHHQADDGYCDGTLLCTWTSAVHQ

SEQ ID NO: 158768 - protein, 143 aa, Triticum aestivum
  unsure (1)..(143): unsure at all Xaa locations
  Clone ID: PAT_TA_53186.pep
RTGKRRGRRAXAXXANRGAXXXDXGTGXTXQGDEXXQXXPXKDRXXEQXEXNXHXXAXAGATXGXXXXXXXKGTXXXQQXXKXXEXXPXKXXNKKXKEGXXXTXXXTAGTRXXGXXXRNXGXXEQXXEXXXXKPXEGXHRRXE

SEQ ID NO: 158769 - protein, 66 aa, Triticum aestivum
  unsure (1)..(66): unsure at all Xaa locations
  Clone ID: PAT_TA_53187.pep
PPPLLVVVVXVXAXXXSSXGXGAXLXCAGXRCXXXXXXWXRFLPALCXFVFGPRAPLWXLXGGXLR

SEQ ID NO: 158770 - protein, 84 aa, Triticum aestivum
  unsure (1)..(84): unsure at all Xaa locations
  Clone ID: PAT_TA_53188.pep
LRXXXXMXXSPSRIXXXXRSHMSFXXHALXQXXXAPSXGTSGQSIRXAPMRMGTRTRRRRMIFAIAIEXHNSLRREICFXPSXP

SEQ ID NO: 158771 - protein, 177 aa, Triticum aestivum
  unsure (1)..(177): unsure at all Xaa locations
  Clone ID: PAT_TA_53189.pep
PSRPRRGRGRPRTQTPRRRRRRRSARRRRTAAKRQXXXKTXTGKTXTXEGEXXDTXDNXKGGGQDKEGXPPDQQRXXXAXKQXEDGXTXADHNSQKEGTXHXXXRXRGGAKKRRKKTXAKPKKQKRXRKKGKXGXPQXDKGDDRPRGGDQGGRGTATAGRRGRGNHGGPGRPGGRGG

SEQ ID NO: 158772 - protein, 111 aa, Triticum aestivum
  unsure (1)..(111): unsure at all Xaa locations
  Clone ID: PAT_TA_53190.pep
PSRGRXGRRALADMGARAAPGDGLXXHYSGHGTLXPPRHGDGGAEEEAXXPTDXNXXTDXDPRQGGDRXPPGASXTXXXDXXHSGGPXDQEKEQXGPGGPGAPARTRPADH

SEQ ID NO: 158773 - protein, 87 aa, Triticum aestivum
  unsure (1)..(87): unsure at all Xaa locations
  Clone ID: PAT_TA_53191.pep
PXRXXLCXXXXXCXSXXXPVPPFAFPSXXXXXXXPPXWXXXRLPPXXCXXXWXXAXSXXLCPPXRXSXPPXLSCAXRVGXRWAXAGS

SEQ ID NO: 158774 - protein, 152 aa, Triticum aestivum
  Clone ID: PAT_TA_53192.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGADGVANINVTDCHIPLTGPNSIVGRAVVVHGDADDLGKGGHELSKSAENAGARVACGMIGLQG

SEQ ID NO: 158775 - protein, 107 aa, Triticum aestivum
  unsure (1)..(107): unsure at all Xaa locations
  Clone ID: PAT_TA_53193.pep
VXSSRPRLAPPAGAXXXXGVLXSRSAXXFLARAXXXXRAXXXAPPRRXXRXLXRRPAWGLXPXXCARPCXWLXSCSXPCRACRCRARXLPXALWGAPGSAPVSRXCA

SEQ ID NO: 158776 - protein, 214 aa, Triticum aestivum
  unsure (1)..(214): unsure at all Xaa locations
  Clone ID: PAT_TA_53194.pep
GPXPRPPAAGPPPPPAPPPPRPRGPPRPPPPPPPPPRAPPPPPPPPRPPPPPPXPAXPPPXXRPPRXPPPAPPPPXPPPPPAPPLPPPPPPPXXPPPPXPPXPPXPPPPPPAAPPPPPPPPPPXPAPPPARPPPAGGALPAAPPLAPRALVGPAFAPAPPXGRPPLFGLALVFGPPRLRVGPARLLVGVLFSAALVRPAPPWAPRALVSFAPPC

SEQ ID NO: 158777 - protein, 111 aa, Triticum aestivum
  unsure (1)..(111): unsure at all Xaa locations
  Clone ID: PAT_TA_53195.pep
EPSREGGEKTNXPEPAKETPKRPEXXAGQTNREETKDPXESRKTAKEGGTTQGKPXARPSAHXEXGXSXTXAAXRRRXAXEAAEESTRTXSKXRKXXXEXXPGADAHEGKK

SEQ ID NO: 158778 - protein, 98 aa, Triticum aestivum
  unsure (1)..(98): unsure at all Xaa locations
  Clone ID: PAT_TA_53196.pep
REEGKXEXEEDGKXXXIAGERGXRREAKSETRHHXERSSATXXGRXHLPDDAAXGQXRAAMDDGGXQLTXTXPRXGAAXAXAMPEPAXAXEVXEASPC

SEQ ID NO: 158779 - protein, 139 aa, Triticum aestivum
  unsure (1)..(139): unsure at all Xaa locations
  Clone ID: PAT_TA_53197.pep
GARHAAGTAEGTNGXQEPHXRRRDGRXPXKDEAEKGTKXXEAAXXRRXAEGXTXEXXGRDRXGXXXDXTRXXREHGXTXTRADXTTXGEQAXNXXXXRDAXGXPXDKKTXEGXRGQXGQTGAPNAKKPARRRSGPAARP

SEQ ID NO: 158780 - protein, 58 aa, Triticum aestivum
  Clone ID: PAT_TA_53198.pep
ARSPGIVAGWSASPGTPRGSYCSHELPVGRGFVKVRRPSSFRHLYSSYKMGLALLCMN

SEQ ID NO: 158781 - protein, 127 aa, Triticum aestivum
  unsure (1)..(127): unsure at all Xaa locations
  Clone ID: PAT_TA_53199.pep
VSRTSTETEYRAVAHVVVECCWIRQLLGELHXPLTSTTVVFCDNVXSTVXMASNPVQHRRTKHIEIDIHFVREKVSLGEVWVLHVPSSHQYADIMTKGLPSQLFSEFRSSLCLLPCDAQAKGGGGGC

SEQ ID NO: 158782 - protein, 159 aa, Triticum aestivum
  unsure (1)..(159): unsure at all Xaa locations
  Clone ID: PAT_TA_53200.pep
GLLSPSTSRTNALLGALXGLSPKVMVVCEQEPSHNTAGLTERFVKALNYYAALFDCLEVGAARGSVERARVERWLLGEEIKNIVACDGADRRERHERLDRWAARMEGAGFGRVPLSYYALLQARRAAQGLGCDGFKVREEKGTFFLCWQDRALFSVSAW

SEQ ID NO: 158783 - protein, 43 aa, Triticum aestivum
  Clone ID: PAT_TA_53201.pep
HKLDLNISADRGTLYLRKIDRGRCKAHTGTDTAPVGWGMVRER

SEQ ID NO: 158784 - protein, 98 aa, Triticum aestivum
  Clone ID: PAT_TA_53202.pep
SSNRESSPPRRFSGVGGPAAVLKKPGAPPGTFGFWKKGGPRGFLGAGRFIGRKRVVAWIPKKSLGTFRRAFPCPKASPGAFALLWPGTGNRARKKFPR

SEQ ID NO: 158785 - protein, 89 aa, Triticum aestivum
  Clone ID: PAT_TA_53203.pep
MKNYGVTCDAEVLDMLDTAARQLELKVVAKVYWGDAREKLCDAVEEQKIDTIVMGSRGLGTIQRILLGSVTNYVLSNASCPVTVVKGDR

SEQ ID NO: 158786 - protein, 253 aa, Triticum aestivum
  unsure (1)..(253): unsure at all Xaa locations
  Clone ID: PAT_TA_53204.pep
FYRNNTSTPPVSYLQSTITHVHYVSPHSALSTLWHVKWRLITTLILLQIVHNLFFHPLRKVPGPFFARASSLWRIIKYFRGTWHDDIMDLHRRYGQVVRISPGEVSFTDEHAIKNIYGHGKHVAKSSFYNGFLVPKMTISFFATRDNKVHRFLRSRVASTYSMTSILSMESLIQDVLDLNLKKLGERADEGKKFEVDKTVNYYTSDVVSQLALGGMVGCVEQQXDIGXIIQSVHDGFYFMGNLGVLPXQMFWI

SEQ ID NO: 158787 - protein, 266 aa, Triticum aestivum
  Clone ID: PAT_TA_53205.pep
EVISILFAIMTGAMSLGNATPCMTAFAEGQSAALRLFTTIKRKPEIDPDDKTGKQLEDIKGDVELRDVYFSYPARPEQLIFDGFSLHVSSGTTMAIVGESGSGKSTVISLVERFYDPQAGEVLIDGINIKSLQLDSVRGKIGLVSQEPLLFMTSIKDNITYGKEGATIEEIKRAAELANAANFIDKLPNGYDTMVGQRGAQLSGGQKQRIAIARAIIKNPKILLLDEATSALDVESERIVQEALNRIMVDRTTLVVAHRLTTVRNA

SEQ ID NO: 158788 - protein, 207 aa, Triticum aestivum
  unsure (1)..(207): unsure at all Xaa locations
  Clone ID: PAT_TA_53206.pep
TQPPTPAQTILISYGIYTXXPQXXXSHLGSIGEVASTWLSENGYLSTQCPPLPKGNINYDIYMGYPEMFAWDKKRCVAYVSNLYNATVSTWDPYKGVVLDTIEFPGLSHAGDSASPNPLHASGIILRPDAYNPHTLEVXIDNGDAFYSDGFNVSGPDHLMTIDLKTKEVTNKLRVNNGLYAGYAGARLGPGGDTCXLGTSASALLRG

SEQ ID NO: 158789 - protein, 130 aa, Triticum aestivum
  Clone ID: PAT_TA_53207.pep
PTRPSQDNCKKTNFRSIHHPSISSPRTKPKPSPARSDPLAGADGSTQRRRSRRLSLSSPRATHLIRRSLRPQRWRRDPWRRPSRAIRRSSSPTTSWSRSSRACPTSPPAAASASPRAGGTSSPTPTTARS

SEQ ID NO: 158790 - protein, 194 aa, Triticum aestivum
  Clone ID: PAT_TA_53208.pep
MSIACCLPVVECVYCLACTRWVWQRCLHTTGYDSETWGLASSGEFEPVPRLCRFILAVYEDDLETPQWAPPGGYGIEPRWVVRRRTPEHAQGRAPTYLLYVDHRHADVVLAVRGMDMAKESDYAVLLDNRIGQAGFDGGYVHNGLLKAAVWVLDAECDALRDLLATNPGYTLTFAGHSLGSGVAAMLAFLAVRH

SEQ ID NO: 158791 - protein, 56 aa, Triticum aestivum
  Clone ID: PAT_TA_53209.pep
GDPLLNPNPNGQKHTKLPESAKPGGYKKHNRPHTLFKPRNGAKNDETPPEAHGGGT

SEQ ID NO: 158792 - protein, 97 aa, Triticum aestivum
  Clone ID: PAT_TA_53210.pep
QSFYNLTNSTRVWKKKTGHCCPLGEEPTKRINGHAASSSKAFSSSSPLGTGSYPTFFGKAIFGLPCLTPPGGWVASPFFRRVGLGGSFAATCFKPAK

SEQ ID NO: 158793 - protein, 107 aa, Triticum aestivum
  Clone ID: PAT_TA_53211.pep
RRPRTRRHLDPLHAISISPETCTKSHPAPSPPFGPRPVALQPERFNRLVPEAEERSSLPRASPALANQQADPASYLFFRRDASPLRCLLRRGRRRQVVAGTRRWRTR

SEQ ID NO: 158794 - protein, 89 aa, Triticum aestivum
  Clone ID: PAT_TA_53212.pep
EGYDELVAALPGDDCRYAVFDFDFVSVDNCQKSKIFFIAWSPAASRIRAKILYATSKQGLRRVLEGVHYEVQATERSEMGFDVIRERAQ

SEQ ID NO: 158795 - protein, 192 aa, Triticum aestivum
  Clone ID: PAT_TA_53213.pep
CWDAIQTTFDTYYQSGHSGTLSTLEATGEPLIPAFEDLIKVFGSKEISAAESQQLNVKARIFREKFRDAWDAPTKLTSTGRPVDALICPTAPAVGYPHDFNVYWGYTSLFNLLDYPSVILPVANFKVNPQDDPVASNYKPLETNPYDKPNHELYKPELFSSQPSTIQVVGRPFQDEELIKVSSVMDDLLRAM

SEQ ID NO: 158796 - protein, 116 aa, Triticum aestivum
  Clone ID: PAT_TA_53214.pep
GVVNQMSGLRKGFSALKFVKSGLSGEIFPPKWVIFYIKEKAPEFFSVVASNEVFVTSKGGAEKMSHKMGVPFLGKVPMDPQLCKAPKEGRSCFPDQRCSASAPAFKSIMAKLFKPK

SEQ ID NO: 158797 - protein, 138 aa, Triticum aestivum
  unsure (1)..(138): unsure at all Xaa locations
  Clone ID: PAT_TA_53215.pep
KSDXXDXXNSENXAGEKXXXXXXAXKEGXAXXGXXXKGXQXXSXXKKXEGGEXXXXXXPGTXAGXREEKGAXXXXXAXTAXRAXGXRXXGXXXXTRXRXXGKXEXXXXDXXXRXEGRRRKGKQXXXGXXXXEQKXARA

SEQ ID NO: 158798 - protein, 69 aa, Triticum aestivum
  unsure (1)..(69): unsure at all Xaa locations
  Clone ID: PAT_TA_53216.pep
GDAPXSGAKSAAGGGXTRSGTXTXASAQAPXXXAXXXXXXATXAGXPXQXQXRGPXXGXRKXXXRHXDP

SEQ ID NO: 158799 - protein, 128 aa, Triticum aestivum
  unsure (1)..(128): unsure at all Xaa locations
  Clone ID: PAT_TA_53217.pep
TQPGAAPARRPAGATSTGGRGAARNPXETRNXERNGRXTXXTXPRDGXRRDXNXXGXGXXGGGGPXSXPXXNGNSXTGXXXXSSGEEHAHXPTPPXHQTQSGRGXXTXHXGRDNARTXGQNGGKGRTE

SEQ ID NO: 158800 - protein, 142 aa, Triticum aestivum
  unsure (1)..(142): unsure at all Xaa locations
  Clone ID: PAT_TA_53218.pep
GLCVPXVFGXXALGLVAGRLVVLPLVLGPXPVGLRRRXXRPXCSRXAGGXXAXGXXGLXRXGVGAAGRXVAXGXLGRXVAXLALVAPPPLLLLRRWRRRRLRGXGRLLAXRXXXWXXXPFXLSXXXXAPRLVACASAPPVCL

SEQ ID NO: 158801 - protein, 104 aa, Triticum aestivum
  unsure (1)..(104): unsure at all Xaa locations
  Clone ID: PAT_TA_53219.pep
KKKTKQKPTKKKTQKEKKRTRKKKKKKKKTNKTNKKKEKKKNRAHPPPKRKRKTTEERSXQTIXQHRRTKKNDSHDNHHHNRRRQHTAAAARSARGGCRTTDRK

SEQ ID NO: 158802 - protein, 125 aa, Triticum aestivum
  unsure (1)..(125): unsure at all Xaa locations
  Clone ID: PAT_TA_53220.pep
LLRAVRXCXXXLLGASXXSXVFXAXAXGXFVPPXXXXAXLFAXLXLXXPLXXXFLXPPAWXPXSXARPLVPXPPXXXPLSXXXSXALPXXSSLSFFLFPPCGGXGGXXARVAXXLVXRVSAXAGS

SEQ ID NO: 158803 - protein, 183 aa, Triticum aestivum
  unsure (1)..(183): unsure at all Xaa locations
  Clone ID: PAT_TA_53221.pep
HHRRREGAPAXAAKXXPRGSDEXPAAGAKARRKXRGPXAEKNXAPXXXRPAXHPAGTGDGATKTGGPXGTXKXPAEXAHGANAGPDSADRRXEPXKEQGPNQSNADRNQHXGGGAGEDTGGPEGAXRPGRRDKAEAARGGRGADARGPGAPGGGGRPPGGGGGGGRAGGGAGRRGGRGGGGGG

SEQ ID NO: 158804 - protein, 161 aa, Triticum aestivum
  Clone ID: PAT_TA_53222.pep
VPGACVTRLYWRLLHLYCCIDRLWLLPLSSIPFSSQIPAMAEPIPADSSIMVTPPVYRRRNPSEESRGISNAGGKDHGVASSTGETSQAAISAGPPDKLDPESAKACLEVEKTHPRILPLLGKAYFACVVCKSHVQQPFQVVDPRTMVPNLPSKPTPATLT

SEQ ID NO: 158805 - protein, 88 aa, Triticum aestivum
  unsure (1)..(88): unsure at all Xaa locations
  Clone ID: PAT_TA_53223.pep
RTRGKEYIVMAALSQVANFPPHSLHVGGSRGRCXXLFPAAHQRWRLLPSPQALLPALPRPPSFCSVLSRLSRRPLASSPLSLPLSPLA

SEQ ID NO: 158806 - protein, 173 aa, Triticum aestivum
  unsure (1)..(173): unsure at all Xaa locations
  Clone ID: PAT_TA_53224.pep
RLPPRPTAGGGEGAEPGGAAXGRXXEXAXXPXRXQPKDGANTRATXTXGPDGAXRGRNETXTDGRRGHXEGTAXRADDAGDEAKXRXRXNXPPXXPXXPGTGDXRXXHGDDAHQDAPDGQPRRNHHXNXXRQAXXDEGXNEEPXERAKGEGGDGSKXRRTPNPEPAPGSQDAP

SEQ ID NO: 158807 - protein, 179 aa, Triticum aestivum
  unsure (1)..(179): unsure at all Xaa locations
  Clone ID: PAT_TA_53225.pep
PPPPRAGPPRPPPPPPPXRPPPXPPPPPPPPPPAPPPRPRPAPPPPPPPPPPPPXPPPPPPPPPPPPPPPPPPPPPPPPPPRPPPPPPPPPPRPAPPPPPPAPPPPXPPPPPPCPAXGPPXPXGPLXVLGVXXXXXRPPPSPPLVGLAXLXXALWPLAXXPPGXXPGGWSLPRLRVGPP

SEQ ID NO: 158808 - protein, 133 aa, Triticum aestivum
  unsure (1)..(133): unsure at all Xaa locations
  Clone ID: PAT_TA_53226.pep
APPPPPPPPPGPRPRPPARXPAPGPPSPRPPARPPPPPPRWPRPPPPGSXARXRXPGPSGPCXGPXASRXAPPWXCWXGWGPPRXXXSAXGXAAGCCPCGFGRRCPPLPLVVVSGCVPGGRWGSPRLRVGCGA

SEQ ID NO: 158809 - protein, 113 aa, Triticum aestivum
  unsure (1)..(113): unsure at all Xaa locations
  Clone ID: PAT_TA_53227.pep
PPXAPPPAPPPPPPPPPPPPPRPPPXPRPPPRAPPPPGPGLPPXAPAPWSFCVFLPLLSCFLSRFACPLFPSVCASVGVVRFGPLRFFARWCPGVVLGVVGRGFPRVVRVLVV

SEQ ID NO: 158810 - protein, 132 aa, Triticum aestivum
  unsure (1)..(132): unsure at all Xaa locations
  Clone ID: PAT_TA_53228.pep
LVPSAXSFSXVSXRXLRFXPRXSWGPLLPCXFGLXFAXASPVXAXXAXXLSXXXWCSLFLSPXPXXSXARXALVXVVXAXPXARXVAXXSXPPLLXPFLCXPXAVAXPAXPAPAXXXSSXPSXXRGVGXAGV

SEQ ID NO: 158811 - protein, 76 aa, Triticum aestivum
  unsure (1)..(76): unsure at all Xaa locations
  Clone ID: PAT_TA_53229.pep
APGDLDPFQHMAIRAQHHAQGDGLISDQMHGIFRLEAVDIQAEHCVWKLAVXQREPSWEREAVQQETERLEAANLI

SEQ ID NO: 158812 - protein, 98 aa, Triticum aestivum
  unsure (1)..(98): unsure at all Xaa locations
  Clone ID: PAT_TA_53230.pep
VPLTKVGGFLQRMDLCPQYAFGKMLVFGFXAPFKVKGVWLFLGRATPGFVLKGVFSLELSGWPQVALSSEAPKKRVEPLFGALYPFQGPPFLGPQCFK

SEQ ID NO: 158813 - protein, 158 aa, Triticum aestivum
  unsure (1)..(158): unsure at all Xaa locations
  Clone ID: PAT_TA_53231.pep
HYXQLVIKETLRLHPAAPLLLPHECRSPCEVLGFDVXQGAMVLVNAWAIGRDPAHWDAPEEFIPERFQEQGGMDGRDFKGTDFEFVPFGAGRRMCPGMSFGLAHVELALAALLFHFDWELPEGMAPEEMDMTEAAGITTRRRSDLLVICIPRVQVSME

SEQ ID NO: 158814 - protein, 47 aa, Triticum aestivum
  Clone ID: PAT_TA_53232.pep
FQNADFTKPKPYMAYCTTQDRYSMPLISSKDGYSSRITSMSLPFMMF

SEQ ID NO: 158815 - protein, 209 aa, Triticum aestivum
  unsure (1)..(209): unsure at all Xaa locations
  Clone ID: PAT_TA_53233.pep
GVHNRLFHLAVNLPDHAVIDRILQSLPPSTRSFVMNHNMQGMEKTIPQVYSKLKSAEVEIRKEHQVLMVNKTTKFKKGKGKKNFKKDGKGVAAPGKPVPGKKSKNGPKPETECFYCKGSGHWKRNCPKYLADKKKAGNTQGXRNKRRLAKDEVPMRVGNGSKVDVIAVGTLPLHLPTGLVINLNNCYLVPALSMNIVSGSRLIRDGYSF

SEQ ID NO: 158816 - protein, 50 aa, Triticum aestivum
  Clone ID: PAT_TA_53234.pep
HLLSLSVVSAGSLFMSPNIFGVGCYHEFCHQYYPALFPSELIMCSVPLYS

SEQ ID NO: 158817 - protein, 62 aa, Triticum aestivum
  Clone ID: PAT_TA_53235.pep
LLNHSHGHELPECDRTYPRSAGGRIPCMIFYGCLNVKSLLSMCTTNIPERPFQLIYIGRLIS

SEQ ID NO: 158818 - protein, 192 aa, Triticum aestivum
  unsure (1)..(192): unsure at all Xaa locations
  Clone ID: PAT_TA_53236.pep
IYFGPAFNGLFAPWXRDTARGICIGXTRFPNKGHIARAVLESMCFQVNSVLSSMHKNAGEAGEVKSAEGEFLLRVDGGATVNNLLMQIQADLLGSPVVRPADTETTALGAAYAAGLAAGVWTKEEIFAGLHKENTTVFRPKLDDAXTGRREESPGTRRFQDHLTWLTFLSSLLPLVARQNWISVCQPMFVDE

SEQ ID NO: 158819 - protein, 134 aa, Triticum aestivum
  Clone ID: PAT_TA_53237.pep
VRVLNETWTDGRRGHIEGTAFRADDAGDEAKLRVRFYVPPFLPVFPVTGDYWVLHVDDAYQVALVGQPSRNYLWILCRQPQMDEGVYEELVERAKGEGYDVSKLRRTPHPEPTPESQDAPKDGGLWWIKSLFGK

SEQ ID NO: 158820 - protein, 141 aa, Triticum aestivum
  unsure (1)..(141): unsure at all Xaa locations
  Clone ID: PAT_TA_53238.pep
SPKLREIQMQNYQXRKMEQKIQREDALRMGLXLYKDEKYEXALEKFESVLGSKPEIDEASVASYNVACCYSKLDRIQAGLSALEEAMKAGYEDFKRIRTDPDLANLRNSEEFATLLNKYDESFINESAINAIKSIFGFGKK

SEQ ID NO: 158821 - protein, 68 aa, Triticum aestivum
  Clone ID: PAT_TA_53239.pep
AELPKWIHGKQGYSQFHISLIDDADYSLGVITVTIYKCTKLLRCSGNALITTHPQTRILNSEMLCISS

SEQ ID NO: 158822 - protein, 76 aa, Triticum aestivum
  Clone ID: PAT_TA_53240.pep
NCSGNNLVQKGVFRQARIDTAIFHSLPHGFVQIKTPLNFFIKKAYKHSPKSFFCPNPLKAPPVVSPCEAPLAKNKK

SEQ ID NO: 158823 - protein, 92 aa, Triticum aestivum
  unsure (1)..(92): unsure at all Xaa locations
  Clone ID: PAT_TA_53241.pep
VPAAVSVFVWKAVQLCRESRARRMNGNLECVCEANIEWSPTQLIFCAFCGLLXGTVGGLLGSGGGFILGPLLLELGCIPQVASATATFVMMF

SEQ ID NO: 158824 - protein, 100 aa, Triticum aestivum
  Clone ID: PAT_TA_53242.pep
MAAAAAAGSSRRGPMDDDKLTFETSAGVEVVGSFDAMGIREDLLRGIYGYGFEKPSAIQQRAVVPIIAGRDVIAQAQSGTGKTSMVSLSVCQLVDTNIHE

SEQ ID NO: 158825 - protein, 241 aa, Triticum aestivum
  Clone ID: PAT_TA_53243.pep
LAGAEEQQGEGCSSSTKRCGNFNISEPFWLSNSEAQRSCGPQDFEVACHNKSFPGLRSSIPSASGLGFAIINISYKENSLRVVDQGNLEVLQASNSCHGTILNTSVKLAQPFRINPVGLSLILYNCSEEGAAAAATVARRDRDLVKTGVRCRNESKVLVRTGVPYDATGDYGGYALKACEAVVVPVMGLSGEANMSNYKQLINDGFLLTWDLPQALPLPAPAPLHTPARTRRRKMATGDDS

SEQ ID NO: 158826 - protein, 192 aa, Triticum aestivum
  Clone ID: PAT_TA_53244.pep
MARSRSSMALGLGLLCWIALLFSPLAFVQTVQADDVDSYGTVIGIDLGTTYSCVGVMQKGKVEILVNDQGNRITPSYVAFTEDERLVGDAAKNQAAANPTNTIYDIKRLIGRKYSEKTLQGDIKHFPFKVVNRDDRPVVQVEVDGAKKQFTPEEISAMVLGKMKEVAEGYLGKKGTHAVVTVPAYFNDNQRQ

SEQ ID NO: 158827 - protein, 170 aa, Triticum aestivum
  Clone ID: PAT_TA_53245.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLLEEGCGTNMFTGIVGNVCGLKGLRALRLEDLRMAATDGKTVAGAPLWFSRLETSVFPLLVSSF

SEQ ID NO: 158828 - protein, 248 aa, Triticum aestivum
  unsure (1)..(248): unsure at all Xaa locations
  Clone ID: PAT_TA_53246.pep
PTKTMSDQPATVAAPAARSDLASAVESAPAPQPELVPAADPQDGDESEADSAVGDDAASSTASITSSILEYRTIQGRTFHSDRHPTEYFTPNDEQQSASIDINHQALTLLLGGKLFLAPVKPNVQVCACILGHMTWLTYSDXRVLDVGTGTGIWAIDFADEYPEAEVIGSDLSPIQPTWVPPNVKFEIDDASLRWTWDNNTFDXIHIRYLFGAIKDWTSLFQEAYRCCAADGWIQSGEADVHIRSDDG

SEQ ID NO: 158829 - protein, 252 aa, Triticum aestivum
  unsure (1)..(252): unsure at all Xaa locations
  Clone ID: PAT_TA_53247.pep
MDSLTPPAPPHPQNTEDDCFPPKNALCRHDEEQHVQNRDRISTLPDDILIEILSLMTISEAAMTGFLSTRWRHVWKKVDHLILDSYTFGMQELEKSRYHENPLLWNDVATKFVHKVNGLLHSRHGNKIKELIIRFPLTSGHASNLDHWIESAIVASTEKLFLDLDNKCCKEGCTICVKGMNAASEPYDFLLGPFFNGRADSLDELTLFNCSIGTMPANIGGFSYLKSLLLARVSIVDETVSSIMXNCCALEI

SEQ ID NO: 158830 - protein, 82 aa, Triticum aestivum
  unsure (1)..(82): unsure at all Xaa locations
  Clone ID: PAT_TA_53248.pep
QNYXGIFRNQIIRFVDDXVYRVTIDKTFEGNPTKPINGAIFIFNPRTGQXLFLKVIHTSVWAGQKRLVSQHSNRASFPYSWI

SEQ ID NO: 158831 - protein, 65 aa, Triticum aestivum
  Clone ID: PAT_TA_53249.pep
NGGWFIDKARPLHRDAHSAGPTISVHHSALVGEPRGPPASTPWTGGAPGSLGPGAPRRDGWLNVS

SEQ ID NO: 158832 - protein, 118 aa, Triticum aestivum
  Clone ID: PAT_TA_53250.pep
PQQGTQSSTTKNHQNTQFPPVCVPQERGPGVWSDPQSEDEDCRPAAATLPTQPVRVVVCRVSVVAHSLSSASAGGRIALLGKYLPGFPAPGQQGSYRERLMFTGNETASVPVGNILLW

SEQ ID NO: 158833 - protein, 177 aa, Triticum aestivum
  Clone ID: PAT_TA_53251.pep
AVRALYGDDFYICSFQEPGAIEAEFKRLGTELVLRKFFADRTPGPLFIQKSGWGSPDDEVPLPSWITEEDLKYYTTQFDKSGFTGGFNYYRALNKTWELTSPWTGAEIMVPTKFTVGNLDLTYNIAGAKVFINKGGLKKFVPLLDDVVIMKDVGHFINEEKPEEISALIIGFIKKFN

SEQ ID NO: 158834 - protein, 76 aa, Triticum aestivum
  Clone ID: PAT_TA_53252.pep
QTFLVLAPQKILLLWGHNDNIFNIELARTMKEQLGEETMLQSIDKAGHLVHLERPCVYNRRLLEFLAYVTAEASKE

SEQ ID NO: 158835 - protein, 179 aa, Triticum aestivum
  Clone ID: PAT_TA_53253.pep
LPLDFISAFPKLPKLEFLVIQFPTCLQVYRVLQHASRLAGLTTVMLVLMKPWKEGISSVAYVLKSAPLIEYFGLHGCCKLHQHTQLNITWPEDLILARLYTIIIGGFSGEFELMELVYFLLRSTPALDVFEIDTRAMEPWLARSNEDKLQDDMRRRYAREMAYAHLVPKVPSTVKFHII

SEQ ID NO: 158836 - protein, 214 aa, Triticum aestivum
  Clone ID: PAT_TA_53254.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACISSRPGQCGRADGYILEGKELEFYMRK

SEQ ID NO: 158837 - protein, 155 aa, Triticum aestivum
  Clone ID: PAT_TA_53255.pep
PRLYTYALYHTSRFRSYPYSTRPQTCEKIGPRGKITHLNGRESEIGQKTGGGRPCAAPPLTVPVSLATCSSSPLAERWIRVDLLLPLVPDCCAPSSPSQPHPTMTGAALLRHRRLCARMVVEGSRRPWRGARRREGPWEWAMARSEKEGGAVGID

SEQ ID NO: 158838 - protein, 161 aa, Triticum aestivum
  Clone ID: PAT_TA_53256.pep
HASAHASEHTSLRVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 158839 - protein, 188 aa, Triticum aestivum
  unsure (1)..(188): unsure at all Xaa locations
  Clone ID: PAT_TA_53257.pep
MSTMAXPRVYAGHWLRCVLVVVCALCWASSSVRLVAGQAGQLSVDASPQTARKMPDKMVGIFFEEINHAGAGGLWAELVSNRGFEAGGPNTPSNIDPWFIIGNESSIIVGTDRTSCFERNPVALRMEVLCGSKGTNVCPYGGVGVYNAGYWGMNIERRKGYKGSLXIRAXDAGGLTIGLGSCDGLDKL

SEQ ID NO: 158840 - protein, 130 aa, Triticum aestivum
  unsure (1)..(130): unsure at all Xaa locations
  Clone ID: PAT_TA_53258.pep
THAARSPQRRPRGQGPAAHGTRKTGTGQRPPPAPPXXGHXHXDGAPPHGGRXDXARKHXPDXXHXRXGAXPTXXXXXPRAAEAXXXTHDHGXAARTRTRGXDSTXNGAXDSGRAPHGQHRRQARKPGTTH

SEQ ID NO: 158841 - protein, 219 aa, Triticum aestivum
  Clone ID: PAT_TA_53259.pep
MRIETCYFCSRPAYPSKGITFVRNDARVFRFCRSKCHKNFKMKRNPRKLKWTKAFRKAAGKEMTVDSTLQFAARRNVPVRYDRELMGKTLKAMERVSEIRQRRERVFYKKRMAGKRERELATARKLVAENEHLLPRMRGSEKKRLRELGLTEEDIEEMEPERQKSKAFGGEKKRVAIALEVDDDEDDDEEGESGMFDDEDEEDDDEDDDDEMGDVDMED

SEQ ID NO: 158842 - protein, 185 aa, Triticum aestivum
  unsure (1)..(185): unsure at all Xaa locations
  Clone ID: PAT_TA_53260.pep
QQRTKGGNEEKLRXAQEEAARLXXEXXEXAAAPREKERGXXXGXQEXEGERGKAKEEXDKXXEXQRGXRXEXXRXREXXKXAXXEAXXAKEXPEKARXEXXQXQEDXXEKEXTXKSXXQEXEXPKXXEXXAQXSXREXKDXXXXXXXXEXTKTXAEAXPXXAKGGNRKGRAAEESKRPARQQKRT

SEQ ID NO: 158843 - protein, 149 aa, Triticum aestivum
  Clone ID: PAT_TA_53261.pep
CPWGRNRVKAAEAGAMTVLVELLLDDGGRHPTELAVVAIDHLCGCAEGRSDLVAHPAGLAIMAKKAMRVSLTTTESAVRALHAVAMHSPTPAVLREMLAVGVVAKLLLVLQVDAGERARAKAKELLKMHARVWKDSPCLQVHLKAYYPC

SEQ ID NO: 158844 - protein, 67 aa, Triticum aestivum
  Clone ID: PAT_TA_53262.pep
PACPNHSKASRTERSGMRMTKGQPGLARWDTDNWETQIIPSKTTGHIQLFLSWVRALCMTKKNAFSL

SEQ ID NO: 158845 - protein, 47 aa, Triticum aestivum
  Clone ID: PAT_TA_53263.pep
MQYKKRFRKAMSAYFIVIPEQWMPAIINPDQSSSNICEDDSQNASPE

SEQ ID NO: 158846 - protein, 171 aa, Triticum aestivum
  unsure (1)..(171): unsure at all Xaa locations
  Clone ID: PAT_TA_53264.pep
PPPPPPPGPPPPPAXRPPPPXPPPPXRXPFPPGPPPPRXXXGPRPXXPGPPLXXPPPXPPLCRPLRPSPPPPAAAGSPPPPLFPGPVPPPGRPRGWXGLPLSXPFVPGGGWWVFRGSCPGGPPGCSVGGLPSSVRPLLPGPCPPPPPFWPLGLARVCPPPPCARFRVLGPV

SEQ ID NO: 158847 - protein, 108 aa, Triticum aestivum
  unsure (1)..(108): unsure at all Xaa locations
  Clone ID: PAT_TA_53265.pep
PPADVLFLKCIFPHWCDKACVHLLKNCKEAFPPPNVGGKVIIVDMGVGFGPDALVPKEPPVFFVLFFMGAEGIYPKDFXWKKIFLEAGFPHSQIFSVLGVRSVFGLPP

SEQ ID NO: 158848 - protein, 137 aa, Triticum aestivum
  Clone ID: PAT_TA_53266.pep
PPTQGPRPGPQAGSRPPPQKPGDPHHPCPQAPSAPSSVSPKRSSKHMFHHRPLKAKGHMSNNNRAPMQSTPKSKAQKPKKKTPSAQFKAKRPKTKATRESKIPRREKKLAQGPKDHAPPPPAAAPPQAPAAPKKPKK

SEQ ID NO: 158849 - protein, 192 aa, Triticum aestivum
  Clone ID: PAT_TA_53267.pep
MDPNGSYPNKVRSSESDAYISPLHEVLRGTTAMPVLNDILAFESLPSDSPSMVNSSLAPNAPLEPTMMLVNDSSMMPHQENVGLAPLPPQLSDTIINPLSMVNTIVPQPNEEIHQDEHEMFKHEDLLSNPVGDYADCCDGTYAWGVGGGWWAVAGWGAGGGCGSSVLPLFLFVCSLFFPFFSSPLRFPSPPF

SEQ ID NO: 158850 - protein, 145 aa, Triticum aestivum
  unsure (1)..(145): unsure at all Xaa locations
  Clone ID: PAT_TA_53268.pep
XXXAXLXXXXAXXXXXXXXXFXXXVXXXXXXXXRXXFXWFSXXXLXXLXXXXXXXSFXAXXVXXCFLSLXSXPXFPPPPPXXLXXXFXXXXXXXFCRVPLXXRRXRWXSPXSXRXFLPXSCLXCWLPRRPLGFXLAAXASAXAGS

SEQ ID NO: 158851 - protein, 205 aa, Triticum aestivum
  Clone ID: PAT_TA_53269.pep
SLLVFALYEVFGKPERPMVPPGLFKDTRGFVCILLISSIMGAMNLCLTIIYPQQVINIFGSRLKNWEETAWMTATAAFGTWAGIMVLGNLFHLIRHIRWQILAGAIWLTAFLGAMSSINRDNKNAAIALSFFAGLVVSWAQDITMLMVQFITTDEDLGVAFSVVAASRPLFGSIFTGAFISLYSNQCPKQIGSHLTSALRGTDIA

SEQ ID NO: 158852 - protein, 144 aa, Triticum aestivum
  Clone ID: PAT_TA_53270.pep
MYSPGGEDDGLYGEHGCEQDEPVSVTSRLSVKQVVTVVQSFGEYKRWLVSEIGFGGMLKLPLIAKIDLKLSLWVMRKVEVVSRMIVIDKDRKLLFTPEDFHKVFGVPCGNRDVRGRDGDISIRAGEGMKDMMGMNRCAGDRLEA

SEQ ID NO: 158853 - protein, 60 aa, Triticum aestivum
  Clone ID: PAT_TA_53271.pep
NMVIPIVLFLKLRCACFPPTSSNPITGASGTISCEKIKLLIHKTGFPLTFIMLRHSQNIL

SEQ ID NO: 158854 - protein, 125 aa, Triticum aestivum
  Clone ID: PAT_TA_53272.pep
TQPPAEQALVMQADEERGRPELPPRHRHRLAELPLPHHDLHPGLLLPLLQHGLSTAVHGSSTPPHESSTAATNRSPRLLKMSPLTDEREERPAGGGDWDGKSWKLGGGAATSWWRWVAWLPGRVG

SEQ ID NO: 158855 - protein, 72 aa, Triticum aestivum
  unsure (1)..(72): unsure at all Xaa locations
  Clone ID: PAT_TA_53273.pep
NTAXLAREAVRKSLVLLKNGKSASSPLLPLPKKAGKILVAGSHADDLGLQCGGWTITWQGQTGHDXTXDDDP

SEQ ID NO: 158856 - protein, 76 aa, Triticum aestivum
  Clone ID: PAT_TA_53274.pep
SISWRVHEKGLLQKGGGMSALAGALGSNSLIFALPFSVSCCQPPHLESWGSFGPQHARGSAAPPVWPWQPVAWPAP

SEQ ID NO: 158857 - protein, 56 aa, Triticum aestivum
  Clone ID: PAT_TA_53275.pep
NLLKFLHLSQNLSVFNHFGAGGNVWPENGNHGMSKSMGRSTLGLVVAFFGVGTDVT

SEQ ID NO: 158858 - protein, 79 aa, Triticum aestivum
  Clone ID: PAT_TA_53276.pep
DNPHSHNIIPVRHAARKVSILKLAYCLLLETGKSATMSTNKYRLKLEKHCSFPMNIETRNWTDVVLSVKVGTRVKDRPL

SEQ ID NO: 158859 - protein, 96 aa, Triticum aestivum
  Clone ID: PAT_TA_53277.pep
LDVHNYNLCVHCQSMESAQLCTTTIHASHHVRHRGGVHCQSIGDSIVNTCNILHRNRIVVYNICISILLHPHTPYGILRTMTSNTNRAVRRLLPWV

SEQ ID NO: 158860 - protein, 73 aa, Triticum aestivum
  unsure (1)..(73): unsure at all Xaa locations
  Clone ID: PAT_TA_53278.pep
QAGLCIXCWIGREGRQGVDGMGWDSRMYRLPVKGCQSYVSTHDLYLCCSNFISSYSSCCFDASQLLSPMSLGL

SEQ ID NO: 158861 - protein, 59 aa, Triticum aestivum
  Clone ID: PAT_TA_53279.pep
VAKNHHTRRVFQRQVKKGKPIERWENNPFEEGFPQPNPIRETLAVGEDARPKIAKGLGN

SEQ ID NO: 158862 - protein, 220 aa, Triticum aestivum
  Clone ID: PAT_TA_53280.pep
RRSKDKRKNSSPRSCSTTLLTNHTRQWSSDSDDELLRKLGRGGVTEDHRTNHLSRIIVYHWSPTTASISHQQTVEALPQTRRRRRVGYHNQGHASGIAPHCHHCHRSHRARPVVGRHHKDQSLQDGTLKRGTTFKTTLPPDHAAGSKFSPEVLDPEDPAVRFPTTPPRRIATPTGTVAAAGQHRPGFHPGSHSHAAGRSRPLPPLDRTPHKQQARHRCAG

SEQ ID NO: 158863 - protein, 80 aa, Triticum aestivum
  Clone ID: PAT_TA_53281.pep
VATVQANTMEASVVRDGESASTVLDGNCSPSFLHKPRRDLVLASPSIRQEALTFPAIAVKNATLVAHELNLSMSHGASGN

SEQ ID NO: 158864 - protein, 85 aa, Triticum aestivum
  Clone ID: PAT_TA_53282.pep
IALMVITTAEKAAMYYHNLLKWPLVHINMLMDWLTEKLHPDTRDGPDPLDDGPDDPLVSLQRGEGAHVPVVGIAISCGLPWIHHD

SEQ ID NO: 158865 - protein, 77 aa, Triticum aestivum
  Clone ID: PAT_TA_53283.pep
LPMPRLGAKLKSFLPRCSPKLVFTFPPRCPRLPKEKFFEKRFRLFKVRNWKSSTQGWFFLKIPKVTPLCTPLSPQSA

SEQ ID NO: 158866 - protein, 165 aa, Triticum aestivum
  unsure (1)..(165): unsure at all Xaa locations
  Clone ID: PAT_TA_53284.pep
TGCSNLKCSGFVQTNNQNALGGTISPVSTYGGTQYDLDILVWKDPKSGNWWLQVGTNNVGYWPSLIFSYLADSASTVQWGGEVFSPDAGQTSTQMGSGHFPEEGFGKASYIKNIQVVDSSNNLKPPSDVKTIAKQQNCYNXKNGMSSDMGTYIYYRGPGKNSNCP

SEQ ID NO: 158867 - protein, 128 aa, Triticum aestivum
  Clone ID: PAT_TA_53285.pep
GSKVLTDLVEGLEKAAVTVEIRLKIDQNHADLKGGSFRDYGESILKHLESVISKDPNLNKAPKNHEGVRVSGYGGWFMLRLSLHDPVLPLNIEAQSKNDAMKLGLAVLAAASEFSALDTTALNKFLQQ

SEQ ID NO: 158868 - protein, 156 aa, Triticum aestivum
  Clone ID: PAT_TA_53286.pep
MAGGKNKRISKGRKGSKKKAVDPFTKKQWYDIKAPLLFTSRNVGGTLVSRTQGTKIASEGLKHRVFEVSLADLQNDEDQAYRKIRLRAEDVQGMNVLTNFWGMDFTTDKLRSLVRKWRTLIEAHVGVKTTDNYMLRVFTMGFAKRRPGQRKRAGCA

SEQ ID NO: 158869 - protein, 113 aa, Triticum aestivum
  unsure (1)..(113): unsure at all Xaa locations
  Clone ID: PAT_TA_53287.pep
PPXPPAAAPPPPXPPRPGPPPXXPPPPPPPPAPPPPXPXPXXXXXXPLXXVXXPPPLXXXXFPVAXACXXGPSXPFWPPXXXXPPARAPXARPAXVPAXSGPCRPPLCSPLCL

SEQ ID NO: 158870 - protein, 133 aa, Triticum aestivum
  Clone ID: PAT_TA_53288.pep
EEHVEEHHVTSHKARCQARRQPAMPWRRNIAEPAERGCSGSMGRSTQQLGPIELMAIRWVGERELGGTWPGSFFAMFFFFGIALHRHTSLWSSPSRQTPPASSHAVPRSRVTRWPRCLVATSLQSKTSNPTVC

SEQ ID NO: 158871 - protein, 176 aa, Triticum aestivum
  unsure (1)..(176): unsure at all Xaa locations
  Clone ID: PAT_TA_53289.pep
MGFDRANTANCVATGRGRTVCVTGAGGFIASWLVKXRLEKGYAVHGTVRNPDDVARNAHLGALEGAAERLTLFRVDLLDKESLIAAFRGCEGVFHTACPVTDDPEKMIEPAVNGTRNVINAAAEVGGIRRVVMTATIGSEYMDPGRNTDGEADETWGGDLGGWGNTEDWGWCGETG

SEQ ID NO: 158872 - protein, 79 aa, Triticum aestivum
  unsure (1)..(79): unsure at all Xaa locations
  Clone ID: PAT_TA_53290.pep
FYYDSSDMLPMKFTLYRKQQVVYSCVGLLLDCRDKVPFSCYYTKXKALVALHRCAVCFYNGQMWLWLREDARGVLLWKR

SEQ ID NO: 158873 - protein, 143 aa, Triticum aestivum
  unsure (1)..(143): unsure at all Xaa locations
  Clone ID: PAT_TA_53291.pep
PPPPPGRGRGGAGGAGALRRVWFAGSAPLXRPLRPPRPAARCAGXXPPXASWGPRRRRXPSPXAGVXAASXPAPRXXPPAWRXRCLXXRLXRXGGCRXXPPPPGPGSXRRPSVXXPPPPPPWPXXXXPSPPPPCPGPSSSAWV

SEQ ID NO: 158874 - protein, 166 aa, Triticum aestivum
  unsure (1)..(166): unsure at all Xaa locations
  Clone ID: PAT_TA_53292.pep
DPAAQATHATRTRATAKPEPTATGDGNDRATPSKGQASDQGRGRGGSASPXTXAAPRRHXPPXTXXXPXXTRGXXTXRXPXXTXXPRRRXPRPPXRRAPPRXXPXTEXXRASXARRPTARRATTTTTXARAXXRRPKTPTTTTXRQRNPRRSXTSXTPTKRRSTRR

SEQ ID NO: 158875 - protein, 177 aa, Triticum aestivum
  unsure (1)..(177): unsure at all Xaa locations
  Clone ID: PAT_TA_53293.pep
QXTLGGPRDXAXNAXGRPDPRXAGHXDPXGPXXNDRERAQXXXXDXGXXAXXXXXXKRGGGXGXXXXXRXXGXPXXXXNXXXXXXTXXQHTHPAXPHXDXTEXDXXRGAXATXDRDXGXXNRXXHNXTDTHXAHHXXXTXPHXHAREATKAXKPXQGEXHQGDPTPDAKATXGEAKG

SEQ ID NO: 158876 - protein, 163 aa, Triticum aestivum
  unsure (1)..(163): unsure at all Xaa locations
  Clone ID: PAT_TA_53294.pep
GSAGPRGXSPPGPGSAAPAXRXSPXCRXASSGPXPPSPXCSGPPPXSALXAAAVCXAFRRXXAXGPXXVXXLVRRXPXXPSXWAPXPAAXVXGPXXPLRXXAPPPPXPSPXAXXXWXCVPXXPPXGXARPLAXXSASGPRSRXAPAPXXAXXPSAPPGXGVPR

SEQ ID NO: 158877 - protein, 134 aa, Triticum aestivum
  unsure (1)..(134): unsure at all Xaa locations
  Clone ID: PAT_TA_53295.pep
RRQTPPTGPPKXNQRAAXXRGGDGENPGXPQQKRRAAHPXXASGXKTEKARTDRPPQQXPSRKGEGDAPGSGPXSAAGGGXTPRGTXTRASAQAPAXRAXAXXRPATXAGXPRQAQNRGPXXGHRXRXXRHPHP

SEQ ID NO: 158878 - protein, 148 aa, Triticum aestivum
  unsure (1)..(148): unsure at all Xaa locations
  Clone ID: PAT_TA_53296.pep
EQEQRARNKXRKGXAGRXXXXXXXGAXXXXXTXXQXXGXXXGXXGNNXPXRSDXXQGGRXKGXNGXRXXXADGQAXXAPRNPGXGPXPDSGNDQXAXXAXSTRNAAAXGQNNGRPXXPXXNXKDNGAGNEGQGGATQSXRPGXRNXNA

SEQ ID NO: 158879 - protein, 228 aa, Triticum aestivum
  Clone ID: PAT_TA_53297.pep
MVLTTLLLLGLLVGLAGSSPPPATVVCAHGTFDCTVSNAYGSFPDRTVCRAANATFPRTEKELVAAVAAAAAAKRKVKVATKHYHSFPKLACPGGSDGTIISTERLNRVVSIDVAKGLMTVESGMVLRDLIKKAAAKGFALPHSTYWSGLTIGGLLATGAHGSSLWGKGGAVHEYVVGMRIVTPAPASQGFAVVRELSADDPDLDAGKVSLGVLGVVSPVTLALRAMF

SEQ ID NO: 158880 - protein, 80 aa, Triticum aestivum
  unsure (1)..(80): unsure at all Xaa locations
  Clone ID: PAT_TA_53298.pep
TKKSGXKXEKXXXSAXARRRPATXXGKXKXXEHXKEAXTXXEQGRGGGGPETXTXPAPXXTRNXEDXTTXXXXXKXKKKN

SEQ ID NO: 158881 - protein, 172 aa, Triticum aestivum
  Clone ID: PAT_TA_53299.pep
MGHGQGHVIIPILLFFSFAPYYITLAESIDLGGTLQTNEKDGTLSRSNPFQLKGRGKTDGKGNTKSHYAMWHTEPGKFYGLRAEMSIWGSPNQENSQESGSAIQIYCQEGEHYSLIEVGFHVSPSLYHNRDVRFFTYTTRDTKSAGCYNLQCPGFVPARGAALVPEQAITAP

SEQ ID NO: 158882 - protein, 109 aa, Triticum aestivum
  unsure (1)..(109): unsure at all Xaa locations
  Clone ID: PAT_TA_53300.pep
LPLPNPDLIQRLGTPNYMXPEHWRPNIRGPISYETDSXWGFAWSFLEMFSGVQTWCAKSPDEIYQSVVLKKEKPMFLYNLPTEVANVLSGCYELEVTHERWQRKIADIK

SEQ ID NO: 158883 - protein, 127 aa, Triticum aestivum
  unsure (1)..(127): unsure at all Xaa locations
  Clone ID: PAT_TA_53301.pep
HERSRTGRTGRNPGKGRDRAGGQANXGDTGXXXGPGNNPXGXRGTSPPXGGAGNRAKXDGRRGPAQQGEXRPTXTNRNRKNAXAKEGEDRXXXEEGHPGRGTARGTGDAPDGGGRGGGPGKDGPGGG

SEQ ID NO: 158884 - protein, 97 aa, Triticum aestivum
  Clone ID: PAT_TA_53302.pep
AHVCAYHMPHAHVRYLCAGRTLHRAKVCRILAKFFPEYPVPMRSKEGAGEMKKGCRFSSRRIMELGVSITPASQCVYDTVTSLQDKGILPRPHADMS

SEQ ID NO: 158885 - protein, 86 aa, Triticum aestivum
  Clone ID: PAT_TA_53303.pep
PPPRPSPPSPPPPTPTPRPRPRSPTSLRAPPAQPLSPRPSSPRSACFSSPRPPSPRAASTPSHPYSNRTSRRSKNAPIPCSRWPNC

SEQ ID NO: 158886 - protein, 89 aa, Triticum aestivum
  unsure (1)..(89): unsure at all Xaa locations
  Clone ID: PAT_TA_53304.pep
WAPXRSSXPVPVXXXLXGARXXXVSVPLVRSVFPFSLCPRRRLXFGRLSSSVSVAVPPPACVVCASVLALASXPPVRVLLLXPLSCXWR

SEQ ID NO: 158887 - protein, 181 aa, Triticum aestivum
  unsure (1)..(181): unsure at all Xaa locations
  Clone ID: PAT_TA_53305.pep
PPPRPPPPRPPPPPPRXRGAPGPPPPPPXPPAPPPPAXPPASPAPPPPPARPLPPPPPFPPPPPPRPPPPPRPVRPPRLPPSPASSAPAVPSPVLSPPLCFPPCGPXXPAPCLFPAXSRPPPRCPSPSFAPVLAAFLCRPPPGVRRLSLVVSLVGVPLPPFPLFVLVVVFLPPPSCLPPPP

SEQ ID NO: 158888 - protein, 70 aa, Triticum aestivum
  Clone ID: PAT_TA_53306.pep
GSSSPLSSPHPSAPVRSSHSSFMSGSTSSSSSPVFLPGIRASTTCVIITPAMLAPVMYSRLQPVLLQVFG

SEQ ID NO: 158889 - protein, 124 aa, Triticum aestivum
  Clone ID: PAT_TA_53307.pep
PPRAPPSPTPLSTPPPPSTKPLLNQAPPCTRPQWAPCPQSSKVGFIFREPNASPGPHHGRHCPMCKLPMFGCTHATQVINEVQQVNKEYPDAYVRIIGFDNMRQVQCVSFIAFKPPGCEESGKA

SEQ ID NO: 158890 - protein, 124 aa, Triticum aestivum
  Clone ID: PAT_TA_53308.pep
VVAFALRYAWAAKKSLRSGYFLWSASAYGTGLLITYVALNLMDGHGQPALLYIVPFTLGTLMSLGWKRGELRNLWFKGEPERVCTHQGYLQMAKPPPAAAAAHDNEDDEDDHEEEGKNTPSSSC

SEQ ID NO: 158891 - protein, 124 aa, Triticum aestivum
  Clone ID: PAT_TA_53309.pep
RVTPPPPPHVPQQLQQRAPRKVGAMPHWGKNPNFAFQGAIVKNPKASKFFEVKGRSDSDGIFSSEWSDQGLGNNGSPVIVEKRCPIEGLWVCSNDSPWAPKEGHHCQPGKVYPKARVCSFESPL

SEQ ID NO: 158892 - protein, 53 aa, Triticum aestivum
  Clone ID: PAT_TA_53310.pep
WRSQRSPTNPPPPVFRVGTVTAKACSLLAVVSRCGPSLHRSGTMFLNRILSCQ

SEQ ID NO: 158893 - protein, 101 aa, Triticum aestivum
  unsure (1)..(101): unsure at all Xaa locations
  Clone ID: PAT_TA_53311.pep
RLRPPRRPRRSPRRRRPRRPLPGXRPXVGXPVGVXPXXXXCAXXPPPPSLVASXFFLSWAXARGXWXASVXPCLLVXCALVPWCCXXCPPXIPFCPPPPPP

SEQ ID NO: 158894 - protein, 57 aa, Triticum aestivum
  Clone ID: PAT_TA_53312.pep
KKVGEVGQDYIVESSHNMYLLDPCLETVKCFGVEYKASDLVEAITTEIQKASNSAAK

SEQ ID NO: 158895 - protein, 148 aa, Triticum aestivum
  unsure (1)..(148): unsure at all Xaa locations
  Clone ID: PAT_TA_53313.pep
KKKKKKKNFFFFSLSPIKKRRGGGGGXNLXFPXFLXPPKKKKKKIKRGGGGVGXTKTIXILSSSGRAAGGGNIKSLSXXLEKKKIKNREWLAXSPPPPAXGKKEKDCSFFTPPPPHNENKWKLVSDFIIFGKLKSTRYSMSTRYSQDC

SEQ ID NO: 158896 - protein, 134 aa, Triticum aestivum
  Clone ID: PAT_TA_53314.pep
MSRQFRYKNKVINFSRLMVKRIFNVQSCDRPVKLLKKSDQRNLCNIYKEGNTAPINHAIDLLKACSETDEVMVERTWILITLATILCPCTQNMINLEYMASLEDMASVHEFAWDEQFLEATMEEVVVFQDKKQI

SEQ ID NO: 158897 - protein, 245 aa, Triticum aestivum
  Clone ID: PAT_TA_53315.pep
HASETVEFKPFQDQKPGTSGLRKKVVVFQQPHYSEAFITSILLSIPEGVEGSNLVIGGDGRYFNPEAIQLIAKIGAAYGVKKLIIGQNGILSTPAASHVIRIRKATGGILLTASHNPGGPKNDFGIKYNLANGGPAPESVTNKIYEFSKTLTSYKIADIPDVDITTVGTQTYGALEVEVIDSTADYVAMLKDIFDFDLIKKFFSSHPDFKVLFDGLHGVTGPYGKAIFEQELGLSNSTQNCIPSP

SEQ ID NO: 158898 - protein, 125 aa, Triticum aestivum
  Clone ID: PAT_TA_53316.pep
WWFLPCRGGRPGTSRCPDPSLVSRSCSTTPMMWSTSWTTACSNRSSSQVTTTNPGGWNKDAFFERIHGITSQLQGKREAISRLLKILGPDSGGASSNHCQSTSSDSRRRTSSLIVGSEVCLEGGD

SEQ ID NO: 158899 - protein, 68 aa, Triticum aestivum
  Clone ID: PAT_TA_53317.pep
NQMGVDHQAGPYKRSLLTRGNITCPNCPGSLDVQTVTLMPGKHLSNHLYQSPNTIISLVFECIVNLHQ

SEQ ID NO: 158900 - protein, 108 aa, Triticum aestivum
  Clone ID: PAT_TA_53318.pep
TKGIFLPVWAQSTKPQSHYQNLARTTFAQSPGKNQVNLFKTFHGALKKNGLVPFWTFVIWENENLKYQGAIKLVFSGLKYIKQLCPLDSFPKNKKVSPQRKQRDPSEL

SEQ ID NO: 158901 - protein, 73 aa, Triticum aestivum
  Clone ID: PAT_TA_53319.pep
DQNMCVATMLWFQSILVVSEDHTCSCCLLRRGALQWSLLGQKHASSRPESSLASVPAHCASHLLCPPMCLSAS

SEQ ID NO: 158902 - protein, 72 aa, Triticum aestivum
  Clone ID: PAT_TA_53320.pep
GDNFTLQLCEQEIPIYGMQVQENPGLMEKPAAISGYLKTIEVKCEEVDNRVCKVLKFLSTFGIAITIQRTNR

SEQ ID NO: 158903 - protein, 207 aa, Triticum aestivum
  Clone ID: PAT_TA_53321.pep
QLYVSIDAADKESLRRIDRPLHRDFWERFNRCLDILREKRFSHRTVFRLTLVKGFNVEEEAEGYARLVEQGLPCFVEVKGVTYCGTSTSSNAGLSMSNVPFYWEVVDFVKALEKRLKEKGLKYGIAAEHAHSCCILLASERFYVDEKWHTLIDYKKFFELLEERGAGNFTPEEYMGAPTPEWALWGNGGFDPRDDRVDRKGRKIEAS

SEQ ID NO: 158904 - protein, 81 aa, Triticum aestivum
  Clone ID: PAT_TA_53322.pep
IKHYRLNLLLLLQNDANQWYIRQRDGWKHTKTLKTTPYVLGREYHNHSHINDRKRRKNSSLCAKRKKKKETVSKKRMTEKY

SEQ ID NO: 158905 - protein, 120 aa, Triticum aestivum
  Clone ID: PAT_TA_53323.pep
ANKVIGELEKLVADSNFVGSTIEGRKVTKAGNFSYTDLDGSVASKQGLYAGFSSGSRIVVRLSGTGSSGATIRLYIEQHTSDPSKYELDAQDFLKEEVKFATELLKFKEHVGRDEPDVKT

SEQ ID NO: 158906 - protein, 117 aa, Triticum aestivum
  unsure (1)..(117): unsure at all Xaa locations
  Clone ID: PAT_TA_53324.pep
LVNGTVVKGGKAIPKWETYGFVEHIKNGHKQGNMLLVVPQGAYTMRLVYDASILQRMPVARVYYYAITLSXAARTCTQAERLNVCVSHEFGELPMQTIYGSIGWDSYSCTLKGNLDG

SEQ ID NO: 158907 - protein, 83 aa, Triticum aestivum
  Clone ID: PAT_TA_53325.pep
GVQVELIQLASQLKGDHVLNSYPDIGKTMSVGEANRYAEDAVSRFLEAGRIALRAGANESALVTMRPALTSRAAMSTGMSSEL

SEQ ID NO: 158908 - protein, 250 aa, Triticum aestivum
  unsure (1)..(250): unsure at all Xaa locations
  Clone ID: PAT_TA_53326.pep
MQVFNGNLCTASYVRQANVPWRQQSLLMLQARHRRRGGVVNVQTSGPAQAQDRPRNQKIDPQLAPVDVQGGSRHMAHHDPSELALMIDTIRAGMSSMGGGEITVSPYDTAFVALVGDLDGGDGPQFPSSIDWIVQNQLPDGSWGESSFFLIQDRIMNTLACVVALTSWNLHVDKCEKGLKFIRENMWRLAEQEEDWTLIGFEISFPSLLCMARDLXLDIPYDHPALDAIYSQRNQKLSKIPLDILHSIPT

SEQ ID NO: 158909 - protein, 120 aa, Triticum aestivum
  Clone ID: PAT_TA_53327.pep
HALPLTEQALPDLPEDAAPSPIPEEILDTCLHVRDKTQVEQVLVRCTAQPASLATWEDREELHQHYPRAPAWGQAVSEGGESVTTPARTHTVSALEGMAQQPTKRIRRPSTRFPAQQWET

SEQ ID NO: 158910 - protein, 163 aa, Triticum aestivum
  Clone ID: PAT_TA_53328.pep
ECIPGLRIDHVDISGLPMVNPDLVTDGGEGFPPAVEALRDRVHAADCFLFASPEYNYSVTASLKNALDWASMGEHNCWADRAAAIVCAGGDFGGGRASFHLRQIGVFLDLHFINKPELHVRAFADPPKFDEEGNLIDVETRERLKKVLLSLQAFALRLQPKDD

SEQ ID NO: 158911 - protein, 71 aa, Triticum aestivum
  Clone ID: PAT_TA_53329.pep
NKANKAGGEACYVITMPAMSPSSQQNPHSCSCHTLSFFSIPYIKNKREIKLRNKEKTHFWGFKRNFSKKTP

SEQ ID NO: 158912 - protein, 91 aa, Triticum aestivum
  unsure (1)..(91): unsure at all Xaa locations
  Clone ID: PAT_TA_53330.pep
LITGRSPFKDIDMRIRXRGGGNTNQICSIGQAIAKSLVAYXQKYVEEAPKKQVKEILVRXDRRLLVAKPGRWEPKKLAGRGARACFQKFYS

SEQ ID NO: 158913 - protein, 148 aa, Triticum aestivum
  unsure (1)..(148): unsure at all Xaa locations
  Clone ID: PAT_TA_53331.pep
GGLGKNFLQGIKKDGSIDVRNKKGKFXFRVPKKSLRVRLSPDTLLSSRSISKDCRVFPVPGFENETVPAKNALFFFGPIPNHDLPIVVRAPPRYPGPEQKLTSLALVFFKPRPRKSWSLGPKLCLFAPCGACFMPPFLVPFPDGQMPG

SEQ ID NO: 158914 - protein, 90 aa, Triticum aestivum
  unsure (1)..(90): unsure at all Xaa locations
  Clone ID: PAT_TA_53332.pep
VLFVDDLIPPGGTLFSPAKLIXVFEQKWFSGPLFFNXPKLKGRAKLGDIPVFFLVQAAESVLNKFCLLGCSKNVPLLELNWKHQKNPFQF

SEQ ID NO: 158915 - protein, 135 aa, Triticum aestivum
  Clone ID: PAT_TA_53333.pep
MTATIFSGLLKANFDHRFWSIALATQRNFIQTNISVYGESFTDPWQMAEPIYVRRAKKTSSEWLMIFGDYQTCSAETEAEDPEMISVQDLFLGSVMPRGKFKVRAWTSHLEPHYSYIFHCEIQRPQRLVDRNKRC

SEQ ID NO: 158916 - protein, 124 aa, Triticum aestivum
  Clone ID: PAT_TA_53334.pep
LPVVVDGVIQQSPIDVRRGLYKNIVLSGGSTLYKDFGRRLQRDIKQLVDARIRASEVRSGGARSGGLDVSVITHKRQRHGPWFGGSLLGQTPEFRSYCHTKAEYQEYGPSIVRRFALLGGPGGS

SEQ ID NO: 158917 - protein, 98 aa, Triticum aestivum
  unsure (1)..(98): unsure at all Xaa locations
  Clone ID: PAT_TA_53335.pep
ACQCIRDLGMPFFNHXVVKKALVMAMEKQNEASILALLQECPPKGLITINQMTNGFARVKEGLDDLTLDIPNAQEKFKGYVELATERGWLLSSFASLP

SEQ ID NO: 158918 - protein, 123 aa, Triticum aestivum
  Clone ID: PAT_TA_53336.pep
PPNHLEKLDPALIRRGRMDKHIEMSYCRGPAFEFLAKAYLGVDEHELFGAVGALLREVDMTPADVAENLTPKSAEDDAGSCLRGLVAALEKARDDKASGGGGGKEEKRPEEEDGGAVAAVDKE

SEQ ID NO: 158919 - protein, 46 aa, Triticum aestivum
  Clone ID: PAT_TA_53337.pep
PAPMYGSTSALCHPHYPKCIHKASLLIGDCLIISKVGWKSMPPHGR

SEQ ID NO: 158920 - protein, 118 aa, Triticum aestivum
  unsure (1)..(118): unsure at all Xaa locations
  Clone ID: PAT_TA_53338.pep
GPLFQKKKKGPFTLGPVKKEVGKLRGEIQRLGQQKPEGSXKVKFGVFFNAAKWANIFXAFVGPFRAPKKRKVFPSHGEMFFQGVFSNVEITLFPPPPVVAPLSLQPRQVSPIIVPIRL

SEQ ID NO: 158921 - protein, 113 aa, Triticum aestivum
  Clone ID: PAT_TA_53339.pep
IQGTSRPAHYHVLWDENKFTADELQTLTNNLCYTYARCTRSVSIVPPAYYAHLAAFRARFYMEPDTSDSGSVASGARGGPPQGGPRSSTRFGNVAVRPLPALKENVKRVMFYC

SEQ ID NO: 158922 - protein, 203 aa, Triticum aestivum
  Clone ID: PAT_TA_53340.pep
HQIRHMVAVLFLAGQRLETPDVVTTMLDVAKNPCKPNYVMADEVPLVLWDCIFPSEKDAPIDPAAEKTDGLDWVYLADDPALSKSGPYGVMDGMWAHWREHKLDELLSNQLLQMVSTQRSKDPSRQVSRPEPTGKQANSVVVYEGGNVGRMGGRYVPMMKKDKLQSPEEQNERYAIRKGYTSSEDMRTQKGMNKRKADEAMDE

SEQ ID NO: 158923 - protein, 138 aa, Triticum aestivum
  Clone ID: PAT_TA_53341.pep
KHKNRGLGSSTGTGVGAGAAAAAAGAAHNQHQSREGGIPGTSGVGSGMGSTGMMGNTSTMGAKSGNIGNPNTAGLNKPHGGEYDSVKTGGLHNDPLKSNSSHVRGDSGVGMEQKKPSLLDRLNPMKDADGDGKKGLMD

SEQ ID NO: 158924 - protein, 72 aa, Triticum aestivum
  Clone ID: PAT_TA_53342.pep
ASLDRRSTVDMHPGKTQCHYASSGDLLQLPGLTTHLLQYLKKIVSFNCHKEHVCRDKKLSAARDNYIIISKE

SEQ ID NO: 158925 - protein, 120 aa, Triticum aestivum
  Clone ID: PAT_TA_53343.pep
GKQLVTAGDMDNSIELGGGGSELVITSKSEKGRRVTTLGSREFIRYYRQKPRPSVAADRALALSLASSYKSMGLVTVQSKEQMVRLKVLRAMNKSGVETMRTKIGMKSNVIRNLPKNVPY

SEQ ID NO: 158926 - protein, 122 aa, Triticum aestivum
  Clone ID: PAT_TA_53344.pep
KMICTLKERAVSSAATDIGISCTHDSWTLSQPKRRCLGYGVLRVVGDAAELSRSTSPELRLLHLENKYNSSIWSRFFAAYQLLQHLQLQGWVGMIFSFPCPRARRCQNGRAGSHLDLVVAEP

SEQ ID NO: 158927 - protein, 50 aa, Triticum aestivum
  Clone ID: PAT_TA_53345.pep
TGYVGLADGGLLVESVEAQHALVGGECRPSVLSFFANSSNSSYRPMSIGS

SEQ ID NO: 158928 - protein, 112 aa, Triticum aestivum
  Clone ID: PAT_TA_53346.pep
FTGLLKVSNPDFKDTRLNIGHASVDEVKGMPPTTIGISGLDPLRDEAIFYGKKLVEAGVPTDIHLFKGLPHGFRRFGDQLSESKRWDKTMENGIKWALSNPAATGKFDIKLE

SEQ ID NO: 158929 - protein, 168 aa, Triticum aestivum
  unsure (1)..(168): unsure at all Xaa locations
  Clone ID: PAT_TA_53347.pep
LLVLLSGLLPNPKLEASVLSICLNTGSLAFMIPFGLGAAISTRVSNELGAGRPEAARLATRVIMVLGLATGVSLGLIMLLGRNLWGYAYSNENEVVEYIARMMPLLSVTFIFDDLXVFFQGLWFGIICGIVVQMLLLLGITMRTNWDKEALKAKNRVFSSSLPLDMTT

SEQ ID NO: 158930 - protein, 69 aa, Triticum aestivum
  Clone ID: PAT_TA_53348.pep
QLRAEHQKENSTVGIDVISGGLGDMQKRGICEAFKVKQAIVLSATEAAEMILRVDEIISCAPRRREDRM

SEQ ID NO: 158931 - protein, 96 aa, Triticum aestivum
  unsure (1)..(96): unsure at all Xaa locations
  Clone ID: PAT_TA_53349.pep
CNKXGDSASATFDRTSTAFDGVYFKELQQRRGLLSSDQTLYESPETQRLVNMFAMNQGYFFYAFTQGMGKMGQIDLKEGDRGEVRKSCRVVNKPSW

SEQ ID NO: 158932 - protein, 83 aa, Triticum aestivum
  Clone ID: PAT_TA_53350.pep
KKQWPYFINAPPPRASYLGWALKTVFSSKPPKGEKKALKALPGKFFPPLEGFAPPPKIKSPPGAEKFSGEPKTVFGDVLPQLG

SEQ ID NO: 158933 - protein, 98 aa, Triticum aestivum
  Clone ID: PAT_TA_53351.pep
PNRKMVDDEYRSADFPFDPVDGETHTGPFEFSTDRRMDLDDYFTYIKSWSAYQTAKDNGVELLDDATVQDFADAWGGDREVVKTVRYPIFLRIGKVRP

SEQ ID NO: 158934 - protein, 153 aa, Triticum aestivum
  Clone ID: PAT_TA_53352.pep
AYLRAVIKESLRLYPIAPLLAPHLAMDDCNIDGYMVPAGTRVMVNAWAIARDSSLWEDAEEFIPERFTDEGSAMHVNFKGNDFQFLPFGAGRRMCPGMNLGIANVELMLANLMYHFDWELPLGVEREDIDMTAVFGLTMRRKEKLLLIPKSWM

SEQ ID NO: 158935 - protein, 89 aa, Triticum aestivum
  Clone ID: PAT_TA_53353.pep
RSRFPKRILCSVISLNFVFIDVPKDQIRLILEYFLYAFGMHGDFCYLAPPKIVPDHSVHTVEKCDLGGAEIPEYKGSPFLHPEILQVHR

SEQ ID NO: 158936 - protein, 142 aa, Triticum aestivum
  Clone ID: PAT_TA_53354.pep
GLIKDKKTSKIKKNSVAVTKFLDDLAKIDFPGAKLVSDAVAKSGTTPLSPAIVFILDKVAPFVPAPKEEPKAEPEAAAPAEETTTREVAVEEKEEEAEPSAAPAEAAPVEAAAPAAEVVEEKKEEEKPAEAAAPAAEEPEKK

SEQ ID NO: 158937 - protein, 125 aa, Triticum aestivum
  Clone ID: PAT_TA_53355.pep
IWPGVTKMPWYNNFKPPRVLKRKVKDAFKHFDRHALDLLERMLTLDPSQRIPAKEALDAEYFWTDPLPCDPKSLPSYEASHEFQTKKKRQQQRQAEEAAKRQKINHPPPHSRLPPIQHPGQSHQI

SEQ ID NO: 158938 - protein, 109 aa, Triticum aestivum
  unsure (1)..(109): unsure at all Xaa locations
  Clone ID: PAT_TA_53356.pep
PTRPPTRPPTRPPTRPPTRPPTRPAQISFSAAPPRRVPPPREWWEPTRSPPPPPRRRRRRGTPPPPXPLLRRLHAGLVPPLHRPRPLSGPPSVSDQPSFDSPLNHPWLF

SEQ ID NO: 158939 - protein, 67 aa, Triticum aestivum
  Clone ID: PAT_TA_53357.pep
MRYNIWNHRVSTLHARTEVMDPSIHRILHRGIPILFSCKYRSVDIGRSHVSYVKPVHAQVTRHVCCP

SEQ ID NO: 158940 - protein, 215 aa, Triticum aestivum
  Clone ID: PAT_TA_53358.pep
WMDNYDQNSVQLGEMAYLQSLVTQHFIMYGEDYHSSHNRNGVCLLRHFEHLHRPVLTLQCPKDIANKKYFMEQITRLPDIKLLELGITACGHSFGASLFHVMRMCTAIRALVLGLNVTLEDEEETVCPSDCICDQPPSWKTEELVLNRLEVIEISGFRGTEHEINAVKQICSWATVLRRMTVKFHDSITENKAEVLCELLVTFSGLGLDMYYRMQ

SEQ ID NO: 158941 - protein, 91 aa, Triticum aestivum
  Clone ID: PAT_TA_53359.pep
MPLLCNGLAGLFDRGKKKKKKKKKKKKKKKKKKKKKKKKKKKKKKKKKKKKKKKKKKKKKKKKGGGPLKKKKFTPLSKQLKCFNMGPPKLN

SEQ ID NO: 158942 - protein, 176 aa, Triticum aestivum
  Clone ID: PAT_TA_53360.pep
KRSTLNFSRCSVLEELEMQDCYIDARRISSKSLKRLCITDFCSFPTKFHIRIFAPGLISLQLDNFDGLTPSLEYMPSLETAYIWLDNDCYHLCRGSWQDYDLDDCSCHAYPVDEGVLLHGLSNAVNLELIADIYTDMVHLHLLPFFTLIVILCSLFNLHILILIAMVCYFYLHRWV

SEQ ID NO: 158943 - protein, 74 aa, Triticum aestivum
  unsure (1)..(74): unsure at all Xaa locations
  Clone ID: PAT_TA_53361.pep
GYCRDKVVSYDQVLNWSDRLYLIVEPXMRGISFKWASHPKSXTDVLQEFALTTKRIRDXDLLPIVELLESDEDY

SEQ ID NO: 158944 - protein, 243 aa, Triticum aestivum
  unsure (1)..(243): unsure at all Xaa locations
  Clone ID: PAT_TA_53362.pep
RSASERAGSQRDLRDEDARFVYINDAPRTNAPPAMFPDNSIHTSKYSVLTFIPRNLYEQFHRVAYIYFLVLAVLNFVPQLLVLSKEAGVLPLAFVLGVTAVKDAYEDWRRHRSDKNENNRTASVLADGVFRPKRWKDIQVGDVVRLVANETLPXDMVLVSTSDPTGVAYIQTINLDGESNLKTRYAKQETMSTPPEALAGVIKCEKPNRNICGFLATVDLNGRRAISLGASNVMLRGCELKNT

SEQ ID NO: 158945 - protein, 151 aa, Triticum aestivum
  unsure (1)..(151): unsure at all Xaa locations
  Clone ID: PAT_TA_53363.pep
STSYNSVFMVSSFGVKVTLLIGPEVTAHFFQGLESEISHGNLFEFTVPMFGEAVGYGRDTATRTEQMRFHIEALRPSRLRSHVYPMLQEVEGYFAKWGDEGIVDLKLEFEKLLMLISSRCLLGKEVRENXVDEVYTLFHEIEDNGVTLISF

SEQ ID NO: 158946 - protein, 252 aa, Triticum aestivum
  unsure (1)..(252): unsure at all Xaa locations
  Clone ID: PAT_TA_53364.pep
HNYIKITKPKAHQDVLNNPLPRCSPPTSVKITSQDSNRSIPTLQQTRSAHLTVDLNFSTALNSFGSSSFTTANISGQDFPVFTTDPQSPWLLSTSPSLPAQSAQQQLQSPESPHQDFVLFDQLPNRHTTTSLPHQRRHSSHLQNRHQQQPASPAVQNQRVAQLLQAFGRPSSTVNNNRPTNQFYASSAPSSSTTLNKQNRAARPPVPLFSQSTGSVPQQTAXMMNAADVELEEFTAFEGGAHTAFSSPAVAS

SEQ ID NO: 158947 - protein, 165 aa, Triticum aestivum
  Clone ID: PAT_TA_53365.pep
MEEAEAPLPFPTEKLSMDPNRDGGSRGGVVLVATGSFNPPTYMHLRMFELAKDELQQRGYCVLGGYMSPVNDAYKKKDLLPAAHRVRLCELACGSSSFVMVDPWEAMQKGYQRTLTVLSRVANSLCKDSLADQGDVRVMLLCGSDLLESFSTPGVLDSRSGQAHM

SEQ ID NO: 158948 - protein, 249 aa, Triticum aestivum
  Clone ID: PAT_TA_53366.pep
DDWATKAKEWASAKSVTENHQIQQHAIPSRTEIHHYGHNDQYQQPAGLPTEPLHPPIPQSSSDQLLFQMSGQQRETNYLQDRGPMAPPPKNFGPFPSTYEQEVPYNYSSAQGNGNAMLQYPSPQAQPSLSASSVQDGFPRGPPGVPGHGLQQSYRMMADPSDQPLEFNDRKAPDMAVHETINIRSSAPTAVSEHGTIPTSTQSWGPSAPVGYFHPAPVPPQASQMDPSLHAGPLFGALSGSSYVPPAAF

SEQ ID NO: 158949 - protein, 240 aa, Triticum aestivum
  Clone ID: PAT_TA_53367.pep
MTAAMPAACSLLLLLLLVAPVAAGDGGECVIDGVRWAAWANSKQLTEGLGIPEHTFSAFIFDLSVGRQALSAVMDISSELVWLQCWPGLRPTPTFLPDHSGSFAPIAPCPSSVRNNSGSFGQIHYADRTCQPGDHGCEARCRYMEHIYGAGNTSGYLATDRFGLGNRVVSGMVFGCSDNVTMRDDLNGASGFVGFSRGPLSLVSQLRLSRFSYFMELPDDPDNGNAFVCWSWGDYADAKG

SEQ ID NO: 158950 - protein, 149 aa, Triticum aestivum
  Clone ID: PAT_TA_53368.pep
MCYELADQRGPHGSGGGRTVKGDDGSAGAASGMTMASPADLMSGYYQAQEMSTMVSALSRVVAEDDPWAPSGSGAGPEGWGWEEQQAMPAAAPARAPIAAASASTPAVYAAAGPASDYLRYQMLLQGRGAVANQGNLLSFYGRGGGGAM

SEQ ID NO: 158951 - protein, 122 aa, Triticum aestivum
  Clone ID: PAT_TA_53369.pep
GRVGLHGLRALWLDKAYEGKSLHFNAMAFPKLRLLSISDAPQLNDVVVEESALQSLVHLSLTDCPELKALPDGIEHLRTLEKLYLRGVSKDLTKKLQNKEKTNECNDYLKKINHVRRVTVYP

SEQ ID NO: 158952 - protein, 91 aa, Triticum aestivum
  Clone ID: PAT_TA_53370.pep
LSVTGEQVPQVHEESALNLLTQGCSTGEALNRRSRSSRAFAWLQVDFRSLLFLLIYSSPSLPVPYSQSFSFCFSRFGFSMSTGCLMKIQKG

SEQ ID NO: 158953 - protein, 113 aa, Triticum aestivum
  unsure (1)..(113): unsure at all Xaa locations
  Clone ID: PAT_TA_53371.pep
DRIVSVSLSVAGSNPTGYSAYTASKTPVXPMVRTMAKELKGTRVTANCVAPGATATDMFFAGKSDETVRRTAETNPMERLGEAGDIAPVVGFLCTDAAEWVNGQVIRVNGGYV

SEQ ID NO: 158954 - protein, 165 aa, Triticum aestivum
  unsure (1)..(165): unsure at all Xaa locations
  Clone ID: PAT_TA_53372.pep
MEMKERQRWRPEEDAILRSYVRQYGPREWNLVAQRMNVPLDRDAKSCLERWKNYLRPGIKKGSLTDDEQRLVIRLQAKHGNKWKKIAAEVPGRTAKRLGKWWEVFKEKQQREIRDSRRPPPEPSPDERGRYEWLLENFAEKLVKERXXVGVGATPLHHHLMPAPM

SEQ ID NO: 158955 - protein, 114 aa, Triticum aestivum
  Clone ID: PAT_TA_53373.pep
SPYGYGYGHGQGGYPPPMGGGFGGAVAFPPGTHPDVERAFRAADRDGSGSIDEGELQAALSDAHHRFSIRTVRLLMFLFSDAQLASSPRSRMGKQSTRLYTHNKICISFGTVSA

SEQ ID NO: 158956 - protein, 101 aa, Triticum aestivum
  Clone ID: PAT_TA_53374.pep
GHGGGCGDDGEGASVLLLPFPGAQGHTNPLLELGRRLARHGLRPTLDTTRHVLSSTAPAGAPFRVVAICDGFDDGGAGLDYTEYLSRVKAVVSRDAAGAAG

SEQ ID NO: 158957 - protein, 208 aa, Triticum aestivum
  Clone ID: PAT_TA_53375.pep
MAGAKDDGPAIGIDLGTTYSCVAVWRPSHNRVEVIPNDQGNLTTPSCVAFTDTCRLIGDSAMNQAAMNSVNTVFDAKRLIGQRFSDTSVQSDIKLWPFKVIQGPGDRPMIVVQYRGLEKLFVAGEISSMLLMKMREVAEAYLGTAVKNAVITVPVYFNDSQRQATLDAGTIAGLNVMRIINEPSAAVIAYGLDRTSSSSEVKTVLIFD

SEQ ID NO: 158958 - protein, 88 aa, Triticum aestivum
  Clone ID: PAT_TA_53376.pep
RRQTREEAAAAAVERSSPSRAWTSSSSSPRSPSSRSSSHCGSSSPTAPSSPPPAPPPPRPPAPSPSPTTLRSTPPTQRPPTRPRRAHR

SEQ ID NO: 158959 - protein, 75 aa, Triticum aestivum; identical to SEQ ID NO: 106874
  Clone ID: PAT_TA_53377.pep

SEQ ID NO: 158960 - protein, 132 aa, Triticum aestivum; identical to SEQ ID NO: 155960
  Clone ID: PAT_TA_53378.pep

SEQ ID NO: 158961 - protein, 64 aa, Triticum aestivum
  Clone ID: PAT_TA_53379.pep
QGFKGLAPKSPDRKIGCRCLKSLAPSIRSINMDKVSGVPGKWGVRVPFPIRMSPNCKNVNWFNI

SEQ ID NO: 158962 - protein, 93 aa, Triticum aestivum
  unsure (1)..(93): unsure at all Xaa locations
  Clone ID: PAT_TA_53380.pep
FLCPRXSFXLVPFGSCPGPAXLSCLVSCXGGRGPCAWXRXSVPAPWCSXXAVGPLRPCVFXRXSPPPPLRFPLVPGFLVLSRAAGASPLPFVR

SEQ ID NO: 158963 - protein, 84 aa, Triticum aestivum
  Clone ID: PAT_TA_53381.pep
DLVSPILCSFHYPVMALCPTGVSRRLSEQFMLVWGGRFLSRRPPVVGTSSSPPIRHGPGAFSSFHVVQCFFTSMLPLVLKIDYD

SEQ ID NO: 158964 - protein, 68 aa, Triticum aestivum
  Clone ID: PAT_TA_53382.pep
SEEELKKAFRVFYKDQNGFILGGELPPVMPTLGENLPAKEVDKIIRKADVAGAGQINYEEFVKVIMAK

SEQ ID NO: 158965 - protein, 113 aa, Triticum aestivum
  unsure (1)..(113): unsure at all Xaa locations
  Clone ID: PAT_TA_53383.pep
TPHNRGGSNNPKLKATRGGRRAPSKKIPSGFNGQASPKGTGDIGGFGLKGKNPHGTKLPFPNAQNILKGSTDSTFRFFPRGARGPPPGMFGMLLLCGLTILTTMVXIPPQTFK

SEQ ID NO: 158966 - protein, 64 aa, Triticum aestivum
  Clone ID: PAT_TA_53384.pep
KITPFPGGLIHFIRFFIKKKRPGCPAFKNNGSRPGPNHTIVGDLRKNFPFPGAYKLLVNQRPQR

SEQ ID NO: 158967 - protein, 125 aa, Triticum aestivum
  Clone ID: PAT_TA_53385.pep
APGTPGKLKPGGRVESLTKNWGPGGAHKQKTTYFGGNGPLPGPRPIFFYAQKHIPSNTRPPTKTPHFSPPRTGTCFCTISPTGFRPQKIIRTFTYKLPNFLPPPPGKSCPKKGFGKKTPFEIRAR

SEQ ID NO: 158968 - protein, 112 aa, Triticum aestivum
  Clone ID: PAT_TA_53386.pep
FMEGSKTTQTPSSCPPKKAFSPTSQRPNLQHRPPLGPTKTKITSTQEPLHKTFPPSDLQLRAKGSLLKKSPLPFSVRYPTIYTPPPLTFDPQTGAITWYKTWHTIPTSRVKA

SEQ ID NO: 158969 - protein, 106 aa, Triticum aestivum
  Clone ID: PAT_TA_53387.pep
DSPQFRCMDPAPGGFPPGCRGWVKLPLPVHPAVFQCMDRVPNFCQRGCKGAVSAPLPWPAGATDQLSNRPPPPSAPGEGRIFMASRPQMPTPPHFLFLLIRRGLSR

SEQ ID NO: 158970 - protein, 179 aa, Triticum aestivum
  Clone ID: PAT_TA_53388.pep
ADLTFQVGGQSFSAHRCVLAARSSVFKAELLGAMEESYAASPIEICDMEADVFKSLLHFIYTDTVPPVLDVVMAGHLLVAADRYNIGRLKMICEEKLCSHIDSGMVATSLALAEQHGFHALKKACLKFLASPSNLEAMMASDGYEHLKSSCPSVFKELVAEILPAELKAAKDIIMTMWK

SEQ ID NO: 158971 - protein, 91 aa, Triticum aestivum
  Clone ID: PAT_TA_53389.pep
AGKKNKAAVLLVGKAVLLNRLGGVALFICFFTWGGGTFAKKVGVFPQRAAFGGGIRQDPQNFQLEPQGGITPARVLGGGPPPRTKLGFAPR

SEQ ID NO: 158972 - protein, 214 aa, Triticum aestivum
  unsure (1)..(214): unsure at all Xaa locations
  Clone ID: PAT_TA_53390.pep
AEPGKLSHPDLAASLLLEDDDDVPPLPSYSSKXSAGSTTAACLHYLVSELRMPLYLQRRLTIPDIAAHRWSRPCAVAFAALAPVLLATAWTSHNPAKSSSHHAATTTATAXAILLVDGVLGLLLAALTAATTDTASPPNGRPRAVAGGGVPDERTLGLWAYTLARELVALLVAIGYRXMVGMKASMLGVTVLACGDSLGDLVXNVAMATHRGPD

SEQ ID NO: 158973 - protein, 61 aa, Triticum aestivum
  Clone ID: PAT_TA_53391.pep
MYTVIGLGASAWRVAPHLAFLGRKVDLRMSSRLPLFLEASRSGATLFFDTPYNPTRPPTRP

SEQ ID NO: 158974 - protein, 86 aa, Triticum aestivum
  unsure (1)..(86): unsure at all Xaa locations
  Clone ID: PAT_TA_53392.pep
MGLMSPQTETKASDNFQAGVKDYKQTYYNPKHETKDTDILAAYAVSPQPGVPPEXAGAAVAVEYSTGTWTTDWTDGLTRVDRVQRT

SEQ ID NO: 158975 - protein, 111 aa, Triticum aestivum
  Clone ID: PAT_TA_53393.pep
FYFGAPIKKFLRCIYGFVNFDFLKPAPPFFFFFFFFFFFFFFFFFFFFFFFFFFFFFFFFFFFFFFFLLKRCRNKVSKYNENRYKYNNISTNISTKQPHQQSSTMLPSPSP

SEQ ID NO: 158976 - protein, 86 aa, Triticum aestivum
  unsure (1)..(86): unsure at all Xaa locations
  Clone ID: PAT_TA_53394.pep
MAASMITSPIVAPTSVPSLSRRGSSFAVVCSGGKKIKVDKPLGLGGGLTVDIDANGRKVGMKGVCQXXDKYGANGDGYRPVYTPEE

SEQ ID NO: 158977 - protein, 55 aa, Triticum aestivum
  Clone ID: PAT_TA_53395.pep
LTGCYLICYKGQNVKRHGKDTRSSKQMRWEHNTGDSSALVWICKRTGLKPKGNNT

SEQ ID NO: 158978 - protein, 58 aa, Triticum aestivum
  Clone ID: PAT_TA_53396.pep
PFNTNHTISDVRAFIYTTRPGETSDYTLQVGFPPKPLDDATKTIEEAGVANSVIIQRV

SEQ ID NO: 158979 - protein, 29 aa, Triticum aestivum
  Clone ID: PAT_TA_53397.pep
SLKFRPQTHWHWSRYSRSQRQQPLPIKSG

SEQ ID NO: 158980 - protein, 83 aa, Triticum aestivum
  Clone ID: PAT_TA_53398.pep
MAVGKNKRISKGRKGSKKKAVDPFTNKQWYDIKAPLLFTSRNVGKTLVSRTQGTKIASEGLRHRVFEVVLADVQNDEDQAYMM

SEQ ID NO: 158981 - protein, 82 aa, Triticum aestivum
  Clone ID: PAT_TA_53399.pep
RTVKPLASFYSDVSGISASVESTTGEAMPHPLDEIEPKKDVEPENCPFWWARSPENILQQDTYLALAASFVILRLLYLLFQG

SEQ ID NO: 158982 - protein, 99 aa, Triticum aestivum
  Clone ID: PAT_TA_53400.pep
CAPDRVQAGVASWFVAAHNDLVLYWPGREHHIICPVYPYVCDCLQPRTKAKALVGYGAHSTQFNMIVGSQMVSAVDAFTPLQNGLFTSVQAVSGRLPVS

SEQ ID NO: 158983 - protein, 151 aa, Triticum aestivum; identical to SEQ ID NO: 151947
  Clone ID: PAT_TA_53401.pep

SEQ ID NO: 158984 - protein, 121 aa, Triticum aestivum
  Clone ID: PAT_TA_53402.pep
MARLNSKAVVSAVVLAAVVLMMAGREATALSCGQVDSKLAPCVSYVTGKAPSISKECCSGVQGLNGLARSSPDRKIACRCLKSLATSIKSINMDKVSGVPGKCGVSVPFPISMCTNCNIVN

SEQ ID NO: 158985 - protein, 162 aa, Triticum aestivum
  unsure (1)..(162): unsure at all Xaa locations
  Clone ID: PAT_TA_53403.pep
TPINQKRPSKPRRPQDATKNSEPPSNRPSPSPPSGHRIGPADLSSSPAAPSRGGAQWGPAAEDAVRQLGILMDQVDAPLRRTFQNVHQGHPRETMLRFLKAREWNVSKAHKMLVDSLNWRIENEIDSVLERPILPVDXYRSIRDSQLXGLLGYTKEGVRFWD

SEQ ID NO: 158986 - protein, 149 aa, Triticum aestivum
  unsure (1)..(149): unsure at all Xaa locations
  Clone ID: PAT_TA_53404.pep
MSSAARRASHPALVNGDGEYGREEEDEEDEEGEEGEGDEPEEEPWFKYQRLGGSVPAILSTDAAAAIAVTDRAVLLGTHDGTLHILDFQGNLSKEIKAHTATINDICFEDREYIGSCSDDGTXVISYLFTGEKLKFEYHCPVKAXAFDP

SEQ ID NO: 158987 - protein, 87 aa, Triticum aestivum
  Clone ID: PAT_TA_53405.pep
TSIIHGSCYSASLTYAGSMLMDIHCPVHLFQLRPQAGITLCITEETPKPSLLYPPQPIGGIQPTWTSKIMDFIGGRSHCLRKVLHMH

SEQ ID NO: 158988 - protein, 73 aa, Triticum aestivum
  Clone ID: PAT_TA_53406.pep
TLKTRVFFFGVHQVGGGVWFFCPPPLYAFPPLSPWVWVSMCPRNFFFFSPLGWGGDFVKIKIFPFFLPLNRPP

SEQ ID NO: 158989 - protein, 119 aa, Triticum aestivum
  Clone ID: PAT_TA_53407.pep
YFGTSDLWSRCYRRKPVLLPGCSRGVELRDGFTSLVYPFSVVSQLRVFSVFSRHGRVGIMLRYVFFRPIIMFLPISILQLLPCHSCLLYIYMCHLFPCHTCLFVHVINALIIFGLGVIA

SEQ ID NO: 158990 - protein, 167 aa, Triticum aestivum
  Clone ID: PAT_TA_53408.pep
MMGPAWWAVLLLLAMADAVAGRFVVEKNSVQVTSPESLKGKYECAIGNFGLPQYGGTLQGWVVYPKDNRQACKEFDVSFKGHKSGARPNFVLIDRGECFFTTKAWNAQLAGAAAILVVDSKDEPLITMDNPEDTGTKHLENITIPSVLITKKLGEDLKKSAENGDMV

SEQ ID NO: 158991 - protein, 168 aa, Triticum aestivum
  Clone ID: PAT_TA_53409.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGGGYGGQRGGGGGYGGGGGYGGGGGGYGGQGGGGYGGQRGGGGGYGGGGGYGGGGGYGGQRGGGGGDSGGQWRN

SEQ ID NO: 158992 - protein, 127 aa, Triticum aestivum
  unsure (1)..(127): unsure at all Xaa locations
  Clone ID: PAT_TA_53410.pep
GGPPLPAPHRRVAHAALVERGATLRDRPVLPLLKLLGDXDNTVTRASYGPVWRLLRGNLGCXTLHPSRGRLFGPARCWVLRVLAEKLRDESTCGGAVVVETLQNTMACVLGLMCFGERLSEATGRAI

SEQ ID NO: 158993 - protein, 210 aa, Triticum aestivum
  Clone ID: PAT_TA_53411.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEAFAEL

SEQ ID NO: 158994 - protein, 95 aa, Triticum aestivum
  Clone ID: PAT_TA_53412.pep
GRVGLASSSPPPIPLHHKIPRLLLPSVSESESETETSRWPRPCSMVILRSHRDTETAEMAQGQGSPDLVGFQFYKLMAAGMSWEKLVITRAFSPS

SEQ ID NO: 158995 - protein, 66 aa, Triticum aestivum
  Clone ID: PAT_TA_53413.pep
MRSALGLSHWCSLLLLLSLVTAPRGLEVGDLFSQGKPPAVKQDCSRTCESKFCTVPPVLRYGKYCG

SEQ ID NO: 158996 - protein, 142 aa, Triticum aestivum
  unsure (1)..(142): unsure at all Xaa locations
  Clone ID: PAT_TA_53414.pep
GVDEIAVDMKEDKMTVVGMVDPVHVVGKLRRCFCTVQVVSVGPAKEEEKKKEXRPPGQGGGEEEDGRLQVRGQEGREHARPSVPAVLPAAAAPPAPVILRAHRGGPQRVRHLLIFSEPVCICMPCQPIDRSGVRDSSAFMHR

SEQ ID NO: 158997 - protein, 97 aa, Triticum aestivum
  Clone ID: PAT_TA_53415.pep
PPPMKTPEVEKRPPPPVRPIPSQFWCKNFGKKEFLRMFPLSQKKSFFSLWAFFCQNRSPPIKIGKSTPPNRYVTLVPFYFPHQRGPFFFRFKKPPQA

SEQ ID NO: 158998 - protein, 115 aa, Triticum aestivum
  Clone ID: PAT_TA_53416.pep
DLVFQIARWRYCGAVSLLGASFVEQRWMAEAGGGAASSCMELWWSCQVMPGRQMLRRVMPGWQVLRMKVFQSLRVWTDERRVVAPWWRRRMSGLARMMRISLLNMGQWSDDDGDF

SEQ ID NO: 158999 - protein, 123 aa, Triticum aestivum
  Clone ID: PAT_TA_53417.pep
FFFFIAFSSSFFIFFCLFGTTWSPGRGASLSRKRIWVYRFGLDSTTLYLLVKIIDAGLMLGDLDGELYLLIFKGACQEVVLRQPATFAALKEHQPRFLVLNLGGHTSSTIKLKKLSPVTPQNK

SEQ ID NO: 159000 - protein, 106 aa, Triticum aestivum
  unsure (1)..(106): unsure at all Xaa locations
  Clone ID: PAT_TA_53418.pep
VDPDAPSPSDPSLREYLHWLVTDIPATTGVXFGTEVVCYEGPRPVLGIHRLVFLLFQQMGRQTVYAPGWRQNFSTRDFAELYNLGLPVAAVYFNCQRETGTGGRRM

SEQ ID NO: 159001 - protein, 125 aa, Triticum aestivum
  Clone ID: PAT_TA_53419.pep
HPELGAIWKIGQCLWNRDYAGIYTSAQGFEWGPEIADFVSAFLDSYRKRIFELLTSAYTSISIADVAHFMGMSEEDATNYAVQNGWSLDVATKMLTVRKQKPHTNQKLDPNKLQRLTECVFHLEH

SEQ ID NO: 159002 - protein, 117 aa, Triticum aestivum
  unsure (1)..(117): unsure at all Xaa locations
  Clone ID: PAT_TA_53420.pep
YDXSHAPPYRKXLXXPLXDGTAPFFFXFFFYFIFYFIFFFIFFIFFIFFFFFFFFFFRATKDALLISLQLSWDEKEIYLTFFPISLTLSFFTGGLFSPDGSLAKQPKLPVSPTKKAF

SEQ ID NO: 159003 - protein, 210 aa, Triticum aestivum
  unsure (1)..(210): unsure at all Xaa locations
  Clone ID: PAT_TA_53421.pep
IRCDLAIATTTDLLIKVPPSSLQQHISDLLSSKEGTDVTFKVGSEVFVAHRCILVAQSAIFKAELFGPMKEGKMASVIQIEDMEPKVFRSLLSFIYTDSLPKMEIDMVEEEGKAQEALWLQHLLAAADRYDLRRLKALCXEKLCEHIDLSSVTTILTLAEQHXCHGLKEVCFEFIKTPANLKEITAADGLEDITRTCPNLLKELIAKFAS

SEQ ID NO: 159004 - protein, 134 aa, Triticum aestivum
  unsure (1)..(134): unsure at all Xaa locations
  Clone ID: PAT_TA_53422.pep
GQGRVQSLRRPRLSPWCEGSSTRTSWSRRGCAGAASRPCSSPATACGGEGGSAPRRGGPPPGHASPGRTSPCTPAPPRSARPTPRTWAPXSASAAPARGSARRTAPGPPPACTSLYAACGARRAPPGGGGGGRG

SEQ ID NO: 159005 - protein, 95 aa, Triticum aestivum
  Clone ID: PAT_TA_53423.pep
FRLQEQPAFDKKQFISHMKRYIKNLTAKLEGDDLDVFKKNVEFATKYLLSKLKDLQFFVGESMHYDGGVVFAYYKEGAADPTFLYFAHGLKKVKC

SEQ ID NO: 159006 - protein, 118 aa, Triticum aestivum
  Clone ID: PAT_TA_53424.pep
PNTRPNETAGSRNTAPDKTAPVYITVGDAGNQQALAWRFSDPQPDHSAFRQASYGHSTLQLVNRTHAVYQWNRNDDGKHVPTDNVVFHNQYWASNTRRRRLKKKHLRYESLEGLMSML

SEQ ID NO: 159007 - protein, 117 aa, Triticum aestivum
  Clone ID: PAT_TA_53425.pep
ARAKQTGNGQLIGGRQIKCSWGSKPTPPGTAFAPLPPPALAPYTPGVSAVDLISYERSLALSKMAANPALMGQVAALRQAAMGMGTGASQAIFDGSFQSVNPQQQQQQQQQQQLMYY

SEQ ID NO: 159008 - protein, 70 aa, Triticum aestivum
  Clone ID: PAT_TA_53426.pep
TYTYPYTYTYTSNPFHSLVLRLNHPVVLHYHTPYSFLSFPSTSLRPIFFPKKKKFFLIKKGNTPETKTTA

SEQ ID NO: 159009 - protein, 143 aa, Triticum aestivum
  unsure (1)..(143): unsure at all Xaa locations
  Clone ID: PAT_TA_53427.pep
GEFFSPGPGTLSRGGPGPIPSLRASQPRLTGPKGGTPRQLXGGPAGAXKGRVRVPGTIVYLPPSGSRRGLSVIGRMSPQKKILPFEPDLVGLKFPPPSLKPPPPPLTELFPLLGAFCPLDFRPLTPPPPWVMISNPRCWLAAV

SEQ ID NO: 159010 - protein, 139 aa, Triticum aestivum
  Clone ID: PAT_TA_53428.pep
LMIMLLVPVRQYILPSSFKGAHLNDLDAAEYEESPAIPFNLAAQDIDVALGRTQSAEILDDMVTRSRGEIKRLNSPKITSSGGTPVTELKGIRSPCISEKAYSPRVTELRHERSPLGGRDSPRTGEARTSKLGEGSTPK

SEQ ID NO: 159011 - protein, 55 aa, Triticum aestivum
  unsure (1)..(55): unsure at all Xaa locations
  Clone ID: PAT_TA_53429.pep
GEVXQFEPKMKELEGLCPPIIAKMYQGPGAAMPGGMDEDPPPPTGGAGPKIEEVD

SEQ ID NO: 159012 - protein, 65 aa, Triticum aestivum
  unsure (1)..(65): unsure at all Xaa locations
  Clone ID: PAT_TA_53430.pep
HGFYNGRFXTMSNLPMFGCTYSTQVIIEVEEVNKEFPDVYVRIIGFTNMRQVQCVNLIAFKPPVW

SEQ ID NO: 159013 - protein, 126 aa, Triticum aestivum
  unsure (1)..(126): unsure at all Xaa locations
  Clone ID: PAT_TA_53431.pep
ASIQYLPGPSXALCPAAXRFNYGHAIQYEHHESTPTSATAADDEPSKGADTASTTYTADASAANADECCAPNAVHASTARCTTFQAFAATSRDAIFPSPISVTFLVDCPAPLNCDSVQFSIVVERN

SEQ ID NO: 159014 - protein, 102 aa, Triticum aestivum
  unsure (1)..(102): unsure at all Xaa locations
  Clone ID: PAT_TA_53432.pep
GGVPFFGGRGHPPTWGKKLYPRAYDCNNVVEQGLPCGGVLFSQSFPVNKKVFVFSGSPRPFFPCXGAKSGPTPPLVKKGKFPPLLAWGGGGDFLKKGPVLCK

SEQ ID NO: 159015 - protein, 134 aa, Triticum aestivum
  Clone ID: PAT_TA_53433.pep
PYPNSYDSLMLYLRKTRNPASSGCALICFSVLKFVFPHNISHTTYKTAALGTLPAAPNERTSDVNGFAHTVRLTCMTPVHATCIHDYSNAQHKGDSFSGAMPHPLYSTRTFKTSGHLTDPALHIDNLTSTLGNG

SEQ ID NO: 159016 - protein, 52 aa, Triticum aestivum
  Clone ID: PAT_TA_53434.pep
VHPPVNQFNPEPEVDFDPVATQKKPHEVNVAIFNSFGFGGPNSGVGFAPFNP

SEQ ID NO: 159017 - protein, 69 aa, Triticum aestivum
  Clone ID: PAT_TA_53435.pep
STKVSSSTYISPVIDSFCSCNCGTTRSVCLRVWIPLDMFHFLVYEETETGELPVVKRTVLLQSDFSSSG

SEQ ID NO: 159018 - protein, 82 aa, Triticum aestivum
  Clone ID: PAT_TA_53436.pep
ALFSDDSLATVPFLILGNKIDIPYAASEEELRYRMGLSNFTTGKGKVSLSESNVRPLEVFMCSIVRKMGYGEGFKWMSQYIK

SEQ ID NO: 159019 - protein, 158 aa, Triticum aestivum
  unsure (1)..(158): unsure at all Xaa locations
  Clone ID: PAT_TA_53437.pep
LWKGFCQILSNSDDLKPQDVGIDPSMPCFRQSESRGPPAVMYLHFXDCSKFSFGIFCLPKSVVIPLVASFADLILVPTASGARLAKVKTDASAETIDLYPENXGNLHCSTALTACVVLDVMAHPXNRADGTDCTYYSESPFSNANAADDCFRQSALSL

SEQ ID NO: 159020 - protein, 193 aa, Triticum aestivum
  unsure (1)..(193): unsure at all Xaa locations
  Clone ID: PAT_TA_53438.pep
SIFRQIHDRYSSVLKTIKSSHRXVAKKLKIVKIIKKLSRTCLVIAGGAVAIGIAAHLLVFSLLVGSALMGLCPIAVKRRVTRLKRSKTESLQQLQEQLDTAAKGTYVLGRDFDTVSQLAVRLSDGIERENAMATYCMEMVDEKYPVQEMVLELRRSCSSSRRLAIELEEHVGLCLATIHRARVLVIEEISKQA

SEQ ID NO: 159021 - protein, 33 aa, Triticum aestivum
  Clone ID: PAT_TA_53439.pep
MHNNGGVVFAYYKEGAVDPTFLSFAHGLKEVKC

SEQ ID NO: 159022 - protein, 28 aa, Triticum aestivum
  Clone ID: PAT_TA_53440.pep
MILPNKPNFTPDMTAKENVQQKRGSRSR

SEQ ID NO: 159023 - protein, 58 aa, Triticum aestivum
  Clone ID: PAT_TA_53441.pep
QHLSSDIHNSVGCTGGAGHRMRDLLCGLGRGWWRAAEIRSTLDKACGAECSAGVGWGG

SEQ ID NO: 159024 - protein, 76 aa, Triticum aestivum
  unsure (1)..(76): unsure at all Xaa locations
  Clone ID: PAT_TA_53442.pep
PPGDYXGRYWPMWKPPMFGGPHPPQGLHQVEGVKKEYPYPYVRVMGFDNLGQGQGVSFIAFRPPGFEEFGKALTTG

SEQ ID NO: 159025 - protein, 172 aa, Triticum aestivum
  unsure (1)..(172): unsure at all Xaa locations
  Clone ID: PAT_TA_53443.pep
APPRTRERDAPEGEGATPPQKKEQKGPGHQGPRGWGANKSKRDRPPRPGPPLGNPPPRPRAQNPRRGPPRPGKKSRGFRRQRCYVPNYQEPKAPAPFRILPWKFCVNRKGMPRPGLLKKKKKKKKKKKKKKKKKKKRKKKEKKEKEKKKTKRAGRXLXXIPXXYGTRVQCDV

SEQ ID NO: 159026 - protein, 70 aa, Triticum aestivum
  Clone ID: PAT_TA_53444.pep
LLQIFDLGNWVVLSHRVTTEVAKGRTKACKNVWSCQKNMPPYATCLNLDQVICRRHVLQASAMITSPIRT

SEQ ID NO: 159027 - protein, 95 aa, Triticum aestivum
  Clone ID: PAT_TA_53445.pep
PRPPGEEKRQMVPPDPAAGGLSYQGGGHFPDPAQGRGQEPRAQGVPGRQKRGGPRGDVSEGLGSRNCEPAPGARGGEVQGLRPCWVGQGELQGAG

SEQ ID NO: 159028 - protein, 85 aa, Triticum aestivum
  Clone ID: PAT_TA_53446.pep
VMCQHHCHARLASPHRCLLLYAVCVCSVLFSAGEPPPSEAVNADRAMILSLIRYFIMCISLRCVPLDVSQNEYVFLHRVPQDERC

SEQ ID NO: 159029 - protein, 139 aa, Triticum aestivum
  Clone ID: PAT_TA_53447.pep
KRGGLNGKKRAGKGPKVGRPPPPKGKNWKNLGLTPPKKGAPFQRLKKGPKKTPKTKKPRGETKGGFNYGEKRGPPKLGAGNKSLFNWPPLFGGGVFLGGGAQKPGAVKKQGGKSPTLLEEKETRGGNPEGERGLNQAQN

SEQ ID NO: 159030 - protein, 103 aa, Triticum aestivum
  unsure (1)..(103): unsure at all Xaa locations
  Clone ID: PAT_TA_53448.pep
PPVAPIKTKRPIPFLGWCPPGFKCGXKYQPPRVVPGGGLSKVQRAVCIISNSPRVVEVFFRLGPKFGLMFAQGAFVPWYVGXGMEEGKFFXAREGFPALEKGF

SEQ ID NO: 159031 - protein, 93 aa, Triticum aestivum
  Clone ID: PAT_TA_53449.pep
IRGSQADSNTRIRGGVQAKHHEQQHGSQAAKRGLHRHIEAGTLRRRIQVNRERSGYRSACHRTEKGGTEQKWRGGRKKGDASGSSSTNEAVTN

SEQ ID NO: 159032 - protein, 65 aa, Triticum aestivum
  Clone ID: PAT_TA_53450.pep
PLFFFFIGRAQATNNQGTKQGFKYTSQTGGSHRAELRRAQPNGREQTRGTGVYYTGQETALAWPA

SEQ ID NO: 159033 - protein, 140 aa, Triticum aestivum
  unsure (1)..(140): unsure at all Xaa locations
  Clone ID: PAT_TA_53451.pep
QMPLGFVVLLPDVFFXKDCAPGIFFPPAWVSLPGFFPVASGGFLVWHLPALPEIFGGVFVFPFGGGPFGPPWGNAPGAPPYRVAFKACVQACNKGGVFAPEGFXFFRPAFKWGPYLPPPFXVWKALHFGFGPVDPFFFLV

SEQ ID NO: 159034 - protein, 56 aa, Triticum aestivum
  Clone ID: PAT_TA_53452.pep
RFFIPPVTPSWLDGKHFLFGKVLFEMNVVYKVGAEGNQNGPPKSKVVFSPTGKVPL

SEQ ID NO: 159035 - protein, 99 aa, Triticum aestivum
  unsure (1)..(99): unsure at all Xaa locations
  Clone ID: PAT_TA_53453.pep
CRKLMWKKEFDSSYVGFMEDGAQWLIDNTDIQLVGVDYLSVGAYEECIPAHLVFLDKREVILVEALNLDXVATGIYTLHCLPLKLRGAESSPARCILIK

SEQ ID NO: 159036 - protein, 160 aa, Triticum aestivum
  Clone ID: PAT_TA_53454.pep
NLQISRAPPPFASVGPPQGDGPAPSSIRGPQAPPPGALPFPGSPSPPGSLFARPAPSVQQSAPFGAPPAAQSLQPQRPPFNGPPPVLPAQVQRAPFRGPPAASQPLPFGGPPAAVSQPAPFGVSPVATAQSAPLGAPPFSAAHPPQFTGLSGASRSAYSG

SEQ ID NO: 159037 - protein, 153 aa, Triticum aestivum; identical to SEQ ID NO: 109663
  Clone ID: PAT_TA_53455.pep

SEQ ID NO: 159038 - protein, 125 aa, Triticum aestivum
  unsure (1)..(125): unsure at all Xaa locations
  Clone ID: PAT_TA_53456.pep
MVKAVAVLTGSEGVKGTIFFTQEGDGPTTVTGSVTGLKEGLHGFHVHALGDTTNXLGNVTAGADGVANINVTDCHIPLTGPNSIVGRAVVVHGDADDLGKGGHELSKSTGNAGARVACGIIGLQG

SEQ ID NO: 159039 - protein, 163 aa, Triticum aestivum
  unsure (1)..(163): unsure at all Xaa locations
  Clone ID: PAT_TA_53457.pep
MYTARKKIQKDKGVEPSEFEDTVAQAFFDLENGNQELKSDLKDLYINTAIQMDVVGRRRSXSGKDVVFVATRKIVRPPKKGSAVQRPRTRTLTAVHDGILEDVVYPAEIVGKRVRYRLDGAKVIKIYLDPKERNXTEYKLETFSAVYRRLWGENVVLXYPVTE

SEQ ID NO: 159040 - protein, 139 aa, Triticum aestivum
  Clone ID: PAT_TA_53458.pep
STAGSSFLALPPSRRRRGADGRLEKEAAGREMNPNQIGSDRGRGSRRVKAERFPAGAAAGGWNSAGVSCSLSLPGPTFQCRPTFHSRPMEETAEDGGGRRCCEAAGDCGRRRGRRRAMGAVVLESGQQRGGRKEPKSGC

SEQ ID NO: 159041 - protein, 125 aa, Triticum aestivum
  unsure (1)..(125): unsure at all Xaa locations
  Clone ID: PAT_TA_53459.pep
MADLMVGLAKSVVVGALSQAQAAIEEEAKLRRKAELMKTWVRQVRELANDLEDCIEFVVHLDKKSTWYFRLLPAWITPPPLLDEAVAEIDVLRARAEELSKCYLRYSHIMDSDPKLXKLQQHETS

SEQ ID NO: 159042 - protein, 124 aa, Triticum aestivum
  Clone ID: PAT_TA_53460.pep
SDKEEEFGWLIKYSPLHNVKRPWEQSFGDNCQYPATMLLTADHDDRVVPLHSLKLLATMQHVLCTSIENSPQTNPIVLCRRCWALHGLTSSILSWRCCVLSTQDGERCNPGGERLLSLQLLNSF

SEQ ID NO: 159043 - protein, 97 aa, Triticum aestivum
  unsure (1)..(97): unsure at all Xaa locations
  Clone ID: PAT_TA_53461.pep
MATTDIRLSIGHQTRFALRLASAISSPSHAKGSAGNAAFSPLSLHVALSLVAAGXEQVVQVVLADASGAGGPRVAFANGVFVDASLKLKPSFKDLAV

SEQ ID NO: 159044 - protein, 46 aa, Triticum aestivum
  Clone ID: PAT_TA_53462.pep
ALANLGVPLRVTPKPPALKGPLKGAFLFPFWVGKFLERLLVRAFCF

SEQ ID NO: 159045 - protein, 194 aa, Triticum aestivum
  unsure (1)..(194): unsure at all Xaa locations
  Clone ID: PAT_TA_53463.pep
MSSCFNGGAGWPEPVVRVQAVSDTCGETIPERYVKLPLDRPSATTLQPAVSHGGGSLNIPVVDMSMPDSGETVRAVDAACREWGFFQAVNHGVSPELLRRARSSWRGFFRQPAEVRERYANSPATYEGYGSRLGTTKGGHLDXGDYYFLHLLPPSIKSHDKWPSLPSTLRDATEEYGEEVVKLCRKVSKVLSKG

SEQ ID NO: 159046 - protein, 97 aa, Triticum aestivum
  Clone ID: PAT_TA_53464.pep
GGGGINSEVRRIGEAVEGIRGPRQIRSPSRTRFNLFPLGGNAGPVNPQRRKVKSARVKEGGTACPTLVSSPLLSSDGRAGRGGGRVGGRWADAWADA

SEQ ID NO: 159047 - protein, 100 aa, Triticum aestivum
  unsure (1)..(100): unsure at all Xaa locations
  Clone ID: PAT_TA_53465.pep
ILXRSIITRPRXRPPXLXXAETRRCRHARCHAAPPLAPSSQHLLQNDAPRRKNDIETSSSSDPVDPDQGFPLEPFDQVDVTCNDDASRRERRPRRRHRPP

SEQ ID NO: 159048 - protein, 118 aa, Triticum aestivum
  Clone ID: PAT_TA_53466.pep
ENLVARRVASRRWRAAGGSLVPGSGGGSRGARRRRPRQLPHLLAPPPGSVAPGSSSPRTVVRRHRDPSPPQHRRQGLAPLPGRRLPARARLDLMTHYLDPLFHDFVLFLLIVIISFSN

SEQ ID NO: 159049 - protein, 110 aa, Triticum aestivum
  Clone ID: PAT_TA_53467.pep
MACAFFFDAEPLGEPGLRLHGPELELDACALCTKPLQGNSDIFMYKGDTPFCSEDCRYEQMHFDAAMARQQASARRKQQQQQAQAQLSVPGAPAPAPAPVSNKADVSVAS

SEQ ID NO: 159050 - protein, 119 aa, Triticum aestivum
  unsure (1)..(119): unsure at all Xaa locations
  Clone ID: PAT_TA_53468.pep
AAAPRGLNPSVSAIGFGPGVSFSGFRVPARMQGNEEHNGGNGDKPPSVSSASHHXQQQWMTDDFTTNLHSVPIALQLGGAKFGAGSTSGWLVGWFSISSATCVIVFCFKITRSFLELGL

SEQ ID NO: 159051 - protein, 126 aa, Triticum aestivum
  unsure (1)..(126): unsure at all Xaa locations
  Clone ID: PAT_TA_53469.pep
MQIFVKTLTGKTITLEVESSDTIDNVKAKIQDKEGKESTLHLVLRLRGGTMIKVKTLTGKEIEIDIEPTDTIDRIKERVEEKEGIPPVQQRLIYAGKQLADDKTAKDYNXERGSXLHLVLGLGGGF

SEQ ID NO: 159052 - protein, 94 aa, Triticum aestivum
  unsure (1)..(94): unsure at all Xaa locations
  Clone ID: PAT_TA_53470.pep
GRGSSHPPRGVRRGSMERAGEDDDTGSGSRRRSRSMSMGGSDATSTMSGGGTTAVKQHQALRLVXXTKMNAGLLDYMADFGKKEVTARGTVIHT

SEQ ID NO: 159053 - protein, 201 aa, Triticum aestivum
  unsure (1)..(201): unsure at all Xaa locations
  Clone ID: PAT_TA_53471.pep
XGSNVRSYLYCEDVAEAFEVVLHKGEVGHVYNIGTVKERRVIDVASDICKLFGLDTEKVIRFVENRPFNDQRYFLXNPDYWGDVAGALLPHPRMLMTPGVERHNWTEEIKSLASSPAEAKECSTVPAAATSKSTSSVPQKATYKFLIYGKTGWIGGLLEKICEKQGIPYEYGKGRLEERSQLLQDIKNVKPTHVFNAAGVT

SEQ ID NO: 159054 - protein, 94 aa, Triticum aestivum
  unsure (1)..(94): unsure at all Xaa locations
  Clone ID: PAT_TA_53472.pep
PPALSXAPXRPVLSGXGVXPRXAXPPLGPWGWASSXXSXPPLPLPLLXPLGXXSAFPCXXXPLXWXAWXXXFAARLVLFXVAAPPXALFXLPLS

SEQ ID NO: 159055 - protein, 122 aa, Triticum aestivum
  Clone ID: PAT_TA_53473.pep
EPGGVATGQSQLNRRRPTGAHFFHTKRAPIARPYAKALRPVGGKQGPRLEAESCRPRTALGCMVIEDKAFDTARACAHMVDDADVPLASCTMLTDYRPFEYPQYIAAAKIGTYLRCAKNTTP

SEQ ID NO: 159056 - protein, 163 aa, Triticum aestivum
  unsure (1)..(163): unsure at all Xaa locations
  Clone ID: PAT_TA_53474.pep
GKAAVAQAKIANQLXYLKKFSGPRWEALVKKGAKKQRLLWASTRREEPXAYLDTLYVDPLIGPDTVSTMPDQALDAFIDHGTVARTIDANVSEAEGIYSALEKLGIDWEEVGKQLEHEGVSSFKGSFDSLLTSLEETNDYRIKMPACWLLSFHLEMKCSQLSG

SEQ ID NO: 159057 - protein, 91 aa, Triticum aestivum
  Clone ID: PAT_TA_53475.pep
AVNTISEELSSIVELAATDEIAMTSKEEKLAELMEMNQGLLQCMGVSHASIETVLRSTLKYNLVSKLTGAGGGVRCFKVEVGGQGLQIHQG

SEQ ID NO: 159058 - protein, 74 aa, Triticum aestivum
  Clone ID: PAT_TA_53476.pep
MAGKYIVAGLVGSCVISYACDYIVSQKKIFGGTIPGTVSDKEWLKATEQRFQARLKILRFAVGWNLYPDGDACC

SEQ ID NO: 159059 - protein, 75 aa, Triticum aestivum
  unsure (1)..(75): unsure at all Xaa locations
  Clone ID: PAT_TA_53477.pep
SWLWRTTDDRGHLPXDSLTQHLERAVSGVQPWEDTAXACIYPHRYCLRNFLLLGPSCESTIAGDVMTXDNKLITV

SEQ ID NO: 159060 - protein, 170 aa, Triticum aestivum
  Clone ID: PAT_TA_53478.pep
LKIRTMAVLVARQGRELQRYSASTGGRIVVGCIPYRMRDGGDSDGEGELEVLVISSQKGHGMMFPKGGWELDESMDDAARREALEEAGVRGEMGKVLGCWHYQSRRYQTTYEGIMYPLRVTDELQQWPEMASRKRTWATVQQVMEGCQHCWMREALEELVARHAKPQSAL

SEQ ID NO: 159061 - protein, 131 aa, Triticum aestivum
  unsure (1)..(131): unsure at all Xaa locations
  Clone ID: PAT_TA_53479.pep
MQIFEKTLTGKTITLEEESSDTIDNVKAKIQDKEGIPPGEERLIFAGKQLEDGRTLADYNIQKESTLHLVLRLRGGMQIFXKTLTGKTXTLEVESSXTIDNXEAKIQDKEGXPADQEGLIFAGEEXEDGRT

SEQ ID NO: 159062 - protein, 214 aa, Triticum aestivum
  unsure (1)..(214): unsure at all Xaa locations
  Clone ID: PAT_TA_53480.pep
VIYSIRESIKFIKASSAREQKFAEIALQLEIPSTKTLCLDVTTQWNTTYLMLLAALDYRQAFTTLETCDDNYNXMAAANPTSNLFFHEAWKLQLELSNAITHEDPVFSSIAKEMHERFDKYWKDCNLVLAIGVVMDPRFKMKLVEFSYSKIYGVEAAKYVKVVDDALHDLYKDYVAQPLPLTPAYAAPREVNKNGPANAKYNAVTSPSTGGWTP

SEQ ID NO: 159063 - protein, 128 aa, Triticum aestivum
  Clone ID: PAT_TA_53481.pep
MQIFVKTLTGKTITLEVESSDTIDNVKAKIQDKEGIPPDQQRLICLRGGAKKRKKKTYTKPKKQKHKHKKVKLAVLQFYKVDDATGKVTRLRKECPNADCGAGTFMANHFDRHYCGKCGLTYVYNQKA

SEQ ID NO: 159064 - protein, 168 aa, Triticum aestivum
  unsure (1)..(168): unsure at all Xaa locations
  Clone ID: PAT_TA_53482.pep
LRFNRVFNEGMKNHSIIITKKLLELYKGFNGLDTLVDVGGGIGATVGAITAHYPTVKGINFDLPHVISEAXILHDWSDEHCATLLKNCYDALPAHGKVVLVECILPVNPEATPEAQGGFHLDMIMLAHNPGGRERYEREFEALAKGAGFGAIKTTYIYANIWVIEFTK

SEQ ID NO: 159065 - protein, 172 aa, Triticum aestivum
  unsure (1)..(172): unsure at all Xaa locations
  Clone ID: PAT_TA_53483.pep
PTRPKKESSQSRAEPSPSPAHTQPQWRAPALSASRCSASSRRTPPSPRRLRPRPPRPPPPRPRRRLPPRRRPRPPRRRPPPRPSPPPHRPQRLPPPPQPPPPPRRHPPRPPQHQPRLPPRHRPPRPSXRPLPRLPRPAPRRSRPPSPPLPLPSPRHPAPCPPSPTPPRPARA

SEQ ID NO: 159066 - protein, 153 aa, Triticum aestivum
  unsure (1)..(153): unsure at all Xaa locations
  Clone ID: PAT_TA_53484.pep
MAAALRSSSAAAVHRFLRISRSTLSTLPYASRPATEPPFSPSITAISGGYNAFSWNFRRLLSSNEKHMPAMSDPQIESALKDLMAASWSELPHSLVEEAKKTVSKSTDDAAGQEALKNVFRAAEACEEFGGVLVTLRMALDDLXGLQAETEAP

SEQ ID NO: 159067 - protein, 183 aa, Triticum aestivum
  unsure (1)..(183): unsure at all Xaa locations
  Clone ID: PAT_TA_53485.pep
MGRRPARCYRQIKNKPYPKSRYCRGVPDPKIRIYDVGMKKKGVDEFSHCVHLVSWEKEXLRVRVHPFHVLRINKMLSCAGADRLQTGMRGAFGKPQGVCARVAIGQVLLSVRCKPNNAIHATEALRRAKFKFPGRQKIIESRKWGFTKFNRNDYLKFKSEGRILPDGINAKLLGCHGPPANRA

SEQ ID NO: 159068 - protein, 87 aa, Triticum aestivum
  unsure (1)..(87): unsure at all Xaa locations
  Clone ID: PAT_TA_53486.pep
MSDLDVQIPTAFDPFAEANAGDAGAAAXQYSKILKDLKKEFCCNGTVVQDTELGQVIQLQGDQRKNVSNFLVQAGIVKKEHIKIHGF

SEQ ID NO: 159069 - protein, 186 aa, Triticum aestivum
  unsure (1)..(186): unsure at all Xaa locations
  Clone ID: PAT_TA_53487.pep
MGISRDSMHKRRATGGKQKAWRKKRKYELGRQPANTKLSSNKTVRRVRVRGVLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFNGGRLLACISSRPGQCGRADGYILEGKELEXYMR

SEQ ID NO: 159070 - protein, 180 aa, Triticum aestivum
  Clone ID: PAT_TA_53488.pep
VRHHARNPQWVTWKAQPCVAMEIESNPKYCRVIRRASSEEDRLSGLPDDVLHSIVGRVPLKQAVPPGTAGLAGLTSLSLNQVDVTDDALRDMVSGCRVLEFLSLKSCHLLVYVRVASESLRGLEIVRCLAMRHLQVDAPVLESVAYHGDVLIWREDEPSGVEFVGPGGRTDARPELRTRT

SEQ ID NO: 159071 - protein, 155 aa, Triticum aestivum
  unsure (1)..(155): unsure at all Xaa locations
  Clone ID: PAT_TA_53489.pep
MARSPMAMLPFLVLGVAALVLSAAGMVAAQKCGCRANECCSQYGYCGTTDAYCGQGCRXKSRAGNGCAGKSFYTRRSFLAGARANPNFGKGRTGDDGKREIAAFFAHVTHETGHMCYIEEIGGASQNYCDRKYTQWPCASGKEYYGRGPAQLTWN

SEQ ID NO: 159072 - protein, 105 aa, Triticum aestivum
  unsure (1)..(105): unsure at all Xaa locations
  Clone ID: PAT_TA_53490.pep
AGQGESLSLVARLLRGFKNLSHQIFAVYDDEEEEEEEPEMVIGLPTDVMAPPXPATASASTSVSASSSAAPPPPQAQPPALSARQFELAMAAXAFAVTTGTPVST

SEQ ID NO: 159073 - protein, 141 aa, Triticum aestivum
  unsure (1)..(141): unsure at all Xaa locations
  Clone ID: PAT_TA_53491.pep
MAPTKGEGPAIGIDLGTTYSCVGVWQHDRVEIIANDQGNRTTPSYVXFIGRRFADAPVQSDIKMWPYKVIPGPADKPMIVVQYKGEDKQFSAEEISSMVLIKMREIAEAYLGVTIKNAVVTXPAYFNDSQRAATKDAXGIA

SEQ ID NO: 159074 - protein, 75 aa, Triticum aestivum
  Clone ID: PAT_TA_53492.pep
SEDSSNSNQIVHDHDFKVEPQTIYHLNPPTHRQESLVILQQKQSPVRTPLPYVLDSPPDHRRSATLAGSSSITTL

SEQ ID NO: 159075 - protein, 73 aa, Triticum aestivum
  Clone ID: PAT_TA_53493.pep
MKGTKLAAILILQAVLVMGVLSHVNADFFPKCCNNCRSFSGVDVCDDAHPKCPKRWTLQEVLIGSCRHMICSA

SEQ ID NO: 159076 - protein, 179 aa, Triticum aestivum
  unsure (1)..(179): unsure at all Xaa locations
  Clone ID: PAT_TA_53494.pep
DHVPGRRAPAAGLRRALVLVLLGVGRCHEEPQRPRAGGAAPGEAAAADAVERRGLPGAEAERAQAADAALAAGVLRLGRRLRGAELERRGXERLRWSEMTKSSSSSESESEPESAPELELKEESRREQEAKSRSKNGPSSSPSPSRGSDVATADAALRRAARSRRICMLWRAERCDSVS

SEQ ID NO: 159077 - protein, 67 aa, Triticum aestivum
  Clone ID: PAT_TA_53495.pep
MASDDSSSSHPTEKKEEAAAAAAGGAGFDDLEDPRFQCCVCLELLYKPVVIACGHMSCFWCVHKAMH

SEQ ID NO: 159078 - protein, 87 aa, Triticum aestivum
  unsure (1)..(87): unsure at all Xaa locations
  Clone ID: PAT_TA_53496.pep
VTSFFXRGARLAAAGIYGILKKLGRDMVPTDGSPLPRTVVALDGGLYEHYKKFSSCLEATLSDVXGDEASSSLVAKLAPXGWIEPRV

SEQ ID NO: 159079 - protein, 64 aa, Triticum aestivum
  Clone ID: PAT_TA_53497.pep
GSTLLLPGHALSSVNLQKHACRAFFRVHRKLACEQGCFSDAEEKRQVLSAREGYAFLPGLPLSI

SEQ ID NO: 159080 - protein, 80 aa, Triticum aestivum
  unsure (1)..(80): unsure at all Xaa locations
  Clone ID: PAT_TA_53498.pep
LLLLLRPRSPAAALLLLLHRPALLHREPLLPLRVPVVDSRGQRGDARGGGHGRLHERDHRRGGPCGRRRXXXXXRXXXAT

SEQ ID NO: 159081 - protein, 160 aa, Triticum aestivum
  Clone ID: PAT_TA_53499.pep
MALKASFPGELAALLDSGNTRSRRGAAFRPRQHQRKVDFTFQRRDKRAAYLRTCCSMQQGPPPAWPGRAVVEPERRSWEGPKPISIVGSTGSIGTQTLDIVAENPDKFRVVALAAGSNVTLLADQVRTFKPKLVAVRNESLLNELKESVAGCEEMPEIIP

SEQ ID NO: 159082 - protein, 155 aa, Triticum aestivum
  unsure (1)..(155): unsure at all Xaa locations
  Clone ID: PAT_TA_53500.pep
MTTGGNGEEQQGRRLFGVSLTDRPVWQQFLICSSGFFFGYLVNGICEEYVYNRLQFSYGWYFTFVQGFVYLGLIRLQGFTVKHMVNPWRTYVRLSAVLMGSNGLTKGSLAFLNYPAQIMFKSTKVLPVMIMGAFIPGXRRKYPFHEYVSAVMLVI

SEQ ID NO: 159083 - protein, 197 aa, Triticum aestivum
  unsure (1)..(197): unsure at all Xaa locations
  Clone ID: PAT_TA_53501.pep
QVGNACWELYCLEHGIQPDGQMPGDKTVGGGDDAFNTFFSETGAGKHVPRAVFVDLEPTVIDEVRTGAYRQLFHLCLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRSLDIERPXYTNLNRLVSQVISSLT

SEQ ID NO: 159084 - protein, 141 aa, Triticum aestivum
  Clone ID: PAT_TA_53502.pep
MTPQALLLLLLAAAVAVAAASAAPANGAANDLLPKYGLPKGLIPDSVSSYTFDEATGGLSKGRITGLAGIQAKKLFLWVSVSGIVAHPAEGTLEFQVGFVSEELSASLFDRVPACGASAGAQLRGVAGVIQELGLLPVAEA

SEQ ID NO: 159085 - protein, 164 aa, Triticum aestivum
  unsure (1)..(164): unsure at all Xaa locations
  Clone ID: PAT_TA_53503.pep
MAVTFSDLHTADGLKALEAHLAGKTYISGDGITKDDVKVFAAVPVKPXSASSAPAAAAPAASKDEDDDDDMDLFGDETEEDKKAAAEREAAKPAKKKESGKSSVLMDIKPWDDETDMKKLEEAVRSVQMEGLTXGASKLMPVGYGIKKLQIMLTIIDDLVSVDT

SEQ ID NO: 159086 - protein, 189 aa, Triticum aestivum
  unsure (1)..(189): unsure at all Xaa locations
  Clone ID: PAT_TA_53504.pep
DELATSGIRAFAIGPLHKLSTIGGAGSLLEQDRSCVEWLDTQAAGSVLYVSFGSVAPVHRHDFNEVAWGLANSGEGQXKVVRWAPQQEVLAHRAVGGFRTHSGWNSTLESICEGVPMLCSPFFGDQLANGRSVEDVWEIGTLLVGKMERGEIEHAIARLMEGGVCATARERAKELKTKSVESLKNAGST

SEQ ID NO: 159087 - protein, 203 aa, Triticum aestivum
  Clone ID: PAT_TA_53505.pep
RPNLFAGEIPASFASLKNMTLLNLFRNRLAGEIPEFIGDLPNLEVLQLWENNFTGGVPAQLGVAATRLRIVDVSTNKLTGVLPTELCAGGRLETFIALGNSLFGGIPDGLAGCPSLTRIRLGENYLNGTIPAKLFTLQNLTQVELHNNLLSGEVRLDADEVSPSIGELSLYNNGLSGPVPAEIGGLVGLQKLLLADNKLSGEL

SEQ ID NO: 159088 - protein, 158 aa, Triticum aestivum
  unsure (1)..(158): unsure at all Xaa locations
  Clone ID: PAT_TA_53506.pep
DISRKMRYXNFVASFVFHGKEKAIACMIANFNFQGQRVKSKLTMEEQAYALLLLLLRKEANLEPQNIDPVLPDRCPILGSGEVRRCRASLLSFILSLSRISLSLLQGPIHVVTLCRRHRRGSAPRPHALDPAGGKGGSDPHNPVLRRRRHARERWEGE

SEQ ID NO: 159089 - protein, 87 aa, Triticum aestivum
  Clone ID: PAT_TA_53507.pep
MGDYTIRISTSLIDQLTRDDEKVKRRTRKPKPKKVVERQEEPQDNGRELPSEPKSSPAPAPGWALPPPMYLPVTPAPPPPLPAIQEV

SEQ ID NO: 159090 - protein, 87 aa, Triticum aestivum
  Clone ID: PAT_TA_53508.pep
LYAGDDVDVNSFPALSGSRGSSSASSSAIGNNNMPKAKPFASVIRPPVEFAVVGNENGNRHLTDHMVRTNSGVNSGCGDKMKLLQDA

SEQ ID NO: 159091 - protein, 167 aa, Triticum aestivum
  Clone ID: PAT_TA_53509.pep
MLRAVLLRSASGLRRSPMAAPLSTAAASWLAEGTSSPPRVRLLIGGDFVESKATEHVDVTNPATQEVVSRIPLTTADEFRAAVDAARTAFPGWRSTPVTARQRIMFKYQELIRANMDKLAENITTEQGKTLKDAWGDVFRGLEVVEHACGMGSLQMGEYLSNGSHGI

SEQ ID NO: 159092 - protein, 52 aa, Triticum aestivum
  Clone ID: PAT_TA_53510.pep
NRPPLFFFFFFFFFFFFFFFFFFFFFFFFFFFFFFFFFFFFFFFFFFFRTSW

SEQ ID NO: 159093 - protein, 96 aa, Triticum aestivum
  Clone ID: PAT_TA_53511.pep
RSGLGDHRWPLVTHFVGCKPCGEPGATYDAVACREGMERALNFADDQILGLYGFQHESLGTTAVRRVRNDTGRPLDADDEEVGRLLHPEFRAANPL

SEQ ID NO: 159094 - protein, 94 aa, Triticum aestivum
  unsure (1)..(94): unsure at all Xaa locations
  Clone ID: PAT_TA_53512.pep
SDQPQSAAGGTSYKLACRRAATPGILLASTTAMATADVQNPTAALTEEAPAVETPVAGGGGAXTXXVPAXVEAEEGAPAPXEGEATKEEAPGAG

SEQ ID NO: 159095 - protein, 153 aa, Triticum aestivum
  Clone ID: PAT_TA_53513.pep
HASAFFFFFFFFFFFFFFFFGLGEQLMQQLEQKAKLNKRREPPFFLTSRKENPPLISMSSSHCPISPVNNNKKGEGNKTKADSASKVSKRNKTSTLKLFLPHHEKVTQTLPFLGLPHTGHACAKAGHGAHTQRCRHGSSSTTAAPSRHPLHLS

SEQ ID NO: 159096 - protein, 202 aa, Triticum aestivum
  unsure (1)..(202): unsure at all Xaa locations
  Clone ID: PAT_TA_53514.pep
SHRIAAYLEEGLAARIVASGTGIYKALTCKDPPTLYQLSAMQILFEICPCYRFGFMAANYAILEACKGEXKPRHLRITGVDDHETVQRTVGGLKVIGQRLEKLAEDCGISFEFRAVGADIGDVTPAMLDCRPGEALVVNFAFQLHHLPDESVSIMNERDQLLRMVKGLQPKLVTLVEQDANTNTAPFQTXFREVYDYYSALF

SEQ ID NO: 159097 - protein, 146 aa, Triticum aestivum
  unsure (1)..(146): unsure at all Xaa locations
  Clone ID: PAT_TA_53515.pep
MAPKRGGKAPVPAKKKTDKVTNPLFEKRPKQFGIGGALPPKKDLHRFVKCPKVVRIQRQRRILKQRXPEDKAAKKERLLKRAQAEAEGKTVEAKKPIVVKYGLNHVTYLIEQSKAQLVVIAHDVDPIELVVWLPALCRKMEVPYCF

SEQ ID NO: 159098 - protein, 59 aa, Triticum aestivum
  Clone ID: PAT_TA_53516.pep
SGPAPARTTSAMSKAQLAPTAKHGHLKTSPKPPTTVHQVHEAVWAFVFAITQTQNGGRG

SEQ ID NO: 159099 - protein, 134 aa, Triticum aestivum
  unsure (1)..(134): unsure at all Xaa locations
  Clone ID: PAT_TA_53517.pep
MSGTXRGSSSASRGGDGNRGTTLPVPTLVASEVSGTMRGSSSASRGRDGGTTPPALTTEATLEGSEEAASEASGTTTGSSSASVSRRGGGCGRDSGATATGCGAWPSIPEGIRGAESAADRSPPLLVDGGCGDG

SEQ ID NO: 159100 - protein, 136 aa, Triticum aestivum
  unsure (1)..(136): unsure at all Xaa locations
  Clone ID: PAT_TA_53518.pep
RVSTLAGGFKCSSVAIFPAAMAANFPAPIFSFAILAVTHLGWMKQPGLPLGMGSRAXEXFFYCCSRPPSLHRFLFFASTSSGTPAMPLLFLDFSKSELIFFLELGSRRITLFSCVGVAVDGTSCDHAAAAAARPPL

SEQ ID NO: 159101 - protein, 59 aa, Triticum aestivum
  Clone ID: PAT_TA_53519.pep
MSCNCGSSCSCGSDCKCGKMYPDLTEQGSAAAEVAAVVVLGVAPENKAGQFEVAVRVMV

SEQ ID NO: 159102 - protein, 204 aa, Triticum aestivum
  unsure (1)..(204): unsure at all Xaa locations
  Clone ID: PAT_TA_53520.pep
SVFAGIAQGPEDPILGVTVAYNKDPSPVKVNLGVGAYRTEEGKPMVLNVVRRAEQMLIQNESRVKEYLPITGLADXRTGSLRVGGEFLARHYHERTIYIPQPTWGNHPKVFTLAGLTARSYRYYDPATCGLDFQGLLEDLSSAPSGAIVLLHACAHNPTGVDPTLEQWEQIRQLMRSKALLPFFDSAYQGFASGSLDKDAQSVR

SEQ ID NO: 159103 - protein, 66 aa, Triticum aestivum
  Clone ID: PAT_TA_53521.pep
MATANLSSVVVAVDGSEESMKALRWALDSLRLRPDGALVGAGVYAGHRVVPAGDHGGDAGARAEDG

SEQ ID NO: 159104 - protein, 92 aa, Triticum aestivum
  unsure (1)..(92): unsure at all Xaa locations
  Clone ID: PAT_TA_53522.pep
TTHDVRVQCRXXTSHLSRLSIQKHPSVLHPHAFVRLDQHSMPTSPPSLLDLLSPSPPAPEAAASSGHGGATVVQVVPMDVSEELLGXFMAAT

SEQ ID NO: 159105 - protein, 182 aa, Triticum aestivum
  Clone ID: PAT_TA_53523.pep
KSLVLLKNGKNRKEPFLPLAKNATRILVTGTHADNVGYQCGGWTISWHGDSGKITPGTSILEAIQQSVEVETEVVYDECPIDATIEAGKFSYAVVVIGEVPYAESLGDRTDLSIPFNGSDLITRVANKVPTLVIVISGRPLVIEPQVLEKVDALVAAWLPGSEGMGVADCLFGDHDFVGTLA

SEQ ID NO: 159106 - protein, 72 aa, Triticum aestivum
  Clone ID: PAT_TA_53524.pep
IIKKENNFKQAGERYRSFDPARQDRFLQRWVDALTDARVTHEIQGIWVSYWSQCDASLGQKLASRLKMKPNM

SEQ ID NO: 159107 - protein, 144 aa, Triticum aestivum
  unsure (1)..(144): unsure at all Xaa locations
  Clone ID: PAT_TA_53525.pep
MDLLASPFKGVVQDVXRRAGWHTDDWFARLRTGFRILAPTMFIFFASALPVIAFXEQLIHETNGMLITVETLPSTAICGIIHSILXGQPMMIVGVAQPTGIIGTYLYNFAKKQQRIGESLYLSSAGWVCIWTEFILLLLATLIA

SEQ ID NO: 159108 - protein, 150 aa, Triticum aestivum
  unsure (1)..(150): unsure at all Xaa locations
  Clone ID: PAT_TA_53526.pep
LISFYKNLANREKPDFHKGSGVDRSRTSVTMYTPSGILLLVFLFTSILVYALLIPLHNNLMCSTLTTRLRERISEFQTLREAIQTEYREVVERRVFTVTGERADEETIDKLIETGDSEQIFXRAIQEQRRGKVLDTLQEIQERDDTGKEI

SEQ ID NO: 159109 - protein, 122 aa, Triticum aestivum
  Clone ID: PAT_TA_53527.pep
THHWRTLTPYTQMNPLLPERRSHDCYERSRPGSLPQGEGACNPPNATLETSPTISGATSPPKRHEVNAIDVAELSRLPPRPPLLRCALHSPPTYHLPGPPSRHTTALPQAAMPHDLVTHNPS

SEQ ID NO: 159110 - protein, 139 aa, Triticum aestivum
  unsure (1)..(139): unsure at all Xaa locations
  Clone ID: PAT_TA_53528.pep
MRLCELMDINCTDPMGATPQDFFNACMLDQPRATEXSKVSVNVTNITVINLPGLNTLWISLATIDYGPFGVNTPHIHRRATVLLTTLDATLLLGLVTSNPNRLXSRXAQKGNVFDFPIALNHSHMNLIHDKPAPAITSL

SEQ ID NO: 159111 - protein, 104 aa, Triticum aestivum
  unsure (1)..(104): unsure at all Xaa locations
  Clone ID: PAT_TA_53529.pep
RNGAEEASQLNHGGKTAXXHGRRPRGGGADGHXGGGDITXKRGAPSPXRTPXGREEGXXXPTHXXXAXXXRHPTXXPXKASLTXTSKGEXFXSEPSRAKXSSWA

SEQ ID NO: 159112 - protein, 158 aa, Triticum aestivum
  Clone ID: PAT_TA_53530.pep
MICAISGEVPDEPVVSKRSGLLFERRLIERYIEDHGKCPVTKEELSMDDIVLVKTNKVVRPRPLQAASIPGLLGIFQNEWDALMLSNFALEQQLHTARQELSHALYQHDAACRVIARLKKERDESRALLALAERQIPASMAGVAPAAVVSNGKRALED

SEQ ID NO: 159113 - protein, 155 aa, Triticum aestivum
  Clone ID: PAT_TA_53531.pep
MEEAEEMQVERVHEDAEHGGADADKLNYEIFSILESKFLFGYTDPHQLWLPKPPPPPPAQASQAAMAATGKAAQRGKVCVLCVDGGGGGLRALLAGRALAHLEAALQRASGSPDARVADFFDLAAGTGAGGVFAAMLFSTHSRGAPLFRAEDTWR

SEQ ID NO: 159114 - protein, 82 aa, Triticum aestivum
  Clone ID: PAT_TA_53532.pep
SNLMKCKTAPPCSLSLSFCICSLLQPVNFFYLSIQPNQTNASPSNPITNQTISRGVGKGPSAPNIHTFSSFHIYQPHHHPNQ

SEQ ID NO: 159115 - protein, 47 aa, Triticum aestivum
  Clone ID: PAT_TA_53533.pep
NERSLHPLHSKNLHFVPRATRCLQGNRVSICGSFLGKNSVILRVYVP

SEQ ID NO: 159116 - protein, 142 aa, Triticum aestivum
  unsure (1)..(142): unsure at all Xaa locations
  Clone ID: PAT_TA_53534.pep
SVRANCYSEHQPIGTAAQGGGAEEKDYKEPPPAPFFEAGELTSWSFYRAGIAEFLATFLFLYIWGVTVMGVVGNPSGSKCGTGGIQGIAWSFXGMIFVLXYCTAGISGGHINPAVTFGLFLARNLSLTRAVFYIXMXCLGAI

SEQ ID NO: 159117 - protein, 61 aa, Triticum aestivum
  Clone ID: PAT_TA_53535.pep
LLASGRMKELSFQNEHAYFFVCIVFVSLDSFISFFPFFFFFFFFFFFFFPRVRPRVRPRVR

SEQ ID NO: 159118 - protein, 151 aa, Triticum aestivum
  unsure (1)..(151): unsure at all Xaa locations
  Clone ID: PAT_TA_53536.pep
MATVRQSNGHGEAAAANGKSNGHAAANGKSNGHAAAAADWNFAGGEDGILARTGAKNSIRAIRYKISASVEESGPRPVLPLAHGDPSVFPAFRTAVEAEDAVAAALRTGQFSCYAAGVGLPAARRAXXEHLXQGGPYEXSARGRAAPPGGA

SEQ ID NO: 159119 - protein, 36 aa, Triticum aestivum
  Clone ID: PAT_TA_53537.pep
MSRVPYFFFFYIVSPFFFFFFFFFFFFFFFFFFFRS

SEQ ID NO: 159120 - protein, 153 aa, Triticum aestivum
  Clone ID: PAT_TA_53538.pep
GLGFRRRGFGDGSEWNKGWPGFSPSVRRQIRCPRGVGDLLYRGSGRPEPVVVILFTGNCAGDGGSSRRGDGCWGFSPCLFGGRGLQQFFILCVSGELESWWRHGAIQSMEIIPGRCARTRPLFLFAGQDLHAASKAFEGDALCRWMVSRRRFE

SEQ ID NO: 159121 - protein, 57 aa, Triticum aestivum
  unsure (1)..(57): unsure at all Xaa locations
  Clone ID: PAT_TA_53539.pep
STQRPDHFCAPPPPHTPLLLLTKWEGACLLLPRTRRCRRRRQGRHSSYXRQXRSGCF

SEQ ID NO: 159122 - protein, 148 aa, Triticum aestivum
  unsure (1)..(148): unsure at all Xaa locations
  Clone ID: PAT_TA_53540.pep
MANAKSPASRARPSAVWXLIKPFANGCASGMLATCMIQPMDMIXSVKIQLGEGSAAQVAQTMTANEGLGYFNKGTAHGLLRQAIYTTGRIAFLKALTNKALVANDXKPLPLVQKDSIVMTARTIGTXYVSNADFTLIMIQSDSSVTAY

SEQ ID NO: 159123 - protein, 48 aa, Triticum aestivum
  unsure (1)..(48): unsure at all Xaa locations
  Clone ID: PAT_TA_53541.pep
XXQXXXNXPITIHAQSIXCPHXNPYIIHPLIXHIXSLGGERNPXXIQL

SEQ ID NO: 159124 - protein, 88 aa, Triticum aestivum
  unsure (1)..(88): unsure at all Xaa locations
  Clone ID: PAT_TA_53542.pep
KGGXXCAXSSXLLQXLPGTVQSVAEKGQRGXAIKESXHTGGGGAXXXXXXXXXXXKEAGXXSLLHXSXXXARGGTPXIXIXXXPTFSR

SEQ ID NO: 159125 - protein, 48 aa, Triticum aestivum
  unsure (1)..(48): unsure at all Xaa locations
  Clone ID: PAT_TA_53543.pep
AXRGRDGGVRICAGDLRTRIHRERVQRQRGVPGHLQWEGGGHXQXXPQ

SEQ ID NO: 159126 - protein, 204 aa, Triticum aestivum
  Clone ID: PAT_TA_53544.pep
SLFLLFLAVHVFVACHGSPLPPSSAYNDSVCSESFRCGSVDIRYPFYLSNSTGAAPDYTPYSCGYTDLKIFCQGEGETASAILTLGQGELHNYTVLNIIYENHAIILRDTEAFISGGKCPTVSHNVTFDRGWLNYTESLEELTFFFGCHSTESDLPPPDPPLDKFQIDCKGFNPPPGSGDRVSFVFSSEESNVSREHELCEYCR

SEQ ID NO: 159127 - protein, 148 aa, Triticum aestivum
  Clone ID: PAT_TA_53545.pep
VYVAGMGSKGAALSNAISYWVYVIVLAVYVRVSSSCKETWTGFSAEAFRDVLSFFRLAVPSALMVCLEMWSFELIVLLSGLLPNPKLETSVLSISLNTAAFVWMIPFGLGSAISTRVSNELGAGRPDAARLAVRVVVFLAVAEGLIMG

SEQ ID NO: 159128 - protein, 165 aa, Triticum aestivum
  unsure (1)..(165): unsure at all Xaa locations
  Clone ID: PAT_TA_53546.pep
RTRGLDLAAPLLCLLAVLLLSTASAEYPQELLRRAEGEREWIIGVRRRIHAHPELAFQERRTSALVREELEGLGITARAVAGTGVVADVGLGMPPIVALRADMDALPIQNCIFSELVEWEHKSRVDGMMHACGHDAHTAMLLGAAKLLXERKDXLKGTGRLLFLL

SEQ ID NO: 159129 - protein, 89 aa, Triticum aestivum
  Clone ID: PAT_TA_53547.pep
PVAPNRPLIISLCLSLRHRADVTTLYQWSSSRSKSTIARRDSSRRISSAARRTLSQMPPHLRRLRPRTAELLLTLRAHPDPLANQLLGQ

SEQ ID NO: 159130 - protein, 98 aa, Triticum aestivum
  unsure (1)..(98): unsure at all Xaa locations
  Clone ID: PAT_TA_53548.pep
MADRANHPSGMQKFGGQGHLASRGGEGVXAPNICPSVPADERRFTTSGDMTQNRGISVPMRASSPLGANAPPEKKGVKNFAIDFLMGGVAAAVSKTAA

SEQ ID NO: 159131 - protein, 89 aa, Triticum aestivum
  Clone ID: PAT_TA_53549.pep
GGPRHAAQGGPTHPKPSLSRAALAQRAETGAPPDLPPSQPPRSPIAPTPRGARATFFGCAAGAPGEDNLARGVPCRPKPPSASGCTTCG

SEQ ID NO: 159132 - protein, 75 aa, Triticum aestivum
  Clone ID: PAT_TA_53550.pep
RRGRLVSLARLNDASIIIVDPILRRRCGLDVWLFPIVCVCACVRASGLGCPAIVFMCSDQMCFSSSRACTFYFYS

SEQ ID NO: 159133 - protein, 83 aa, Triticum aestivum
  unsure (1)..(83): unsure at all Xaa locations
  Clone ID: PAT_TA_53551.pep
MQIFEKTLTGKTITLEGESSDTIDNVKAKIQDKEGGGPDQXRLIFAGKQLEDGRTLADYNIQKEGTRHLDLKLRGGMQILVKT

SEQ ID NO: 159134 - protein, 103 aa, Triticum aestivum
  Clone ID: PAT_TA_53552.pep
SVLPRIHIIRIEESVMICIVYLRPFPLHTLRKNIRQLARIYVRCKLRSKILHILLGDRLSELQTPRHVFAGPDMRHQITRVEEFVDLFPGALEVRRPLAHGSM

SEQ ID NO: 159135 - protein, 127 aa, Triticum aestivum
  Clone ID: PAT_TA_53553.pep
DWPKNKQQYSASHVNFHTTNAEINRIHVLQTMKSHPWFTTNFKNIKRHPSWQVTSIQKSMLFNDNHLHRQNYKMKFVASLLNHQMYTNGIDRVFGEEFARVLIHRSNAEGKRDTCVIKGFYIATMAG

SEQ ID NO: 159136 - protein, 96 aa, Triticum aestivum
  Clone ID: PAT_TA_53554.pep
MVRPRLPSKALIVPLGAPPFLPSSAYLRVMDNTSRSTDIPHSPGASSSSSLRSPLSLPEPLIFAGGPSLLSNLQFTHQSATVIPQESAHRFSISPT

SEQ ID NO: 159137 - protein, 170 aa, Triticum aestivum
  Clone ID: PAT_TA_53555.pep
MTSVWKTKVLPGLNKIFDKDGKKAAAAEFLKSFNKEEIDKEIEDKKTELEPKVVETIEASPPEIKGLMKDKKTSKIKKNSVAVTKFLDDLAKIDFPGAKLVSDAVAKSGTTPLSPAIVFILDKVAPFVPAPKEEPKAEPEDAAPAEETTTREVAVEEKKEEAEPSAAPAE

SEQ ID NO: 159138 - protein, 189 aa, Triticum aestivum
  Clone ID: PAT_TA_53556.pep
MADLVWPYLRLVYQPPEESARRRRREQYSIFTIMEALRQMILEPIVYDTAEQDSGEVKFSMIAASKGGFDIKIGSHTMHAPKYASARHPLVYMMLFACNLLDGKFSCPKAMVPRSILNMIQKSRSVSRSTGIAGESIVESIGVYAESELGCAAIPSTISPAIAAKEDEDAAYHDNAMGWRLTPILIWRV

SEQ ID NO: 159139 - protein, 227 aa, Triticum aestivum
  unsure (1)..(227): unsure at all Xaa locations
  Clone ID: PAT_TA_53557.pep
SELPPPPPPAPAKPPSIPSAATTTTTTLATAADGTTTISSLGQDQLLEIFLRLPNLPALVRAALTCRSWLGAVRSSRRFRRLFRALHPAPLLGIFLEVDVSTSPSFAPLRRSDPDVSAALRRGDFFLTSLPPDDGAPPCWTVTDCRDGYILMWNSLWAVAAVNPMTWAADIISLPAMSRSGASXGFVFLGLHLLCPEESSRSFGVVCIGADVSRVRAPTTSRRRRGI

SEQ ID NO: 159140 - protein, 92 aa, Triticum aestivum
  unsure (1)..(92): unsure at all Xaa locations
  Clone ID: PAT_TA_53558.pep
RPSXRGLLGRPLVRPRVRSVSSIAKRQAYCPRHCRLLRQWRLLLSAWFCVCSCSRTVRRKPGRPLGGRWCLPRIXMERXAGRGSWVVVWKGP

SEQ ID NO: 159141 - protein, 150 aa, Triticum aestivum
  unsure (1)..(150): unsure at all Xaa locations
  Clone ID: PAT_TA_53559.pep
MEEYGAGDLLSEAMCAGARVVVVEDCVEAPAAFVLHLLLKRALAAGGGGGGGAALLALAQPFSHYDRVLRKMGCNLSMHRKSERLHFFDLQGFPGGTRGGAIADSLAQLYSAAQRVVETCRXGENAGRFTGMIDEVSLLEVAAHGSADDV

SEQ ID NO: 159142 - protein, 153 aa, Triticum aestivum
  Clone ID: PAT_TA_53560.pep
MALEEAAPGGGGGGGIRVLLRRKQVDSDRARAAGGQQLAKELSITQLIAIGVGSTVGAGVYVLVGTVAREHSGPALTLSFLIAGIAAALSAFCYAELASRCPSAGSAYHYSYICVGEGVAWLIGWALILEYTIGGSAVARGISPNLALFFGGP

SEQ ID NO: 159143 - protein, 100 aa, Triticum aestivum
  Clone ID: PAT_TA_53561.pep
MAPIKIGINGFGRIGRLVARVALQSPDVELVAVNDPLMTTDYMTYMFKCDTVHGQWKHHEVKVKDSKTLLFGEKEVAVFGCRNPQEIPWAAAGAEDVGEC

SEQ ID NO: 159144 - protein, 177 aa, Triticum aestivum
  unsure (1)..(177): unsure at all Xaa locations
  Clone ID: PAT_TA_53562.pep
LLQVAFFYASLYLIAMAQGADKPCALAFAADQFDPEHPKERASRSSLFNWWFFSMAVGISICVAVVSYIQENVGWGIGFGMLCAIMVCTFIVFLSGTPTYRFCASTTDVESPFARLGRSLGTLIKSSSVPFSTNGHQDEDVVAKSEEGRSMLRLXPIWAGWLAYGVAYAQIMTLFNK

SEQ ID NO: 159145 - protein, 216 aa, Triticum aestivum
  unsure (1)..(216): unsure at all Xaa locations
  Clone ID: PAT_TA_53563.pep
LPDAWSQVRAPVIVPLLKLAVAVCLLMSVLLFLERLYMAVVIVGVKLLGRRPERRYKCDPICEDDDPELGSAAFPVVLVQIPMFNEREVYQLSIGAVCGLSWPSDRLVVQVLDDSTDPLIKEMVRMECERWAHKGINITYQIREDRKGYKAGALKAGMKHGYVRECEYMVIFDADFQPDPDFLHXTIPYXHHNPEIALVQARWRFVNADECLMTRM

SEQ ID NO: 159146 - protein, 159 aa, Triticum aestivum
  Clone ID: PAT_TA_53564.pep
MDPAKYWMITRRKQGDQKAPAVFSTPHIAVGSGGGTSSATYYESWEERAFAQDSAGSLGGCIWPPRSYSCSFCGREFRSAQALGGHMNVHRRDRARLKLSGMVEDGGGVVHGMPLHQSYMIQPLPCPPPRPSAPSTEANPNPVRSFLSDPGKSLVDAAT

SEQ ID NO: 159147 - protein, 78 aa, Triticum aestivum
  unsure (1)..(78): unsure at all Xaa locations
  Clone ID: PAT_TA_53565.pep
FLKKKKKKKKKKKKKKKKKKKKKKKKKKKKKKKKKKKKKKKKKKKKKKKKKKKKGARXLKEQNFSPAGGREKSFFLGP

SEQ ID NO: 159148 - protein, 141 aa, Triticum aestivum
  unsure (1)..(141): unsure at all Xaa locations
  Clone ID: PAT_TA_53566.pep
RPAVQAFWRWIQNTVAGGWDGFWPLIQRFVATAASTAHELVPAVEALWRWLKDAAAVALPVVLAIAAVVCVAALVWFWWRVLGVAAFVAGVLVAQALVLAGVLVAQALVLVICICGRWLFVVAMGVXGALAYLLPICGQFC

SEQ ID NO: 159149 - protein, 75 aa, Triticum aestivum
  Clone ID: PAT_TA_53567.pep
GGTRGSSEWNFVARRRKVISWRHPKKNLDPLKEPPQFWIFYMVLPFFFFLFFFFFFFFFFFFFFFFFFFFFFFFF

SEQ ID NO: 159150 - protein, 155 aa, Triticum aestivum
  unsure (1)..(155): unsure at all Xaa locations
  Clone ID: PAT_TA_53568.pep
TSQATLPSTPEIRSHVRRAQARDRGRRRRRRLPPGALRAAGPGRRRPQARRLRHRRARLRGGAAASPTAHKITLKSADMKEEMQKEAFDISRVAFEKHTMEKDIAEYIKKEFDKNHGPTWHCIXGRNFXSYVTHETNYFXXFYIDSKADLLLKSG

SEQ ID NO: 159151 - protein, 86 aa, Triticum aestivum
  Clone ID: PAT_TA_53569.pep
EQVSRFIWHTVRRFMIQVRKECHLEQLIDVAPSPHVCWSTSWSIILLCKPYSSLASAGDDLTSYLCCNECMFILIQFLIMFGSYLY

SEQ ID NO: 159152 - protein, 141 aa, Triticum aestivum
  Clone ID: PAT_TA_53570.pep
RTSYLCPDYNDADPRTHQGLDLTRMTTRELIAKHGLSDDTIDFIGHALALHRDDRYLSEPAIDTVKRMKLYSESLARFQGGSPYIYPLYGLGELPQAFARLSAVYGGTYMLNKPECKVEFDMEGKGWGVTLEGETAKGKKV

SEQ ID NO: 159153 - protein, 156 aa, Triticum aestivum
  unsure (1)..(156): unsure at all Xaa locations
  Clone ID: PAT_TA_53571.pep
QLKADPVTSMALADGNSTQAEARDLAGEATAREQRCKQALGPDEEAVALPALDAEQIEVDAVLGVVGQLPELLHPLPDEVAQPTFIGFXLHAXQGVHGGQLVFQLSDLATDGAELPELLANQLPNIDQNGLCRALHEFCLSWFSKRMVMGGDGMCS

SEQ ID NO: 159154 - protein, 191 aa, Triticum aestivum
  unsure (1)..(191): unsure at all Xaa locations
  Clone ID: PAT_TA_53572.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKXGRFRLHSVRDEDAKFKLCKVRSVQFGQKGIPYLNTYDGRTIRYPDPLIKGNDTIKLDLETNKIGDFIKFDVGNXVMGTGGRNTG

SEQ ID NO: 159155 - protein, 114 aa, Triticum aestivum
  Clone ID: PAT_TA_53573.pep
VRAIVFVLRRNVQLIQPEILQHVVLDMPGLAFFTTYALLVLFWAEIYYQARAMSTDGLRPTFYWINGVVYAIQIILWLVLWWKPVRVMVILSKMFFAGKILASFALCVCECGGG

SEQ ID NO: 159156 - protein, 135 aa, Triticum aestivum
  Clone ID: PAT_TA_53574.pep
LANLRERYNIYNLIRLLATAVMAFANGLKLAALCVLVLTVGQLMAVADASAPLMQSVEQERSTFEDCPCSPDKLWCCLRASGVAKPFKDCPCSPDKLWCCLKASRVAKPSEDCLCSPRTRFCCLQASEIPKASEN

SEQ ID NO: 159157 - protein, 228 aa, Triticum aestivum
  Clone ID: PAT_TA_53575.pep
NPDVGPGISSELRFYDNGTIQLVDRLSESPLWQFSTGPPLSKHITTTNSDLSYLIYPLDESDLVEVHNGTGVKLPWELEEFIARTPYIRDSVVTIGSKASTTFAVDADSGEIIYKHSLPAALNELAVPAGEAPSKLDVGRSSNIIVVVRTDYSLSASDLGVHLFNWTRSSFSANYYVKQSHPNMLEQSSCLQENIPCIRTDGVPIKLTLPDSSTANALVLQDVNKVTT

SEQ ID NO: 159158 - protein, 64 aa, Triticum aestivum
  unsure (1)..(64): unsure at all Xaa locations
  Clone ID: PAT_TA_53576.pep
LSSATRRSRWPPRQSETLAQPPPSPRLCPPARCCGWSRXRXGEARXXXXXXNAXXQGXXGGGAL

SEQ ID NO: 159159 - protein, 96 aa, Triticum aestivum
  Clone ID: PAT_TA_53577.pep
KGKRAGPIGITPPREKGRSAKGLQRGEARGFPRLNSGETPPHRKENRGPHRREYNAALLARAKLGFPIKLRPFFFFFFFFFFFFFFFFFFFFFFFF

SEQ ID NO: 159160 - protein, 144 aa, Triticum aestivum
  Clone ID: PAT_TA_53578.pep
MAAEAQQLTVPTEAELLQGQADLWRHSLYYMTSMAFQCAVKLGVPTTIHSLGGAASLPDLVVALSLPPAKLPYLCRIMRLLATSGVFAADNATDVVTYRLTPLSWLLLDGVAVEGHPSQSSLVLAATSRNCLEAAMGLYDWVKK

SEQ ID NO: 159161 - protein, 165 aa, Triticum aestivum
  Clone ID: PAT_TA_53579.pep
IIGAHFFSPAHIMPLLEIVRTEKTSPQAILDLITGGKIIRKVPVVVGNCTGFAVNRTFCPYTRGAQLLVSVGVDLFRIDRVISNFGMPMGPFQLQELTGYGVPLAVKDIYAAAFGTRNFNSVLVDSMVQTGRQAKSNGKGYYLYEKGAKPKPDPNAQLVIDEYRK

SEQ ID NO: 159162 - protein, 213 aa, Triticum aestivum
  unsure (1)..(213): unsure at all Xaa locations
  Clone ID: PAT_TA_53580.pep
SSGKGNLDPFSMESLNKAMDGAKKQQSIQGFLMEQMAKITGQGSGGNGGNNNRYGGSGGGSDGPDDESFTDSLYEVVQVVLATVAFVLTPFLLVDLPAQKGXYVYLKYIIVILPFSISEKTSYIHIIRGEELYRLARDYTRYLVTGKRTSRLKRAMLNWRDFSDSITKNFSTQDDVYQSPVASEAMWWQQPQKLVHHLGDLFRGNLRPHAQES

SEQ ID NO: 159163 - protein, 86 aa, Triticum aestivum
  Clone ID: PAT_TA_53581.pep
QCPLAVASCDLVEHGRPERWCHARVRKAIAVYHRIGLQRTASPGPSPMATNSASTPAHRPSVPLITAIHGSSLNLLPRAGLAWLAS

SEQ ID NO: 159164 - protein, 169 aa, Triticum aestivum
  Clone ID: PAT_TA_53582.pep
ASGRQGDRLLLRRRAWCGLVFRIEPFLIFLSFAWHLPSQLVPRRRHRHGCAAERGCLLLPQEGHVASGAPEGRGRRVERLHQRVVKPLHDFEHLRQKKMIGFPWLGLLSSCFISVIIAGFIFYKYCLGSKEAEIPLQSQNLYCSGNYHGKQALNLSWLSIKSVAAVHGF

SEQ ID NO: 159165 - protein, 205 aa, Triticum aestivum
  Clone ID: PAT_TA_53583.pep
MALAFDDFGRPFIILREQESKSRLRGLDAHKANVAAGKAVARSLRTSLGPKGMDKILQSPDGDVTITNDGATILEQMDVDNQIAKLMVELSRSQDYEIGDGTTGVVVLAGSLLEQAEKLLERGIHPIRIAEGYEMASKIAFDHLEHISTRFEFTAANIEPLVQTCMTTLSSKIVNRCKRMLAEIAVRAVLAVADLKGGCKLDLLK

SEQ ID NO: 159166 - protein, 237 aa, Triticum aestivum
  Clone ID: PAT_TA_53584.pep
MTGTNPAASLSGTAGTLTTLNAGTLSAGSSTSAPISVTSLGSLITLRLTRDNFLLWKTQAVPALAANGLFGYVAGTAAAPPHTIKEGTGDAAVDVANPEFLRWYQQDQLVMIALLGSMTEDILGQMTQLTTSAAVWTALHDMFASQNRARIMQLRYQLSNLKKKDLSASDYYRKMKGFADAMASIGKPLTDDEVLGYMLAGLGSEFEPLIASITARDDPVSLSSFYAYLLSAELRLE

SEQ ID NO: 159167 - protein, 123 aa, Triticum aestivum
  Clone ID: PAT_TA_53585.pep
MASTAAGEETVRASHILIKHEGSRRKASWKDPEGRVISATTRADAAARLGDLRAQILAGRASFADLAAQHSDCSSARRGGDLGTFGRRQMQKPFEDATYALKVGEISDIIDTESGVHIILRTA

SEQ ID NO: 159168 - protein, 158 aa, Triticum aestivum
  unsure (1)..(158): unsure at all Xaa locations
  Clone ID: PAT_TA_53586.pep
MAPPRRVCVTGGGGYIASWLVKLLLSRGYAVHATVRNPRDSKNAHLMQLDGAAESLRLFKADVLDSAALAAAVEGCEGVFHVASPVPADKIVDPESEVMVPAVKGTVNILEVCSSMKVQKVEVVXYTSCVDCNPNWAEAKPKDESCWSDKKMCGDDEL

SEQ ID NO: 159169 - protein, 81 aa, Triticum aestivum
  Clone ID: PAT_TA_53587.pep
STAVFREFEALAKAVYHSPEKKRAKPWKCKLKISHHKVNSPSEAWSSTCYGPFCGLILKGHTCICCKRETSISFSTVNMSQ

SEQ ID NO: 159170 - protein, 75 aa, Triticum aestivum; identical to SEQ ID NO: 106874
  Clone ID: PAT_TA_53588.pep

SEQ ID NO: 159171 - protein, 259 aa, Triticum aestivum
  Clone ID: PAT_TA_53589.pep
DAWVRGEKIGTLFHNEANVWDCSKEVTTREMAVAAKDCSRHLQNLSSEERKKILLDIAGALDANVDLIISENEADLAAAQDSGYEKSLVARMTLKAGKITSLAESIRAIADMEDPISHTLKKTEVAKDLVFEKMYCPLGVLLIIFESRPDALVQIAALAIRSGNGLLLKGGKEAMRSNTILHKVITSVIPDAVGKKLIGLVKSKDEIADLLKLDDVIDLVIPRGSNRLVSQIKAQTKIPVLGHADGICHVYIDKSADMD

SEQ ID NO: 159172 - protein, 94 aa, Triticum aestivum
  Clone ID: PAT_TA_53590.pep
LSLIHSTTVARQPRPSHLINELGRLNTGAPNEKRLKEATEMNQKDFKDASVLDKTTATRKEVYHYRYRICREAIPPITLALYWILTCTLTIPKT

SEQ ID NO: 159173 - protein, 84 aa, Triticum aestivum
  Clone ID: PAT_TA_53591.pep
SSCSRSGLLCSLHQPDYSISCLFYQSDNQMEELCQHQGQLICFTHVHYEWNIANYTVAGNSIFKFVKFASILVTVISSCKNNPE

SEQ ID NO: 159174 - protein, 96 aa, Triticum aestivum
  Clone ID: PAT_TA_53592.pep
MAASVACAFFFDAELLAEPGMPAMDACALCAKQLARDSDVFMYRGDTPFCSEECRQEQMHLDAVGARQAARRLQRFTAEAECHRGQRQSRKVSIAS

SEQ ID NO: 159175 - protein, 137 aa, Triticum aestivum
  Clone ID: PAT_TA_53593.pep
GAMEQGEEDGDWMVEPAAGKKGGAMIDRKKRFSEEQIKSLESMFATQTKLEPRQKLQLARELGLQPRQVAIWFQNKRARWKSKQLERQYAALRDDYDALLSSYDQLKKDKQALLNQLEKLAEMLREPGGAKCGDNAG

SEQ ID NO: 159176 - protein, 149 aa, Triticum aestivum
  unsure (1)..(149): unsure at all Xaa locations
  Clone ID: PAT_TA_53594.pep
MDEDDVASSHGGRGRGCPCLPFCFWGSRVPAAPERRRRRRRRFRLRLRLSLSWFSWSWRWLRKSRGGKSSEAGGKNKGKRRRKLLLLLLRSLQVKKALASVSSGSSFLPKLXVGGSGGAKKXKRSKPWRTVDDDAAPPRAALKRRACAA

SEQ ID NO: 159177 - protein, 99 aa, Triticum aestivum
  unsure (1)..(99): unsure at all Xaa locations
  Clone ID: PAT_TA_53595.pep
GGAQKFRVKLLPEGAGSPTDVLCQIGLDGIRMLDPSTSRTLRIYPLDTLTKWEXLDXTVLAXWAKTRXDSEGEGIRAKLNRHRLDTGGDLKPKLHGCSV

SEQ ID NO: 159178 - protein, 105 aa, Triticum aestivum
  unsure (1)..(105): unsure at all Xaa locations
  Clone ID: PAT_TA_53596.pep
MASTLLRKVWGTVLARAVPRDPDASASSSSPRRRGAPAAAAAEYGSLGALDAVPIDVLAQILRLLGPADAARSAXVCRTWRLLASDNALWAFFLSLGPDPWDLVV

SEQ ID NO: 159179 - protein, 65 aa, Triticum aestivum
  Clone ID: PAT_TA_53597.pep
LGTVANLEIGFYSKTCPDAEKIVREEMAKIIVGALRLDGSLLRLHWHYWRSRSSECRRPATILGG

SEQ ID NO: 159180 - protein, 187 aa, Triticum aestivum
  Clone ID: PAT_TA_53598.pep
TSGAAVAASLLDDHLKPLGIGGTGPSSSSRAAVAAPAWATSPSHGIAFDSSWALLDDLEILVKRLRSKQLRKTSSIDTSGGGSNLDSFSEAGWSREISASADSGLASAPWDETSRDYLTFVKELAVLRTRADASRSREEAFDNHMVIGRALSEHRLFRDALASFRRGCELQPTDVRPHLRAGNWLYT

SEQ ID NO: 159181 - protein, 231 aa, Triticum aestivum
  Clone ID: PAT_TA_53599.pep
HASGVRDDGQEIAVKLLNANLQTIDNEQFTREFRNLMMLKHQNTVRLVGYCYETQHQPMDFEGRFVFSERIHKALCFEYMPQGSLHDRLSDKCNVLDWQTRYKIIKGTCEGVKYLHEGLEKPFYHLDLKLGNILLDENMAPKLADFGLSKLFNEEQTCRVTQNLRAGTIGYMPPEYINGGTVSKKFDIFSLGVVMTKIIAGPSGHTKCAEMQHQGFLDQVEGNLEKKFERY

SEQ ID NO: 159182 - protein, 165 aa, Triticum aestivum
  unsure (1)..(165): unsure at all Xaa locations
  Clone ID: PAT_TA_53600.pep
MASASCLSLLVLVAMASAASAQLSPTFYQASCPSALFIIQTAVQAAVNNEPRMGASLVRLHFHDCFVDGCDGSVLLADTGSFVGEQGAAPNAGSIRGMNVIDNIKTQVEAACTQTVSCADILAVAARDSVVALGGPTWPVLLGRRDSTTASKTNAENDLPPXTFD

SEQ ID NO: 159183 - protein, 41 aa, Triticum aestivum
  Clone ID: PAT_TA_53601.pep
YAIFSSSRHISTFLLVEAASGRWFRMWMLGVAPDAVGSIPG

SEQ ID NO: 159184 - protein, 136 aa, Triticum aestivum
  unsure (1)..(136): unsure at all Xaa locations
  Clone ID: PAT_TA_53602.pep
GTNKSQANLVSDRLEACRILLPHRLKMQIFVKTLTGKTITLEVESSDTIDNVKAKIQDKEGIPPDQQRLIFAGKQLEDGRTLADYNIQKESTLHLXLRLRXXMQIXXKTXTXKTXTLEXESXDXXXNXKXKXXDKE

SEQ ID NO: 159185 - protein, 138 aa, Triticum aestivum
  Clone ID: PAT_TA_53603.pep
LYYHYYPSQIWILNSFRIRLSWIETYRTEPSSCASEIALPSTIWQSDGDLKLKMEQMAMSSNKYEVFYHKIPQLHDNRAMGAEGGHWWSAEGAVEVLAAARLYLHATRFRIGMDLGAAAFAAAPCCSVRSRLAAVEEE

SEQ ID NO: 159186 - protein, 163 aa, Triticum aestivum
  Clone ID: PAT_TA_53604.pep
MVAQAFTVDLDKPLVFQVGHLEEQYQDWVHQPIVSKEGPRFFANDVLEFLTRTKWWAVPLIWLPVVCWCLNTSIQMGHTVPEVALMVVAGIFIWTLVEYVLHRYLFHIDTKSYWTNTAHYLLHGCHHKHPMDGLRLVFPPTAAAILCYPVNSLSHRLIAEQHC

SEQ ID NO: 159187 - protein, 77 aa, Triticum aestivum
  Clone ID: PAT_TA_53605.pep
RVHCFSEMIVGLRIHGELVVDPKLMPNGKSIKDFQALLQHPYSGQPLSPGMGHLRVLVRTGLGGAARPVLPGRALRG

SEQ ID NO: 159188 - protein, 125 aa, Triticum aestivum
  Clone ID: PAT_TA_53606.pep
RRLRRSEAHGGRGRGGGGDAGRKEMGGAAVGPGRADVGVDAVRRRRPRCPRLIRSNLLPAPAADGVVGEGRPVLADHWRCVVLPSLCNCVVMVSPSSIHSSVTRTHSNSLSFSMCVFCISVHVYS

SEQ ID NO: 159189 - protein, 108 aa, Triticum aestivum
  Clone ID: PAT_TA_53607.pep
PFPCRSGSSRHSASDRARCRPGSFEGAFGHSINDLCYGLGCSPVSSPVGVLGGVSGPGSGTDLVRHLHGYRHGFMCGVLIRALTCPLFLPRVLVRAVASTVASLPHAW

SEQ ID NO: 159190 - protein, 53 aa, Triticum aestivum
  Clone ID: PAT_TA_53608.pep
TKVAPETKDVFPRPRFFNLACHPLISLFFFFFFFFFFFFFFFFFFFFFFFFFF

SEQ ID NO: 159191 - protein, 259 aa, Triticum aestivum
  Clone ID: PAT_TA_53609.pep
KLIRDSALQMLETLSLREWAEDDADGIGHYRASVVGNLPDSYQQFQYKLSSKLAKDHPELSEHLCGEIMQRQLDAVDIIAQHQVLTCMAPWIENLNFVRLKESGWSERLLKSLYYVTWKHGDQFPDEIEKLWSTVASNTRNIIPVLNFLITRGIEDCDANPSAEITGAFATYFSVAKRVSLYLARICPQQTIDHLVCELSQRMLEENEEPIRPGKFDASANVVLEYSQGPTTSQISSVIDSQADMYPLLERGSLDGAIR

SEQ ID NO: 159192 - protein, 204 aa, Triticum aestivum
  Clone ID: PAT_TA_53610.pep
LVIPAIPEMQKTWTTVFGFKPVGPMKKQKMKSFNLLIIHGTGLLEKRLLLTAQVNRQTASVTVNAVECDKTASQTFGEASGSLTPVYVSQEFAVGGHPETKDHDTCALIEGSSGLASNLPPVSEEKTEETISTVSIADVNLHISEDDMPCKALADITEKVKYAETDLTLVADKIVVEKPEDKSSSSSADSKAIPGTGDPCPCFI

SEQ ID NO: 159193 - protein, 85 aa, Triticum aestivum
  Clone ID: PAT_TA_53611.pep
MPSHSDLDRQISQLRDCKFLPDAEVKALCEQAKAILMEEWNVQPVRCPVTVCGDIHGQFYDLIELFRIGGDTPDTNYLFMGDYVD

SEQ ID NO: 159194 - protein, 107 aa, Triticum aestivum
  Clone ID: PAT_TA_53612.pep
MRPMPGMVGLISSSSKEKRKPTPTKPSDVKRTRRDRRELENIIFKLFEKQPNWALKALVQETDQPEQFLKEILNDLCMYNKRGPNQGTHELKPEYKKSSEDAAGAAP

SEQ ID NO: 159195 - protein, 52 aa, Triticum aestivum
  Clone ID: PAT_TA_53613.pep
MCNNSGGRGGARAARKGPWAENEDAQLVWFVRLLGERRWDFLAQVSGLRGGG

SEQ ID NO: 159196 - protein, 203 aa, Triticum aestivum
  Clone ID: PAT_TA_53614.pep
VVCVQTDKASLLAEVLEHVKELKRQTSAMTMMAAAVGGGEDDDAAPVQMLPTEADELGVDAAEDGDGRLVVRASLCCEDRPDLIPDIIRALAALRLRAHRAEITTLGGRVRSVLLITAEEGECADEGGDGIDEECAASHRRHECIASVQEALRGVMDRRAACSNDTSSSGGGGVSIKRQRMNYGAHEQCSVYPLAVIIQDRKS

SEQ ID NO: 159197 - protein, 213 aa, Triticum aestivum
  unsure (1)..(213): unsure at all Xaa locations
  Clone ID: PAT_TA_53615.pep
HQRGAASSSAANKVDRRPPRITSNVKQNLRIVKFWKDYERRQTTGPQPATRFRKKKIMKEVLPDDTDFYEDPSATLTCTNDGSVEIASPVILVDGYNVCGYWGKLKSDFLNGNQGIARQMLIDELVSFSAVREIKVVVVFDAALSGQSTHTETYKGVDVVYSADLSADCWIEKEVEAFVADGCXKVWVVTSDVLEQQLSHGEGALIWSFKRLV

SEQ ID NO: 159198 - protein, 123 aa, Triticum aestivum
  Clone ID: PAT_TA_53616.pep
MSDNLMDKVNALGERLKISGAEVSRKMSTGVTSMSFKMKEFFQGQNMADKIVDEATLETMDGPDWATNLEICDMANTERVNSVELIRAIKRRIMLKSPRVQYLALVLLETIFKNWEKAFSQIA

SEQ ID NO: 159199 - protein, 147 aa, Triticum aestivum
  unsure (1)..(147): unsure at all Xaa locations
  Clone ID: PAT_TA_53617.pep
FIPLTLDRNWKWIKGEQARSKCSALLPAGQDPTLYQESVLRREGKGGCCRGTREGNRRRRRQIPPYTSVSPECAHIVPDTKLKNKIGKTLNEHKWNAGFTHQGSLHIASVLNRXIQSGGVHPSIRGEVWEFLLGCFYPESTLDDRGH

SEQ ID NO: 159200 - protein, 93 aa, Triticum aestivum
  Clone ID: PAT_TA_53618.pep
FNLVVFYLIFFFFVFLCFFIFVSFFFFALFFFFFFFVFFFFFFFFFFFAELVQNSLLSPTNELDRIMAYNAQRVSRVAPKQSNATKGDKKQIL

SEQ ID NO: 159201 - protein, 80 aa, Triticum aestivum
  Clone ID: PAT_TA_53619.pep
SGSYPASNHLLFSTNIALEINLFGMRWHLSSVLAFQDANLGAIQLDSVCCFGVIERISVLISVTCCAYGTKFCQFILQVN

SEQ ID NO: 159202 - protein, 211 aa, Triticum aestivum
  unsure (1)..(211): unsure at all Xaa locations
  Clone ID: PAT_TA_53620.pep
HDTDKVATLRAYRRATGLCFTCGERWGRDHRCPAXVPLHVIEELMQMLETEDNVMPTENEQQSDEVANCVAISFHALDGTASPKALQLQGWVGDTKVLMLIDSGSPSSFINQELIRTEIXSNSSARRLRVRVVDAGELACTHEVVDCQWWSXGQQFSCSLKVLPLHGYDIILGMDWLESHSPTQVEWEKKCIEFQHHGSCIRLQGLLNRGP

SEQ ID NO: 159203 - protein, 84 aa, Triticum aestivum
  unsure (1)..(84): unsure at all Xaa locations
  Clone ID: PAT_TA_53621.pep
ESMIIVQYIDEVFAGTGPSLLPADPYERAVARFWVPYVDDKLVAPWRQWLRGKTEEEKSEGKKQAFAAVEVLEGALXECSKGGG

SEQ ID NO: 159204 - protein, 196 aa, Triticum aestivum
  Clone ID: PAT_TA_53622.pep
QEPKWDIQVSLCDGQLGVFRGGCLHLLIHLDGLAIVDAQGLKWRTIPVPNFIDPSFSGFIGKSAGQLFYINSDDSEEGYGSTSFSTISVYVLGSGIYNWDASYLDDGCTHWILLHKLSEVIPKENFCLGWDLKVVGVHPHANIIFMADFNNNELLAYDLDHRESTSVHHIERTYLAHEQYFPYVPLLSNLPVPTPS

SEQ ID NO: 159205 - protein, 100 aa, Triticum aestivum
  Clone ID: PAT_TA_53623.pep
KKKKKKKKKKKKKKKREERFKGIQIYVHKACKVGGSFLGTPFFIALPGVFQRFVGETLVDSHVRRLTARGLFNRWRTRDEARPDRPSLRLGSWNGEGHAP

SEQ ID NO: 159206 - protein, 199 aa, Triticum aestivum
  unsure (1)..(199): unsure at all Xaa locations
  Clone ID: PAT_TA_53624.pep
ERPVRHGRSSPAPRARGPSRLGGRSGRRRPLPRAAHRVQVQRDLYLHRAIPRPAFLHGPGQRHGGVRARRDHPQLHARPAQGRQLRAGDDALKVQSWARPPGPVAARSTAGGRPPASCSRGRAGAARRRSSSDGSSSWSTSTSPPTLPTAVALRQRQDHAAAQLGRGQSRAQAGPPAPLAVRARSSSGERXPASCSRGS

SEQ ID NO: 159207 - protein, 135 aa, Triticum aestivum; identical to SEQ ID NO: 140221
  Clone ID: PAT_TA_53625.pep

SEQ ID NO: 159208 - protein, 125 aa, Triticum aestivum
  Clone ID: PAT_TA_53626.pep
MRTAATAAEAHQSRLLYELGALLLTIIRSPLGPGEEPRQVTAAGVASMMLGASMALMLCGSVTFMLGFFLMPWVVGLACVFLFVGFLTNLSGIWRAILCWPAACSSSSPHKDASTWHIFPKPPFM

SEQ ID NO: 159209 - protein, 71 aa, Triticum aestivum
  Clone ID: PAT_TA_53627.pep
LCELNPRCLNRSVPWLSVEKERNEMRREKRCTSTLGEGWDEWGMIVQRTASSSFIGMCAENYTHYILEWRE

SEQ ID NO: 159210 - protein, 53 aa, Triticum aestivum
  Clone ID: PAT_TA_53628.pep
NQPVHVPQLEGRRCGECSQVLPESYEPPADEPWSNGIFGCTDDPESWAQCWSW

SEQ ID NO: 159211 - protein, 53 aa, Triticum aestivum
  unsure (1)..(53): unsure at all Xaa locations
  Clone ID: PAT_TA_53629.pep
IDNIEEYTPIVYTPTVGAICQNYRXXFRRPRGMYFCAEDHGEMMFMVYNWPAD

SEQ ID NO: 159212 - protein, 193 aa, Triticum aestivum
  Clone ID: PAT_TA_53630.pep
MEAAAAAAVALRSPAAAGAAPSRRVAAAASSLPFERRRSFALGSIKGLGRRQRTSRRLRGVIRASSSSPSESLPSSSPIAPLQMESPIGQFLSQILVTHPHLLPAAAEQQLEQLQTVQDSADKKDAQAPPAAGDIVLYRRIAEVKEKERKRTMEEILYALVVQKFVEAGVFLVPALSHSIDASSGRVDQWAEH

SEQ ID NO: 159213 - protein, 58 aa, Triticum aestivum
  Clone ID: PAT_TA_53631.pep
ALAIPNLSPFKQEWYILARNYITTQGFMGGLEKRQPGSGRTIQLALREGHTAAGQNTG

SEQ ID NO: 159214 - protein, 86 aa, Triticum aestivum
  Clone ID: PAT_TA_53632.pep
HHQSLFSVTLFFSAGEIPMIVPMTPPAVYFGMRVCWRQNAKVWKQLYRCKHQSRTPPLQPYLHEKTFPVCNDIHTHHRFIVNLMHV

SEQ ID NO: 159215 - protein, 82 aa, Triticum aestivum
  Clone ID: PAT_TA_53633.pep
FTQKWRAPQKGQVRSVNPVVVVPVGFAQTSKRVRFMPLLFSCNFDERAPPGFRMGIKNPNPPPPSPPMAQIFAHLVHQEPFP

SEQ ID NO: 159216 - protein, 88 aa, Triticum aestivum
  Clone ID: PAT_TA_53634.pep
TLREKVQVEWIVRQSRNATTAKRKEKKSGARLATTRATRSRRWADFFFFFFCGKGGLTLHAAKKRLWRHSDRTAPEAADQTNKSSACF

SEQ ID NO: 159217 - protein, 41 aa, Triticum aestivum
  Clone ID: PAT_TA_53635.pep
TSNLPTIHLELHCKEQFPCVFVSPSCTPTPAPVLNLTPASP

SEQ ID NO: 159218 - protein, 203 aa, Triticum aestivum
  Clone ID: PAT_TA_53636.pep
QQRLLDLAAELEEERRLRRAAEESLASSETRLGRLKAFAQDALRKRDDLKAESAASSRALQALQAEAATASSMLSSGLERISAKASPSTPPAPLPTSGKYSAGLPALAYGVLKRANDIVDDLLAQIDAAGRDRDRARQDMDQRNYQIAIEVSELEAAVASRAAESESLSRSLSDREAEISALQDKVRSLEAKMDAQRPLLAEQ

SEQ ID NO: 159219 - protein, 49 aa, Triticum aestivum
  Clone ID: PAT_TA_53637.pep
RLTTPSSSTSPRFRMASHAPGAQLPVAFSSELFTKIQTQMMYCIRHFRV

SEQ ID NO: 159220 - protein, 92 aa, Triticum aestivum
  Clone ID: PAT_TA_53638.pep
SAPWHGAKIMVPAKFIGGEKDIGVESFGVKRYIESGGFKSNVPDLEVSIIEGHHFLQQEQAERVNFEILSFLDKLFGEEAHNKNEVGEEVGN

SEQ ID NO: 159221 - protein, 53 aa, Triticum aestivum
  Clone ID: PAT_TA_53639.pep
HIYKDAHPPIIYNDTPKNTNYMATRFVTKINCSLPFEILVAYANLNKPKNAKQ

SEQ ID NO: 159222 - protein, 130 aa, Triticum aestivum
  Clone ID: PAT_TA_53640.pep
DSRPSDQTYSSHPEVESWTSPDLSAGGLGQSVKPSRLRSYVMSFDSDTLQTYATIRSKVAFGIIEKHTEALFGKPEIVITPEGTVDSSKDEYVRISFSGLRRLILEAVTFGSFLWDVESYVDSRYHFVTN

SEQ ID NO: 159223 - protein, 101 aa, Triticum aestivum
  unsure (1)..(101): unsure at all Xaa locations
  Clone ID: PAT_TA_53641.pep
LEYLFIFVRFEDCLIGKVFLRKLRPLPVLEPARRPLWIHLXPSSPDSTRVRGRPHQHQAPPRPRHTPRATRTQDEDAPRQHARARNPPPSNPQAHRDVPPP

SEQ ID NO: 159224 - protein, 93 aa, Triticum aestivum
  Clone ID: PAT_TA_53642.pep
YSISIFCNSYKDFSRQTINIGTPKKKKKKKKKKKKKKKKKKKKKKKKKKKKKKKKKKKKKKKKKKKKKKKKKGGGGLKGPNFTTGGGEGKIFF

SEQ ID NO: 159225 - protein, 105 aa, Triticum aestivum
  unsure (1)..(105): unsure at all Xaa locations
  Clone ID: PAT_TA_53643.pep
STSFQNXPNSSSSRNHSVHQDLTKPTNQAEPGQLRHEGLRRGTIPAAPIHVTRACLPSFKKKKRACLPCEDRPGAAALRGGARGDRGLALGFDGFGEEERRRRGS

SEQ ID NO: 159226 - protein, 96 aa, Triticum aestivum
  Clone ID: PAT_TA_53644.pep
MARTKQTARKSTGGKAPRKQLATKAARKSAPTTGGVKKPHRYRPGTVALREIRKYQKSTELLIHKLPFQRLVREIAQDFKTDLRFQSHAVLGLQEA

SEQ ID NO: 159227 - protein, 56 aa, Triticum aestivum
  Clone ID: PAT_TA_53645.pep
IRTCRKCTVLRTSASYRDQSPLALHVVYQGICLGSDKPLRYRVFLRQQHRAETARR

SEQ ID NO: 159228 - protein, 150 aa, Triticum aestivum
  Clone ID: PAT_TA_53646.pep
PRDAGGNGGLLPLRHRALPLHAGGTLGPALLLAAKRTPATRVAADPSGQFPGCFWGPLRPELGPGPGPCAARWMAPLVRTCAWMITCHIVRFGFTLGTVVDLLLYTLMIAGPNDSITKSTVESTAPYVALGLLYYYLLYLYWTRDTIRAM

SEQ ID NO: 159229 - protein, 112 aa, Triticum aestivum
  Clone ID: PAT_TA_53647.pep
MRSPTAARMASHHTLLCSSRRHSPSRPAPTSSSSASAATAEDSRSPATMSTSSLATSRARAVRSSVTPSSSACAVSRTRCMACRVRSTTSCRMWIFNTTPSSSSSTPATARS

SEQ ID NO: 159230 - protein, 207 aa, Triticum aestivum
  unsure (1)..(207): unsure at all Xaa locations
  Clone ID: PAT_TA_53648.pep
MGPPQGRCFGAPWAWRIGEQSMPYIRRSLDAMDDQEGGWNGGAGLLFSLRFDPMRAGFDPTLASFPVSALISRLLGWGKNSGQGRPQGAVMVAAAVALYVAALCASDQQPRRRRLAASAAARPTSATRPRALPAPDDGLRILSSNDEYLENVIHSVSIGAGDDEPILVARVQTMPPDMAGATSAWETERDXLEKEEVERFKQLWLSL

SEQ ID NO: 159231 - protein, 72 aa, Triticum aestivum
  Clone ID: PAT_TA_53649.pep
NCGSGCSCGSDCKCGKVYPDLTEQGSAAAQVAAVVVLGVAPENKAGQFEVAAGQSGEGCSCGDNCKCNPCNC

SEQ ID NO: 159232 - protein, 181 aa, Triticum aestivum
  Clone ID: PAT_TA_53650.pep
MSSGGGGGGDQGRHGLYHQHGHGQLTRYDGAGGYELSNDDMESFFFSQPEGVGGGVRADEIAPYSSITSYLQGFLDPTGLARHLDVPAKHELSVDVRSHDQDSQGTGSAAGESAALLTPNSSVSFSSGGGDGEGKSRRSKKGRAQEPDDQEDGKDHEDGESSKTANNKPKKKAEKRPRAAP

SEQ ID NO: 159233 - protein, 54 aa, Triticum aestivum
  Clone ID: PAT_TA_53651.pep
EPPRFFFVFAKTNSCPSLTKNSKYKYVYGSGPFNILYLEFFVKLVQEFFLAKQT

SEQ ID NO: 159234 - protein, 36 aa, Triticum aestivum
  Clone ID: PAT_TA_53652.pep
SLTVRPLLSGDTNRDDLTLAPFHKCGCGRCSAAPSS

SEQ ID NO: 159235 - protein, 146 aa, Triticum aestivum
  unsure (1)..(146): unsure at all Xaa locations
  Clone ID: PAT_TA_53653.pep
MGMKWHVVAVLGVACTVAAAVAADRGLLFAGAVAPPEEASYDLRKLASSLWQSDGTAYHHVWPPMKLGWKIVLGSFIGFFGAAFGSIGGVGGGXIFVPMLTLIIGFDPKSSAAMSKCMXIMGAAVSTXVYCNLKLKHPTLDMPVID

SEQ ID NO: 159236 - protein, 47 aa, Triticum aestivum
  Clone ID: PAT_TA_53654.pep
NNKACSRILVFLSIIPGSSTPIHFPMLTAYEYHTENLSRLGAWLPPT

SEQ ID NO: 159237 - protein, 80 aa, Triticum aestivum
  Clone ID: PAT_TA_53655.pep
QREQETMSGGGGNRGGKNNTDTLTEESKRGREKSKVQWALKKAPTKGYDWASDTKEHINHQRAVAIEALVKGLEGGGPGH

SEQ ID NO: 159238 - protein, 56 aa, Triticum aestivum
  unsure (1)..(56): unsure at all Xaa locations
  Clone ID: PAT_TA_53656.pep
LFLFFFLKCPWGYCHXKHLPLYNNPRXTRKNIPPXTNLSXPFFFPGIXDLFLGAFF

SEQ ID NO: 159239 - protein, 55 aa, Triticum aestivum
  Clone ID: PAT_TA_53657.pep
KKRLKLKLGFMKERQWRVELSWCPTRFGRPDGTGFLLLPDDKLVPGYQCLFIDLC

SEQ ID NO: 159240 - protein, 127 aa, Triticum aestivum
  Clone ID: PAT_TA_53658.pep
PARSSSTRFNSTRVSPKVPTVSYNIAQVTYELNVLGTRGPRRMRCIMHSIPASSVEPGGVVPGQPEQIVPRALGDSFRSITSFSQSFRSSATFSRSIMDQSMDFNSARFSEISGGGMTDGDGEGEVK

SEQ ID NO: 159241 - protein, 72 aa, Triticum aestivum
  unsure (1)..(72): unsure at all Xaa locations
  Clone ID: PAT_TA_53659.pep
FGRGGAPLFPKKKKKKXKKKXKKXKKKKKKXKKKKKXKKKXKQKKXKKXKKXKKXKKXGFSYQLTYCHAIVI

SEQ ID NO: 159242 - protein, 61 aa, Triticum aestivum
  unsure (1)..(61): unsure at all Xaa locations
  Clone ID: PAT_TA_53660.pep
HQPXQMSNMIXXXINLHILXXXSPSYPNYPHSIXSCXFSQPHXLQGGGEXXYXXXIXXXSS

SEQ ID NO: 159243 - protein, 85 aa, Triticum aestivum
  Clone ID: PAT_TA_53661.pep
HGATELLLHCFKGTVRTPFTEYKSYRKNYMHLHYGDSYTTNLGGIIYVLTIVSRILHRSTLLYIVPEIFSRCTRGRLLVYTICTT

SEQ ID NO: 159244 - protein, 144 aa, Triticum aestivum
  Clone ID: PAT_TA_53662.pep
SRFSPPPLSLALFTHSSLFTRRSCSVSIAIFSSVRSSRPSLPCCSTLRRSIRLLSASLFLSSPSIVIALCASRPRWRRSSSACGSTYHTPRDFVVVRNTELDRTIRPTWLIFSKNIFKDGGMRAACPHCVQFLRKADSRTKQPF

SEQ ID NO: 159245 - protein, 82 aa, Triticum aestivum
  unsure (1)..(82): unsure at all Xaa locations
  Clone ID: PAT_TA_53663.pep
HLCDEPKGLKTGMCMAXIFPFAIANALTARLDDGNPLFDEQLVLLIYCLFTVALYMHFATSVIHEITNALGIHCFRITRKKA

SEQ ID NO: 159246 - protein, 56 aa, Triticum aestivum
  Clone ID: PAT_TA_53664.pep
GARCRPPPRRTVSHRKQQLPCERHAEIRLPKSKGSRPTAYVYLEFFVKLVQEFVLP

SEQ ID NO: 159247 - protein, 39 aa, Triticum aestivum
  Clone ID: PAT_TA_53665.pep
FMEEVLSPPPPGEIVYFTWKTLLIRLDHLIKTRMSRCFN

SEQ ID NO: 159248 - protein, 117 aa, Triticum aestivum
  unsure (1)..(117): unsure at all Xaa locations
  Clone ID: PAT_TA_53666.pep
MARTKQTARKSTGGKAPRKQLATKAARKSAPATGGVKKPHRFRPGTVALREIRKYQKSTELLIRKLPFQRLVRXIAQDXKTDLRXQSFVVFALAYGRTRLPEGDWDTQLVKFIDSPG

SEQ ID NO: 159249 - protein, 89 aa, Triticum aestivum
  unsure (1)..(89): unsure at all Xaa locations
  Clone ID: PAT_TA_53667.pep
PGNWNPLLAPGNLPPGKGLGLPGRGRXPVGWFPQGPGXRPTERIPGSPPSLLRSSPNPIRARKFPRRPWRGNLRMASXGLRRXGFSESG

SEQ ID NO: 159250 - protein, 38 aa, Triticum aestivum
  Clone ID: PAT_TA_53668.pep
KKSIIDQKSRSSLDHSPEGGATTRSMRADDSLCFVWWR

SEQ ID NO: 159251 - protein, 131 aa, Triticum aestivum
  Clone ID: PAT_TA_53669.pep
AFRVIGGDDDAVRVVRVMANNDLTVFRQLDTSGEWVVEKLVRLPEATSGLPEREETYFHGPAKIVATTTRHVLVTPQEETWIFSIDLETLEVDQAHERNRYAGAGYPFELPWPPALRADNRRRCSRMDLTV

SEQ ID NO: 159252 - protein, 141 aa, Triticum aestivum
  Clone ID: PAT_TA_53670.pep
NLHNRARAVDGVGPVAWDNNVARFAQDWAAQRAGDCRLQHSGGPFGENIFWGSGQSWTAADAVKLWVDEKQNYHLDSNTCDAGKVCGHYTQVVWRKSTRIGCARVVCAGNRGVFITCNYNPPGNFNGERPFAFLTLDAEAK

SEQ ID NO: 159253 - protein, 55 aa, Triticum aestivum
  Clone ID: PAT_TA_53671.pep
AVQVTQNFANYFISQARKSSNSPPADKVLVNLIYNYIPTFSGKTSKSFELVYLFS

SEQ ID NO: 159254 - protein, 59 aa, Triticum aestivum
  Clone ID: PAT_TA_53672.pep
DGPRMKPQTGKEQITGNLLLRTARTNQFTQTVGVCALGSITNETSQFLKTDIRICAHLP

SEQ ID NO: 159255 - protein, 86 aa, Triticum aestivum
  Clone ID: PAT_TA_53673.pep
AGDATLCNAWITTTGLLSIHISARRDKGISGCYGCTKGWLQAAALCPGSAVVDHRQVPLPWWWTRRLILLQQGDWAVELSVVCAFL

SEQ ID NO: 159256 - protein, 79 aa, Triticum aestivum
  Clone ID: PAT_TA_53674.pep
MILLLLGLIVIAQVFIIIAAVGVQSWPILPSSSMLAMASISSLPVFAEKKSPLPRIPLGMNGGSEHDSFTLVFLCSQMQ

SEQ ID NO: 159257 - protein, 198 aa, Triticum aestivum
  unsure (1)..(198): unsure at all Xaa locations
  Clone ID: PAT_TA_53675.pep
PPPPPPXPPPPPPPXPPPPPPRPPPXXPXPPPAPPPPPPPPRGPPAPARAPARGRGPPPPPPGGPVRARPVAPPVPARVPVPPPGRAXXLRAPPPPAXGVPARXPAXASCRAXPXGSXLSXXXPPCPASAAPXXGPPPGXPPPSWAGVPLAGAARARRSFGLPAFLFSPPLSFSLSAPCVGVGALPRPVVCLSGLCFR

SEQ ID NO: 159258 - protein, 87 aa, Triticum aestivum
  Clone ID: PAT_TA_53676.pep
KLGQVTIASLSHSQKQNRRSFGDGGGGAGAGAGLMGNVKQENQPLRPFFDEWPGRRDSWSEMDDERSNGTSFSTTQLSISIPMPRCD

SEQ ID NO: 159259 - protein, 186 aa, Triticum aestivum
  Clone ID: PAT_TA_53677.pep
INLPLGTTGQHVGDWEHFTLRVSNFTGELMAVYYSQHSGGRWVDAAKLEYAAGNRPAVYSSRNGHASYPRAGVYLQGSAALGVGILNEAARSKLSVDSSVKYRVVAAEYLGDGVVAEPQWLQFMREWGPTVIYRSRTGTERMVKSMPQRLSCPAENMLNKMPNELSKEEGPTGPKEKNMWEGDERW

SEQ ID NO: 159260 - protein, 167 aa, Triticum aestivum
  Clone ID: PAT_TA_53678.pep
LAMFALAIVMAVVADVSAQNTPQDFVNLHNRARAVDGVGPVAWDNNVARFAQDWAAQRAGDCRLQHSGGPFGENIFWGSGQSWTAADAVKLWVDEKQNYHLDSNTCDAGKVCGHYTQVVWRKSTRIGCARVVCAGNRGVFITCNYNPPGNFNGERPFAFLTLDAEAK

SEQ ID NO: 159261 - protein, 191 aa, Triticum aestivum
  unsure (1)..(191): unsure at all Xaa locations
  Clone ID: PAT_TA_53679.pep
MALNYPSCSFLVSDECSALMRGCGCWSEEASPLSSPGVNSRRWDDFEPDPADLLPADPFGMNLGNTITAAIASCLDRTVMSGAGRFVGSSDGGAAVRADLSYYLDLNHAIALSWEPPFLPGGCRRAFEGPFGFGGLYAAGGANCSQGLPXLASCSRQIVPGEDPSTSGSAALVCRDGVDARGASCSWALYP

SEQ ID NO: 159262 - protein, 124 aa, Triticum aestivum
  Clone ID: PAT_TA_53680.pep
HPPRPPPWRRPPPASPFPRGGRRNGRPPPQPLRNPRQRGRRRGDPSQPPPPSPRGGACPSAGRRRYPVGVAAGRQQSASCPIGVAAVAVGYALEDPPPSAAEAVLPPPRIRRLQALARHRRRPQ

SEQ ID NO: 159263 - protein, 77 aa, Triticum aestivum
  Clone ID: PAT_TA_53681.pep
FPVSLGEKKKHPCVNKKETRLFPGVEGFFNATGTKCFSPGKRAVRVWQFILVGLLFWDPRLFPFCFRVVCFLKFFSD

SEQ ID NO: 159264 - protein, 65 aa, Triticum aestivum
  Clone ID: PAT_TA_53682.pep
HASAQVHQCCSLLWHCSSKFSFLPEIYSVLLQQVSWMFSLCPRRSVLPFIFLRTRQWTSFTLHTY

SEQ ID NO: 159265 - protein, 63 aa, Triticum aestivum
  Clone ID: PAT_TA_53683.pep
VHDQGAMIDDIDTHIDNSVAATAQAKGQLSKAAKTQKSNSSLICLLMVIFGVVLLIVIIVLAA

SEQ ID NO: 159266 - protein, 102 aa, Triticum aestivum
  Clone ID: PAT_TA_53684.pep
ELPVLLIHHDPDIWGSDVHEFKPERFADGIAKASKDPGAFLPFGWGPRICIGQNFALLEAKMALCMILQHFEFDLAPTYSHVPHNQKMLRPMHGAQIKLRTI

SEQ ID NO: 159267 - protein, 76 aa, Triticum aestivum
  Clone ID: PAT_TA_53685.pep
KKLKLTHPTQEKRATQVFMIKPRGKFVRKNRQNIYWTSYTFARSYHEALFCFVLAMLRRSPKSLSSGFAGLVRCAV

SEQ ID NO: 159268 - protein, 67 aa, Triticum aestivum
  Clone ID: PAT_TA_53686.pep
RRNFSNSLHGCQVNFFVSQIHKQSKKKKAYFCIKKTCCISHSSPHSGGGKVQEHIFWMVGAPLSLGK

SEQ ID NO: 159269 - protein, 78 aa, Triticum aestivum
  unsure (1)..(78): unsure at all Xaa locations
  Clone ID: PAT_TA_53687.pep
FEPTFFQVFEKKVKAWCASKGNIPYFXTFAKKGFNVEPPFECIPRNAIKNDPEEDIYLPDPIHMGGAGRQHPSSGCEC

SEQ ID NO: 159270 - protein, 78 aa, Triticum aestivum
  Clone ID: PAT_TA_53688.pep
KRNRNLILGCRPPWHKFSLRPPNRSKKGKSPINWRVRRLNTPRCYEYSADIVLPLGPVHPFDTSAGGSQSCQPRDVIM

SEQ ID NO: 159271 - protein, 60 aa, Triticum aestivum
  unsure (1)..(60): unsure at all Xaa locations
  Clone ID: PAT_TA_53689.pep
FFFFFFFFFFFFFFFFFFXFFXFFFFFFFFFFSPFPRAPKKKNQPAQKEKKGGAKGAQSG

SEQ ID NO: 159272 - protein, 30 aa, Triticum aestivum
  Clone ID: PAT_TA_53690.pep
YCHYHSRWLIIKKNITTPHTHDIIHVLRTH

SEQ ID NO: 159273 - protein, 50 aa, Triticum aestivum
  Clone ID: PAT_TA_53691.pep
KKKGGNQLQQTTTCHGLQISNTVPFHDNIIGGVEETFWDKMNWGVRNWWA

SEQ ID NO: 159274 - protein, 81 aa, Triticum aestivum
  Clone ID: PAT_TA_53692.pep
PGPREFPLLRRAPPPGFPKGPVWFFPPFKCFKPFFKPVLLFFFLGPRGFIFASIFLPFVCFGLSPRGGVAPFENKGLIFLV

SEQ ID NO: 159275 - protein, 92 aa, Triticum aestivum
  Clone ID: PAT_TA_53693.pep
LFLFFFEKRKTNPFFFVTLPGGKPLFFQCFRRGFLFFSGENQTQIFFPLKCPSLTQNPQSFKYPVYPPRPLFGFFGPPPTFSPGAPPFFPFF

SEQ ID NO: 159276 - protein, 97 aa, Triticum aestivum
  Clone ID: PAT_TA_53694.pep
LRSGRLDRKIEFPHPTEEARARILQIHSRKMNVHPDVNFEELARSTDDFNGAQLKAVCVEAGMLALRRDATEVIHEDFNEGIIQVQAKKKSSLNYYA

SEQ ID NO: 159277 - protein, 125 aa, Triticum aestivum
  Clone ID: PAT_TA_53695.pep
RFLGAPAEAHRRGHRRRHRRLTVAPPTDLRAAAGQECMGAVRMPKRNQQDHPKSPWRRRWMRTRTRTTMRTMTRSIGPTMTWVKPYTGSTPLRARHGIDASLLNILGRRKRLMRLGCPNAHCRNC

SEQ ID NO: 159278 - protein, 76 aa, Triticum aestivum
  Clone ID: PAT_TA_53696.pep
AEPERTRRRREQLRARVNALLNAEQFLSTASLACFSCPGIQCPRIPPTTLASQVCLRALRRTPDWVDRLVEVGEGG

SEQ ID NO: 159279 - protein, 75 aa, Triticum aestivum; identical to SEQ ID NO: 106874
  Clone ID: PAT_TA_53697.pep

SEQ ID NO: 159280 - protein, 247 aa, Triticum aestivum
  unsure (1)..(247): unsure at all Xaa locations
  Clone ID: PAT_TA_53698.pep
CGLHEASGRLVLLKDHLSTLSLNVISRMVLGRKYLEKQAAGEDGSATMAPEEFKCMIDELFFLNGVLNIGDSIPWLDWMDLQGYVRRMKKLSKKFDRFLEHVLDDHNERRRLQGDNFVSRDMVDVLLEIAGDPNLEVKLHRNGVKAFIQDLIAGGTETTAITVEWAMSEMLKKPEVFSKATEELDRVVGRERWVTEDDIXNLPYVEAIVKETMRLHPVAPMLAPRLSREDASVGGYNIPVGPRVLIN

SEQ ID NO: 159281 - protein, 160 aa, Triticum aestivum
  Clone ID: PAT_TA_53699.pep
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLVDSGRAASSKKGSVR

SEQ ID NO: 159282 - protein, 176 aa, Triticum aestivum
  Clone ID: PAT_TA_53700.pep
MSYSRYRSRSRSVDSSDVENPGNNLFVTGLSSRLTDQDLEKHFSTEGEVIDASIVLDPWTRESRGFGFVTMATLKEAERCIKYLDRSVLEGRVITVEKAKRRRGRTPTPGRYLGAKSSRGRRYLRSRSPVRRDRYSSRYSPERERSYSPYRRGRSYSRCDRRRSYSRRRSYTPSNR

SEQ ID NO: 159283 - protein, 100 aa, Triticum aestivum
  Clone ID: PAT_TA_53701.pep
RTAGVYACCRIGRGRYPLTVYCFQQQREKKKKKKKKKKKKKKKKKKKKKKKKKKKKKKKKKKKKKKKKKKKKKKGGGRLKEPKFTSRGLQGKIFFMGPPK

SEQ ID NO: 159284 - protein, 63 aa, Triticum aestivum
  Clone ID: PAT_TA_53702.pep
TYTGKPQVCICTHAPQSTYVDCLPPFNVLFIVNLFLSFLASSFMAYGLYSFWTIRMMNKVFPP

SEQ ID NO: 159285 - protein, 108 aa, Triticum aestivum
  Clone ID: PAT_TA_53703.pep
GREFPGEPPGPPRFGGRDKKIGFPPPPEKARARVLQIPPRKMDGPPEAPFGGRAGPTEDFPGAPLKAVWVEAGMPALPRGAPGGAPEDFPGGLTPGPPKKKAPLNYTA

SEQ ID NO: 159286 - protein, 73 aa, Triticum aestivum
  unsure (1)..(73): unsure at all Xaa locations
  Clone ID: PAT_TA_53704.pep
AVAVERSLPPQHRMVFAMLKDLVNEVHSADLVSPTLIXIGKVVALSPLWVESSEHDALNNENSSQPSTTVSPV

SEQ ID NO: 159287 - protein, 84 aa, Triticum aestivum
  Clone ID: PAT_TA_53705.pep
FPAVSKTKSTHGLGRERGDKKSKRRDFISAKEIDYFLCSAGGRVNSFIRKCSPAAVYPVAISTYFLFSPGHLIQCKLLNKMNRV

SEQ ID NO: 159288 - protein, 111 aa, Triticum aestivum
  Clone ID: PAT_TA_53706.pep
VEMLQPAGHLLWLRRQQRTVREAKNGCIEQRMKQPQIASELPSLFLLSVSFRNPRELCTRQQPWHSSLQACMHGLCLEWVQASGRVHLIEENDHGHGQRRVQVWLHHQAEH

SEQ ID NO: 159289 - protein, 166 aa, Triticum aestivum
  Clone ID: PAT_TA_53707.pep
MVLPEVSGMAGAGAEEAVVGESFEFAFDKEAFSDKKLRVEVVGSDDAASRKRRREDDKSDEGECVDSSSIVMAAPILRVTTMHINSAILAAKSPFFFKLFSNGMKESDKGQATLRIADSESAVLCLDLPYSISMAPALAVAAKKFFAERYKDFLSTKLQDELVRIP

SEQ ID NO: 159290 - protein, 166 aa, Triticum aestivum
  unsure (1)..(166): unsure at all Xaa locations
  Clone ID: PAT_TA_53708.pep
PKKRLPPGPWTLPIIGSLHHLVGVLPHRTIMELSRRHGPLMLLRLGEVPTVVVSDAEAAALVIKTNDLAFASRPCSPTQEIFGCGGKGILFAPYGDHLRKMRKVCNVALLSSQSQVXQVKRMEAIRAEEVGNLLHCITPAASTGTTINLSDKVAKLTNHVVCRSVY

SEQ ID NO: 159291 - protein, 79 aa, Triticum aestivum
  Clone ID: PAT_TA_53709.pep
IHPFIRHVISDGGTIYASKQVDEEAKPSMRASTSSRPLPCGAEDEEAEQSRAPSYSSSPSSESGGRGGHASVIRRSFCN

SEQ ID NO: 159292 - protein, 145 aa, Triticum aestivum
  unsure (1)..(145): unsure at all Xaa locations
  Clone ID: PAT_TA_53710.pep
LLNPKIREEGDRASRPSGGHGPWRSSSEIHLPRSSGEHNRPLARLCARRRLRAHLRASPIFPTHLRRQIGFASSSRALTEMLLRMLLLGHCPRHGAGASARPARRSSPSAVQMHQRLCLLLVRFPCPRLWVAFAAXFLCSFGGGG

SEQ ID NO: 159293 - protein, 75 aa, Triticum aestivum
  Clone ID: PAT_TA_53711.pep
TTNKFTFICNKKWVHFIPDNTRVVQQASSGTSYRPQKNNGQLSEQIIEALLQLCARLAGIQHWKLFRNKIVNQDR

SEQ ID NO: 159294 - protein, 48 aa, Triticum aestivum
  Clone ID: PAT_TA_53712.pep
RKPRFFKSPAPLIFVFFIFGPPFFFFFFFFFFFFFFFFFFFFFLPTRT

SEQ ID NO: 159295 - protein, 87 aa, Triticum aestivum
  Clone ID: PAT_TA_53713.pep
LVRPRYSALFTSFHTKVPQVAGALAPRDPARPPSPLERARASSGRCTDSPTTEQAAGGRQGVLAPGGGGGRRPRYEIWSSLVRLSTG

SEQ ID NO: 159296 - protein, 133 aa, Triticum aestivum
  Clone ID: PAT_TA_53714.pep
KSPGAHPRVAGPFPTSRTCSQGPAGGLQQRHPSPPLPGRKSADFLTKQLTWLANGRNHHIGRDSQWQTNNCSLPRADARRFMDRRKGKRLMSGGDSLNRSQLYPLAGVGHSILSNRRKKGRKRGANTMGHARE

SEQ ID NO: 159297 - protein, 144 aa, Triticum aestivum
  Clone ID: PAT_TA_53715.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVECSDTIDNVKAKIQDKEGIPPDQERVIFAGKQLEDGRTLANYNMQEECTLH

SEQ ID NO: 159298 - protein, 181 aa, Triticum aestivum
  Clone ID: PAT_TA_53716.pep
LQQPCHLLPPPNQVLVRTSSNVTWCSKNTIACMQLANVTSAWHACMQRLVNIAVERELSSRELTREDETHGRACTFHARTSGHQPAGEEDVGTTYVGRITRKAWTRRRRSVTATKKPRPPIAPHMPLARKSRMRPKVSPMAASPPTTTRAEDLTTGALPSTAPTTPNAASASVATATTTAT

SEQ ID NO: 159299 - protein, 83 aa, Triticum aestivum
  Clone ID: PAT_TA_53717.pep
DKPPSIVSAGGGFGGGRSQYHLRQVGVFLDLHFINKPELFVQAFQQPPKFDSDGNLIDAEIRERIKQVLLSLQAFTLRVQKKD

SEQ ID NO: 159300 - protein, 136 aa, Triticum aestivum
  unsure (1)..(136): unsure at all Xaa locations
  Clone ID: PAT_TA_53718.pep
NRRGSIICPASTAXVLGGVGXPAYSVSKAPVVGLVRXVAGEMARPGVRVNAISPNYIPTPMVMGYMAESYPGASAEERRRIVERDMNEMGGPALAAEDIARAAVYLASDEAGYVNGHNLVVDGGFTVGKAPKMPAP

SEQ ID NO: 159301 - protein, 202 aa, Triticum aestivum
  Clone ID: PAT_TA_53719.pep
QQQVESFHELGKALRLLGGFYLVDLFPSWRLVRWLSSGESGISRSCGRIQKIITDIIEERQAVQAAGHGGSDEDLLDVLLRLQKEDTMEFPLTTEIIRGVLFDIFGGGTETSGTVLEWAMSELVRHPEAMAKAQLEIRDVLGQDRAIITNSDLGELQYMRMVIKESLRLHPPSPLVHSAAREDCTIMGYDVIKGNSVLVNIF

SEQ ID NO: 159302 - protein, 48 aa, Triticum aestivum
  Clone ID: PAT_TA_53720.pep
KRDSCSYSGSHTSCDGVCRATVCVSIQPAPCICNFTLLCKSSRNFLWP

SEQ ID NO: 159303 - protein, 125 aa, Triticum aestivum
  Clone ID: PAT_TA_53721.pep
GVRFGCGKPVLPVSPLNMLAEGGPFFFLRAWCLNGRQFFSKWEFKVFFFAVLCYGKNTWGGPEVPSAKVPGDNGIGSGWKIFWTRLHFLFPVGGPPSKKQGRVGNFLPFVCPVVNTGGLVPPIYG

SEQ ID NO: 159304 - protein, 105 aa, Triticum aestivum
  Clone ID: PAT_TA_53722.pep
VSLGVPMVAWPLYPEQRMNAVALVGSVGVALPLRPREADGVVARDEIAGAVKELMESAEKGRAVRRQAGDLQQAAARAWSPEGSSRRALEEVAATWKKATLGKVK

SEQ ID NO: 159305 - protein, 114 aa, Triticum aestivum
  unsure (1)..(114): unsure at all Xaa locations
  Clone ID: PAT_TA_53723.pep
PNPSTLQASFTGALHXRVDXGGSVLVALYEXGVVTDCGRGENKSKSLLNDHVVRRLEKVAAVRDGTSARKAVSGSVQFPLWDDFRATKCGIVLFVQNSALQVLGVQHFDLPDNV

SEQ ID NO: 159306 - protein, 78 aa, Triticum aestivum
  Clone ID: PAT_TA_53724.pep
LKKNSSKGQWSTVSIVLKQRLLAHCKQLSSASGIHSWREYMSGGTGSRLLGYEHPPIPPETVRAHLKADGAWPLPRLP

SEQ ID NO: 159307 - protein, 61 aa, Triticum aestivum
  Clone ID: PAT_TA_53725.pep
VTAQEEHNPPPLYTDGAIKDVVILTADDLHPFAFPHVLQNRSSLKATRMKSCVLRCANAMN

SEQ ID NO: 159308 - protein, 77 aa, Triticum aestivum
  Clone ID: PAT_TA_53726.pep
IQEYRCPMLEYELESKSAIVKMNNNFYFVIYAMSPILLFFLFGSIGLQPEEPENTTPVLCAAISPMASTRTISPTVF

SEQ ID NO: 159309 - protein, 62 aa, Triticum aestivum
  Clone ID: PAT_TA_53727.pep
NELQGGGPTLNQYGRPRTCYVSGTEILRASICFLELPWCWWSLLQPTKISSLSFGRCTPGAR

SEQ ID NO: 159310 - protein, 200 aa, Triticum aestivum
  unsure (1)..(200): unsure at all Xaa locations
  Clone ID: PAT_TA_53728.pep
MAAAVASSGGRKRKCEELSAPELGQLHEDMLERVLARLPPASFFRLRGVCRRWREAAGSPAFLXACARVPARDPWFLMLSDQQEEEEPRPPCPAVAFDAAEKTWAQCRAAPGPVPVAAAGGLVLYRAPETGALTVANPLSGVSRALPPPPPAATDALYAVAMYGSPYRVVLILGELPNLSMAVFNSSKNAWEDALPLARK

SEQ ID NO: 159311 - protein, 168 aa, Triticum aestivum
  Clone ID: PAT_TA_53729.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFVHGLKEVKC

SEQ ID NO: 159312 - protein, 100 aa, Triticum aestivum
  Clone ID: PAT_TA_53730.pep
GDSRATNPSSHRPPPSLPLPAATRDGRQRSRAAAGEGGGEVPAAPHLVGSFGTTGRRPWMGRRRRPRPTGGAASVGWPSRSRGRRWLLAGWSDWAAGPDL

SEQ ID NO: 159313 - protein, 90 aa, Triticum aestivum
  Clone ID: PAT_TA_53731.pep
VDATVRKDASGRAYLPYAQWPKAGCSPTLIKLGNLRVLPVELVVRAGQLNPIGSQDRIRYTVASTGLVTLDPLNRPPYFFLFILIFCFLF

SEQ ID NO: 159314 - protein, 130 aa, Triticum aestivum
  unsure (1)..(130): unsure at all Xaa locations
  Clone ID: PAT_TA_53732.pep
LNQLKLIVNVLGTMSEADLAFIDNPKARNYIKSLPYTXGIPLSSMYPQAHPLAIDLLQKMLVFDPSKRISVXQALEHPYMSPLYDPSANPPAQVPIDLDIDENIGTDMIREMLWQEMLQYHPEAARMVNM

SEQ ID NO: 159315 - protein, 96 aa, Triticum aestivum
  Clone ID: PAT_TA_53733.pep
NRAWAGHNPRPPTLGGPPMGPLRSGPPRAQMPTAWGEPAAITPASQSLNHLDLALPHPEGCAHPRTPPSYARTHGRNMDTSQTPPKPWPDYTQVGP

SEQ ID NO: 159316 - protein, 76 aa, Triticum aestivum
  Clone ID: PAT_TA_53734.pep
PPPPRACGPQAPAPKLPRKTPGRVFPASPPSIQPAKSRTPPPCLGKKPQGLFVNCPPLFALNPVVRVDFKKPKGVF

SEQ ID NO: 159317 - protein, 143 aa, Triticum aestivum
  Clone ID: PAT_TA_53735.pep
HRSLALLRRSTGSEKKAEPRLEMVADLEAATLLAGPVVSVDWSEKKVTPPTVMEASPFAGLASSIDRSKKKSEPLTKMEEDSEASFFAGPTFMVSPDPSELPMPTFIVSPDPSELPMPTFLYKHKVAKVLARLVAPMLIDQQD

SEQ ID NO: 159318 - protein, 82 aa, Triticum aestivum
  Clone ID: PAT_TA_53736.pep
RPPRPPPRPPPQPTTAARPPPPAPPSPPTAPAHTPRRRPRHPPPSATRRPMHALVSSGLQFISALTTPSQAAVVCDLLKSAS

SEQ ID NO: 159319 - protein, 146 aa, Triticum aestivum
  unsure (1)..(146): unsure at all Xaa locations
  Clone ID: PAT_TA_53737.pep
DYFVXQISNKARGFARFNYXYPPCPRPDLVLGMRPHSDVGLLTILSVDHDVGGLQVQRDGKWYNVPAKPYTLVINLADCMEIMCNGIFMSPVHRVVTNAKKERLSLGVFYVVDGEMVLEPAPGLLDDERPPRYGKFKANDFGFSFD

SEQ ID NO: 159320 - protein, 66 aa, Triticum aestivum
  Clone ID: PAT_TA_53738.pep
CTSHPSHQRPMVDPKPVVKRQAGVGVGVVGLCFSRSMGLPRSVECKCSSFMGLRTAMLDFRSIEMK

SEQ ID NO: 159321 - protein, 77 aa, Triticum aestivum
  unsure (1)..(77): unsure at all Xaa locations
  Clone ID: PAT_TA_53739.pep
PSPPARPPQQWSSSPRSHRRRLRHRPPPHPTKLPTTTCLDITSSESATLRRQHQSVLLIVALXPLLLRITHFSAIAN

SEQ ID NO: 159322 - protein, 77 aa, Triticum aestivum
  Clone ID: PAT_TA_53740.pep
IAPQSYINRLGAGDNYLLKSNDNYKRRYISLLLSSKALRYINLNLHMHVIHTQSVHGGLPFVNEQPYIGLIRDLSCM

SEQ ID NO: 159323 - protein, 42 aa, Triticum aestivum
  Clone ID: PAT_TA_53741.pep
LELVTRGRNNMCYLSVGRSVVFVGDAAIPSVMDWDVMLESYV

SEQ ID NO: 159324 - protein, 69 aa, Triticum aestivum
  Clone ID: PAT_TA_53742.pep
EGSRAHHARIRLQERQITPGPYGANISPGEDPPVVNPQERLGSRGVYNSLINGGAGPWEPHPGSQQGSR

SEQ ID NO: 159325 - protein, 148 aa, Triticum aestivum
  Clone ID: PAT_TA_53743.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLGDYNIQKEATLHLVLR

SEQ ID NO: 159326 - protein, 177 aa, Triticum aestivum
  unsure (1)..(177): unsure at all Xaa locations
  Clone ID: PAT_TA_53744.pep
ELGKRYPQGLPKLHPITDMGIEEPELVDLVHKLEDLEQKLCSHPLHKSDQSEQQLSWYQRKAELNHEIQQLKSKMRDSQLQKFRDELKNRSRVLKMLGHIDADGVLQLKGRAACLIDTGDELLITELMXNGAFNDLSHHQVAADGSWFVPGEKSSEQIRLRNELCKPMMQLQEGGRK

SEQ ID NO: 159327 - protein, 49 aa, Triticum aestivum
  Clone ID: PAT_TA_53745.pep
IHGPGFKNVGIGKTLGFPNLIALEKIPFSQVGVKAKRPPPFAFPKICPP

SEQ ID NO: 159328 - protein, 41 aa, Triticum aestivum
  Clone ID: PAT_TA_53746.pep
GGHRGTLLSLYGGDPPHRSMRCTIHPARPDPPTSPSDGRVG

SEQ ID NO: 159329 - protein, 83 aa, Triticum aestivum
  unsure (1)..(83): unsure at all Xaa locations
  Clone ID: PAT_TA_53747.pep
MDPNPSRXQSGRSGAGVGVDGQRRGLAWPPRRVAARRRGLFLAGWLALLGMRGQGWGGSEAPSLRRRGEKKQAGKGDRERDEK

SEQ ID NO: 159330 - protein, 179 aa, Triticum aestivum
  unsure (1)..(179): unsure at all Xaa locations
  Clone ID: PAT_TA_53748.pep
MAYAASTPAVPDWLNKGDNAWQLTAATFVGIQSMPGLVVLYGSIVKKKWAXVNSAFMALYAYASSLLVWVLVGFRMAFGERLLPFWGKAGVALTQDYLVGRAKLSATERGSTPLVEPFYPEATLVMFQFEFAAITLILLAGSVLGRMNIKAWMAFTPLWLMLFYTXGAFSLWGGGFLYT

SEQ ID NO: 159331 - protein, 59 aa, Triticum aestivum
  Clone ID: PAT_TA_53749.pep
AGRHAGSPRHRAAGYQIFRPWLPHVETRVPLATACTVAIPARRQERGRRTREGRNAREE

SEQ ID NO: 159332 - protein, 167 aa, Triticum aestivum
  Clone ID: PAT_TA_53750.pep
AETEYRCFVGGLAWATDDNNLQQAFSQYGEILDAKIINDRETGRSRGFGFVTFGSEESMRQAIEEMNGKELDGRNITVNEAQSRRSGGGGGGGGGGYGGQRGGGGGYGGGGGYGGGGGGYGGQGGGGYGGQRGGGGGYGGGGGYGGGGGYGGQRGGGGGDSGGQWRN

SEQ ID NO: 159333 - protein, 210 aa, Triticum aestivum
  unsure (1)..(210): unsure at all Xaa locations
  Clone ID: PAT_TA_53751.pep
MASASRLGLVVLVAMASAASAQLSSTFYDTSCPNALATIKAGVTTAVQNEARMGASLVRLHFHDCFVDGCDGSVLLADTGSFIGEQGAAPNNNSIRGMNVIDNIKTQVEAVCKQTVSCADILAVAARDSVVALGGPTWTVLLGRRDSTTASKTQRGNDLPPPTFDLXNLTTLFGNKQLSMTDMVALSGAHTIGQSQCRFFQNRIYNETHI

SEQ ID NO: 159334 - protein, 52 aa, Triticum aestivum
  Clone ID: PAT_TA_53752.pep
KRTPPDGNQGPLKKAPPPFFFFFFFFFFFFFFFFFFFFFFFFFFFFFFFFFF

SEQ ID NO: 159335 - protein, 62 aa, Triticum aestivum
  Clone ID: PAT_TA_53753.pep
NPKLYSVVQVPERSPVGLPEVQTLSGRGVADLQRVLPVEAEQPVVMTAKHGGRPCMPWKSCH

SEQ ID NO: 159336 - protein, 75 aa, Triticum aestivum
  Clone ID: PAT_TA_53754.pep
PTDPAPPMRPPARSDQSACPELGDPDHQRQHLGDEPTPQADQNRQAEDAEDDVVGPVHRFNRPSWAPASTCRTRG

SEQ ID NO: 159337 - protein, 67 aa, Triticum aestivum
  Clone ID: PAT_TA_53755.pep
SPPPALSAQPPKPNPPSSVISRSSAVRRSASDSPPPPQAITGGAAVLCCDVSGTPPKEKCKSEGDIS

SEQ ID NO: 159338 - protein, 75 aa, Triticum aestivum
  unsure (1)..(75): unsure at all Xaa locations
  Clone ID: PAT_TA_53756.pep
QSKAGVEEYVGCATVHGIGPSIGVFDSVRDGQLDCACMYPSPLHSRKQIQEIFDKVKRILGEGCNTGDEKXEDCT

SEQ ID NO: 159339 - protein, 125 aa, Triticum aestivum
  Clone ID: PAT_TA_53757.pep
LIEAEITDLERMIEESEDSELVTLLKEKIDRLKDQKENLETLIEDILQIEEQLRKIREEATSDKEEAKRKLAIIGRKMMEKESGLPRNKPWRKLLGWGLLLLLAPKATMGFPKAIEEAFTGWGAG

SEQ ID NO: 159340 - protein, 102 aa, Triticum aestivum
  Clone ID: PAT_TA_53758.pep
KETPTSISYSYLIVHQGIQRFRKDPKYRAITGKKQQGLELHGGETASQEPSTLPFGPMPEEEKSTVDSFPSCGNTNWPNMATDARVKARLWRRGKALRERAP

SEQ ID NO: 159341 - protein, 53 aa, Triticum aestivum
  Clone ID: PAT_TA_53759.pep
KSTRGNSQTQPKQSQTDRQNNRARQIASNHILIKGAAGELDCNFYLGEGWAQT

SEQ ID NO: 159342 - protein, 97 aa, Triticum aestivum
  Clone ID: PAT_TA_53760.pep
NAKPAIQVLLVCKSRCKTGRPLHFDSNSTYHSTLVTADELSEHFSGTSSLDLFASRDASPRVWPLFSETNSPFSTLGSLRCSSEALLGGSWVTGRTC

SEQ ID NO: 159343 - protein, 75 aa, Triticum aestivum
  unsure (1)..(75): unsure at all Xaa locations
  Clone ID: PAT_TA_53761.pep
THWVILVVPHASVLPLRAPQGPFIFPLSESGFVFLYQTCIYPSTHSVETLTPGSYTPVFVESQDTKEKKXKKKXK

SEQ ID NO: 159344 - protein, 48 aa, Triticum aestivum
  Clone ID: PAT_TA_53762.pep
NSVGFSTGYVTIKDMVVPGMPIKIVGVAALTVLLPTLGVAVFGMDQKV

SEQ ID NO: 159345 - protein, 87 aa, Triticum aestivum
  Clone ID: PAT_TA_53763.pep
GPTRRPASSAISIKVNSFRTHLAAMVYLRDSTAVALSPTHSSAIYSLPLTQSQFDRPMLFHRRVINSRKASSTGQCYFTDVLLIHPR

SEQ ID NO: 159346 - protein, 52 aa, Triticum aestivum
  Clone ID: PAT_TA_53764.pep
QPPAPSHMAPAAVALPLIQTIFTCMSKLSPLFSSILSISCLDVLGSYPPPLY

SEQ ID NO: 159347 - protein, 105 aa, Triticum aestivum
  Clone ID: PAT_TA_53765.pep
FYGGGIKQVGKQLAGAAFVIVWNLVVTTLIMLGIGLFVPLRMPDDQLMIGDDPAHGEEAYALWGDGEKFDATRHDVSRGAGGEREMGTAEQRLAGMGARGVTIQL

SEQ ID NO: 159348 - protein, 152 aa, Triticum aestivum
  unsure (1)..(152): unsure at all Xaa locations
  Clone ID: PAT_TA_53766.pep
TSKNLTTLFGNKQLSMTDMVXLSGAHTIGQSQCRFFRNRIYNETNINTTFATSLRANCPQSGGDSSLAPLDTQTPNGFDNAYYTNLMSQKGLLHSDQVLFNGGGADNTVRSFASSAATFNSAFTTAMVNMGNIAPKTGTQGQIRLVCSKVNS

SEQ ID NO: 159349 - protein, 50 aa, Triticum aestivum
  Clone ID: PAT_TA_53767.pep
PPPIRGATRPMNSVPTKNELPCNSRATFKQLAIVTYSQVISILCTKLFNF

SEQ ID NO: 159350 - protein, 53 aa, Triticum aestivum
  Clone ID: PAT_TA_53768.pep
SLPVDGEAGVRKVLQMLRDELELAMALSGCPSLRDITPPPVVTDGDRIRRARL

SEQ ID NO: 159351 - protein, 27 aa, Triticum aestivum
  Clone ID: PAT_TA_53769.pep
SSENLAPLSVLHMVKFHHSLCVSCVIY

SEQ ID NO: 159352 - protein, 77 aa, Triticum aestivum
  Clone ID: PAT_TA_53770.pep
RPLRCSWKDSPPSRAIRGGSNRYCCHNSSPPPHGWSNGRRPVSANICIRLPCSITCRACRRRCCPPYRERRPLRRRP

SEQ ID NO: 159353 - protein, 60 aa, Triticum aestivum
  Clone ID: PAT_TA_53771.pep
LGQPDRPPCSHNRPPTVGWMPCDPPTIANVHGYFYYNYFGHLIAVIADDPCYLYYNYFGP

SEQ ID NO: 159354 - protein, 114 aa, Triticum aestivum
  Clone ID: PAT_TA_53772.pep
MHRSGKGEPPPSPQIWGPPGGSPHPPWENAGPGKGLSGPQKKSKNAHGHGRKVWHPKKAPPLQGFSQSFLLYFFRPFLFFFFFFYFFFFFFCLFFFFFFFFFYIVFFFFFFFFF

SEQ ID NO: 159355 - protein, 198 aa, Triticum aestivum
  unsure (1)..(198): unsure at all Xaa locations
  Clone ID: PAT_TA_53773.pep
VTTSTSGGRLSPQEQATIQAIVDASFYPLSIVMVGVGDGPWDAMQHFDDCIPDRAFDNFQFVNFTGLMSASKDMSKKEAAFALAALMEIPTQYKATQGHLQSTCSSSFLEALHXILPPPSKVLEYDNIVAASHTPAATSQSTDVGYTVSDEKVCPICLTNPKDMAFQCGHLTCKECGPTLSTCPLCRAPITVRVRLFS

SEQ ID NO: 159356 - protein, 239 aa, Triticum aestivum
  unsure (1)..(239): unsure at all Xaa locations
  Clone ID: PAT_TA_53774.pep
VDLGRGFGFAEVELYGDVVLRFVSHPDGTDVPFLPGFEGVSNPGAVDYGLTRFDHVVGNVPELASAAAYVAGFTGFHEFAEFTTEDVGTAESGLNSMVLANNSEGVLLPLNEPVHGTKRRSQIQTFLEHHGGPGVQHIAVASSDVLRTLREMRARSAMGGFDFLPPPLPKYYEGVRRIAGDVLSEAQIKECQELGVLVDRDDQXVLLQIFTKPVGDRPTLFLEMIQRIGCMEKDERGEE

SEQ ID NO: 159357 - protein, 158 aa, Triticum aestivum
  unsure (1)..(158): unsure at all Xaa locations
  Clone ID: PAT_TA_53775.pep
DHRRHRQVLLQGRDIEEGSTRGRKQVWFSNVPHTWLVADKGGQNWITKAKDXVPSGSRTRVFLDVGFGVTSFGPYLISREFEHGVPAMVATNLSPAIIQCSHCRINSTCDGELSGILXLEVNRVXRTGEYFPWPAQPVYKHEEAQHEAGKDMLLNTIM

SEQ ID NO: 159358 - protein, 117 aa, Triticum aestivum
  Clone ID: PAT_TA_53776.pep
SSCIKYILLCHFFLGVALFIKHHKVCNGVHQTRLYCVKKKKKKKKKKKKKKKKKKKKKKKKKKKKKKKKKKKKKKKKKKKKKKKKKKKKKTKKKKKGKKIKKNKKWEKPGGFPNKTA

SEQ ID NO: 159359 - protein, 237 aa, Triticum aestivum
  unsure (1)..(237): unsure at all Xaa locations
  Clone ID: PAT_TA_53777.pep
PLCCRHALFEQIRVGASALGWVDTRYGILLLDDLFGRHPVVKIIPLPVTTVGLPEPTKPYDYYCAPEYFYNVACCDDLIKFVHIKYDDPDAMTRGSGWKATMWNMKVSEQNWCERYTVDVAKISVDKSFPAKLPELWDDETQQLQLKNLMFQGPILSMLNDDLLYMMAKVNDEDDTAXAITIDMKHAALKALAKXSVKPKQQLLTTLCFSCVFPKYLNIPPGTEMYDPMEMHFKRMS

SEQ ID NO: 159360 - protein, 127 aa, Triticum aestivum
  unsure (1)..(127): unsure at all Xaa locations
  Clone ID: PAT_TA_53778.pep
MSKRRQEQVSYRDRADKKLRSAQRQKHLYLALDDWTKGFAIYKIDIDTLDSSSDLDLEPPVLRLVSASPPYPMYFAALGSNIFMASSXHPGTMVYNTETAGLXHRPXXPDGTTRSIKIFVATANMQL

SEQ ID NO: 159361 - protein, 75 aa, Triticum aestivum; identical to SEQ ID NO: 106874
  Clone ID: PAT_TA_53779.pep

SEQ ID NO: 159362 - protein, 221 aa, Triticum aestivum
  Clone ID: PAT_TA_53780.pep
QNLTSPVHFATATVGQAPDIVYALALCRGDVLNDTTCAECITNVFGKVQNAMPPEVECFRAASYFADCILIYNSKDILAPSFTNSTEGENGGDPPFERWNVRNVTGNVPLITGLMHELLVETVEKAASASPRRFATGVVDSGTNFPKVYSLAQCTPDLSSGDCLECLQHLLGMINSTMSLRMWGQMGVIRCYFRYDACQFYQGQPMISLVPVATTTDQHRE

SEQ ID NO: 159363 - protein, 179 aa, Triticum aestivum
  Clone ID: PAT_TA_53781.pep
KKKKKKKKKKKKKKKKKKKKKKKKKKKKKKKKKKKKKKKKKKKKKKGGGLFKGSKFTSPCLRGFIFFLGPPNLISLAVFLKLGDWKTLGFPKFIRFEKIPLFPSWVITKKARPFPLSKILSTLIGNWTPPFTGPLSPGGLGFPPRVPFTFASPLAPVLLVFFLFFFPTLPVFPLKFLIG

SEQ ID NO: 159364 - protein, 105 aa, Triticum aestivum
  Clone ID: PAT_TA_53782.pep
ENIVKMAYKHLIPTPKDQCSKPLQLGVSFGSGYIAGVFCAAISHPADNLVSFLNNAKGATVGDAVKNLGLWGLFTRGLPLRIIMIGTLTGTQWVIYDSFKVMVGL

SEQ ID NO: 159365 - protein, 135 aa, Triticum aestivum
  Clone ID: PAT_TA_53783.pep
MERVVAGSSEQGTPDSEMGDGDNDSVGYGTEMELDAASTPGSAPAYPARPSVHDGVDPFEGMEFDDEEDAWTFYNLYAHRVGFSTRISVMHRSRRDGSIMSRQFVCAKEGFRTYRGKHEQAAALASSPAGADDGG

SEQ ID NO: 159366 - protein, 84 aa, Triticum aestivum
  Clone ID: PAT_TA_53784.pep
EYIWGTGRTCRKQKSMTLLDWSMILVIHSSTLQNSLVSNMNISVRTKTYLLFNFRLVLGVTDDLYSATVSTSSTGLPSSFFWLV

SEQ ID NO: 159367 - protein, 141 aa, Triticum aestivum
  Clone ID: PAT_TA_53785.pep
RRASGGAAFVSHCLRSSSSKTSSPPPPTSKIRRRRRRSTCCSGCSNSAAAAGHRSSAAEDGSFASDVQQQGLASFSFSGSGSGGGGGSASGAPEGQGESGGGAPGMQSGSSGGAAERKGESSGGSASGAPEGQGESGGGTP

SEQ ID NO: 159368 - protein, 252 aa, Triticum aestivum
  unsure (1)..(252): unsure at all Xaa locations
  Clone ID: PAT_TA_53786.pep
EVTIPIFGQEVFYGVDTATCSEQLNFIVDALKPSKLRSLVDPMSQEVEAYFAKWGQDGIVDLKHELEQVLMFISSRCLLGYEVRDMMLEEVYSLFHDLANGLNFLSFLFPYTTTPRNRRRDKAHIRLKEIFTATTMSRRSSGRVEDDALQRLMNSKYKDGRFTTEAEISGMIMGLVVAGHISSTSTSTWTGACMLSNTKFLIAAMXEXKHIISKYKNQIGYEALSEMDTLHRCIKGGNRMHTSAPVLVRKAH

SEQ ID NO: 159369 - protein, 79 aa, Triticum aestivum
  unsure (1)..(79): unsure at all Xaa locations
  Clone ID: PAT_TA_53787.pep
MAVLQASDTSSCTDQIQLLRKMLDKLWDDVVAGPRPXTVLNKLRRAVDTQPLCMNTVGVEAMKQAAFMPTTPTTPVTPF

SEQ ID NO: 159370 - protein, 169 aa, Triticum aestivum
  Clone ID: PAT_TA_53788.pep
MAAESSVPQTSSESAAHKMGFFRVSDLLVKLSTKCLIELDAVRSPTSPLDLKLFTGLATKSPRSSFLDAGAASQNQKILLGDRVGLGLVDSLSHENNPTPLGSRKVLGSEMRITDNLTLKNSSTAPNQAGLLEQKDENMSDGLNGSIMSLDDIVNSEDYHLCCYPWSEP

SEQ ID NO: 159371 - protein, 196 aa, Triticum aestivum
  unsure (1)..(196): unsure at all Xaa locations
  Clone ID: PAT_TA_53789.pep
MDLSANPDSPLSGGGNGGGSSSSITSSLSVVSGGTPQSPSRYEAQKRRDWNTFGQYLRNHRPPLSLAQCSGAHVLEFLRYLDQFGKTKVHASACPFFGHPSPPAPCPCPLRQAWGSLDALVGRLRAXYEENGGSPESNPFAARAVRLYLXEVREHQARARGVSYEKKKRKKPQQLTRDSSGSSFHSNQHQAPPGAP

SEQ ID NO: 159372 - protein, 86 aa, Triticum aestivum
  Clone ID: PAT_TA_53790.pep
MHACMVASRVSKKKKKKKKKKKKKKKKKKKKKKKKKKKKKKKKKKKKKKKKKKKKKKKKKGGAPLKEPNLPTPSLERKIFFLGPPN

SEQ ID NO: 159373 - protein, 195 aa, Triticum aestivum
  Clone ID: PAT_TA_53791.pep
MFGYRKAPDLDLEAGGSAPLYPGMTEDVELRWAFIRKIYVILSVQLAMTAAVAGFVVKVPAVSDFFVSSNAGLGLYIFFLVLPLIVLCPLRYYHQKHPVNLILLGVFTVSISFAVGMTCAFTSGKIILEAAILTAVVVISLTAYTFWAAKRGHDFNFLGPFLFGALMVLMVFSLIQIFFPLGKISTMIYGARASI

SEQ ID NO: 159374 - protein, 188 aa, Triticum aestivum
  unsure (1)..(188): unsure at all Xaa locations
  Clone ID: PAT_TA_53792.pep
RTRXEKKKKKKKKKKKKKKKKKKKKKKKKKKKKKKKKKKKKKKKKKKKKKKKKKKKKRGGAVFRGPSFLPRVWEVFFFFLGPLNLISWAGFYHRGGGKTLGFPNFFRFGKFPFFPGGVIRKGAPPFPFSKIWPPLMGNGPPPFRGFLTGGVGGFPPRWPFIFPGPLAPVFLFFSLFFWPSLGVFPRKF

SEQ ID NO: 159375 - protein, 51 aa, Triticum aestivum
  Clone ID: PAT_TA_53793.pep
ATRPLFPLAPSSCAGTRVLADLARPDDDLGSHQTWTPGASCRAACSNRRRR

SEQ ID NO: 159376 - protein, 125 aa, Triticum aestivum
  Clone ID: PAT_TA_53794.pep
MSDTDEHHFESKADSGASKTYPQQAGAIRKGGHIVIKARPCKVVEVSTSKTGKHGHAKCHFVAIDIFNGKKLEDIGPSCHNCDVPHVDRQDYQLIDITDDGCVSLVTESGSTKDDLKLTTDDEAG

SEQ ID NO: 159377 - protein, 169 aa, Triticum aestivum
  unsure (1)..(169): unsure at all Xaa locations
  Clone ID: PAT_TA_53795.pep
MHMDGGAAELRETHRLTGHADRAWSLDWNPNPGPGAGPVLASWGGNKTVRIWDHTPDGVWNCXDVLDGVHNRTGRTCSWIPGRKLMATTSVDGTTAITXVLARRLRMRGTLNGHDNEVNSVAGTQSGSLFSTXLTRHGTGTWEVQPANEHECVAVLHGHTQDVKMGQCD

SEQ ID NO: 159378 - protein, 44 aa, Triticum aestivum
  Clone ID: PAT_TA_53796.pep
MTVIDILTRVDVICQKYDKYDAEKLNGANVAGEDPFARLYGSVD

SEQ ID NO: 159379 - protein, 130 aa, Triticum aestivum
  unsure (1)..(130): unsure at all Xaa locations
  Clone ID: PAT_TA_53797.pep
QXRCLWRGRRRVKKKRCEHLEAFAMLGALAWQAATIIKMFFCLGGRSHGGYLVLAPGSPPCVLVCSFVRTPRPIRLHGTTFYRRKSFMELPSKDQSLNSCKWSVYYPNEAYSTIIAAPSNGCFSRWSFDG

SEQ ID NO: 159380 - protein, 90 aa, Triticum aestivum
  Clone ID: PAT_TA_53798.pep
VSSAAIHILSTVCPDPRPQPDLLGCSCDLRISFMLVAILFVELQKMVYLPKLWNHIRVMVSRNTDKSSDPYSSFRGNDKSCPLLSILTCL

SEQ ID NO: 159381 - protein, 117 aa, Triticum aestivum
  Clone ID: PAT_TA_53799.pep
HSLTCIPQPHASSSSSSSSSSSSSSSSSFSSSSDAGGKKSSDDDSGDSDDQRSEKTAASSSCDSGCHSQSASPKPRRSSSCSRVCGASASTQASSLSNSSLNRRPSSSSSSSRWLRP

SEQ ID NO: 159382 - protein, 167 aa, Triticum aestivum
  Clone ID: PAT_TA_53800.pep
MAMAGGAPPAPLPVVGHQFCAPYVVPLTVTKKALSLSDGDFAITDANGAVVLKVKGAIFSIRSRRTILDGAGMPLLTMQEKVFSMHHRWEVFRGDSTSSGDLLFSVKTTSLIQLKTEMDVFLAGNTAQQVCDFKIKGSYFDRSCVFYLGDSNNMVAQMSRKLTVSNV

SEQ ID NO: 159383 - protein, 59 aa, Triticum aestivum
  unsure (1)..(59): unsure at all Xaa locations
  Clone ID: PAT_TA_53801.pep
MTPVQDPFYIAKDQIHYSIDKIQDTFTQWKLAPQNTGEYAHXLPENLLTTCESVQWHGR

SEQ ID NO: 159384 - protein, 215 aa, Triticum aestivum
  Clone ID: PAT_TA_53802.pep
MSSPLLVAMAAAAIIVACCFAACPVGAGASAGGFYDNFVVKWGTDPDPDQRVEIVDGGRLVTLTLNNVSGAGFQSRDAFLFGEFTMEMKLVPGDSAGTVTTFYLTSKDPTAVGDGHDEIDFEFLGNVSGEPYLMQTNVFAQGVGGREQRSYLWFDPTEDFHNYTILWNPLNIIFSVDGVPVRVFRNHDANGVPYLSRQAMNVHATIWDGDTWATR

SEQ ID NO: 159385 - protein, 152 aa, Triticum aestivum
  Clone ID: PAT_TA_53803.pep
KKKKKKKKKKKKKKEKKKKKKTGLQKTSKQKKKTIRGANLNLIDRAVVNQRAWLETGRGRPKEPGWRPLLLPPAGFLPGRPPSVLPPRRSPCLIGETPASCCRSARPVCRLLTRWGVGSLAPPLPLLRLGAFPSFLGPPAFPPQHILRGWLF

SEQ ID NO: 159386 - protein, 235 aa, Triticum aestivum
  unsure (1)..(235): unsure at all Xaa locations
  Clone ID: PAT_TA_53804.pep
FTGRARRQELGQVARPPASARPGLDLDPRRQGNPRERQDPAMNPEYDYLFKLLLIGDSGVGKSCLLLRFADDSYLDSYISTIGVDFKIRTVEQDGKTIKLQIWDTAGQERFRTITSSYYRGAHGIIIVYDVTDQDSFNNVKQWLNEIDRYASENVNKLLVGNKCDLADKRAVSYETAKAFADEIGIPFMETSAXNALNVEQAFMAMAASSRIGWRASQPQTTLAQLLYRSAGNLS

SEQ ID NO: 159387 - protein, 216 aa, Triticum aestivum
  Clone ID: PAT_TA_53805.pep
MQKSVVMEDIGSSLFGVLSSKLKAPDERFVAVHEYVVQLESNLTALERLYLRLSKRQSDLAADYSELAASLTLASATEDALGSMLRAIAQAHDRVGTAYKTLQERIETEFLDPLHDYILYCHAIVNTLKERDQRQLLHEDLAAELEAKEANLAHLSDANAAGVAASTSSVWNRFRSNDPEALRAAIEETKRDLEDADQVQQAFSKLVMQELDLFNR

SEQ ID NO: 159388 - protein, 123 aa, Triticum aestivum
  Clone ID: PAT_TA_53806.pep
TTTRWYQSMRIAPRYMEIGVHSCHRMMSQKDWGQLRSIWQEKDNLVGVPLSSPEQKIIRAKRSTQARSYGLERKKKETRSSPSQIPRRAAHRISAPSSPLTAHLHHLAVIFHFSRQKNKFRHA

SEQ ID NO: 159389 - protein, 247 aa, Triticum aestivum
  Clone ID: PAT_TA_53807.pep
MGMAMGIMSLPWSLVLALTIAVVSAGDEAALLAFREQISDGGALASWNSSAGFCSWEGVTCSHWAPKRAVALRLDGRALVGALSPALGNLTFLRTLNLSFNWFHGEIPASLGRLRRLQRLDLSDNSFSGTFPVNLSSCVSMTEMRLRNNKLGGRIPTELGDKLASLKVVSLRNNSFTGPIPASLANLSYLQNLDLGLNQLVGSIPPGLGTLHNMRQFTVVRNNLSGMLPDSLYNLASLELLNVRGKY

SEQ ID NO: 159390 - protein, 255 aa, Triticum aestivum
  Clone ID: PAT_TA_53808.pep
NLIQSSPPPISPGNLRSKQSQGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFIKTLTGKTITLEVESSDTIDNVKAKIQDKEGIPPDQQRLIFAGKQLEDGRTLADYNIQEESTLHLVLRAP

SEQ ID NO: 159391 - protein, 164 aa, Triticum aestivum
  unsure (1)..(164): unsure at all Xaa locations
  Clone ID: PAT_TA_53809.pep
CRQTRPPEREPKKRRKKRKRKRLNEKRGXRRQRQKTNKGQKKKRKGGGKKEETKKKKKERTKKHVGGKKNGPAKKTKKPTTGEKKATPRGGEKGGLCTREGGGHKWNEKNGPWLRGGKQKAQRGRRKGKKFLLEGKERRKKTGASGKKKTTTDPGARTRSQSRT

SEQ ID NO: 159392 - protein, 96 aa, Triticum aestivum
  unsure (1)..(96): unsure at all Xaa locations
  Clone ID: PAT_TA_53810.pep
RELLVXAMSPLGEDAVKGGEGAIYLWAKLPDNCSDDFEVVRWLATKHGVAVIPGSASGGPGYIRVSFGGLKEEDTRLAGERLRRGLQELVTDGMVQ

SEQ ID NO: 159393 - protein, 203 aa, Triticum aestivum
  Clone ID: PAT_TA_53811.pep
MEPLSYSDSTRLFCKRIFSSENKCPSELKEVSRDILKKCGGVPLAILTIASLLTAGHQIKPKVEWQVLLDSIGRGLTEDASMEEMQRILSFSYYDLPSNLKTCILYLCMYPEDHEIDKEDLIWKWICENFVQHGKHQTSIFEVGETYFNELINRYMIIPIFNGFREVQSCRVHDMGLDLIRSLAAEAKVLTILGSNKDITSSQ

SEQ ID NO: 159394 - protein, 114 aa, Triticum aestivum
  Clone ID: PAT_TA_53812.pep
MGRRRSPALPLLVIFGVLAVVLAALPPLAESSSSHHHHHGHGHHSRVQSRGHGGEEEQSAAAAAAKARGSAWPCCDSCGGCTKSDTPQCRCMDAAPVGCHPACRDCVRSPLIVH

SEQ ID NO: 159395 - protein, 191 aa, Triticum aestivum
  Clone ID: PAT_TA_53813.pep
ERSVDGSDQQHQQTQIHRDDAHQATARAAGAVADGIELTADDVGDAGEERKTREEQTRHQLENDDGGDALDVVVVCALCVVDDEPVVERQFASEATVAHVRVAAARPAELALRTGELKLEFSIVGKIFLEKILVEDLTASRAHRSETGDDALNAHDDRDQQVPCIGGGDEESTHLRCLFEGSRQPEPNQRS

SEQ ID NO: 159396 - protein, 77 aa, Triticum aestivum
  Clone ID: PAT_TA_53814.pep
MSTEKKQLNPMRDIKVQKLVLNISVGESGDRLTRAYKVLEQLSGQSPVFYKGRYTDRLFGIRRNEKIACCVTISGEK

SEQ ID NO: 159397 - protein, 46 aa, Triticum aestivum
  Clone ID: PAT_TA_53815.pep
TRSLRILNMILKIVLLLKTMLLHAMVIDHIMITCYRLMVLIKYSRD

SEQ ID NO: 159398 - protein, 122 aa, Triticum aestivum
  Clone ID: PAT_TA_53816.pep
MDVPPSPPFDGEPPAGPSPSSLPHGAPPLPGLQLATHDPPSRPPRPHHNPRERTHRKGRRVSALVDPRRRRPHRPHRLRLAPKTGRRPEPLPPRAYSGRSPSGHRRRPGRPRRPGRPGRPGR

SEQ ID NO: 159399 - protein, 69 aa, Triticum aestivum
  Clone ID: PAT_TA_53817.pep
VLSCRWCRPRCNRPTAGTPRSCSYHRTRPPGRSSQCPRPGRQGRLRRTEEPRMSRREAGRLHTSCHWSA

SEQ ID NO: 159400 - protein, 149 aa, Triticum aestivum
  Clone ID: PAT_TA_53818.pep
MSVELVLWLFSFASVMALVGLTAYQLICLSDLEFDYINPYDSSSRINAVVIIEYVLQGVLCASFLLTLNWFPFLVMAPVTYYHVKLYMNRKHLIDVTEIFRQLHGEKKYRMIKLAFYFALFIISIYRLVMTAVLLFIDEDVNLVETRTI

SEQ ID NO: 159401 - protein, 59 aa, Triticum aestivum
  Clone ID: PAT_TA_53819.pep
PVGSTVTCQAEVASKSHGVHQAVQLYCWQRKLSSKEPFWSRTARRWRASSTEKSKDRSI

SEQ ID NO: 159402 - protein, 41 aa, Triticum aestivum
  Clone ID: PAT_TA_53820.pep
NRAGSRKLRVPNSGTFYPFFPFFFFFFFFFFFFFFFFFFFF

SEQ ID NO: 159403 - protein, 162 aa, Triticum aestivum
  Clone ID: PAT_TA_53821.pep
MASFSAALVALLVASCAAAAAATTFDVGDGHGWQTGVDYTAWTSDKTFAVGDALVFNYTSKAHTVTEVNKSGYDACSGGNSLSNDDSGATTITLTTPGVHYFICDVPGHCASGMKLAVTVTVAGGSTTGGTIPAGAAGGSLLPAMSGLDTGAAGALIVLAPF

SEQ ID NO: 159404 - protein, 122 aa, Triticum aestivum
  unsure (1)..(122): unsure at all Xaa locations
  Clone ID: PAT_TA_53822.pep
AGEPYSRIDSARGVALXGLVILILSNVASNVPTVLLLGTRVAASAAAISPASERKAWLILAYVSTVAGNLTLLGSAANLIVCEQARRAQFFGYNLSFWSHLRFGVPSTIIVTAIGLLIVSSY

SEQ ID NO: 159405 - protein, 151 aa, Triticum aestivum
  unsure (1)..(151): unsure at all Xaa locations
  Clone ID: PAT_TA_53823.pep
MLPYSTAAEAEAALGRAMSYAEGAWFRYSAGMPDYYLYCHIVPMLLLVYTLSSVPLALFELGAPSIALRYKLQPRVKLSPSAFLRCYMDTMGLLLVTIAPLHLVSYPAMAGIRTXLPLPSVGETVAQLVVYLLVDDYLGYWIHRLLHAKWG

SEQ ID NO: 159406 - protein, 174 aa, Triticum aestivum
  Clone ID: PAT_TA_53824.pep
MPIPPPPPPPMATAGREARRSRRAVSRRAGAMVLVLGALALAAYYSFYSDVAVQFLGMEEEEAQKERNETKSFLFQLYPKAHQGRALREFGDIKLAAKRVDDGGGRKVTKKLDVKGATSAGTNSTVLLPIKGNVFPDGQYYTSIFVGNPPRPYFLDVDTGSDLTWIQCDAPCTN

SEQ ID NO: 159407 - protein, 147 aa, Triticum aestivum
  Clone ID: PAT_TA_53825.pep
MAPKVAVAKKGDAKAQAAKVAKAVKSGSIKKTAKKIRTSVTFHRPKTLSKARDPKYPRISTPGRNKLDQYQILKYPLTTESAMKKIEDNNTLVFIVDLKADKKKIKAAVKKMYDIQAKKGNTLIRPDGEKKAVLKFTPRLRWLSTRP

SEQ ID NO: 159408 - protein, 49 aa, Triticum aestivum
  Clone ID: PAT_TA_53826.pep
ASRMTPHGRAPFPGLKLLHVDHREAQRGSGISRKSHLCVCVCVYVCVCA

SEQ ID NO: 159409 - protein, 89 aa, Triticum aestivum
  Clone ID: PAT_TA_53827.pep
MSREWVVKADLLVALLAVSLALEAQAFSGYGGGHAPTPTPVAPPPKHEKPPKGHKPPHHHHHAKPPAASHGPPTHAPAPPTYLPPSPDP

SEQ ID NO: 159410 - protein, 65 aa, Triticum aestivum
  Clone ID: PAT_TA_53828.pep
QTRSLDHCLAGPAPAAAGARASATGAARDAVRPGDLPLRDARHAARHVLRQRPSHGTLRTDLERC

SEQ ID NO: 159411 - protein, 168 aa, Triticum aestivum
  Clone ID: PAT_TA_53829.pep
RKKPHPHQLSPSVFLLGGGERRTLAARGTPRSPRPATMAAVRCAARRLGGSLLQRTQAAVAEEGRLLAPSRLMRSRQLSTKVSGERSQVAERHLLEPGSLMRSRQLSGEHARNIQKKEDDCWAGFNETLKRRMISIDRALKSLVYGSFKVTVVYVAAATAFSGSGLEA

SEQ ID NO: 159412 - protein, 93 aa, Triticum aestivum
  unsure (1)..(93): unsure at all Xaa locations
  Clone ID: PAT_TA_53830.pep
DYLHPRKTTSTMNGRFLDATTDELNVSDVTCIICCEETTTAKKLLCGHLFHVHCXSWRERQNTCPTCRSPIAPRTMDVLHQRDSMKPNWELAW

SEQ ID NO: 159413 - protein, 61 aa, Triticum aestivum
  Clone ID: PAT_TA_53831.pep
NASMQRSRAASSAALKYHPRVLAIELSHEDSCQALRHLSMYVIPYSPGSAPRTFNYKGTCI

SEQ ID NO: 159414 - protein, 137 aa, Triticum aestivum
  Clone ID: PAT_TA_53832.pep
EYTAPIAFAAPYGHWSDVLILGAPSLVGPSIVPCHITTLWLWLVIRQIEAIDTHSGFKFPFNPTNYIPFYGGAEYHDYHHFVGEHSQSNFSSLFTFCDYLHGTDKGYRYHMANLVKSTMKMKGAATTTMATPRSEAK

SEQ ID NO: 159415 - protein, 52 aa, Triticum aestivum
  Clone ID: PAT_TA_53833.pep
WACACGLLRSLSAYALPLGPLWVCVGMCPCNCFIYLPYGWSDEYVRMNDFPN

SEQ ID NO: 159416 - protein, 127 aa, Triticum aestivum
  Clone ID: PAT_TA_53834.pep
SDEEVAFLTQGDATDEKNVLSLWFEGLKLLIVTDGEKGCRYFTKDFKGSVPGYSVNTVDTTGAGDAFVGSLLVRVSKDDSIFYNEAKLREVLQFSNACGAICTTKKGAIPALPTTATALELISKGSN

SEQ ID NO: 159417 - protein, 121 aa, Triticum aestivum
  Clone ID: PAT_TA_53835.pep
FKKGGGGPNFFKPPPIAEAVLKHGGMGGKARANPAQTRKKNFFRPPVFLGGEGGKSTFKPKPNFCTHGGAPGGPGGRFQKKGTKKGGVKTRPGPRGRRTEFTRLGKLGGKKKTGRGKSDFK

SEQ ID NO: 159418 - protein, 112 aa, Triticum aestivum
  Clone ID: PAT_TA_53836.pep
WGGLFSRAPQGVVFQIFPPPRGAPPPFFLKNSQKIGARKKPKKGESPQKGFPRGWPKHIFSRCLGPLKKREGPFKPTIFFPFGGFRKKTGAGGAFPRFFFGVPGAKKKFFFF

SEQ ID NO: 159419 - protein, 75 aa, Triticum aestivum
  unsure (1)..(75): unsure at all Xaa locations
  Clone ID: PAT_TA_53837.pep
TSPXRLFLRRTSPSPPAXGLGGSSXKKIHHSVNLGAQKPVEQSCGVRPTRATYGVVDPPPVCVAAALGPFSQEMG

SEQ ID NO: 159420 - protein, 105 aa, Triticum aestivum
  Clone ID: PAT_TA_53838.pep
GRLLAPSRLMRSRQLSTKVSGERSQVAERHLLEPGSLMRSRQLSGEHARNIQKKEDDCWAGFNETLKRRMISIDRALKSLVYGSFKVTVVYVAAATAFSGSGLEA

SEQ ID NO: 159421 - protein, 84 aa, Triticum aestivum
  Clone ID: PAT_TA_53839.pep
NVVIYILLNVHYYILHDNMFLLCQSYKLSIFYRLLHPQRGFQQQNFKLEWKVVQELYDVDFFTNIMGSGLHYDWCHIPNLLLIS

SEQ ID NO: 159422 - protein, 60 aa, Triticum aestivum
  Clone ID: PAT_TA_53840.pep
RKTHRTNATENRQPKQSEIKPPPHGRIHVFGRLVSIKSPHALSTCSKQQCFVRVSECIIC

SEQ ID NO: 159423 - protein, 165 aa, Triticum aestivum
  Clone ID: PAT_TA_53841.pep
SPFDRPKSLMFLAHFVGDVHQPLHCGHVDDLGGNTIKLRWYKRKSNLHKVWDSDVITEAMKDFFNKDQDAMIESIQRNITDDWSSEEKQWETCRSKTTTCAEKYAQESAVLACDAYEGVEQDDTLGDEYYFKALPVVQKRLAQGGVRLAAILNRIFGGNGRLQSI

SEQ ID NO: 159424 - protein, 66 aa, Triticum aestivum
  Clone ID: PAT_TA_53842.pep
KLSYFKLRSIHSRTHVLIYSITSYKPSHAKPSLFTSASYKCLYTRIKLNLDLSRLLVRVNISAVRL

SEQ ID NO: 159425 - protein, 92 aa, Triticum aestivum
  unsure (1)..(92): unsure at all Xaa locations
  Clone ID: PAT_TA_53843.pep
GGXXXXAXXCGXSPXRCXXXCXXGRAWGPRXRRCXPXRPRXSXXPACPXXXSSWPPXWXSXPAPAXXPSCRXCRPRSXFSXCXXXXRXSRLM

SEQ ID NO: 159426 - protein, 165 aa, Triticum aestivum
  unsure (1)..(165): unsure at all Xaa locations
  Clone ID: PAT_TA_53844.pep
MRSSSSSGSAGSAPRRRPMSDLIGGSDDLSRYSVATTTASSERSSGSVRGAAAFLDAFRSCFAPGDARSPETSLSDVDFDASHQHSQSLSSQGSTSGSTFESRRSARGLYGSTLRNSSEREVPGDRKFTLPEIQKATKNLXPNLKIGQGGSGTVYKGQLRDGALG

SEQ ID NO: 159427 - protein, 86 aa, Triticum aestivum
  Clone ID: PAT_TA_53845.pep
ALARVAAVGEGDLLVHDASVGPSLLGLSGVPLQGFVPVLHAGSVGFGVLQRGFCARWAAAVVGRDGERLCWKRRGFFLPDAWADAW

SEQ ID NO: 159428 - protein, 105 aa, Triticum aestivum
  Clone ID: PAT_TA_53846.pep
LGRDCWSGNRARTRSSSRFCYYLANSFVSHLLMRELTRCRKGAACYSSPSPSLLAEERHGCHHTRETDEDMKLSWRRRGGHRCTPTPWMRRFPSALPSITTSAAP

SEQ ID NO: 159429 - protein, 154 aa, Triticum aestivum
  unsure (1)..(154): unsure at all Xaa locations
  Clone ID: PAT_TA_53847.pep
TQSCAHADDRYTGSCCAYYWWRWDAGCRYWKFISDSAHRSMGAGHTSCNLFVNEACELYLDLSTAITNDXPALRSVGNEKHERFDKCWKDCKLGLAMDAAIDPRLKMKLAQXCYSKIYGAVALKNDKDGDDALHDLDMDYDAQSLPLTPAYGVP

SEQ ID NO: 159430 - protein, 231 aa, Triticum aestivum
  unsure (1)..(231): unsure at all Xaa locations
  Clone ID: PAT_TA_53848.pep
RVSFPFPLGRDGKMLTKGDNAGKAEESRVDKAKRKAEEKRLARLEKEMLEEEEKKQREEMAKLVEERRRLRDEKAEAEERSKGATPVGEKDARKEAERKRQERRRKEDKGSSKSNSDCEDIERRVSREGEWKRYFDRRNEPDRRDTGRVGADGYKPHNFEANVQGSKVVQSKTKYFGRMTGGLLSSSRGFSGGSIFGRSTXAPAPQANKVTKPLXNCTDQSNTVKEMPSLQ

SEQ ID NO: 159431 - protein, 112 aa, Triticum aestivum
  unsure (1)..(112): unsure at all Xaa locations
  Clone ID: PAT_TA_53849.pep
TPPAQTDRESAREEAAXTTAPXGAPTSXPXXXRRXXXXAXXGSXGKKXKGDKPXGPGGGXAGDXDANGRKGGKKGXXQXXDKXGANXDGXSPXXTPEEGAEXGDRSAGGTTG

SEQ ID NO: 159432 - protein, 115 aa, Triticum aestivum
  unsure (1)..(115): unsure at all Xaa locations
  Clone ID: PAT_TA_53850.pep
THAGKGXNXEQQAADXAQGXHGQXTKRXEXXXXXDQXXXXGXATXETXEXXPXSQGXATKXGAGGXEXRKXGXXAXXRPXGKTQXTXEXXNEGGAXXXXXXHXXXXTTQQXEXXT

SEQ ID NO: 159433 - protein, 136 aa, Triticum aestivum
  unsure (1)..(136): unsure at all Xaa locations
  Clone ID: PAT_TA_53851.pep
PPPPPPPPPPHPPPPPPPPXPPPPPPPPPPPPPTHPXPPPPPPHPPPXPXPPPPPPPHPPPPPHPPPTPPPPPPPHTTPPPPPHPTPSIPPPPPHPPQYPXPNPPNNILIHTNFISIITTLFQPHSSNSFLNPPFI

SEQ ID NO: 159434 - protein, 94 aa, Triticum aestivum
  Clone ID: PAT_TA_53852.pep
LDDRPVISQADYINTSHPSFIGGSKAIVQAHLQVRTARLPAMVVRRDGDADGPQDSERTRKSHALLGRTTGVNGIMTEQIQGVRPAAGAQRPGS

SEQ ID NO: 159435 - protein, 68 aa, Triticum aestivum
  Clone ID: PAT_TA_53853.pep
ATGHLPPLFLFNQCYRTELQQHRHAKFGPGLRSCCCSLNFHDWYLCLHSLRRLPLPPLSPQAYRIKSS

SEQ ID NO: 159436 - protein, 107 aa, Triticum aestivum
  unsure (1)..(107): unsure at all Xaa locations
  Clone ID: PAT_TA_53854.pep
TETHEGTRQGGQGPPKRRGPRPRRTHDPSQASSRATGNQGPGRGQAQAQGGNQGQDXAQGQXXDQSQAQGQGTGKGHQQDGGKSAGGGGAGGGTGGGGGRRGGGGGG

SEQ ID NO: 159437 - protein, 84 aa, Triticum aestivum
  Clone ID: PAT_TA_53855.pep
MAARGLRGVRDDLSELGRHLLDIACFLHPLLNPAHTDSPPSTPTHSHAHARRRSPSPRPATPPSPPASILAGMLADLAEIGGYL

SEQ ID NO: 159438 - protein, 174 aa, Triticum aestivum
  Clone ID: PAT_TA_53856.pep
MTGEIKNLDGDKALAAPADDGGGAAGHGRKGGKNKLSLVPLIFLIFFEVAGGPYGAEPAVQSAGPLFALLGFLIFPFIWAIPESLVTAELSTAMPGNGGFVVWADRAFGPVSGSLMGTWKYVSGAINGAAFPALCADYLARVVPAVADGGARVATIVTFNVALFVLNYTGLSVV

SEQ ID NO: 159439 - protein, 126 aa, Triticum aestivum
  unsure (1)..(126): unsure at all Xaa locations
  Clone ID: PAT_TA_53857.pep
TVVAGVKAKGXFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDMPAFVLVQADESV

SEQ ID NO: 159440 - protein, 105 aa, Triticum aestivum
  unsure (1)..(105): unsure at all Xaa locations
  Clone ID: PAT_TA_53858.pep
VACPLAALILPDDGIPPPSXKIPPVVKAAGIKVXAYWPPLFAQLLEKRSVDDLLPSVGFGGGGAPPAAAAAPAAGGAPPPPKKKKKKKGGAKEKNHYSLGFRLFD

SEQ ID NO: 159441 - protein, 130 aa, Triticum aestivum
  Clone ID: PAT_TA_53859.pep
RVFQLKELDTPRGLTTHEWTELEDLDERVLFVGKGSGRSYEKSEFPGFGEGGFLFFLDDEYLNDVPRSVVMNGPYRGLITGCWRIRKSTRRDIEIVDGHWKVKVLFDKCIEYVFLDQYYARHSPPVWCLP

SEQ ID NO: 159442 - protein, 198 aa, Triticum aestivum
  unsure (1)..(198): unsure at all Xaa locations
  Clone ID: PAT_TA_53860.pep
PPPAAPPPPRPPPXPPPARPPPPPPXPPPPPPPPPRPRPPPPPPPPPPPPPAPRPPPPPPPPPXPXPXPPPPXPPPPPPPPPXPPPPPXPPPPXPPXPRPPPFXPPXPPPPPPPPPXPPPXPPLPXPPLSPPXAXPPPPGPGPGPPFXPALSGVLRPALPRWLALVPLAAFLGPSPVLPPVRPFSCLPPPLVFPPPPP

SEQ ID NO: 159443 - protein, 189 aa, Triticum aestivum
  unsure (1)..(189): unsure at all Xaa locations
  Clone ID: PAT_TA_53861.pep
PPPPAPPPPRPAPPRPPPPPPPPPPPPRXPPPPPPPPPPPPRXPPPXPPPXXXXPPAXPRTRXRVPPPPPPPPAPFPGGXPLPPPXTRAPTPSSPRPPXPCPQASPPPWPRQLHLVSHVQMGFGSSPRPCLPWPRSAPHSAWHLGLPPRASNKLLYVQLEDIHPGKNAVNRFCIAGRPPPMHMHFFFLY

SEQ ID NO: 159444 - protein, 50 aa, Triticum aestivum
  Clone ID: PAT_TA_53862.pep
FEHKMKEMEGLCNPIIAKMYQGPGPPMPEGMDEAAPTANGGAGPKIQEVD

SEQ ID NO: 159445 - protein, 103 aa, Triticum aestivum
  unsure (1)..(103): unsure at all Xaa locations
  Clone ID: PAT_TA_53863.pep
PLWDLFFGFPGMGPLKPIWGRGDKWANPVSWAIXGVIGWQFGDNTSPGWVPGGSLGGGKQFLGGGMGIKPDFLGDVGVGHFGDVIGFFLGFAYPPKGLDFPKR

SEQ ID NO: 159446 - protein, 224 aa, Triticum aestivum
  Clone ID: PAT_TA_53864.pep
TPLHDAVLQRKSDVALKLLEANPSCAHMLNAAMQSPFYIAVRDSLTYVVKKIADQGLYVALMSTHGTVLHQSVLGNNIRALEILLDRYEELVELTDLSGNNALHYAAQHNNARIVSILLNKYSNLAYKQNDEKHTPLHTAAYYGSAEAAKELLKQFPDAIEMVDNTRQNALHIAARNDKVDVLELLLKYVLPEEIVNQQDRDGNTPLHHAAKLLNRQSTMLLLN

SEQ ID NO: 159447 - protein, 128 aa, Triticum aestivum
  unsure (1)..(128): unsure at all Xaa locations
  Clone ID: PAT_TA_53865.pep
THAAAHASAHARGSGEGXRRDXRGDXXLTGRXEEXXKAXGHRRGTAEGEXAXGXQPKGAEAXXXGGEXEXKGQGXXAXGTGGEGGXXXEEPRKSQXXAGRSQEGARAGPDKEHGPRGARGARGGGGGG

SEQ ID NO: 159448 - protein, 157 aa, Triticum aestivum
  unsure (1)..(157): unsure at all Xaa locations
  Clone ID: PAT_TA_53866.pep
GIPYRHPFAVTGVVATVGTGGPPFVALRADMDALPMQESVEWEHKSKVPGKMHGCGHDAHVAMLLGSARILQEHRDELKGTVALLFQPAEEGGGGAXKMVEAGAGENIEVMFGLHVADSVPIGVLAYRPGPIMAGSGFFEARISGKGGHAALTDDTM

SEQ ID NO: 159449 - protein, 88 aa, Triticum aestivum
  Clone ID: PAT_TA_53867.pep
MKLPLSAGSPDAAPELAKPSLPATWLILHALFCATSMAVGFRFSRLVVFLLFLPTPPMNPSAHLVSLVTPPVMLASCNTTGTMATTAT

SEQ ID NO: 159450 - protein, 59 aa, Triticum aestivum
  unsure (1)..(59): unsure at all Xaa locations
  Clone ID: PAT_TA_53868.pep
GFYFYFWTDTPSAVTYTNGNGGQLTMNWNGNRGNHVXAKGWNPGAGPTMAPSADYRLYL

SEQ ID NO: 159451 - protein, 90 aa, Triticum aestivum
  unsure (1)..(90): unsure at all Xaa locations
  Clone ID: PAT_TA_53869.pep
SPPCXVWSALSVRGAALRCXXXRPPLAXAXXSAALLLXXPLSXLAVAALWXPLXRXLXXAFVXLVWLCXSXCPPPPPFXWARXRGRXRGS

SEQ ID NO: 159452 - protein, 83 aa, Triticum aestivum
  Clone ID: PAT_TA_53870.pep
KGWLGPGSQSQRRAEKEEQKSQRRHRHSELDRKIHKYLIPETSIYRLKMGIQEWSHPPSPPTQQGQLYLPPGRVGGRVGGRVG

SEQ ID NO: 159453 - protein, 82 aa, Triticum aestivum
  Clone ID: PAT_TA_53871.pep
MVAASPPSLHLALLLFAAHAAVGGAAGAVGVSEGGQLWCVANNNAEDGALQSDIDWACGPNGGADCQAIQKGGACYEPGDLV

SEQ ID NO: 159454 - protein, 50 aa, Triticum aestivum
  Clone ID: PAT_TA_53872.pep
LTFVGVGHQPAPVPDPHSPLQPGQSHLVRGVVGVGRDELAVAVEVVVVGG

SEQ ID NO: 159455 - protein, 111 aa, Triticum aestivum
  unsure (1)..(111): unsure at all Xaa locations
  Clone ID: PAT_TA_53873.pep
TAXRMASXDAPQLGAATXEGPGAAGPXRXXAAAGPPEADPRKAXDXAXXRRXXESXQGERGRRAHGKXSRRQSRTQGGDXXGERXGXXKXKADXXDEATKAKXPGTDXARG

SEQ ID NO: 159456 - protein, 187 aa, Triticum aestivum
  Clone ID: PAT_TA_53874.pep
AWSRRRSQQVLTEQQFRPLWYWGRRTYMVSSVVINLFVAAMMSMATFAVTLAVPGGYSQQSGTAIVGHHLAFKIFAVGNTISMCGSTSTVLVLCYLTWQYHGQVLTRLIWANMLIVLSVLTAIISMLTAVYLTIAPVSRFLAYAVIAIGASAPFLACLILRKSLTRKSLFTRWIGMKLVPQGETGHR

SEQ ID NO: 159457 - protein, 164 aa, Triticum aestivum
  Clone ID: PAT_TA_53875.pep
QDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHGLKEVKC

SEQ ID NO: 159458 - protein, 189 aa, Triticum aestivum
  unsure (1)..(189): unsure at all Xaa locations
  Clone ID: PAT_TA_53876.pep
SHVLFNGFVCKDPKXVTAXTFFLAAKLDMPRDTKMSKVGSIVTLLNVMRIXGLNTLGISLARIDYAPLGENPPHTHPRASEILTMLEGTLYVGFVTSNPENKLIWKVLNKGDVYVFPQGLIHFQFNPNPYKPAVAIAGLSSQNPGAITIANAVFGSKPPISDDVLAKAFQVEKKTVDWLQAQFWADNHN

SEQ ID NO: 159459 - protein, 166 aa, Triticum aestivum
  unsure (1)..(166): unsure at all Xaa locations
  Clone ID: PAT_TA_53877.pep
LKKSMAKAVVPFYPXAGRLGADGDGRMEIDCNGEGALFVVARSDRTVEDFSGPSPSSELTKLFCPRVQPSSIMLAAQVTFLKCGGVVLGTAVHHAAVDGSSAFHFIGTWARYCRDGQGAVIELPCHDRALLRARSPPAIHPETVSMFCSKLAMHEHESSVLLELMG

SEQ ID NO: 159460 - protein, 165 aa, Triticum aestivum
  Clone ID: PAT_TA_53878.pep
GAVGVSKGGHLWCVAKNNAEDGALQSAIDWACGPNGGADCRAIQQGGACYEPPDLLGHASYAFNDYFLRSGGAASPAACDFSGAAALIGLNPSHGNCVFPSSCCGKKVVKITLFCSSPRNGSFTGITTYGRPGADLSQSFSWRLDTRSFILCMSLSVTFFVASHF

SEQ ID NO: 159461 - protein, 66 aa, Triticum aestivum
  Clone ID: PAT_TA_53879.pep
YFFIFFFIFFIFYFYFFLFFFFFFFFFFFFFFFFFFFFFFFLTKGRGGGTQKRGGEGAQDLIKGST

SEQ ID NO: 159462 - protein, 126 aa, Triticum aestivum
  Clone ID: PAT_TA_53880.pep
MTQRVFQFGRVGQETLDAFPGFPGPEKALPPLGGFPPYGVVRAGSLMFKGCCVGPKKGVVPLPPSLLKQPFFLALGGFKLKFFAPFSKFGAGGFPPPGEKQGFFGKLKALVFAPLPPLFPFVQTTL

SEQ ID NO: 159463 - protein, 54 aa, Triticum aestivum
  unsure (1)..(54): unsure at all Xaa locations
  Clone ID: PAT_TA_53881.pep
MSAETDETAAGGLAGEMEVEAYXRLFPLAFLERHLRESVRPDAXRLXEAPPTTV

SEQ ID NO: 159464 - protein, 190 aa, Triticum aestivum
  Clone ID: PAT_TA_53882.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKIARREERLAQGPRDHAP

SEQ ID NO: 159465 - protein, 196 aa, Triticum aestivum
  unsure (1)..(196): unsure at all Xaa locations
  Clone ID: PAT_TA_53883.pep
PSPPPPPPRPXRWPPRAPRPPRARAGPPARXPPPPXXPXARRPPRGPPRAPPRXPPGPPPGPPGPPXPPGPACPRCPPPGRLAGARSPPGARSARSPRVPRCSRVASGPPAGCAPSXXXGCXARRRAPRPPXRXRSPGXXXAGRXXPXRACXCSSPSPPPPPRGRGRRXXXXAWCCCPLARRCAWCCRVRVVAPSV

SEQ ID NO: 159466 - protein, 179 aa, Triticum aestivum
  unsure (1)..(179): unsure at all Xaa locations
  Clone ID: PAT_TA_53884.pep
PPPPPPRPPAXPAPAPAGARPPAPPRPRPPPPPARGPGRPGPRPPXPPXRPPPPPGAXPXRFPPXXRPPPPLSPPPPGGXPFLPVCLPVPSRVAPPXAPXSLSXCCPRLVXRLVPSAGCFRPRGGVVLVGVGAAGGAVAVVRGAAGGLRGPGGPGGGRALRRRWFARPLRSAFRGRRGS

SEQ ID NO: 159467 - protein, 125 aa, Triticum aestivum
  unsure (1)..(125): unsure at all Xaa locations
  Clone ID: PAT_TA_53885.pep
TQPPSFRPKRPGDKPXXXPXQEGXKXXGXGTXXXGRXEXXXXKXXXXXTXGPXXXTXEGKXXERHHEXXXEAXXXDXXGXNXKNXXXKXXKXGXXAXNXKXDXAKEAXNXTXQXXNXNHXXQNGN

SEQ ID NO: 159468 - protein, 108 aa, Triticum aestivum
  unsure (1)..(108): unsure at all Xaa locations
  Clone ID: PAT_TA_53886.pep
RRARGDRTTGEATPAPAATAATAAAPKNPXXGARRAXXXAAXXGAAKPGGRRXXXXAAAXGKKXXSPAXKSXAEXXNPXGXXGTXPGDQGKNPGGXGKDPGGQKGGRE

SEQ ID NO: 159469 - protein, 109 aa, Triticum aestivum
  unsure (1)..(109): unsure at all Xaa locations
  Clone ID: PAT_TA_53887.pep
LGPVGASGPFFFFFXGGXFCRSAWGFXCRLFXLXFGXLFLXLVLLLVVVCXFAVALLXCVXXVVXLAXGLAVGXXLVPLXVXLLXVGXXXRXAXPGPCLRRLLSXXRGS

SEQ ID NO: 159470 - protein, 134 aa, Triticum aestivum
  unsure (1)..(134): unsure at all Xaa locations
  Clone ID: PAT_TA_53888.pep
PRPPPPPPPPPPPAFPAPAFPLXALXALWAXGLPPWSPCCCPGXXPWLPCGXACCCXXPCCCPXPAXXAAXPLPAPRVVAXASXPAAXVXAXXSLPPXAXPXXXXXPXPLGPGGAFPLLAPLASSSVALPGRWV

SEQ ID NO: 159471 - protein, 52 aa, Triticum aestivum
  Clone ID: PAT_TA_53889.pep
PRTPTPAALPLITPPASHGPSTDTAQDGTGLVVHGADAERGSAGDSRHERVA

SEQ ID NO: 159472 - protein, 153 aa, Triticum aestivum
  unsure (1)..(153): unsure at all Xaa locations
  Clone ID: PAT_TA_53890.pep
PPPPPPPRXPPRPGGARAPPAPPPPPPPPPPPPAXPPPRPPPAPPPPPGPPARPPPPRRAXSLXPPPPGSGPPGPXPVARXSAPRCPGPRLRGSACRPPRRVSAPAWGGVGPGVCSRRWCGAVRRAVRPAVSGWSAPCPAPPRARRVGRVGRG

SEQ ID NO: 159473 - protein, 79 aa, Triticum aestivum
  unsure (1)..(79): unsure at all Xaa locations
  Clone ID: PAT_TA_53891.pep
WCRRCPCCSVXCRGCSPRRXARLGPAARRRSPWCRRWXCRRRXXXXXGWXXXRXCGPXXGPAXXGXXXGRXXWWXAWWL

SEQ ID NO: 159474 - protein, 53 aa, Triticum aestivum
  Clone ID: PAT_TA_53892.pep
AHPPAERAPAPRAQPATQTVTNKLSCRPVCKPAGADEEGGLRSLRFRKLGKMG

SEQ ID NO: 159475 - protein, 114 aa, Triticum aestivum
  Clone ID: PAT_TA_53893.pep
MTVVPSSQPQPRLISPSSASVAAGARPPHATRHGRRRPLRHGARRRSPPAPPLRATSTRSVLRGAPPDGPSSPGPAAPVGPAPGGGGGGNARYEGDAGQGGVLFTRLVLCMKGT

SEQ ID NO: 159476 - protein, 58 aa, Triticum aestivum
  Clone ID: PAT_TA_53894.pep
HPPSASSRAHTCWFLSGPTKAQCCMIFPWPYSTQRLGIISYLVLLGPFCSDLLYPPPQ

SEQ ID NO: 159477 - protein, 90 aa, Triticum aestivum
  unsure (1)..(90): unsure at all Xaa locations
  Clone ID: PAT_TA_53895.pep
PCSRGSSALLLCWSRRRCRGXAPRCCXARRCVGRXGCXPAXPRXXGXCCRRXRRRVPPPARPRXPSWXXXPLAPRXPXXSXSCPFXXXRR

SEQ ID NO: 159478 - protein, 77 aa, Triticum aestivum
  unsure (1)..(77): unsure at all Xaa locations
  Clone ID: PAT_TA_53896.pep
LGSSXXSALGLAAAGFGFGAAAAGLAGRXAGLAWXGLAAXXXXALXLXLXLXLARCARLAFARALAXASAXAWVXPG

SEQ ID NO: 159479 - protein, 82 aa, Triticum aestivum
  unsure (1)..(82): unsure at all Xaa locations
  Clone ID: PAT_TA_53897.pep
AEPRDRRRKXEKHXXXHNEXXXXEASEGQDXXRSKGXXXXXEDGHQEXXRXRKGRPXRRAHKGHKAXXTGQRKXQXXGTRAS

SEQ ID NO: 159480 - protein, 80 aa, Triticum aestivum
  unsure (1)..(80): unsure at all Xaa locations
  Clone ID: PAT_TA_53898.pep
PTPXXKKXXKRRRAPXHXEPDKXXGXXAPKPXXXPHKAREXXPXXPXXRNRXKXAXTNXEXQTSRRQXDTTAEGKARTDK

SEQ ID NO: 159481 - protein, 85 aa, Triticum aestivum
  unsure (1)..(85): unsure at all Xaa locations
  Clone ID: PAT_TA_53899.pep
SGERTGGEGGEXQRXTXRKRHSHATKXNQXRGGKTPGGRXXXQXTKKRASGPKGAGAGKKXQGXPHXRPTEXKRPRXARNRRTGN

SEQ ID NO: 159482 - protein, 61 aa, Triticum aestivum
  unsure (1)..(61): unsure at all Xaa locations
  Clone ID: PAT_TA_53900.pep
FIGSFGNCPAGIRLAIKSQNLPPPXPPPSEQHHRSAALAGPRAGVALYAAVTVLAALLRAV

SEQ ID NO: 159483 - protein, 45 aa, Triticum aestivum
  Clone ID: PAT_TA_53901.pep
FKSSIFNKVVVYHVYPFFRKFFSKGHKVLSIPKDQLLKVGITYEI

SEQ ID NO: 159484 - protein, 132 aa, Triticum aestivum
  Clone ID: PAT_TA_53902.pep
QRPPVGAPPPQGYGDKGGYPPPGYPRAGYPPPGGGYPRAGSPRRGYPPRWGQKPPPPQRQQQSRGLSFLGGCLAPLFCFCFLDACFLGGGKKPPFPFVGLGLSYPFCRRNGARSLKFFSCGGFSPTLLDPCL

SEQ ID NO: 159485 - protein, 78 aa, Triticum aestivum
  Clone ID: PAT_TA_53903.pep
MSEWARLALSHEWSSHILHVQIAGELQRHGYILRLTQVALMCAAVEPDRRPKMPDVVRMIDEIAAGVEEKGRWELVVG

SEQ ID NO: 159486 - protein, 121 aa, Triticum aestivum
  unsure (1)..(121): unsure at all Xaa locations
  Clone ID: PAT_TA_53904.pep
VPFRRGPWXLPLXAXXPSAXPWXVSFSXARALPXSVLXXWPGPPXPSXAAPXALLVRAXAXSLAPLGRSPGXGXXXXAXXGLFPXGSPXGGGSPPPRPFAGFCFGVPRVLVPPPVCGRAPL

SEQ ID NO: 159487 - protein, 185 aa, Triticum aestivum
  unsure (1)..(185): unsure at all Xaa locations
  Clone ID: PAT_TA_53905.pep
PPPPPPPPXPPPXPPPPPPPPPPPPXPPPXXXPPPPPPXPPPPPPPPPPPXPXPRAPPPPXPAPPAPPAPPPXPRSPPPPPPPVRPXVSPXXPSPLPXPPPLXFPPLSGPGPPPLGALGPFWLARVVAGLLCSAARAWRLVAPPPPLCPCLLWGGVCPSGSRPLSFSRCLVALFAPSAFSPPPPP

SEQ ID NO: 159488 - protein, 85 aa, Triticum aestivum
  unsure (1)..(85): unsure at all Xaa locations
  Clone ID: PAT_TA_53906.pep
KPVPSTIPSTKGAGIATQIPRNAQQXQQDLPKGPASRTQGAAQGNRRQRPVTRQKTEWGRAPSHRLGQENGNGGSRRYSRIFSSV

SEQ ID NO: 159489 - protein, 99 aa, Triticum aestivum
  unsure (1)..(99): unsure at all Xaa locations
  Clone ID: PAT_TA_53907.pep
PPXACFSXLVFLRPSAXAVGPXXFSFXXAXACPFVXXXPVFLPVRSFWFCFXXXXAPPPXFAXXXLXXPRPPRXXXRXXXXXXSFASXAXVXXCAFPLF

SEQ ID NO: 159490 - protein, 129 aa, Triticum aestivum
  unsure (1)..(129): unsure at all Xaa locations
  Clone ID: PAT_TA_53908.pep
GARAPPVVPXPXAXLXXVLXVXXXRLSASXSLAGXXXXLAALGXFPFARXFLAPGXAPLVAXLPXVXAWWXGLXARPAAXXVXXLLPPALGLXXXAXLPPPPPRVVSPVLRCAPGPRPLLPVARVLFSA

SEQ ID NO: 159491 - protein, 73 aa, Triticum aestivum
  Clone ID: PAT_TA_53909.pep
APPQWTLHGFQPPQVKMFSDKGAHHHVIPRAEQAKKRAEIPRFRQLQTLKGHGSSVAQPKGPEIQAIQPSSRV

SEQ ID NO: 159492 - protein, 161 aa, Triticum aestivum
  unsure (1)..(161): unsure at all Xaa locations
  Clone ID: PAT_TA_53910.pep
RSWRXSCPPXPRRSXWXXRXGXCRPAXPRRASPSXAXAGSCRGXGAAFXXXXLAGLSWWGPXPLPAGALALVVXXAXAXLRXSCPLXSRPCVFLSLXXXSGWSCGPPPLWXWSASPXAXVAPXCXXCPAVGLXXSRVXVVSGXCXXXWPSALRXXXPPPPP

SEQ ID NO: 159493 - protein, 139 aa, Triticum aestivum
  unsure (1)..(139): unsure at all Xaa locations
  Clone ID: PAT_TA_53911.pep
CSAFPPCXSPGXPXXACPVALRSPXXXSXXXRAGRXLCFSAPLVXPVCXCLXXFXXVAPXAPSSLFLRLAXXSAXFVCRXPFPPPLAPXXXVPPVVVPCXXFLXPVPVLLRFVPXXFVSXLXXAAASXLCXXXFPPPPP

SEQ ID NO: 159494 - protein, 77 aa, Triticum aestivum
  unsure (1)..(77): unsure at all Xaa locations
  Clone ID: PAT_TA_53912.pep
LPRAGHRAQNSAQRPERRGEPPTRKIERPTPAREGGAKPKGLGNKGRAGGXVKKKRARPKKKKKPQKEKKKKKKKTH

SEQ ID NO: 159495 - protein, 56 aa, Triticum aestivum
  unsure (1)..(56): unsure at all Xaa locations
  Clone ID: PAT_TA_53913.pep
RFPTRTENITTKTDATGARTDEPEPSINDPKAERGSDGKTPTKVKDEEXKPADSSA

SEQ ID NO: 159496 - protein, 101 aa, Triticum aestivum
  unsure (1)..(101): unsure at all Xaa locations
  Clone ID: PAT_TA_53914.pep
GTRGPQSNPRRRGPAATEEEHNPRQNKEPERPPNSKKEHKDGRFSQDETNAEDMKLRDDHERXKKNRNHRGQRHNWGVRDRGQHTKTTGRRGKTVGVTKKR

SEQ ID NO: 159497 - protein, 239 aa, Triticum aestivum
  unsure (1)..(239): unsure at all Xaa locations
  Clone ID: PAT_TA_53915.pep
PRVRPRVRPRVRGITLSIHGGEKIGVVGRTGSGKSTLIQALFRIVEPSEGKIIIDGVDICTLGLHDLRSRFGIIPQEPVLFEGTIRSNIDPLEEYSDVEIWQALDRCQLKEAVTSKPEKLDASVVDNGENWSVGQRQLLCLGRVMLKHSKILFMDEATASVDSQTDAVIQRIIREDFAECTIISIAHRIPTVMDCDRVLXVVDAGLAKEFDRPAGLIERPVLFGGLGFKSTQTRVVWTC

SEQ ID NO: 159498 - protein, 111 aa, Triticum aestivum
  Clone ID: PAT_TA_53916.pep
HAYEDAYLVFPWYGRHGLFLSLHGGRGYCRRYCLWPDRTTDRSVERDPRRDGARAAPARGGPRHGRTKTPRRRHRTPSRTPTYPGRQRRTNRATRMLTPFPSEVPRRTEME

SEQ ID NO: 159499 - protein, 95 aa, Triticum aestivum
  Clone ID: PAT_TA_53917.pep
LPSVPGAAVSVRPVQGGDPSSRFARCHQSPIRSARMGSSPVSFDPFKSVFPVVAWRAALPRRAVSQVWQRERIGHADAPTPSSFVGILFPSPREG

SEQ ID NO: 159500 - protein, 218 aa, Triticum aestivum
  unsure (1)..(218): unsure at all Xaa locations
  Clone ID: PAT_TA_53918.pep
CYVPMELCVVCEGQKFLGKLSDEQTSKVLRMGCQRPSERKGIIKGIVEEEFGAGSNSYADQFNLQVSKDMTQLSGRVLLPPRLKFGSGGRITDMTPHRFDRQWSLLDSHVTDGSKIKNWALISFGGTPEQHSYIPKFVNQLSSRCEQLGILLNKKPVISPLFERIQLLNNPGILESKLGKIQEAASGNLQLLICAMERXHRGYADLKRIAENVIGCCD

SEQ ID NO: 159501 - protein, 118 aa, Triticum aestivum
  Clone ID: PAT_TA_53919.pep
SVSLVLGCMPFSRRLVGLAGAGFVCAGEGARFRGPSFDLLGPPVSLAPRSGLFPPIRPAAGAQGDMRAASAPRRRTPNPAARLPHGETRVPLAAACAVAIAARRQERGRRSREGRRNA

SEQ ID NO: 159502 - protein, 328 aa, Triticum aestivum
  unsure (1)..(328): unsure at all Xaa locations
  Clone ID: PAT_TA_53920.pep
MGSTPGSYCSFKVLLIGSAVRKSLLLSFSPATNHHISPTIDFKILTDKKTTPRTTLPILTPIHPPPPHTPSTTTPPPPPPGPPRNTXNPPLPPPTPXXPPPPTPPPPPPTPPPPPPHPPPPAPPPXRPPPHPTKPTPXPPPPLPPXPPPPXPPXPPXLXXPPPXXXPPXXPPPPPXPPXXXXKXXXXPPPTHPPPXXXXXXXXPPPPPTPXXXXPPPXXPPPXPPPXXPXXTPPPPPPXXXXPPXXPXXPXXPPXXPTXXPXXPPPPPPPXXPPXXXXPPPPPPXPPXPPXXXXPPPXXXXXXXPXPPPPXXXXXPPPXXXXXXPPPP

SEQ ID NO: 159503 - protein, 89 aa, Triticum aestivum
  Clone ID: PAT_TA_53921.pep
MAETEYRCFVGGLAWATDDNNLQQACSQDGEILDPKIINDRETGRPRRSRLPTLGREEPVRPAIGETNGPGAPRARHHPDPRPPPAASG

SEQ ID NO: 159504 - protein, 194 aa, Triticum aestivum
  unsure (1)..(194): unsure at all Xaa locations
  Clone ID: PAT_TA_53922.pep
PRVRPRVRMIARGVMLGADQPVILHMLDIEFAAEALKGVKMELIDAAFPLLKGVGATTDVAEACTGVNVAAMAGGFPTKEGMERKDGMTKNAPIYKAQASAXLEAHAAPNSKGLXAANPANTKARRLKECAPSIPXEKNIRGSTRLDHNRXLGQITEETRAPHIPPRTNASSRGGRKRGQKKTRERNQGAPPNT

SEQ ID NO: 159505 - protein, 84 aa, Triticum aestivum
  unsure (1)..(84): unsure at all Xaa locations
  Clone ID: PAT_TA_53923.pep
KCWKGNSPFFQVMNPYEAAKYVSDGHRPTFRSKGHTAELKELTEVCWAADVNLRPSFLEILKXGXEKIKESLASHDHHWHLFSQ

SEQ ID NO: 159506 - protein, 159 aa, Triticum aestivum
  unsure (1)..(159): unsure at all Xaa locations
  Clone ID: PAT_TA_53924.pep
MPKEGVAGDGSKTVEQSSAEEARAANALVLRGRPGGELGAPRSVRDVGMSSTSFPLLTRTNYXMEVIMEVRHMWKAVETGDVGYEEDRLAMEAILRSIPHEMVLTLGAKKTAKEAWDTINTRDPALPQSKKRAGKAPAFLHPLRNAEDPIRPGPKNWAP

SEQ ID NO: 159507 - protein, 157 aa, Triticum aestivum
  Clone ID: PAT_TA_53925.pep
GSRVLAGPFLFRTVLFVLALPRWMAVAAEARRLVGDLLVVSATAPDDLGALAGVVNHHLLLLCYHGVHFGWVGHLGSRPVAWPEPARRCPGGQRLPVPLASKARRGGAPAQTLRGGSRRARRGHRRRRCAPWVLLVVARGQCGDGMKACTNAWTHAW

SEQ ID NO: 159508 - protein, 181 aa, Triticum aestivum
  Clone ID: PAT_TA_53926.pep
MAPKAAEKKPVVAAEKTPAGKKPKAEKRAPASKEAGGEGKTRGRKKGSKAKKGVETYKIYIFKVLKQVHPDVGISSKAMCIMNSFINDIFEKLAGESAKLARDNKKPTITSREIQTSGRLGLPGELAKHADSEGTKGRHQGHFILGRRRVFHEVEGRAGHPGTEAGQEARRDEAGGKKRAD

SEQ ID NO: 159509 - protein, 171 aa, Triticum aestivum
  Clone ID: PAT_TA_53927.pep
MQLRLSSPAGAPFRHGEPRLLPRALAKGPCRLRGKGDAGGTRVARRTSSVSSTPTKVPAGLQAKPAGNDIQILERPEEEEARDLDGHRVIPGTELEQPLIDRVKAMLGSMGDGEISESAHDTAWVALAPRLDGGDGAQFPAALRGILGNQLPHRSWGRRGPLPRPTTREHQ

SEQ ID NO: 159510 - protein, 245 aa, Triticum aestivum
  unsure (1)..(245): unsure at all Xaa locations
  Clone ID: PAT_TA_53928.pep
MKFSFTAAALLAVSPLTEATKPPVTAKKLQKLITEKGLMKNLETLNKIAYANGGNRAFGLPGYAASVDFIYKEISKLKGFKTWKQDFPANFTQTLAAEVTVDDETFRTVALTYTPSTSEEGVTAELIHAPEGEDACDVANYEGLDVKGKIVLVERGLCPDQTTFAGKVKPAAAAGAAVVVIYNSDEAKLTAGTLSAISPDYVPTALIDQAPGKALKAKLEAGETIETFAKIIQTIETRITXNXFC

SEQ ID NO: 159511 - protein, 133 aa, Triticum aestivum
  Clone ID: PAT_TA_53929.pep
GGGPALLSFFRGKGRPVPRKRRGKKGRGRGFWALPVWGSPLGVPPPPPPFMGRFRGGSLFPLGWGPVWEGGRVGPFCFFPPWPKGGFLPGGLVWGPPGFSRLPVFKPRPVDFILGAPFHSFFVACPRSVTWVP

SEQ ID NO: 159512 - protein, 55 aa, Triticum aestivum
  unsure (1)..(55): unsure at all Xaa locations
  Clone ID: PAT_TA_53930.pep
GSVGRPRVRGRVAAIPLSQRPPSFSXEKQXXIXTPQXQPLHXYYRPQKYHVNHNT

SEQ ID NO: 159513 - protein, 119 aa, Triticum aestivum
  unsure (1)..(119): unsure at all Xaa locations
  Clone ID: PAT_TA_53931.pep
KLDASVVDNGENWSXGQRQLLCXGRVMLKHXSKILFMDEATASVDSQTDAVIQRIIREDFAECTIISIAHRIPTVMDCDRVLVVDAGLAKEFDRPAALIERPSLFGALVQEYANRSFDM

SEQ ID NO: 159514 - protein, 78 aa, Triticum aestivum
  Clone ID: PAT_TA_53932.pep
EQPIEFLMADGLDDAIGSIVGFDEVLVVKHPVGLEPLDQGPGSGGYKLREYSLVVVGLYKQRPYVVWFGFKEVVCGCM

SEQ ID NO: 159515 - protein, 106 aa, Triticum aestivum
  Clone ID: PAT_TA_53933.pep
EPKWEHFHPLSAGGPAQVSQFFKNLKAYVKRFSRSKNPNPVPRVPETLSRYTLLEFEFCPLGTLCPSPPPKAKGLVPSLVPGGRFASSPRVAKMPNALSPFPKFEW

SEQ ID NO: 159516 - protein, 130 aa, Triticum aestivum
  unsure (1)..(130): unsure at all Xaa locations
  Clone ID: PAT_TA_53934.pep
SDQNIPRGTVVDTVITHPREFDFYLCSHWGTKGTSRPTHYHVLWXENRFQSDEVQQLIHNLCYTFVRCTRPVSLVPPAYYAHLAAYRGRLYLERSDSVATSCTTLYRSTPLQTTPLPKLSDSVKRLMFYC

SEQ ID NO: 159517 - protein, 94 aa, Triticum aestivum
  Clone ID: PAT_TA_53935.pep
SMTISKQGCCLQPCLALYLILQCITPTITDHISSQHRQCNETAKKAHRIILEGLCVDYPCRIHKSDHAGNHHPGTMNSPLCLNKGMPPPQPPTL

SEQ ID NO: 159518 - protein, 70 aa, Triticum aestivum
  Clone ID: PAT_TA_53936.pep
GVMPRPRSGGTGAPFIAYLAVGLSPGQIKNGAPSRSKGLSKYNQLFRIEEKLGPPPVYSGPKFRAPGGPY

SEQ ID NO: 159519 - protein, 114 aa, Triticum aestivum
  unsure (1)..(114): unsure at all Xaa locations
  Clone ID: PAT_TA_53937.pep
VLLARSSPLPSYIINYAXLSATDVGFFGDFLLPTIVGCLPMILQNVSIVSLADAAVASTTGSKKSHVYSYLFPILGIVSSILISLRIKQYSSALAIPEELTNPPTNGTSMRIPS

SEQ ID NO: 159520 - protein, 203 aa, Triticum aestivum
  Clone ID: PAT_TA_53938.pep
AGPRSSFFSRRKAVEEAVNNAEAYKEKMNELQSSLDSSASKTLLLEEEVKDLTDRFSQHQEQAHSVHERSIELASLLHTSKSDADGAHSRRQELEQELEATQAKFKEVEAELEQYRSKVSHLSDDVEAYQTKSASLEAVMEAASGKEKDLMDSLIQITEEKKKLEELTAEYEVKLQEQLQEKQVIEERVQSQELKVLDLEELL

SEQ ID NO: 159521 - protein, 114 aa, Triticum aestivum
  unsure (1)..(114): unsure at all Xaa locations
  Clone ID: PAT_TA_53939.pep
VLXXVXPXXGXSSXAXSXXXSFXXXXFXXLAGXSAXLARXXXXPPXXSRGXXPSVRLVLPGXLAXXAVSGGXXAVPPPPSALSLFPLAAGLVVGRRVFSLLCCLRPPRAVAVPP

SEQ ID NO: 159522 - protein, 203 aa, Triticum aestivum
  unsure (1)..(203): unsure at all Xaa locations
  Clone ID: PAT_TA_53940.pep
WIISKDLPGEVQYALDFPWYASLPRVEARVYLDQYGGDDDVWIGKTLYRMPLVNNNTYLELAKRDFNRCQIQHQLEWHXYKKNGLEAFGVAPRDVLRAYFLAAACIFEPSRATERLAWAKASVMANIISKYLRSDLSGNKMVERFMHGGLYEGNNDISWLKGDAKVEILVGALEKLIDLLAQTALHVGEEPMHINNLLRCVVS

SEQ ID NO: 159523 - protein, 222 aa, Triticum aestivum
  unsure (1)..(222): unsure at all Xaa locations
  Clone ID: PAT_TA_53941.pep
PGINDDGSGTTLILXTAKALQHFSTNLKVRFGWWGAEENGLVGSRYYVNNMKKDEVDNLLAYVNFDMVSRGFFGVFDGTGEKAGPGGPPGSDVIENLFREYFEAEDIEVTPVGLTGGTDYVAFREVIKKPVGGLFTGTGLEQDACYHQACDNITNPVPETLHTNAHAAAHVLSKLAIDGVELLSKPPANTTVGFIKRVRDEASLHFHEVNNAEGKPCDHDLI

SEQ ID NO: 159524 - protein, 137 aa, Triticum aestivum
  Clone ID: PAT_TA_53942.pep
AALPGYFRDKLSRPVEVVTPGKKDGDKKDDGEKKKDKGAGDGGEKKKDGGGEDKKDKSAASVAPMPMADPSMYQMPPQYGYMPYPPAPVGYYGAAPPPPNPGFYPNAGPQYPPPYATYPAHAPQMFSDENPNACSVM

SEQ ID NO: 159525 - protein, 44 aa, Triticum aestivum
  Clone ID: PAT_TA_53943.pep
VPPHPKGEGGESTEKPVLAFNKGKPKPVIVWTLIVRPPYVLFWR

SEQ ID NO: 159526 - protein, 153 aa, Triticum aestivum
  unsure (1)..(153): unsure at all Xaa locations
  Clone ID: PAT_TA_53944.pep
NLFHFNLFFPIRLSRIDFFKTALNGGACIRTSAXPTYLRAHQFWTKDKDGRPRAFKPIKGGAAKDNSTMWAMTDVSKHILLGNHNFSASKRAHYCKSMALSLGTGYVKEGGKFHAGARXMWGILGWPVYHGATPIIVWCSQFSAYLSLIKVSG

SEQ ID NO: 159527 - protein, 135 aa, Triticum aestivum
  Clone ID: PAT_TA_53945.pep
MVKQGEIDKEEFKKVMALMRSYNRQGAAHRHGLRTGFKVGQSVENGGVVEYFFGNDGNEPLHFDKFTSFLKELHEEIIRLEFSHYDVKSTNTIPAKDFALSMGASADMNHITKLLDRADTLGNDPYLKNLRITFE

SEQ ID NO: 159528 - protein, 183 aa, Triticum aestivum
  unsure (1)..(183): unsure at all Xaa locations
  Clone ID: PAT_TA_53946.pep
TSFLGGNSTRCATASQHRRPGCLLGLLSVAGALFLTPTALAAGGKTGQATGFWGRSRGEGSLREACDYSLCTMVTMSFLDVFGANGKCHLDLSGHDLSSVGAGIMHCXQSKGAPVSLCIGGYGAGYSLTFNRYALWLFCHLWNFYFGGSIPGVPRSFCDTRLDRVDLFLEHGTPGDRYYDLAL

SEQ ID NO: 159529 - protein, 191 aa, Triticum aestivum
  unsure (1)..(191): unsure at all Xaa locations
  Clone ID: PAT_TA_53947.pep
MMQGIPYSGLNVHGNSMQMHSSSSGKQLFNQSQMLGSFAMPINRATAPDNPGFQFGEHEKKDRRHHHQQQQQHSHYSKNSISDEEEHDMTEDVTDTQNDKGKKGSAWHRMKWTGSMVKLLITAASYTGEDPGADQGRRRNIAIVQKKGKWKAISKGMGERGCSVSPKQCEXDSSMDLNKRYKXLTDILGSG

SEQ ID NO: 159530 - protein, 206 aa, Triticum aestivum
  unsure (1)..(206): unsure at all Xaa locations
  Clone ID: PAT_TA_53948.pep
EGPVRLLRLRRLQPRQVGVGGGGVRGAHGRRRAPPLRGRRVGGDLPPPPRGQRRVRAXXXXXPXRXHVPHPGPPQHLPPPHQXXQGXPPRPHPGPHVPPQLQXPPIHQHQLHXXXSAAPPTGPPPGTTPPSNWACCPSPPPAPPPLTXPELLKLXPYPHFLLYSFFPPPNLPPPSPPPPPXSPPPPPPSLPPSPPPPPPPPTPPPP

SEQ ID NO: 159531 - protein, 182 aa, Triticum aestivum
  unsure (1)..(182): unsure at all Xaa locations
  Clone ID: PAT_TA_53949.pep
MSPQTETKAGVGFQAGVKDYKLTYYTPEYETKDTDILAAFRGSPQPGVPPEEAGAAVAAESSTGTWTTVWTDGLTSLDRYKGRCYHIEPVAGEDNQWICYVAYPLDLFEEGSVTNMFTSIVGNVFGFKALRALRWEDLRIPPTYSXKTFQGPPHGIQVEREKLNNYRSALYWENTIKPKKGI

SEQ ID NO: 159532 - protein, 95 aa, Triticum aestivum
  unsure (1)..(95): unsure at all Xaa locations
  Clone ID: PAT_TA_53950.pep
HASGAXTCGDVTSAVAPCMSYATGQTSAPSAGCCSGVRTLNAKASTSADRQAACRCLKKLAGSGITMGNAANIPGKCGVSVSLPINTKLHCNTLH

SEQ ID NO: 159533 - protein, 126 aa, Triticum aestivum
  Clone ID: PAT_TA_53951.pep
MERTPVMVRQGGQEVLRQLPPGFRFRPTDEELVVQYLRRKALALPLPAAVIPNVHNLYSLDPWDIPGAREGEKYYFAVRPDGGAKRGGRTTTGSGCWKPASARERPVVVSRCGRSHLVWVKNSMVF

SEQ ID NO: 159534 - protein, 133 aa, Triticum aestivum
  unsure (1)..(133): unsure at all Xaa locations
  Clone ID: PAT_TA_53952.pep
APPTPKPHIHPHIQYXSYWKNPPHNAMRYLMTKIYGLELGTKPRQKGTKIXSPQDXPNLLGATYAADFFLXGSANCIPPHPXAPIERTVXYRKKAARMHSPLSYTINSHIQKNKQQQKHQYTTHTPSIPQIAI

SEQ ID NO: 159535 - protein, 150 aa, Triticum aestivum
  Clone ID: PAT_TA_53953.pep
GRRRLQLHASATRAVTQIWRHTSPRPSAPRRMLTAPTHAPALRSRLSRRRPEPPLLRPGSRSSPARAHPLGAAVPNRSSSSSSSFSSCHPQSKESSGSSPSLGSQSKRLLFLAAIRNQSSPSRAAIRNRSCFSFNISLRAAAINLVWRQP

SEQ ID NO: 159536 - protein, 139 aa, Triticum aestivum
  unsure (1)..(139): unsure at all Xaa locations
  Clone ID: PAT_TA_53954.pep
MSDGICQMGFSSESLGALTIFLKWCNNNLGWKGSWNKWKSANPATWLTVGLKTDDKSRQWVHPNNVLYGVGQVAHKKIICGGIMLXWDQCVHKQTHFNSLYQVRPLSSCNSSTLASCIAVGLSLRNCGKLKQSKACSCI

SEQ ID NO: 159537 - protein, 142 aa, Triticum aestivum
  Clone ID: PAT_TA_53955.pep
SRWAQKGHVDSSPFGGQGRSSFPQEKGRPGVLGDRAEYARVWAARDDCGENPGSVGGPLGRVPRSVPVGQAHHVKPPVRRACFGGHCLDSRPSFHLCRRQEYLRASPDSQGAVALLCISINLCGVIKKKTMKEKKNHNKEVN

SEQ ID NO: 159538 - protein, 59 aa, Triticum aestivum
  unsure (1)..(59): unsure at all Xaa locations
  Clone ID: PAT_TA_53956.pep
YGQDELWMVCEACXKWSSGKGEKITLFLVEHIRHQKWPVCNSSIKRASVWWGIPCGAHV

SEQ ID NO: 159539 - protein, 109 aa, Triticum aestivum
  unsure (1)..(109): unsure at all Xaa locations
  Clone ID: PAT_TA_53957.pep
SGPRVPGKXXRRKRGGISCLLFACTIFILRCLLHRGDTAYRVFTSSHVGIMLQPRGFLNTKHWFILVESENRFNSMNNVSKACFSFYHGLFFSRRLSPDTLLLSIFDGL

SEQ ID NO: 159540 - protein, 106 aa, Triticum aestivum
  unsure (1)..(106): unsure at all Xaa locations
  Clone ID: PAT_TA_53958.pep
STFFSNYVRMKHLLVALLSRRMDHTHTCASVGWRPAAGAGPGGSGRAWRASGRARRAAPGARRRAPYQRQPLLVLHRPPGHLLPVEPRPSPAPCPRPEXYRVHAVP

SEQ ID NO: 159541 - protein, 77 aa, Triticum aestivum
  Clone ID: PAT_TA_53959.pep
MDGHGQPALLYIVPFTLGTLMSLGWKPGELRNLWFKGEPERVCTHQGQGYVQMAKPPAAGDDQDDDEDDEEGNPFSF

SEQ ID NO: 159542 - protein, 116 aa, Triticum aestivum
  unsure (1)..(116): unsure at all Xaa locations
  Clone ID: PAT_TA_53960.pep
SHEGSIAHIAKGPATTLQIVDNEEAMFRSLKTLGNTPKCGLIFHSSFIGRAGAYPHERRAGSVANECSVACGSGCXADMSSHIFGQTVRGQVQGTLKFYGQGVAGSNNISVMRQGN

SEQ ID NO: 159543 - protein, 156 aa, Triticum aestivum
  Clone ID: PAT_TA_53961.pep
HSEECDLSWIMFILQGAPTLKELRILVRDHLCEMVTGERRKKYAFSEEKDKGLEWEPSASDFKHHNLAELRIYGRFEAEENIVRFARNVMEAAVNLEDIQLYKSPVCENCKHMLQEWTLKEKSLLSYKLSKGMLSSLVRIQFPSLGEIFTWPKYWS

SEQ ID NO: 159544 - protein, 111 aa, Triticum aestivum
  Clone ID: PAT_TA_53962.pep
PKCVDFVMNKSDHQTIINHLGGLLFAIWPIYVWALFFANILGTKQPSQHQLPYDKMGQPCSEQKRSRKHFPSTWGFSTFYHVPAKELIICFNHLKNSRIFQICELSLNPKV

SEQ ID NO: 159545 - protein, 104 aa, Triticum aestivum
  unsure (1)..(104): unsure at all Xaa locations
  Clone ID: PAT_TA_53963.pep
MAPAVGIKRTGGAQAVTVQAPPPPPDARLVREAVRTSTIAEADAPAALEAPAPALEGFLCLEEAEGRRWKYVEDAXPAQGKAKGRGRGGSADPLGAPARGGAVQ

SEQ ID NO: 159546 - protein, 223 aa, Triticum aestivum
  unsure (1)..(223): unsure at all Xaa locations
  Clone ID: PAT_TA_53964.pep
MEKKLPLPAVHGEGLWARPWRRAKTAFLLGSMLASLLLGCAPPLLIGLLDLLLPPALLSNFLRADAHQHAASAHTLLDQARGXHFRSSLADLPAGCGGRSLLSLCAYTAXGGRAAYLRGAAARTAGLPLGRGRGGAAAGRRAPPAPAGARPRPGRAGAGGRGGAGAGGARPRPGRPPPPAARAAGRAGAGRAPRPPRPPPPPPRPPGPRRGGPGPRGPAPPPP

SEQ ID NO: 159547 - protein, 264 aa, Triticum aestivum
  unsure (1)..(264): unsure at all Xaa locations
  Clone ID: PAT_TA_53965.pep
SAISLLLLLPPIPNQGGTRREEGKGREEEITEPSARTGQQAPRSAGAEMGLTFTKLFSRLFAKKEMRILMVGLHAAGKTTILYKLKLGKIXTTIPTIXFNVXTVKHKNIXFTXWDVXGQDKIRPLWRHYFHNTQGLIFAADSNDRQRLARGKTMSFTRMLQCKIELPRRWPSLGAPPNKAKNFPQRPSKPPARKPPPPTPRPLPLPPTIPPSPTPPTPPPLPATRGARPPRAPPPGPPNTPQHKAPPPPPPPPGPPHPPPPNHP

SEQ ID NO: 159548 - protein, 210 aa, Triticum aestivum
  unsure (1)..(210): unsure at all Xaa locations
  Clone ID: PAT_TA_53966.pep
PTRPATARLRSASASSLRGILLRHCSAGPAASGAPPRAFSDFQVPGSATWRHFSTCKPNPLAKGNSFGSMASLYSQTRWASQATAVKETDPSGGKISIGPKSKQIKEEDKDDDLVYQGPISSTIKKVKLVSLSTCCLSVSLGPVITFMTSPDMNVILKGGVASTVIFLSATTTAALHWFGSPDIHKLRWXEGSDSFEAEIKSWLATPLKK

SEQ ID NO: 159549 - protein, 81 aa, Triticum aestivum
  Clone ID: PAT_TA_53967.pep
TWRVLNRVFHNTTDTHVAHHLFSSIPHYHAMEATKAIKPVLGEYYQVESNPLARATWRSAKECIYVQPEDRKGVFWYSNKF

SEQ ID NO: 159550 - protein, 232 aa, Triticum aestivum
  Clone ID: PAT_TA_53968.pep
TLGKRLLKLIYPKRSAVVVLRRWAEEGRAVHKYQLNRVVRELRKYRRFKHALEICEWMRTQPEIRLLPGDHAVHLDLVAKVRGLASAEKFFEDVPERAKGPSTCNSLLHAYVQHGARDKAEAMLKEMAGAGYLTCALPFNHMMSLYMSTGELEKVPEMIKELRRYTIPDLVTYNIWLTYCSRNNSVKSAEKVFDLMKDDRVVPDWMTFSLLANIYINAGLHVKGRDALVEME

SEQ ID NO: 159551 - protein, 160 aa, Triticum aestivum
  Clone ID: PAT_TA_53969.pep
MTMASVASGLAIMALGVVLLASPSECARAFFVFGDSLGDNGNNNYLMTTARADSPPDGIDYPTHQATGRFSNGLNIPDIISEQIGAEPTLPYLSPELHGAKLLVGANFASAGVGILNDTGIQFVNIVRGSRQLHYFGEYQGKLRALGGAAQATHEREPGA

SEQ ID NO: 159552 - protein, 116 aa, Triticum aestivum
  Clone ID: PAT_TA_53970.pep
MEKDSHKEGEGATAWMTVPAFGDWDMKNGAMPDYSMDFSKIREMRKQNKKELSRASLGGDDDLLAHHKQHHHQQQPAAKAPQQPTKLGAPAKDHGRDHSPTGRKRFLSYFQCCIKA

SEQ ID NO: 159553 - protein, 110 aa, Triticum aestivum
  unsure (1)..(110): unsure at all Xaa locations
  Clone ID: PAT_TA_53971.pep
LVSFAVVVVSACAVVRVSLRSQCRFVSRLIPAGVLLWARSRWEPVXTRRGQVSVASAGGGERTEGGAAGMGGVGGGGGRWPPVSCLGSWSWSGALLLFLCVFLLSSPRVR

SEQ ID NO: 159554 - protein, 126 aa, Triticum aestivum
  unsure (1)..(126): unsure at all Xaa locations
  Clone ID: PAT_TA_53972.pep
MARTKQTARKXTGGKAPRKQLATKAARKSAPTTGGEKKPHRHRPGTDALXEIRKHQKSTELLIRKPPFQRLAREIAQNYKTDLRYQSHAELALQEAAEAYLDGLFEDTNLRAIHAKRVXTIMPNDM

SEQ ID NO: 159555 - protein, 157 aa, Triticum aestivum
  Clone ID: PAT_TA_53973.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRVEDLRIPPTYSKTFQGPPHGIQS

SEQ ID NO: 159556 - protein, 231 aa, Triticum aestivum
  Clone ID: PAT_TA_53974.pep
QQLPSSRCPRGSLLPHPPAPAATEKTRTEGGDPVTGHIISTTIGGKNGEPKRTISYMAERVVGTGSFGIVFQAKCLETGETVAIKKVLQDRRYKNRELQLMRSMDHPNVVSLKHCFFSTTSRDELFLNLVMEYVPETLYRVLKHYSNANQRMPLIYVKLYMYQLFRGLAYVHTVPGVCHRDVKPQNVLVDPLTHQVKICDFGSAKVLVPGEPNIAYICSRYYGAPELIFGG

SEQ ID NO: 159557 - protein, 40 aa, Triticum aestivum
  Clone ID: PAT_TA_53975.pep
CKIVSSSYGPFRKKAKEQGWIMSESLLNPGKARLCVTRPQ

SEQ ID NO: 159558 - protein, 93 aa, Triticum aestivum
  Clone ID: PAT_TA_53976.pep
CPFKPKPVFCPYWGAPGGAGGPFPNKGTKKGRFKTLPRPKAGSTVLTRLLILGGKQKSARINPTFKQPGGLGIPRLPQQPRSLGPGLILPRWG

SEQ ID NO: 159559 - protein, 101 aa, Triticum aestivum
  unsure (1)..(101): unsure at all Xaa locations
  Clone ID: PAT_TA_53977.pep
PVVDCHTSHIPVKFVEIHTKISRRFGKEIXAAPKFLKNGNPGFVKMIPPKPMGVETFAQYPPLGRFFVGNIRQPVPVGVIKAVEKKDPPGPKVTKAAAKKK

SEQ ID NO: 159560 - protein, 138 aa, Triticum aestivum
  Clone ID: PAT_TA_53978.pep
MSAEEEENAAELKIGEEFLKAKCLMNCEVAIILEHKWEQLQHMSDGGADQVSQVFEKSQAYVKRFSRYKNPDAVRQVRETLSRYSLVEFELCTLGNLCPDTADEAKALVPSLVPGGRFDSDDRVDKMLNDLSLIKKFE

SEQ ID NO: 159561 - protein, 122 aa, Triticum aestivum
  Clone ID: PAT_TA_53979.pep
DPSGPVSVYDVDRRVAEKTRFLAPLPEDRFLCGFSHIFAGGYAAGYYSYKWAEVLSADAFSAFEDVGLDNEKAIEETGRRFRETVLALGGGKSPLEVFVAFRGREPSPEPLLRHNGLLPVAA

SEQ ID NO: 159562 - protein, 116 aa, Triticum aestivum
  unsure (1)..(116): unsure at all Xaa locations
  Clone ID: PAT_TA_53980.pep
ILIQHVPERNGDRYEAIYSIYXGDYGHITVQGPYLTYEESYLAVTGGSGVFEGVYGQVKLNQIVFPFKIFYTFYLKGIPDLPKELLCTPVPPSPTIEPTPAAKATEPHACLNNFTD

SEQ ID NO: 159563 - protein, 192 aa, Triticum aestivum
  Clone ID: PAT_TA_53981.pep
MLTSLTRFGDIAAAECVYGEWESESGTKDSRIPKHHPFIYIKNGNMEKAESFLQYIVQKGVKPSYSTWELFVWGYLGNDERTAKVMECLKKALSSLEKWEPNPQLVAALFSQIEKRGDIEAAEELLVVLRDAGYVTTEIYNSVLRTYAKAEMMPLIIDERMDEDKVSMDDETRRLLKSTSKYPIGEVSTIMS

SEQ ID NO: 159564 - protein, 123 aa, Triticum aestivum
  unsure (1)..(123): unsure at all Xaa locations
  Clone ID: PAT_TA_53982.pep
QRGAWEEISISWQLXQYFFLAGGEVFCYIAQLEFFFDEAPDTMKSMCTSLALLTIALGSYMSSFIYAIVEAFTATGDSPGWISDDLNKGHLDYFFWAMAAMCTLNFVVYSGIVKNYRLKTVIS

SEQ ID NO: 159565 - protein, 233 aa, Triticum aestivum
  unsure (1)..(233): unsure at all Xaa locations
  Clone ID: PAT_TA_53983.pep
MAAKHQNEGADTASEVKKPKHGFRVGPENLPDGPWRRKATKAKKELIHKAKGKKAYAKIKAREQQNAQPPNTTQPAQDDTPPHGTAKDNQPQKEPNTHPTQQHTQTNHPNPPTHPTPTTPPPHKTQPPKPQPTQHKKPTPPPPPHPPPPPPPPPPPPNPPPPPPPPPPPPPPPPPPPPPPPPPPPKQKPTXPPPHPPPHPPPPPKQTPPPPPXPPTPPPTQPPPTPPPPNPPP

SEQ ID NO: 159566 - protein, 136 aa, Triticum aestivum; identical to SEQ ID NO: 126263
  Clone ID: PAT_TA_53984.pep

SEQ ID NO: 159567 - protein, 82 aa, Triticum aestivum
  Clone ID: PAT_TA_53985.pep
HASEQVHPDIGISSKAMSIMNSFINDIFEKLAGESAKLARYNKKPTITSREIQTSVRLVLPGELAKHAGSEGTKAATKFTSS

SEQ ID NO: 159568 - protein, 175 aa, Triticum aestivum
  unsure (1)..(175): unsure at all Xaa locations
  Clone ID: PAT_TA_53986.pep
RTRGHDLKIYSSDEGRVQMSAAAFAKGLLDLEGQLTPILVXLVSKDSSMLDGLEDASIEMDEAKARLHEIIISNAKAXNTNGSXEFPWMVDGAGLPXNAXELXXXMXXLTKQXTXQXXLXAEGEDENLALTSSFSKYHQTKTLGKTTIDAAPIACGLTLGEKKSFLLMFARGKKN

SEQ ID NO: 159569 - protein, 143 aa, Triticum aestivum
  Clone ID: PAT_TA_53987.pep
GASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 159570 - protein, 166 aa, Triticum aestivum
  Clone ID: PAT_TA_53988.pep
PRVRHASEEIDDPEAAKPEDWDDEEDGEWEAPKMDNPKCEVAPGCGEWKKPMKDNPAYKGKWHAPLIDNPNYKGIWKPQEIPNPEYFELDKPDFDPIAAIGIEIWTMQDGILFDNILIADNEKVATSVREKTWKPKFDAEKEKQKAEEAAPGASKGPLWKSRRRIF

SEQ ID NO: 159571 - protein, 82 aa, Triticum aestivum
  Clone ID: PAT_TA_53989.pep
QMPTWLPILGGAKKADSACERDLAQAIPGGKTYSGGTRTTCSPPRRRQEGTAVATHRPLIKNLSIRGTAYRIKRRLTASMKG

SEQ ID NO: 159572 - protein, 149 aa, Triticum aestivum
  Clone ID: PAT_TA_53990.pep
HASGGSSASARREEEDLEAIAAREQRAFRYEALAAATRNFSEKQKLGQGGFGPVYLGQLPDGRDVAVKRLGAGSRQGAREFKNEANLLSRVQHRNVVNLLGYCAHGADEKLLVYEYVPNESLDPAPTTSSITPGSCTRRSAAWSCWTRR

SEQ ID NO: 159573 - protein, 155 aa, Triticum aestivum
  unsure (1)..(155): unsure at all Xaa locations
  Clone ID: PAT_TA_53991.pep
RTTTPCSPRGPSAPPCACSPTAARTLFPPYGEYWRQLRKIAPTPTLHSAPRPTPTPPSPRKTPPQXPPAPTPSPSRPPPPPEEPPPPPPPPPPPPPPPPPPPPPPTPPPPPPPPPPHPTPHPQPPPPPQNQKKPKKTPPPPPTKPTKQQQKPPHP

SEQ ID NO: 159574 - protein, 194 aa, Triticum aestivum
  Clone ID: PAT_TA_53992.pep
GQPEVAAEEPELGGDAATGGAVADAVRLEPARLHLRRAPSGDGELLARQLPRLRRLRPGLQGGRRPQAPPRAGPATRGRQGPRPWSAAPEDTNSGWPEVFFPWGPRRDQEPGGRLGRGPRARATSPRTPGGPRPTDPPGARGEAPPSQNGRRGPPPPGPHPAPNHPPPPGAGPRGAPPARPPPPAPPPPRRAAP

SEQ ID NO: 159575 - protein, 66 aa, Triticum aestivum
  Clone ID: PAT_TA_53993.pep
KVFSRIDHKFDLMYAKRAFVHWYAGEGMEEGEFSEAREDLAALEKDYEEVGAEFDEGEDGDEGDEY

SEQ ID NO: 159576 - protein, 169 aa, Triticum aestivum
  Clone ID: PAT_TA_53994.pep
MGSLDTNPTTFSAFPNDKAAAFEPLNPEDVRAYLHKAVDFISDYYTNVESMPVLPNVKPGYLQDELSASPPTYSAPFDVTMKELRTSVVPGMTHWASPNFFAFFPSTNSAAAIAGDLIASTMNTVGFTWQASPAATEMEVLALDWLAQLLRLPTTFMNRTSTGRGTGGG

SEQ ID NO: 159577 - protein, 111 aa, Triticum aestivum
  Clone ID: PAT_TA_53995.pep
MHPTRHLMLADEAKAQENSVGEPSSDGNRRRTRRPGYYEKQLGKAAQLRQEQEARQAEFQRRREEREQKMADRDRYKKAMAKTRDRNGNKKLGRESSLLLDKVRKMVAEKK

SEQ ID NO: 159578 - protein, 181 aa, Triticum aestivum
  Clone ID: PAT_TA_53996.pep
IDQFMKDGVNDRTDEYGGGLENRCRFAAEVIAAVCHEAGAGRVGVRLSPFADYVDCVDSDPEALALHVIGVMNGLGVLYCHMIEPRMCVNERMIPRRLLPFRRAFSGTFMVNGAYDREEGDKAVADGYADLVAYGRLFLANPDLPERFKRNAALNKYDRSTFYTSDPVVGYTDYPFLDQED

SEQ ID NO: 159579 - protein, 35 aa, Triticum aestivum
  unsure (1)..(35): unsure at all Xaa locations
  Clone ID: PAT_TA_53997.pep
TFLRPESSPLNPRPISFKRQEHHKLKXITWDAYSY

SEQ ID NO: 159580 - protein, 50 aa, Triticum aestivum
  Clone ID: PAT_TA_53998.pep
CALSNGAGLVNRRRSIEDRDQMSGLSEVPLIRASLTWCTTSSAIGSAVPS

SEQ ID NO: 159581 - protein, 147 aa, Triticum aestivum
  Clone ID: PAT_TA_53999.pep
RPYLKRSDKLHQVIDSALECQYSCKGAEVAALVTYKCLSQNPKSRPSMREVVKALEPVLDMDDFFPAGPFVLTIVVEDDKVMDMKVETEEKHQSHHQNHQDRHRHKYPESAIHGDIVIHGDNRQVAGFTGALRRQQRTLSYPRERGA

SEQ ID NO: 159582 - protein, 69 aa, Triticum aestivum
  unsure (1)..(69): unsure at all Xaa locations
  Clone ID: PAT_TA_54000.pep
LVRRXXXXGVFPPPRACPXVCSCXVSSCXXFXLVLAXLSXSCXXXGLPXLWFXXXLPPXXSXAXXRPPP

SEQ ID NO: 159583 - protein, 58 aa, Triticum aestivum
  Clone ID: PAT_TA_54001.pep
GILLPANAFRSPMDGAKHFPFVKGIFDFPLLFQIAAFLDVKANVPTLGGGGGPQAKGP

SEQ ID NO: 159584 - protein, 141 aa, Triticum aestivum
  unsure (1)..(141): unsure at all Xaa locations
  Clone ID: PAT_TA_54002.pep
KKFGGPRKKLVTRSVKAGLQFPVGRIGGFLKKGRYAQGVGSGAPVYLAPVLEYLPPQVLELAGNPPKGNKKTRIVPRPLFLAIRNDQELGRVLSGVPIAPGGVIPNINPGVLPKKTPXKAEKTPPQLPKKAPQSPQKAPKA

SEQ ID NO: 159585 - protein, 189 aa, Triticum aestivum
  Clone ID: PAT_TA_54003.pep
SISMSPHKWLLTCLDCTCLYVRDAHRLSDSLETNPEYLKNDATESGEVTDLKDMQVGVGRRFRGLKLWMVMRTYGTAKLQEHIRSDVAMAKMFEDFVRADDRFEVVVPRNFALVCFRIKATGAMTEEDADEANRVLMENLNKTGKAYLAHTVVGDRFVLRFAVGSSLQEERHVRSAWDLIKKTTSSIMD

SEQ ID NO: 159586 - protein, 190 aa, Triticum aestivum
  unsure (1)..(190): unsure at all Xaa locations
  Clone ID: PAT_TA_54004.pep
MAATLQFISLLGTSSAHPAPSCSSSNEKQHRSVHLPQQQQGRRLRAVRAVETGAEPATADSETTVEPPSVDFAFVSPRLLPDGTPDVHYRTACGGQKLRDIMLQGYIDLYGPYDKLLLNCSGGGECGTCIXEVXEGGEMLSPKNEVKKEKLKRKPKSWRLACQATVGNPDSTGQMDIQQLPEWKVHKWDK

SEQ ID NO: 159587 - protein, 44 aa, Triticum aestivum
  Clone ID: PAT_TA_54005.pep
GLVDLVTATRLWHGAYSKTREVPDPIIYPEELHSYVQRHIRASG

SEQ ID NO: 159588 - protein, 189 aa, Triticum aestivum
  unsure (1)..(189): unsure at all Xaa locations
  Clone ID: PAT_TA_54006.pep
PRXRPRXRXKKEKXXRXEXXXERKKKXAEPKSXAXTDHPXXPKXASAEHPRRRSXPXPEDXQTKKXXXIMQLDETKSXALPELKVKSPQTPAAXVEKNKAADKVXKEEPRVGPKAHATSQSKDGKKYSNGKVSRXRQNDNNVXVEKTXXMXENKVDYKTTVDLPPGRSAKRKTXKKDRMXYSNLEQEYV

SEQ ID NO: 159589 - protein, 95 aa, Triticum aestivum
  unsure (1)..(95): unsure at all Xaa locations
  Clone ID: PAT_TA_54007.pep
TRPHRGRSRRSSNRGPQHPPWQAERXQAPPXPAPPLAGANGPEPAGAPRPAPPALPRGERHRAPARAQTGRGSPPPPPAKAGKGTRASKPKKRHQ

SEQ ID NO: 159590 - protein, 133 aa, Triticum aestivum
  Clone ID: PAT_TA_54008.pep
RTRGRGSTTTQPTTPSPDPGGAAALVGGSRRRTETRGPDGELGHSHGAPAAPKVVGHLDKSHTPSTSTNLSAPPHYPPQPSSTDRTCTSEHRLSSGSSTSSIRRPAPFGRAGIGFFPGSGSLHVPVPLGLLLF

SEQ ID NO: 159591 - protein, 66 aa, Triticum aestivum
  unsure (1)..(66): unsure at all Xaa locations
  Clone ID: PAT_TA_54009.pep
RRPPAATPSWPPRNRADDPSLHNPLLRLERMGCGWVGVIFEWEGVVVEDDXRXERQAGRGANPRPE

SEQ ID NO: 159592 - protein, 79 aa, Triticum aestivum
  Clone ID: PAT_TA_54010.pep
PIDSGNQVLPLRLGVLGPFVVNKQTPNRQIWLFSPVSGPARFAWDPPPPSWFYRRPGVIFIPLLKKEIVELFGTPVPLF

SEQ ID NO: 159593 - protein, 92 aa, Triticum aestivum
  Clone ID: PAT_TA_54011.pep
KGKGPEKQDPKLGPKFTRKDKNTGKALDQKGPGVGSIPLSPDNFRPRKEAWEELRAKLEEKEWISQKQMIILLNQATDINNLWQQGGGSLST

SEQ ID NO: 159594 - protein, 107 aa, Triticum aestivum
  Clone ID: PAT_TA_54012.pep
RFQHANLYVCDLLRALGQCSDNRCPPESAQEPCELPWPRRAAAAEPEVLLKEEAGCLSGGHVQGEAGDQSDGSFLDDAQQEEGYVLTCVAYPKSDCVIHTHKEGDLY

SEQ ID NO: 159595 - protein, 82 aa, Triticum aestivum
  Clone ID: PAT_TA_54013.pep
NNQGNLSHSIQHHDIDIKSPCVFTSGPLLLYTRLRCTFTLLPGLNNVGRVTRVWWRKESTGKTQEMLGGSCVFKGRPFFQPA

SEQ ID NO: 159596 - protein, 82 aa, Triticum aestivum
  Clone ID: PAT_TA_54014.pep
GDRLVKYIMGMGIYIATGWIQIRACFFETCGDMNMGIHIFLGTNKKDKWGRKTQSNGRVDKTGMALYMGPGGRELFKPCRTP

SEQ ID NO: 159597 - protein, 96 aa, Triticum aestivum
  Clone ID: PAT_TA_54015.pep
NKLFKVCIINDGYLHVVSRPKTHKRFLSTFDQPHSYCRSSVHTIHQTDLPHGTCMTLPTRHNAGDLPHGACMTLLVMKPCCADGKAARWGGGCGVW

SEQ ID NO: 159598 - protein, 127 aa, Triticum aestivum
  Clone ID: PAT_TA_54016.pep
AMIQQLFPDKSRDQVRQKFKTEEKKHPMQVHDAILHRSRDNLYLKQVIKQLNIEDLQRDINSTHKQVVASIEGDTGNEHALQDFMEEENDSNWSAKELSARQSEVREVEHVAGNADDGLDLDVFDWY

SEQ ID NO: 159599 - protein, 85 aa, Triticum aestivum
  Clone ID: PAT_TA_54017.pep
GVSVGVTKPTANVLTAGKHGSGEAKAEVGAEQVNSALEKLMDGGVEAEDTRRKALACKVKANTSLKEGESSYNNLEELIQSVSEN

SEQ ID NO: 159600 - protein, 83 aa, Triticum aestivum
  Clone ID: PAT_TA_54018.pep
AKVPAIDPLPKEPAAETELLPDKFPGELGTIVKALKGKGKEEKEELMVRLRDQSDETARMKKENARLKREMVSLRAALKGTTE

SEQ ID NO: 159601 - protein, 152 aa, Triticum aestivum
  Clone ID: PAT_TA_54019.pep
GQTQNEQLFIKKRIHVVSGGQPKNLHHIQIGGLTEPRFFGNSRIKETVVKGRRISGGHKAFRRACLDTACWNRFVAISVVGITPSKTNHAYTGGGGLLTSLQLHGLLLDKRFDCLEPPEHLHLVLVRHVGGQELRKLGGHLAVVRELVDRLP

SEQ ID NO: 159602 - protein, 101 aa, Triticum aestivum
  unsure (1)..(101): unsure at all Xaa locations
  Clone ID: PAT_TA_54020.pep
MHSKEGNRSGGSGGQDASSWHHLIRKPQLDSMPWKRSRHDMSSDSQALMEKILDHGLLTSYXTAEYDEEKSHEDTSKMAPSVNAQKLDANQLAAQILHLRM

SEQ ID NO: 159603 - protein, 103 aa, Triticum aestivum
  Clone ID: PAT_TA_54021.pep
PLCFSPDPAKWPKMEKLENWALFITLDRKSPPFFCMNPEKWGGKRNCIFVPRGSKDFDDPWISVKLGQAVSSITRWGSTLLEGKSNPLESLWGLPRLVYGVGQ

SEQ ID NO: 159604 - protein, 159 aa, Triticum aestivum
  unsure (1)..(159): unsure at all Xaa locations
  Clone ID: PAT_TA_54022.pep
NGNQTGPKTTPYDELVEEIKANLGNAATAAQLKGVLSSSALPPKDVMHALFEALFHGVGKGFAKXVVKNKKYLSTAVPDEGSQMLLLQAIEAFCGKCSAEALKEVPVVLKALYDGDVLEEETIVQWYNEAVAAGKNSQVVKNAKPVVEWLQSAESADKE

SEQ ID NO: 159605 - protein, 75 aa, Triticum aestivum
  unsure (1)..(75): unsure at all Xaa locations
  Clone ID: PAT_TA_54023.pep
RFPRRPVLSFARELWDLHPLLVASKHNLRXTVVAASSPERAYRLLSLRWQRKLCFMVPELPRFAILTRAFGAVKF

SEQ ID NO: 159606 - protein, 129 aa, Triticum aestivum
  unsure (1)..(129): unsure at all Xaa locations
  Clone ID: PAT_TA_54024.pep
MSDCARNRFNEEEDFQVVLGKGNPGESSCQQHTKWMAHWTRASSSPYGKSCSPLEDANNSNCTKNSETSPFELRKFTVAERLMLGRNHEGISMKNVPRLDPNMXGVAHDAWQEAEQTKIEWRDGHFQSC

SEQ ID NO: 159607 - protein, 166 aa, Triticum aestivum
  unsure (1)..(166): unsure at all Xaa locations
  Clone ID: PAT_TA_54025.pep
RGRNRRPTPHERTXRXRESQRRKKRXRRPKRKXKKERARXKXTXXXKTRXDTKKKKKRXKNAKTKPRPKQGTSQTGAKGNNRNAKSREKTKGKTTRRKNPTQERXKXNTKKXXXEGKKTXKRXGTRRXXERAXTKXNQHKETQQQTKEKEKQKKPXAKKKKKKGKG

SEQ ID NO: 159608 - protein, 84 aa, Triticum aestivum
  unsure (1)..(84): unsure at all Xaa locations
  Clone ID: PAT_TA_54026.pep
VALXAASSXLFALVLRVXXVGLAXGLVLVVVLAXVGGGVVAVPLGVVVPLXRPLLPGLRRLRCPXXPXVXLVFFFSLFXLAACA

SEQ ID NO: 159609 - protein, 67 aa, Triticum aestivum
  unsure (1)..(67): unsure at all Xaa locations
  Clone ID: PAT_TA_54027.pep
APLLCPSPSPFWLRPCWXGRSVRAFFLFRLLALGACAARRFCWVXPGFSLXRRCFSSAPVLFGAPCR

SEQ ID NO: 159610 - protein, 88 aa, Triticum aestivum
  unsure (1)..(88): unsure at all Xaa locations
  Clone ID: PAT_TA_54028.pep
FGRAKIPPPPPFLGKAWTSPNPRGGVFLAPKILGAKGILGIFXEKKGFFVLDPFFSNGGPLDINTLLAGKKIPGVASFKPFGGGKFRL

SEQ ID NO: 159611 - protein, 77 aa, Triticum aestivum
  unsure (1)..(77): unsure at all Xaa locations
  Clone ID: PAT_TA_54029.pep
VVVIXFAGAELVFFXTWAMLVGSCVRVGVRREGDRTRSNHHDVRSPFNSRDYTYLYLYLSTTIYTILPVNKATWVSL

SEQ ID NO: 159612 - protein, 142 aa, Triticum aestivum
  unsure (1)..(142): unsure at all Xaa locations
  Clone ID: PAT_TA_54030.pep
KPHFYQLFKEPASFKKNFPPCPKANNYQFKVPPKYGFVFFGTQDKCAASKKTVSPLEKMPLEGEPSPKPCFKWAPGGCIFRAASWPPLKGILYSQNPFWQLFKERGSXSNLFKPPSAKNPAEPKAPKKKEQAPESPEAPESS

SEQ ID NO: 159613 - protein, 79 aa, Triticum aestivum
  unsure (1)..(79): unsure at all Xaa locations
  Clone ID: PAT_TA_54031.pep
ISTCMTFQLELKLLFLQGTHSTMSVQAYELMGGGGNVMSLHTEVASILCPGXCGGYDHPGEPGLAGGGPGVGGGGGGGG

SEQ ID NO: 159614 - protein, 117 aa, Triticum aestivum
  Clone ID: PAT_TA_54032.pep
IFAPSEGVFSPIPLWPKGCPGATGLAPSATPKNPKGFLFWVSPKKFFIFYAPLVSPKMLFFFKNNEGFAAFFLFPPRRLVFSLVLAKFSVVFCSPPSFHCWSFPRLTLIALFFYPPP

SEQ ID NO: 159615 - protein, 168 aa, Triticum aestivum
  Clone ID: PAT_TA_54033.pep
MLSTPVLGKEYETKAINYFMNSKQDDEDFYVASHLISDKHHDLNTHRMEYAANVTDSCMFPDPAASILATNSKGGAVTRERQPVDRFTDFVEQNGPCLFEMLTIPSKSQSTYPIDLLSSCSPLFGAQNQFSPKAKTMHGDSQHVSKSSAGTDSSLMQKVSVLHLHIVG

SEQ ID NO: 159616 - protein, 102 aa, Triticum aestivum
  Clone ID: PAT_TA_54034.pep
PPVGITASPQSGHRLHSRVVRAGENFLIPRGLMHFQFNTGDTVATMFVSFNSQNPGIVFVPLTLFGSDPPIPTPVLTRALRVDAGVVELLKSRFAGGSFQAS

SEQ ID NO: 159617 - protein, 88 aa, Triticum aestivum
  Clone ID: PAT_TA_54035.pep
CHTLQLEPRNTTILSLDTICKATMKYNTMENMCPTEFLNKMTFPGIPNHELKLKVGLPVMLLKSLCHQATRSGPSCTCPGLGKKWPPA

SEQ ID NO: 159618 - protein, 128 aa, Triticum aestivum
  unsure (1)..(128): unsure at all Xaa locations
  Clone ID: PAT_TA_54036.pep
GGTGPNRPNPKAPFPKGPKGSTPSKPPETKGPQPLLAKPPFFFDQNPKKGFKNKKPPATQNQTFYQNNGPPGXPPYSRKLTPPPGSPGALRKKFPTPPGISPLKPPLKGGPTKSQGPPVKKKPPKFPT

SEQ ID NO: 159619 - protein, 92 aa, Triticum aestivum
  unsure (1)..(92): unsure at all Xaa locations
  Clone ID: PAT_TA_54037.pep
AAGWCPLRGARCGRAGDGVXGGGGGGGGGEGLSGLFFMHXXXPCGGGGQFFFSHXXXPKXGGSHLLQXXACPGRIRRARTLXAAQQPAALQP

SEQ ID NO: 159620 - protein, 134 aa, Triticum aestivum
  unsure (1)..(134): unsure at all Xaa locations
  Clone ID: PAT_TA_54038.pep
QHRSSPGLLPHDLARSLELLEEEHPGQKSACYDERPARRRRGARMRMGRRQVRATRMRQRRVRATRCHRLECQLAAVAMNVVGHGPARLQQAAQDGRAVRRRQYGEARAPFVVDGEVVLHIEXHRRVGVVEHQR

SEQ ID NO: 159621 - protein, 53 aa, Triticum aestivum
  unsure (1)..(53): unsure at all Xaa locations
  Clone ID: PAT_TA_54039.pep
KWVSVPPKKVPPMAFXMFMFXMFNPVKRNQYFVLNNNKKKAPKMPLLKKKFKL

SEQ ID NO: 159622 - protein, 70 aa, Triticum aestivum
  unsure (1)..(70): unsure at all Xaa locations
  Clone ID: PAT_TA_54040.pep
LLQHLLLXXXNYXIXINNHXXNNHPKIFTXXNFYNKIXPSXSFFNSIXINKPNSFYKKINFFLSHHFTTH

SEQ ID NO: 159623 - protein, 87 aa, Triticum aestivum
  Clone ID: PAT_TA_54041.pep
KVPPSLPWGPPKGVFPFFHGNRFPKGFFSPPFFSPPGQKNQGASPNSQKKHPPKSFPFTKGRPPPFKGLTPPTTFGGPPIPFGGPPS

SEQ ID NO: 159624 - protein, 119 aa, Triticum aestivum
  Clone ID: PAT_TA_54042.pep
SQKKRVAEEKKSARKMGLGVRLLPPSAEDAAAAARVRFASNFEKNRKDKRAAIKAASIFPEPSGSASKDKLDLALKRRNIKASAASALMAGRAKPSSWSRQSTGSGSARTAVPILARRK

SEQ ID NO: 159625 - protein, 108 aa, Triticum aestivum
  Clone ID: PAT_TA_54043.pep
PTRPPTRPRTRGVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 159626 - protein, 260 aa, Triticum aestivum
  Clone ID: PAT_TA_54044.pep
GTRKWLSSLLQTAGWPLLLAPLSASFLSRRRSHKDRGSVAPLFLMSPRLLAATVAIGFMTGLDDLLYAYGLAYLPVSTSSILISTQLAFTAAFALLLVRQRFTAFSVNAVVLLSVGAAMLGMNAGGDRPAGVTRAQYSAGFGMTLGAAALYGLMLPVMELSQAKHAARTGAGVTYTLVMEMQIVIGVTGTALSAGGMLGNNDFPGYPKRKPGGFGLGPRWATTLLLGRLGPLGDQVVFCLGTHWGALLSYGLKGLAPPRG

SEQ ID NO: 159627 - protein, 94 aa, Triticum aestivum
  unsure (1)..(94): unsure at all Xaa locations
  Clone ID: PAT_TA_54045.pep
FPXXPXXXXHGXXCVCXLXXXXXIRXXLASQXPIXPXCDXRYPPLGNTCSXXXERPXARXAPSYXXSITGFXXPTQXKFCTXGAPSXXXCVXLX

SEQ ID NO: 159628 - protein, 116 aa, Triticum aestivum
  unsure (1)..(116): unsure at all Xaa locations
  Clone ID: PAT_TA_54046.pep
GRKPTHAHAAQRQATPARRPARTTDXARRXPAXEGEXTADPXXETTAEAAAGDAKPAKETKAKAAKGKKPXAPRKPRAXAGHPTNAEKEXEAXTDQKXXTGXSQRXXNKKXXDKHK

SEQ ID NO: 159629 - protein, 144 aa, Triticum aestivum
  unsure (1)..(144): unsure at all Xaa locations
  Clone ID: PAT_TA_54047.pep
MGKEKTHINIVVIGHVDSGKSTTTGHLIYKLGGIDKRVIERVEKEAXEMNKRSFKYAWVLDKLKAERERGITIDIALWKXETTKYYWTXIDAXXXXDXXKNMITGTSQADWAGLMIDSTTGGLEAGVFKDGQTREHALLGLTLG

SEQ ID NO: 159630 - protein, 141 aa, Triticum aestivum
  unsure (1)..(141): unsure at all Xaa locations
  Clone ID: PAT_TA_54048.pep
CRRXPLGSPRVQGFTPQRGDRALGVRPRLLRPVAHPAAGARNVTRGRSIEQSTAAVCRRKGSGCAREDRQVQYASAAPYVSSHTWGKKXLPGHRSXVDDXQYXLLSGAXXRGXALNRRXVEWTDGDPRGYRRNGKRTALGR

SEQ ID NO: 159631 - protein, 130 aa, Triticum aestivum
  unsure (1)..(130): unsure at all Xaa locations
  Clone ID: PAT_TA_54049.pep
MPLNLPSAACYSLRRSIYASLRKKISPMASAPGSDSAALSTDDPADNGAAKPTEQRPAQAEKRPEKAKTTMVTQRSMLAAKQGATNLGQGXPKGDGREVGKEAGIEAIKAGKNQHARGWGVPELNSAEAE

SEQ ID NO: 159632 - protein, 90 aa, Triticum aestivum
  unsure (1)..(90): unsure at all Xaa locations
  Clone ID: PAT_TA_54050.pep
LVRASPRCPFLLSVFVVLWFSFPWCLLXVAPRGCRGCPSAVCLRVLACFGFVLRSFXGLFPXCCVSLLGFFVLCAVSRXVVFAFCAAPSV

SEQ ID NO: 159633 - protein, 178 aa, Triticum aestivum
  Clone ID: PAT_TA_54051.pep
PTRPPTRPPTRPPTRPPTRPPTRPAADDDFAFYYSFFQDAAAASPLPLALDGAALPNNRRRKRGGDDDSAAEPIKDGSNNGRKRSIATIITSLAALEAEDHADSAGAADASRRELALLESNADNKSQAMMDYFAKMEGRCDADADSEAAEARSGLSAEGGAEAGGAAEEAATNTGRGG

SEQ ID NO: 159634 - protein, 146 aa, Triticum aestivum
  unsure (1)..(146): unsure at all Xaa locations
  Clone ID: PAT_TA_54052.pep
FGNMVLWGFPRLQVRDVLGLNSGCVVGATRDPGGGIXAGYSPSFVALGGVGAPNGDQLRGTSSFGAMLCPDPKGESWVGFRFPQLAFGTGPPWGFLPPGFPVEGFMVFVPSRPPKGRVALFLAFGGGLVPGFTKFWSPRGFFPFGG

SEQ ID NO: 159635 - protein, 172 aa, Triticum aestivum
  Clone ID: PAT_TA_54053.pep
MTLGAAALYGLMLPVMELSQAKHAARTGAAVTYTLVMEMQIVIGFTATAFSAVGMLVNNDFHAIPREAREFGLGQIGYYLLLAASAIVYQFFFLGTIGAIFYGSALLAGVIMTVLIPVTEVLAVLFFHEPFNGTKGVALALSLWGFVSYLYGEIRAKAPHSDKPLNTEHLDP

SEQ ID NO: 159636 - protein, 119 aa, Triticum aestivum
  Clone ID: PAT_TA_54054.pep
MCFFLSLVHRPPETLLRFKLMDADHGEPPITTEDRTTAVTARFIKGVDKRATKTRGWSDFFRQAHMNKGSICFRLQMHFQGIAPDCYRCLPRLLCLSSFWILCNHLRPSRAFNYRLFPA

SEQ ID NO: 159637 - protein, 73 aa, Triticum aestivum
  unsure (1)..(73): unsure at all Xaa locations
  Clone ID: PAT_TA_54055.pep
HPMNFLKKRTFKGTFLGNFKRGTDLPNVVXCXIKKKLEVEKFIKQRVRFWEIKKGFDLMEKKKGIRCIIRMEN

SEQ ID NO: 159638 - protein, 91 aa, Triticum aestivum
  Clone ID: PAT_TA_54056.pep
RPRFGVPGVDNFQLPLIMISSEGGRRLRSKASCLLLLSTLKLPVWGCCGPLGPMYLARVKCGSRVVCCGLNRTRLLGVGALKKKRGETLFR

SEQ ID NO: 159639 - protein, 169 aa, Triticum aestivum
  unsure (1)..(169): unsure at all Xaa locations
  Clone ID: PAT_TA_54057.pep
KKKINFPITLPDPNLGAGPPPPPEKKNPFPYLDPKNLIPQITPPPYXPPPLKPPFSLSFPTPQPSPIPKEPNPLPHPFKVSQTFPPPPIKKPPCPGIFFLPSKSPKHPPPPSLPKPHFPKIPPTLSPPXPPPVPSQRSVLQPVPPPPIKPPYPVLQSPPTKNFPLEGPL

SEQ ID NO: 159640 - protein, 127 aa, Triticum aestivum
  Clone ID: PAT_TA_54058.pep
KGKGLLLVAEMRAPSNLAHEDYTPAAVKFAEQHSDLVIGFLSVNPASWPAPAPSPALVHVVKTGVDVVAGENFPGQQYETPHLVVNEQGGDVIVVGRAIIKVSDPAGAAREYRAQGWQAYQTSLSSS

SEQ ID NO: 159641 - protein, 68 aa, Triticum aestivum
  unsure (1)..(68): unsure at all Xaa locations
  Clone ID: PAT_TA_54059.pep
PGEFYVQGSPPLYLVPPSGKKFLFXGARPAPEFFASFKKTKEISGQGAAAAPKKAVXPVPPEPLKDEF

SEQ ID NO: 159642 - protein, 160 aa, Triticum aestivum
  Clone ID: PAT_TA_54060.pep
MGDASTACYEHMHAGLDSLLRSGAPLAVTRDGLAFEDRLIQNGNGCQAANGEPALVDHGAEPCHSAANSVNVNALQCLEAPDKRKGAGRPTNCREKAPYEGLSKRTRFCSICCREGHKRTTCPGRGDAPKKPRKPGRCKNCSIEGHRRDTCKRPFRFAES

SEQ ID NO: 159643 - protein, 248 aa, Triticum aestivum
  unsure (1)..(248): unsure at all Xaa locations
  Clone ID: PAT_TA_54061.pep
ALDLIKNAQVQAIIGPKTSAEAEFVAQLGSRAHVXVLXYSATSPSLSPAQTPYFVRTAAKDSLQATPVAAVLAHFGWRAAVVLHEDSPYGTGILPALADALQSVDSAAIVERVPVPSRAHDDALDALLYRLNAMPTRVFVVHANFRLATRLFRRAGEAGMMSDGYAWVVTDGVGSLVDRLSPEDVDAMQGVVSLRPHVELTSQVKNFSARFRARFRRDNPASDDDMINDPTVTRLWSYDTAWAIAAAA

SEQ ID NO: 159644 - protein, 169 aa, Triticum aestivum
  unsure (1)..(169): unsure at all Xaa locations
  Clone ID: PAT_TA_54062.pep
GHVDPNGALDPGLVXDADTADYIGFLCALGYTPSQIAVFTRDGSVADCSKKPARSGDLNYPAFAAVFSSYKDSVTYHRVVRNVGGDANAVYEAKVESPAGVDAKVTPAKLVFDEEHRSLAYEITLAVSGNPVIVDAKYSFGSVTWSDGKHNVTSPIAVTWPESAGAASM

SEQ ID NO: 159645 - protein, 154 aa, Triticum aestivum
  unsure (1)..(154): unsure at all Xaa locations
  Clone ID: PAT_TA_54063.pep
PPHPPPPPHPXPPPXHPRXXRXPTPRTPSAQYSVPAXVEVPMHRTHXLSRIFVGNPQQRITMPEIKNHPWFLNXLPVQITDEYQRSXQLADMPTPSQSIEEPMAIIHEAQKPGDNALGIAGQVACLGSLPPDDIDFADIDDIAPPPPGDFVCPL

SEQ ID NO: 159646 - protein, 184 aa, Triticum aestivum
  unsure (1)..(184): unsure at all Xaa locations
  Clone ID: PAT_TA_54064.pep
STDQFELDSXXVLDPVNGVWQPIASMGTNMASSDSAVIGGRLYVTEGCAWPFFSSPRGQVYDPKADRWEAMPAGMREGWTGQSVVIDGRLFVISEYERMKVKVYDPEMDSWDPVDGPPMPERIMKPLSVSCLESKIVVVGRGLHVVIGHVKKQSSCDYLVRWQDVEVPRAFSDLTPSSSQILHA

SEQ ID NO: 159647 - protein, 96 aa, Triticum aestivum
  unsure (1)..(96): unsure at all Xaa locations
  Clone ID: PAT_TA_54065.pep
KPAGFIVHPPSGTXFVMVAHKKKGFDXDTDFCEHLIQKVGVVAIHPSVXYLTPEDGKNLVRFTFCKSPHTXRAXVDRKKAKLPQKRLGGRFSEAVK

SEQ ID NO: 159648 - protein, 107 aa, Triticum aestivum
  unsure (1)..(107): unsure at all Xaa locations
  Clone ID: PAT_TA_54066.pep
PRVXAQQIESEDSSSTSTTGDQPTGLDPEVLDSSVSSGSSSHVXDSAARNTALRTKPRKQKDKEEIGPGKTQTACTSGHHPDGPRKKGIGAKAAKAPPPRPQRGGTK

SEQ ID NO: 159649 - protein, 74 aa, Triticum aestivum
  unsure (1)..(74): unsure at all Xaa locations
  Clone ID: PAT_TA_54067.pep
ARRQGAGPGEEENGEGDQPAAREQAATIPHPRPPPAQEDPHRQHKRPKGXAHPTPDPPPQPPPQPAPPPPPPTP

SEQ ID NO: 159650 - protein, 185 aa, Triticum aestivum
  unsure (1)..(185): unsure at all Xaa locations
  Clone ID: PAT_TA_54068.pep
GFVEVGSXTPQPQEGNPKPRIFRLKEHGAVVNRCGFNSEGIVVVAKRLGAQHGKRKMEETSSSSDVKQGGKAGPGILGVNLGKNKTSEDAGADYVQGVHSLSQYADYLVINVSSPNTPGLRQLQGRKQLKELVKKVQDARDEMQWAEDGPPPLLVKIAPDLSKQDLEDIAAVALASKLDGLIISN

SEQ ID NO: 159651 - protein, 116 aa, Triticum aestivum
  Clone ID: PAT_TA_54069.pep
MEGLAQRAALLRDSLGKSQAATDAVVSILGSFDSRLSALDAAMRPIQLRTHAVRTAHENIDRTLRSADVILTQFDRTREAEREIQKGPNENLQGFLDAGDRVRSIEGLFSYNKSYS

SEQ ID NO: 159652 - protein, 39 aa, Triticum aestivum
  Clone ID: PAT_TA_54070.pep
IKNASTYLQNSLSRDYHNIRTSIFAIRNKTSRRKHLTNM

SEQ ID NO: 159653 - protein, 96 aa, Triticum aestivum
  Clone ID: PAT_TA_54071.pep
LSEQQQEELAGTMAAQGLLSGRQLLGRPLQSSISRSSSSRKSAFAVRASTSPPAKQNDNRQPAVLAQAAPHLPGRHADRRLWLPPLGAGRPGGRRG

SEQ ID NO: 159654 - protein, 77 aa, Triticum aestivum
  unsure (1)..(77): unsure at all Xaa locations
  Clone ID: PAT_TA_54072.pep
MATGGGGGGGAADFGAAGGAGGRMPTWRERENNKRRERRRRASAAKRWXXLGAHGGDKLPKQCDNNEGLKALCNKAG

SEQ ID NO: 159655 - protein, 266 aa, Triticum aestivum
  unsure (1)..(266): unsure at all Xaa locations
  Clone ID: PAT_TA_54073.pep
FXFFFFLFFXFLCFFFMFLSVLVVFLLCPSWVFXVFCCFSSFSWFFFWVFWXNAFFSWRXMFSFVVEFAFWCFLFKINMWGQSLGSAHRGRLCVCVHRDECMRICMSARVCTVFKKQKDELKSHFYYIHTQKSLIFIRYTTGSSIQLPIPHVELEEQKQKSFCWHRDRTMHLRSERSRIEVMKIIELPIEDVGRVEVVLLDLVVPELAPRLARRSSPEARCRRRTDLHFLVVVHGGLELERRLQSRRVVVPEARGHRRRKGLRPDA

SEQ ID NO: 159656 - protein, 147 aa, Triticum aestivum
  unsure (1)..(147): unsure at all Xaa locations
  Clone ID: PAT_TA_54074.pep
MQIFVKTLTGKTITLEVESSDTIDNXKAKIQDKEGIPPDQQRLIFAGKQLEDGRTLADYNIQKESTLHLVLRLRGGTMIKGKTLTGKERESEIEPTDTIDRMKERVEEKEGIAAGQQEAHLWLGSKLADDKXAKGYNIGRAGSTAAI

SEQ ID NO: 159657 - protein, 111 aa, Triticum aestivum
  Clone ID: PAT_TA_54075.pep
VGCFRWHPSFSGECQSSLPVLGALSPGPPCGCVTCSTPAWCSTRRTRTPAFALIHVRPSSASRWPPAAAPWPGPELAPPWPLLAVPVRPPFCPLTSTGPVYTYSGLAVASV

SEQ ID NO: 159658 - protein, 68 aa, Triticum aestivum
  unsure (1)..(68): unsure at all Xaa locations
  Clone ID: PAT_TA_54076.pep
MGKMKIGINGXGRIGRLAAREALQSDDVELGADNDPXITEEDRTYRAKNDTEHGHRTHRDSRRKDDKT

SEQ ID NO: 159659 - protein, 95 aa, Triticum aestivum
  unsure (1)..(95): unsure at all Xaa locations
  Clone ID: PAT_TA_54077.pep
GSFRPPFPPPSFAPPLPPPLVGRRPTFASAXPPFVWXGLCGFLAVCXLGGVAAAGSAAALCSSAARFAXAAVLVVAXASPLCLCLCLCVFFPWAV

SEQ ID NO: 159660 - protein, 89 aa, Triticum aestivum
  unsure (1)..(89): unsure at all Xaa locations
  Clone ID: PAT_TA_54078.pep
MRECISIHIGQAGIQVGNACWELYCLEHGIQPDGQMPGDKTAGGGDDAFNTVFSETGAGKHAPRAASADXEPTATEEARTGAHRQPLAP

SEQ ID NO: 159661 - protein, 146 aa, Triticum aestivum
  unsure (1)..(146): unsure at all Xaa locations
  Clone ID: PAT_TA_54079.pep
MAPMKVYGWAVSPWMARVLVCLEEAGAEYEIVPMSRSGGDHRQPDHLARNVAIVRSKKLPGPDSGIKKSRAIARYILRKYKPELLRAGNLAESAMVDVWLDVEALQLEPIVRPIVANCILYPLEGRDCDQKIIDEKIXKLKKLVEV

SEQ ID NO: 159662 - protein, 157 aa, Triticum aestivum
  Clone ID: PAT_TA_54080.pep
DEIVVRELSNLASTYFAGRPSAIRRCSTHRRNSECRFSMRVEVHCNLHWDVRKLNLIYPLKEVVLVITGNMFVIEAHSKMAHTHHHYSKDHLHIRVALPESRFLKIYIFCICFIFLDNWLFILVEIQCFTEPAYKGNVYCYFSYLVALESPHLFIRR

SEQ ID NO: 159663 - protein, 129 aa, Triticum aestivum
  unsure (1)..(129): unsure at all Xaa locations
  Clone ID: PAT_TA_54081.pep
MSEEDSTSRPAPKLNERILSSLSRRAVAAHPWHDLEIXPGAPAVFNVVVEITKGSKVKYELDKKTGLIKVDRVVYSSARYPHNYGFIPRTLCEDNDPMDVLVLMQEPVIPGFFLQARPIGXLCPMIDQG

SEQ ID NO: 159664 - protein, 83 aa, Triticum aestivum
  unsure (1)..(83): unsure at all Xaa locations
  Clone ID: PAT_TA_54082.pep
FGGRNPGTTHAAQQGTTAKAAPXGDAENXRQXDRARXAXRAHNAXKGSAPXKRXQERNXXGTQEXNTRTGGAXGKRRDEEEDT

SEQ ID NO: 159665 - protein, 106 aa, Triticum aestivum
  unsure (1)..(106): unsure at all Xaa locations
  Clone ID: PAT_TA_54083.pep
GGEQKRXXPHGEGEKNTXXRXGAXPNXDXXNKHXEEERTKERAEGXEEERXQRXRKTRETEQDHKGRXEDQKSAHPKNXXAATNRPKPPTREEGKGKGRHNPRGAT

SEQ ID NO: 159666 - protein, 143 aa, Triticum aestivum
  Clone ID: PAT_TA_54084.pep
GPVPVSVAAVGFALASGVGAADAGAMVAPGPVPAAVAAVGFTAAIGFALAAGLGDANGHVPVTPEPTTSLMLNFLLLLSAFSETRCLLFCWSAGFFWPAIDLRRVCARIWQEEAASYGGEGATFLRKRRSFFALSGGLWSETE

SEQ ID NO: 159667 - protein, 71 aa, Triticum aestivum
  Clone ID: PAT_TA_54085.pep
KKKEKNKKKRGKRKQPKTNKKHNRTRRKQEKKAKNAHGPKKKDKEQKKKKTKERTKKKQTTAAGQSSMNKP

SEQ ID NO: 159668 - protein, 105 aa, Triticum aestivum
  Clone ID: PAT_TA_54086.pep
LANRKNKPIISVMCTENYFNWTPGMPATYDEFTKSMMVVIRTVIHHGVGHGLFDEESGIPHASQPLKMVVRATRFTPKVNAPILRWRSGDLRMALLFWHALSLPF

SEQ ID NO: 159669 - protein, 97 aa, Triticum aestivum
  unsure (1)..(97): unsure at all Xaa locations
  Clone ID: PAT_TA_54087.pep
TKVYLKTSPFKPNRVPFPRKKTLQSYEISPKSNSTFXNPFLSLPRKLVGVPTIPFVKIVALNPPEVPFDLAMHQQPKVELGVERAHPLPYSNAVLFE

SEQ ID NO: 159670 - protein, 140 aa, Triticum aestivum
  Clone ID: PAT_TA_54088.pep
LAHRPVEEKLTGGTAMHMDVPDQHAPGIHAGESSRDERRGGLRHQGLRRESRPCRALHRALRLCQPSGVAPHNVQVPVAMRFQRTPRWCRPQAYQPTISSGGRFCLQPAFIQSCALCYTVRWLYHCLDPAWRLRCYLEHG

SEQ ID NO: 159671 - protein, 87 aa, Triticum aestivum
  unsure (1)..(87): unsure at all Xaa locations
  Clone ID: PAT_TA_54089.pep
QAPESQAPPAXXPAKNSPNVQSKLDQRQQARXLHSHIQQQFTGGRLLACFSSRPGQCGRADGYILEGKELEFYMRKLQKKKGKGATA

SEQ ID NO: 159672 - protein, 67 aa, Triticum aestivum
  Clone ID: PAT_TA_54090.pep
NNGGDFFHARSSSEKIKKSNSPLPIYILVNDQLAIKKSNFCWKSDVAQFFKLQCWEKQCAILGVSQV

SEQ ID NO: 159673 - protein, 165 aa, Triticum aestivum
  Clone ID: PAT_TA_54091.pep
PPRRPAPPPPAPPAPRPPAGSTPTCRQRQNTNRRERRRRAIAAKIFSGLRAHGGYKLPKHCDNNEVLKALCNEAGWVVEPDGTTYRKGCRPAERMDGIGCSVSPSPCSSYHPSPRASYNASPTSSSFPSGASSPFLPHSNNMVNGVDATPILPWLQTFSNSTASN

SEQ ID NO: 159674 - protein, 118 aa, Triticum aestivum
  Clone ID: PAT_TA_54092.pep
RDSGIPSPPGFKSWCSHHSWIYFRISGDALLVGGDVSVDDESPTVTSSQDDMSAQSLGSAHRGRLCVCVHRDECMRICMSARVCTVFKKQKDELESHWYCIDTQKRVVVIRYTAGSRV

SEQ ID NO: 159675 - protein, 121 aa, Triticum aestivum
  Clone ID: PAT_TA_54093.pep
GCYYRSTYVCYETCKGGVTNSGATGAQRPMDDLTTGKLIHQHAGANPAVIATNCRWGGTGAGVGPGGPNAHKPEGGEPCGAGGGGGPTPALAWPPGWSARAGVFWPLGTGTPFSWGGGGRP

SEQ ID NO: 159676 - protein, 99 aa, Triticum aestivum
  Clone ID: PAT_TA_54094.pep
ILSSASPCFSLSYLTGQPKFKLWSRAGDRNNIFADGNDQTMQAGEEEGALRYVWVAMPCHVTQAPACQGSLLPFPVIYCGRSVYGQVQPSLMAMLLRPA

SEQ ID NO: 159677 - protein, 92 aa, Triticum aestivum
  unsure (1)..(92): unsure at all Xaa locations
  Clone ID: PAT_TA_54095.pep
IGPSLPYYRTISNECTSNNTRPIQSHTPTHPKQSSQLWTTTKPTPNYSTPPKQAPPRSGAAPGDXGEDXXVPHHADEDGXLLGLRVRDPHVS

SEQ ID NO: 159678 - protein, 62 aa, Triticum aestivum
  Clone ID: PAT_TA_54096.pep
KFPLVCTQRDHIVYQQLLFSLGGRWKFISAFFFLKFGRIFLLQLGRGAPWGGGGESGATFLF

SEQ ID NO: 159679 - protein, 61 aa, Triticum aestivum
  Clone ID: PAT_TA_54097.pep
PPKKTNPLKKRPPTRLKFENPNFTVSGIQVRYPKVTEKSGSQAPPWVRDTPMGGENKQRLI

SEQ ID NO: 159680 - protein, 72 aa, Triticum aestivum
  Clone ID: PAT_TA_54098.pep
GAGGAQHGGNEDTAAGGAQCSGHHGTGTGGAQSGGHEDAGASGAQCSVNEDADAGGYGDAGRRGEPTGHGEA

SEQ ID NO: 159681 - protein, 128 aa, Triticum aestivum
  Clone ID: PAT_TA_54099.pep
DHKPDQTDERQRMKEAEGFVMWAGTWRVGGVLAVSRAFGDKLLKQYVVVDPEIREEIVDESLEFLILASDGLWDVVSNEEAVDMTRSIQDPEEAAKRLLQEAYKRESSDNITCVVVRFFHGQGSSGPA

SEQ ID NO: 159682 - protein, 129 aa, Triticum aestivum
  Clone ID: PAT_TA_54100.pep
EEMKSQEKFFHDQIENIHKATEDKESEFERLLQEERAKARQCDVDSGTTENRRLRKEQVQRFIECQVKDVQEFEVERDELIKAHEEKKVQLKKEYMAKEVELEKEFDAALTGLMEKHRPGTFQASSSSP

SEQ ID NO: 159683 - protein, 121 aa, Triticum aestivum
  Clone ID: PAT_TA_54101.pep
QVGRYQSLIAFAGLVTPPGMQTATSLVFTAGEHAGSTLVMVGSIVSSEGPYETAVVGGTGAFRMARGYCVLKAVWSPTPVSTVYEVNLLVKTEGKLLAKMDAWRRRYALSHACSTACCYYE

SEQ ID NO: 159684 - protein, 62 aa, Triticum aestivum
  Clone ID: PAT_TA_54102.pep
GGAVAPPKGQKLFKGLGPPPRPPRGPKESWGGPQERGLSQDFTWGQPPHLYKGVLVKAKSPW

SEQ ID NO: 159685 - protein, 106 aa, Triticum aestivum
  unsure (1)..(106): unsure at all Xaa locations
  Clone ID: PAT_TA_54103.pep
LPPLSTQPLVNQVXHLTRSKWAPCLQFRKVGFIFRXAHPIPWVIPWPVMTXMCNLPMFGCTAPTQVITPPPEVKKEYPPAYVGIIGFANMRQVQCVSFIPFKPPGC

SEQ ID NO: 159686 - protein, 142 aa, Triticum aestivum
  Clone ID: PAT_TA_54104.pep
LFGTQTRGLKPFVVFPSPPRFFLEKRGFFLKGKGIFFFGEFGLFPPQNFAFWQSPGVFFFLGGKFFFKEKIFGGPLFGLFGKGLFSFLNPPPLGGWAFSVFWTKFFFWAPFFVPPLNRGAFPLPNGGPPLFFNKGYLGPQKI

SEQ ID NO: 159687 - protein, 51 aa, Triticum aestivum
  Clone ID: PAT_TA_54105.pep
EIKKPQFRRTPIWWAVEPKEVPPVVSFLCMPGASLVTGQVIPVDGGRPISG

SEQ ID NO: 159688 - protein, 86 aa, Triticum aestivum
  Clone ID: PAT_TA_54106.pep
PWADDYVKPGGFTLLQGKNAFILALTLVYQAVFFRGNLLPALWKRGSRKPDTFRAVTRSWVQARDHLNTYCWGRQTRWRKLVDGLG

SEQ ID NO: 159689 - protein, 28 aa, Triticum aestivum
  Clone ID: PAT_TA_54107.pep
KDGNLNIMPVNAHQQMKRSVQRRKYVDL

SEQ ID NO: 159690 - protein, 47 aa, Triticum aestivum
  Clone ID: PAT_TA_54108.pep
PKEGSLVQKIPSAAHNYRSGYNHYSLYVFTAGGLRWRDFYWSYEGTG

SEQ ID NO: 159691 - protein, 128 aa, Triticum aestivum
  Clone ID: PAT_TA_54109.pep
RKFRGYCPKKGIPVAAYSPLGGQNWNGDGNPVLDSKVLPEIPKAKGKTLAQVALRWISDQGVPPIVKSFTKERLKENLGFFDWWVADDDLGKMGQIPQKKIVKAETVLFSAEGGFTWAALPNMEIVGE

SEQ ID NO: 159692 - protein, 61 aa, Triticum aestivum
  Clone ID: PAT_TA_54110.pep
PTPQNNPQASPQLLAPFPGPGLHMVFIYRTQSQSFLRSTRPQISTHLCGAGPTLFELVALV

SEQ ID NO: 159693 - protein, 153 aa, Triticum aestivum
  Clone ID: PAT_TA_54111.pep
EIKAAPQFLKNGEPGFVKMIPPQPLVVETFAQDPPLGRFAVPPIRQPVPVGVIKAVEKKDPPGPKVPKAAAKKKLNGVRFFPASMGGGAVAVFGGGDSCSSRFETLLSFGFLCRPVLELLFALALVSFGCVGGTMPVDVAPKKSRHVWGRFFS

SEQ ID NO: 159694 - protein, 157 aa, Triticum aestivum
  unsure (1)..(157): unsure at all Xaa locations
  Clone ID: PAT_TA_54112.pep
CPHFCPPGHRANPKEGVTQGYPFRRRTEERHKSFFRLNAADDKLLNLIHQFTLRPGFRVKWNKRVRVNPFKFQAWEEFKVKFRPRVFTYVADWTDPVNLQSKDRTPGLGFXRRSXPVGWTKKFFEVNDTLLPDATRKWFGVGFGNNFPTVGPIISSL

SEQ ID NO: 159695 - protein, 62 aa, Triticum aestivum
  Clone ID: PAT_TA_54113.pep
LFLAQVQGSFIHSSSSKSAAAQHKVQTQPDITLDHNTVATKNKTRRGHADNHNGVHRKTTDS

SEQ ID NO: 159696 - protein, 135 aa, Triticum aestivum
  Clone ID: PAT_TA_54114.pep
LNKDKKVGGLGLHMYGALPYVVVKPFPMFFSYSDCARKFVNGVFRSPVYTVFIVVDKDRFIQPVFYAEYMWALFELALGLLDVFLAHPRYRLSAMNKDLWVGSLSTSPPRPNLCICTLIILGSIVYYGARTRYSL

SEQ ID NO: 159697 - protein, 79 aa, Triticum aestivum
  Clone ID: PAT_TA_54115.pep
LQPAGPPPPVDLRPVVSLWKRLFRRCEAPASNFEPPCKLGGAVLLHVLPPQHQQQDQALQFPRWFVNRILARYPIFCSY

SEQ ID NO: 159698 - protein, 98 aa, Triticum aestivum
  unsure (1)..(98): unsure at all Xaa locations
  Clone ID: PAT_TA_54116.pep
NFNPPRGPWVSLFKRAPPSPSFKEKFLEGKVPWPFPPGFFKCPPPPPWGGPPSRMGIPPNSPSFPLVXEWPKGPLLEPPGWHTPRCRAPPPGVPGFFF

SEQ ID NO: 159699 - protein, 81 aa, Triticum aestivum
  Clone ID: PAT_TA_54117.pep
VRNPLQARARCIPACRATGSRPRRSRTRCLARTAASAIRTASASVSATAPGPASWRAGPYLLRSLAAAVAIATDVVAAIAL

SEQ ID NO: 159700 - protein, 77 aa, Triticum aestivum
  Clone ID: PAT_TA_54118.pep
RRGRPRRRRLAGFLTPLGFRPPPTAVPLRKTPGFGGPPWPPPSGEFFSQKSPFFPFFRPVGGMIPPKYFFPWAWAFF

SEQ ID NO: 159701 - protein, 92 aa, Triticum aestivum
  Clone ID: PAT_TA_54119.pep
TNPGEFSKLKSQRGAKKIKPPRGAPQQNPPKGLKQKLGNPAGPRGKEKKKGPKGPLKGGGPWGEKNPPPGPGKKNPQPGLGGKTKKNKGGLL

SEQ ID NO: 159702 - protein, 96 aa, Triticum aestivum
  Clone ID: PAT_TA_54120.pep
PPPRPAPRRAPTSPPGPPPQDIQNPNGVKLKEIKNGRLPMVFMLGFFVQGFVTHPGPLENFFTHFLAPFPKNFFFALPFFLKFPVSKFRLFFLFSL

SEQ ID NO: 159703 - protein, 74 aa, Triticum aestivum
  Clone ID: PAT_TA_54121.pep
PLGGKKFAFNPKGFFLKGGEGALAPGPRGFPPMGLPPPRGPFWVLGEVFLGPPPPVFDLGKLGGGFPKGALRGV

SEQ ID NO: 159704 - protein, 38 aa, Triticum aestivum
  Clone ID: PAT_TA_54122.pep
LVRCACYSQRVDVSRSNYLLSFFSHSMYYIPFNKMSFA

SEQ ID NO: 159705 - protein, 93 aa, Triticum aestivum
  Clone ID: PAT_TA_54123.pep
TKKKRGPLRGEFFSTGDFQLTPRGKKKVFVFKLGIIIGLKIMGILRIIIRGDKLDVTQGGLINIRGTNRDFDILNDLGPLGLGPSIFFFPRFN

SEQ ID NO: 159706 - protein, 105 aa, Triticum aestivum
  unsure (1)..(105): unsure at all Xaa locations
  Clone ID: PAT_TA_54124.pep
MKFDELGFDFQSPPLNRRKLGTLPSPRPFFVAGVNARKRDKPLPPIIIDDPSDIVAIKGACNTLSARKFWERKAIKMDXLEDQISQLEKKGDPWKRVAFGPSGGQ

SEQ ID NO: 159707 - protein, 86 aa, Triticum aestivum
  Clone ID: PAT_TA_54125.pep
SSQEEAVQISNPGQEEVEETRWFCLFQLGMLALCPSDEGTAFARPRTKMLDLASNKEDDSPPHVMDVVRRMMHGAHRKICPVCQYY

SEQ ID NO: 159708 - protein, 117 aa, Triticum aestivum
  unsure (1)..(117): unsure at all Xaa locations
  Clone ID: PAT_TA_54126.pep
SSRXXXRRSEAGRARWRPTRGRRXRPPGPTRASSRTTRRTPNSAAIAKPKPRPRFCAVSGRKNKLCTDGDGDGRSSSKQKIEKKTSRRRSRMMASLAEGHVLIDSYGRCSFCSFVDY

SEQ ID NO: 159709 - protein, 114 aa, Triticum aestivum
  Clone ID: PAT_TA_54127.pep
IEGEKNLAQLKKKSFFAAGGGEDPERGGGEGGPGVVAEKNVNLDVGGPVKLKVGKDPLRGGPLGLEGDHGADRLGEVGQGRARLFVPLEQPLEGAGPRGHFHHPFFLDRKPLGR

SEQ ID NO: 159710 - protein, 91 aa, Triticum aestivum
  Clone ID: PAT_TA_54128.pep
PPPPRPPQGHPRRPPPPAQGGLPQRHLLPAGGHPPARPALDPPARGSPFAVVVPAPCVPCRAVDPNKRVVCRVVSSPGPPPPTPVVGLAGF

SEQ ID NO: 159711 - protein, 137 aa, Triticum aestivum
  unsure (1)..(137): unsure at all Xaa locations
  Clone ID: PAT_TA_54129.pep
PPFFPPGRRGAPPPLPGSVPGLKEGLPGFHVPGFGAPPNGCMSLGPPFTPPGHVHGAPQNXIPPAGVLGNVPPGVDGVASINIIDCHIPLSGPNSIFGRPVFVHGDADDLGKGGHXLSKSPGNPGARVAFGIIGLPG

SEQ ID NO: 159712 - protein, 109 aa, Triticum aestivum
  Clone ID: PAT_TA_54130.pep
RHKVGSWMLGKAFVWCFPIHFIHCASLFWTPNVLAGQPMTLNSVFSFQVYFKLTSFPFLVVVNNMKVQPWFLLPADAYCFACSYHQPLLLVLSLFENQRNIDFQLTCVC

SEQ ID NO: 159713 - protein, 169 aa, Triticum aestivum
  Clone ID: PAT_TA_54131.pep
GTTYEYMNINQALVADSHIHTYGTRSITPGRIYTGYYYKKFILPWGKLAHQYLDLELIHGPIQAPGGWWPNRVHAGGPTPQGSHNESHGADEVPQLQQAKGQKEKCAGETTSWAWVGKTDKNNGAAGHPRAGGSEREPKPKQGKLGVEGWEQQRQRRRGCLGPGAKQGP

SEQ ID NO: 159714 - protein, 99 aa, Triticum aestivum
  Clone ID: PAT_TA_54132.pep
ASFLEGSTPLNLFRGEIAQCRGTNKCHQPLAPKDVFLGFQRNSVPALKRRLAGDQFFHFAPPLGFKVPSGVLDLFPLSQALAFCPLFKVWFFGPFSGGG

SEQ ID NO: 159715 - protein, 94 aa, Triticum aestivum
  unsure (1)..(94): unsure at all Xaa locations
  Clone ID: PAT_TA_54133.pep
PLPNDQSRAGVLKIPPVGFPKHGEIDYXAVVKLAGGFNGPDFSNVCPGGGMAPLXTKGGFFSPEDFLKGGGKFNYPKKLESRAPYRAGFGKASN

SEQ ID NO: 159716 - protein, 77 aa, Triticum aestivum
  Clone ID: PAT_TA_54134.pep
PFMLVRLPPWLGHLGRWAQKGHPPLSPPQFCMIPTLFYDPPSPVVPLPKQHFPFFFWMETDSFPPLCWGTLPPSLSL

SEQ ID NO: 159717 - protein, 85 aa, Triticum aestivum
  unsure (1)..(85): unsure at all Xaa locations
  Clone ID: PAT_TA_54135.pep
SCRQTLASNPQLVIIAHDVDPVELVVWFPALCRKXEVPYCIVKGESHRGPYRYFLIRPTCHKHGVGHCLSSSLQKRRDGREWLHH

SEQ ID NO: 159718 - protein, 82 aa, Triticum aestivum
  Clone ID: PAT_TA_54136.pep
LDSLYHNFPGGQSITVGWPNWGGHNKTKNKLGGHFWVLFFPPGFTLFPWERAGFPFYPTVKKSHRGTPIPNWDLERTQNQTF

SEQ ID NO: 159719 - protein, 136 aa, Triticum aestivum
  Clone ID: PAT_TA_54137.pep
QQGGYAKTGQCCMLLLFYLLDRTTLLSIIPPSPIPIIPFLVAARQLFCFCRHVTSISLHGCALIALRPWTTRAAWIGGRIEIILDAAAAVAAARASRRTGRGGPGAPAPASAGRRCRCRCRCPPIPPPCCWSRPCA

SEQ ID NO: 159720 - protein, 75 aa, Triticum aestivum
  Clone ID: PAT_TA_54138.pep
EREDGGESGALLPPSSRAPHIAKWVSPRQAKQQEETIVIDASTRSSYSTCSSGSGGLLRSSPFVSESELRCVQGI

SEQ ID NO: 159721 - protein, 125 aa, Triticum aestivum
  Clone ID: PAT_TA_54139.pep
PPPFFSPPGGGPAPPPQENAPRGQGGSPPLPKGGGEKGPPPPRKGKAQIWGQKGKCPPNQGGAQKGGPQPPKGPASPRQKRFFPWGKGPGGPGVNIKRGPPLGANPRFFLRVYPPPPIPPFWNVR

SEQ ID NO: 159722 - protein, 256 aa, Triticum aestivum
  unsure (1)..(256): unsure at all Xaa locations
  Clone ID: PAT_TA_54140.pep
QAKNEIDSLHDGIDFYGPITRAXFEELNMGLFRKCIEHVEKCLSDAKVEKPQIHDVVLLGGSTRIPKIQQLLNDFFNGKKLCKSMNPDEAVAIGAAVQAATLSGEGNQKVQDLILLDVTPLSLGVEIVRGIMGDPGIMSVLIPRNTTIPVKRDGPYTTIYDYQTSVTFPVYEGEGAFTKDNNLLGQVTVSGIPPELKGMAXLKVTYEVEANGIMRVSAEDLTTGNKSSVTIDKGGLRKEEINRMMRDAGKYKSEDK

SEQ ID NO: 159723 - protein, 75 aa, Triticum aestivum; identical to SEQ ID NO: 106874
  Clone ID: PAT_TA_54141.pep

SEQ ID NO: 159724 - protein, 249 aa, Triticum aestivum
  unsure (1)..(249): unsure at all Xaa locations
  Clone ID: PAT_TA_54142.pep
AARTRERRHCWLLAFYSPLAPGRPPACLLTLLSVVAALSLAAPGLAAGKTGQVTVFWGRNKAEGSLREACDSGMYTMVTISFLDVFGANGKYHLDLSGHDLSAVGADIKHCQSKGVPVSLSIGGYGARYSLPSNRSALDLFDHLWDSYFGGSKPGVPRPLGDAWLDGVDLFLEHGTPADRYDVLALELAKHNIRGGPGKPLHLTATVRCGYPPAAHVGRALATXIFERVHVRIYEESDKACNQYGAWEE

SEQ ID NO: 159725 - protein, 126 aa, Triticum aestivum
  Clone ID: PAT_TA_54143.pep
KGGGKNCLKKGGAQKKTLGKPNPQGGPIGGGFFCPKQKDYGGGGAPQKRGVTRNPGEIWKRGKIPIFWREREKGFGPKKRGVHFPMGKRGKGGGVGLLIWAWKTPFLKIGGNPPMGLNPKGGGDPP

SEQ ID NO: 159726 - protein, 104 aa, Triticum aestivum
  Clone ID: PAT_TA_54144.pep
AQTRGQQGKKNGGTKRGAKKKTRGGKRGEKKGKKTGGAPPKKGGEKGKTPGWTTQKKALNQKPTRKGLGFKRIGGKKKKNSGPLFNPKKTEIEKGRGWALETQN

SEQ ID NO: 159727 - protein, 53 aa, Triticum aestivum
  Clone ID: PAT_TA_54145.pep
EIKNGPPPLFSMLGFFVQALVPGKGPLENLAGPLAGPVNNNAWAFPPPFVPGQ

SEQ ID NO: 159728 - protein, 183 aa, Triticum aestivum
  Clone ID: PAT_TA_54146.pep
PPPPPLLVCVFPPPLFRFCFFSSKPFSFMGLCLSQFFSLRERGFAFSFSPYFLGGAPPVCPGFFFSNPWGFWVGSFSPPPGFFFVQFFWPLLVLILGPFVSIFPPLLAPFLRVPPPLLRLVPRGRLVPLQLGWFTWVVFLSFFLCPFWCFFLVPWCGVRPLFFFPCFFFLAPTCLLWSVFFGS

SEQ ID NO: 159729 - protein, 46 aa, Triticum aestivum
  Clone ID: PAT_TA_54147.pep
TTMLIELYKLKTALTKGGGHIKKKKNTAQIRVQGASLLGVALLPCE

SEQ ID NO: 159730 - protein, 169 aa, Triticum aestivum
  Clone ID: PAT_TA_54148.pep
KKPQGGVFLFKETQKTHRQPFNQPKGPKFIGAREQKTPKTRRKTIWNKPNRLVGQLFANNPLGAGGFLKTKKNPTGGGETFLWGGGQTKRSRGLKRGGFLKLKGGVLNPYRGLRGFGTAQNGGGKKESPHLGHVKKKNRGHGNTPGGGTRGINRFFCPFGPFGLFRPKF

SEQ ID NO: 159731 - protein, 154 aa, Triticum aestivum
  Clone ID: PAT_TA_54149.pep
IPRFPMQYRNSAAKKKFVPWPIEMRFCQDSKSQHEPSLHYWFRARGKLSDDPALHRCVVAYASDLLYSGVSLNPHRKRGLKTYSLSLDHSMWFHKPVKADDWLLYVIDSPSAHGGRGFVTGRMFNRQGELIVSLTQKALIRRAKTPGQTPRPKL

SEQ ID NO: 159732 - protein, 71 aa, Triticum aestivum
  unsure (1)..(71): unsure at all Xaa locations
  Clone ID: PAT_TA_54150.pep
SVGAARRRVLLLLVAEVAFVAGVAALVLSLAHTHDRRSMVXGILCVLFGTXMYAAPLXXMKMVIQTKSVEX

SEQ ID NO: 159733 - protein, 137 aa, Triticum aestivum
  Clone ID: PAT_TA_54151.pep
PTRPPTRPAELGKEKLAGTVGFHERHVFLCYKGPEEWPSHVEASESDHLPRHLAAAIKARKPNLKKSVSISSPSPSRFARNWLILSCDVVLVCFCSGSVILFWLLGVGTACWSLRASDLAATSTSIRLALRMVVLGS

SEQ ID NO: 159734 - protein, 82 aa, Triticum aestivum
  unsure (1)..(82): unsure at all Xaa locations
  Clone ID: PAT_TA_54152.pep
DPRGRLVLNSIACGGAAAXLPWVPXAAAAVHSGCWTLXLPSRPRLFKRRVFLGGEKLGISLGVLLGLSGSPLFLFGAGGTSW

SEQ ID NO: 159735 - protein, 199 aa, Triticum aestivum
  unsure (1)..(199): unsure at all Xaa locations
  Clone ID: PAT_TA_54153.pep
MSAPMEISFDPHPSHPALPAFPSSPPLEPAAAATPPAVSSSPQPTAEAVVAPTPPDDKVLVSVEVLLHATSTARAEDVRVAVERMLESRSLSYVDGPVQIPPDNSFLLEHVKRIQISDTDELIENHKILLFWQVKPVVHVFQLNEDGPGEEPSEDDTLSSFXEWALPAKELMDMGKLLYEVGLKQRLLRYAASALLFTE

SEQ ID NO: 159736 - protein, 39 aa, Triticum aestivum
  Clone ID: PAT_TA_54154.pep
PPGLVIARLSTLPNQASELHQVRHQGRLKPWRASWHETG

SEQ ID NO: 159737 - protein, 119 aa, Triticum aestivum
  Clone ID: PAT_TA_54155.pep
PKKFFGGGGRKKKNGTPKGGPLFKFNGETPQRGGKEREKTKKKGVKGFGKLKGNMGGKPHPPRCKRPVKGGFHFPIKVGKFLEKGMGWGLFVFTPPGKRGFFSKGLNWGKPGVFQVPGF

SEQ ID NO: 159738 - protein, 217 aa, Triticum aestivum
  unsure (1)..(217): unsure at all Xaa locations
  Clone ID: PAT_TA_54156.pep
AALPLYYGTPASCSGLSSVRGPFTPSQWMELEHQALIYKYLAANIAVPHNLVVPIRRSVTSLYPSAYFGSSTLGWGPFQLGYSGSADLEPGRCRRTDGKKWRCSRDAVADQKYCERHMNRGRHRSRKHVEGQPGHAAKAMPATAAAAAQPGALATGGGGGAPAGAXICHEQQPLKNYAASTIDPCSLQYNRXMVSKQQHECEQVQDSDTLLMLTFMS

SEQ ID NO: 159739 - protein, 47 aa, Triticum aestivum
  unsure (1)..(47): unsure at all Xaa locations
  Clone ID: PAT_TA_54157.pep
XKNLQRWHPWRSAGRXSRRAQAAEPDHASAAYGWKMVTGLSLGGAGA

SEQ ID NO: 159740 - protein, 192 aa, Triticum aestivum
  unsure (1)..(192): unsure at all Xaa locations
  Clone ID: PAT_TA_54158.pep
AITSSKPSFAFHFNFVPMEARDGGSAPLPCSYAPLPEDAEAAATVGRVRRTAGLLCAALLLATVAVLLVVAALAGVRLAGQLPAGGIVVMSGHQTTVDTAPMSASSRGPESGVSEKTSGAGARGGMLRADAGGNAFPWSNAMLQWQRTGFHXQPEKNWMNDPNGPVYYKGWYHLXFYQYNPDGAIWGNKIAW

SEQ ID NO: 159741 - protein, 33 aa, Triticum aestivum
  Clone ID: PAT_TA_54159.pep
RRPRLRRHRPEIGASQHFGVWSVSRRFYFPRVR

SEQ ID NO: 159742 - protein, 56 aa, Triticum aestivum
  unsure (1)..(56): unsure at all Xaa locations
  Clone ID: PAT_TA_54160.pep
GSHVVFSGGIDCLTNCVVVSWSTSSADTSCPTISGRSTMTIMMXHLDKGGDHMPAY

SEQ ID NO: 159743 - protein, 89 aa, Triticum aestivum
  Clone ID: PAT_TA_54161.pep
GVGMAFSRLSPDGAATPAGLISAAIAHAFALFVAVSVGANISGGHVNPAVTFGAFVGGNIAGLHGLFYWVGQVLGCAGGWLLLGWLHRG

SEQ ID NO: 159744 - protein, 59 aa, Triticum aestivum
  Clone ID: PAT_TA_54162.pep
FFFFFFFFFFFFFFFFFFFFFFFFFFFFFFFFFFWGGGVNPEIPARALGGTHFSLKGGK

SEQ ID NO: 159745 - protein, 124 aa, Triticum aestivum
  Clone ID: PAT_TA_54163.pep
NTNHKKTGRTPGKKPGENGVKRPKNDRGGRGKRGEKINMEGPPRGPNDGFLNGFYPAHSLIVPNRGFIGPKLELSPTKREKKQKLGGKKINICIQSLPWKGPKDNDEDGEEENQFPPPPHGSPF

SEQ ID NO: 159746 - protein, 131 aa, Triticum aestivum
  Clone ID: PAT_TA_54164.pep
KNTGKYIKQGLKTKKKGNQLIRAKIPSLSLKKHNNPWVQSPPPPNGRAKCKGPAHGATGGPKKTRADLREIIGPNKKLGGPGGKPRRRPLGEWKTTLGNWGNVDLRVWEKRNPLSSGGGGRKKRGGGTPLP

SEQ ID NO: 159747 - protein, 93 aa, Triticum aestivum
  Clone ID: PAT_TA_54165.pep
CGVLRGVVHPTVTIYRKTKSNATATAPISWSSYFFKPKNGMDLLVSKNNKLRITSNYASYQGQGTRIRPLAICSSKQYARNLPRDSKSFFRAV

SEQ ID NO: 159748 - protein, 72 aa, Triticum aestivum
  Clone ID: PAT_TA_54166.pep
FSSPQPPKEKPPLGPFVSVGPGSLHKEAKSHPLSVSPGSPVLFSKFPGGEFKGASAPNTIFFKVSNFRADLF

SEQ ID NO: 159749 - protein, 77 aa, Triticum aestivum
  unsure (1)..(77): unsure at all Xaa locations
  Clone ID: PAT_TA_54167.pep
EGQNPTPQARVLIRQTHIRVGRQXVNVPWFKVRVEFEKHIDFSLTSPFGGGPAGRGKKKNQKKASGGGDAGGDEEKE

SEQ ID NO: 159750 - protein, 80 aa, Triticum aestivum
  Clone ID: PAT_TA_54168.pep
SCPFSFPLRFLAKGGIFAFFFFPLFLLFVLWEKVFCFFFVKIFFKVGVFVSFLNNWALLFLAVFSTPKIFVGAKGTDQFK

SEQ ID NO: 159751 - protein, 109 aa, Triticum aestivum
  Clone ID: PAT_TA_54169.pep
NRSGHHFSSLQVPPSTASFCWSSSVMSADFCLFWSPVSSSSDRYITLAEASMSWGSLGSPRPVSHSFSDAESESDSAEPDAEGPTPLLGNTFNAADETLDVVVKPCWDG

SEQ ID NO: 159752 - protein, 150 aa, Triticum aestivum
  unsure (1)..(150): unsure at all Xaa locations
  Clone ID: PAT_TA_54170.pep
KKGKSXXKKKXPPKKGPRGFFLXXWGFSLKNIFQFXTXXKKKNXFIFRPFFIKTQPGLGNRVLKAHPRYFQIYGVGXXKKKXXXXXVFVXXKXXXXXXXXKXTXSXXMVYVWSICSKKAKPSYQCKKNLXKKXWKRLFPXKCXFAQDSKC

SEQ ID NO: 159753 - protein, 85 aa, Triticum aestivum
  Clone ID: PAT_TA_54171.pep
VCLLPTCEETDQGRGPWPRVVHANEGYQNCPWSMRSSLSGAALLVWPQAEETLLIKVVTTCIFEPRIECHFVFVSRISCLIYRSF

SEQ ID NO: 159754 - protein, 93 aa, Triticum aestivum
  Clone ID: PAT_TA_54172.pep
FFFFFFFFFFFFFFFFFFFFFFLNQNNNGIIHGRGILPRLLPGKKKQGDSRNNTHQLQAGFLDYWWDTRATNSYRLQLQIYIYNHAVKTHTLF

SEQ ID NO: 159755 - protein, 66 aa, Triticum aestivum
  Clone ID: PAT_TA_54173.pep
AEKLDYSNIKYKHDRDTIAYSHGYSVMTVLVWKTIMLGILCTIIRTHGDERREALRRSTPDGGRRR

SEQ ID NO: 159756 - protein, 52 aa, Triticum aestivum
  Clone ID: PAT_TA_54174.pep
LTEAMSQYDGGLTGVYPEEEDDRLGDLGGDSDYEDYEYVQCITMAGEDTCAM

SEQ ID NO: 159757 - protein, 137 aa, Triticum aestivum
  Clone ID: PAT_TA_54175.pep
MFGDDAVDVRAGAKTAVDPCGGHAANPDQPTAQPDGSGATTEEEAGGVAGWDYVYDPASGYYYSGSTGHYYDAASGCYWSASTGTWFSYDVHGEEASTTPARTSEYWMWSSSDRLSKFKFKVTFLRSGFGSAEFLHM

SEQ ID NO: 159758 - protein, 172 aa, Triticum aestivum
  unsure (1)..(172): unsure at all Xaa locations
  Clone ID: PAT_TA_54176.pep
GYVWMRQGKPYEHHFRATGTRVRYDAEVTAYVEEGRMKRMTGVRSKQMMLWVPIVEMSLDGADKVYFKSNVGIGRSFPAAAFADEDAAAXTRRRRPAPPRPTTSIDRSIDVAAFIWFVLVPIVPVCDTTVRVKVICGARIGMSTYVVRLVRGVFFLFCEFASINCYQRCNAT

SEQ ID NO: 159759 - protein, 256 aa, Triticum aestivum
  unsure (1)..(256): unsure at all Xaa locations
  Clone ID: PAT_TA_54177.pep
ERGSAGGCVMAAVAGAGGGDEMLLRRSRRRLPLADLTNLSSATSAITRLKRNPQHRTSPASSASSIGSSTVPRIPTPPPPAALSVSTTKGKDKSTRELQSSNTHLNKIQKISKPKVKTGGVLPGTSSPPSKNTRKITRKEQPRTESLISPLYASSKTKAKTSGDVLPGASTPPSKKIMKVTREEQPRTEPLISPLYASSKTGLKTGDELPGASLXSRKKTSKVTGSSGKEQLQMEEMSCDESLVPSEDFIKERRAY

SEQ ID NO: 159760 - protein, 161 aa, Triticum aestivum
  Clone ID: PAT_TA_54178.pep
MVIAPVATYSSSRAPPPARSTAYRARLAAAWLSSRASSFASGSGLAVAAASVAVAARPRRTGAGGGALGCKCLFGLGVPEMVVIAGVAALLFGPKQLPEIGRSVGKTVKSLQQAGKEFETELKKEPEEGGDQPAPTTPTVVQSDDDEEKRELQACCRKEST

SEQ ID NO: 159761 - protein, 66 aa, Triticum aestivum
  Clone ID: PAT_TA_54179.pep
VITTNRKFQTSQNQETTLQPPRHSKLTTLLKEKDRQLLKSRPRWTKSKMVKLLILLLVQLLKSRPR

SEQ ID NO: 159762 - protein, 176 aa, Triticum aestivum
  unsure (1)..(176): unsure at all Xaa locations
  Clone ID: PAT_TA_54180.pep
GRVGAATAPAPDAAPSPIPFSLAADADPVLGTALTLALPPDTASFLLTFSTSPGASALQWLAPPQTASGLPFVFSQCQSIHARSVFPCHDTPAARITYSLLLNVPAQLSAVAAARHVARRDPVPCDHRGACNDALWCAPGRIVKEFEMAQCVPAYLXAWAAAEIGSRSLGAQDTGV

SEQ ID NO: 159763 - protein, 35 aa, Triticum aestivum
  Clone ID: PAT_TA_54181.pep
PTRPGWCSQFSKPPVNKDFGPLFRPVMTKKKWALC

SEQ ID NO: 159764 - protein, 64 aa, Triticum aestivum
  Clone ID: PAT_TA_54182.pep
KGNDPPGFFKEVGCVSVPSRQSLTLYTKYPLALKTWEGGPTLVTWCHVFFSTDYYFLVVVELGF

SEQ ID NO: 159765 - protein, 93 aa, Triticum aestivum
  Clone ID: PAT_TA_54183.pep
NMLMCIYFPFNENATLLPVQKKNYIRFLHSLKEEGSRGTPPWRGTPTFAETCAPPASVGAPFSSPRRCGTTTVDAAFQSHRPLEAMGVAPPAR

SEQ ID NO: 159766 - protein, 54 aa, Triticum aestivum
  Clone ID: PAT_TA_54184.pep
CVWFLLVAGKSYYEISELSKLPVGFPHRLHFILLICFGSMRVKNTRIKQDNHYP

SEQ ID NO: 159767 - protein, 60 aa, Triticum aestivum
  Clone ID: PAT_TA_54185.pep
FFFFFFFFFFFFFFFFFFFFFFFFFFFFFFFFFFFFFFFFFLKTKKILFGGKGEKKGGAF

SEQ ID NO: 159768 - protein, 78 aa, Triticum aestivum
  unsure (1)..(78): unsure at all Xaa locations
  Clone ID: PAT_TA_54186.pep
KTGALWPLWCIQIRFLDRPXMNEVIEILEAGFDGPQILLRPFFCDKGPTHVEDFSLFSSKLTGVWEEDLFVVSEETDV

SEQ ID NO: 159769 - protein, 60 aa, Triticum aestivum
  Clone ID: PAT_TA_54187.pep
VFRPPLLSLPPNQTSSPVLVLTEPKWYGIPTCKRGVGALACTLESLRKNPLWLQDKRSCF

SEQ ID NO: 159770 - protein, 247 aa, Triticum aestivum
  unsure (1)..(247): unsure at all Xaa locations
  Clone ID: PAT_TA_54188.pep
MASTSVVTLNVGGELFQTTAATLSRAGASSPLASLGPSPADAPHFLDRDPRLFAGILSFLRSGRFASPPPSAALLAEARHFSLDGLLLASLSPASTFSPLSLRPTALLPLTGRVAPSAVAISPSPHAASLVAAHGGVVTSFDAVLASRTSVLTPLPTIDSLVAVSPALALAGARDFPGVQLCRFPGDAPATASEALYWPDSPSSSVLSMAATAASETASQWLFASFESARRNSSAVVXXDLNSLSPV

SEQ ID NO: 159771 - protein, 89 aa, Triticum aestivum
  Clone ID: PAT_TA_54189.pep
MQKLQFPAVNLQKSYKTTVNLTAAEMSCLRSSRVPCHEQSLCCLWARSSPVEHQNFTSLPCLCTKDTVYTRSGTSCPFLVHGVNNLFRL

SEQ ID NO: 159772 - protein, 137 aa, Triticum aestivum
  Clone ID: PAT_TA_54190.pep
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAGMPTIKYLLRNGTKGILTSHLG

SEQ ID NO: 159773 - protein, 207 aa, Triticum aestivum
  Clone ID: PAT_TA_54191.pep
MAANYYWGMWGAATTSSTAATCPAPASAAEPSWEEQAFARDAAGHLGAGCVWPPRSYTCTFCRREFRSAQALGGHMNVHRRDRARLRQCVSPPDHQAQPQPTSPHDHHEHLQPGMQYRAAVRPKSPQDQQASMIGPSTTSPSYISSIIKESRNKVFISMPAEEASESGDEGERRKRRRVVDQPPAVALPFFLRWSPASSEREGMGAD

SEQ ID NO: 159774 - protein, 134 aa, Triticum aestivum
  Clone ID: PAT_TA_54192.pep
QKCQSDVQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 159775 - protein, 71 aa, Triticum aestivum
  Clone ID: PAT_TA_54193.pep
ATVTRAWFTTLPDFRSPALDFDLRRSIGYQSCSDVSDSSYPDRHRSFCSLCLYPVSPLDFIFYLAFLFPNA

SEQ ID NO: 159776 - protein, 89 aa, Triticum aestivum
  Clone ID: PAT_TA_54194.pep
EPVHFLSSLSSFLTLYMEMQEPSFSVNCRELIRELQDPKIIQPFSTFQLGSAEYLTVKQNFQIRVRHHQEQEQMHHAHTSRFDMKVQEQ

SEQ ID NO: 159777 - protein, 138 aa, Triticum aestivum
  Clone ID: PAT_TA_54195.pep
YMTTSTTLPISRSIVSSKHHQLLITESRRALKQPLKQSGNKLTLWLISSNRSGNAASVRVMSSLMNVSFRLYGVCRSCVPARQKDPAHLATGVVYRVAGGHRGEPSWWSVATWLLRHQSALWEIIICLINFDLFMFTS

SEQ ID NO: 159778 - protein, 71 aa, Triticum aestivum
  unsure (1)..(71): unsure at all Xaa locations
  Clone ID: PAT_TA_54196.pep
AEPRAQQQPAGVDPPGGLRPHLVPLHHLHLXPRRGRGVRWPLALDPPPLLLMIXCKHGGGHRCKFRHGYLH

SEQ ID NO: 159779 - protein, 72 aa, Triticum aestivum
  Clone ID: PAT_TA_54197.pep
GTTNSYGANMDSSTGRLSPSHWAENQEKVTRQTLSRPVGPFLRCPQANWAGLFFPLPLAGSRCPLMLLGPGS

SEQ ID NO: 159780 - protein, 107 aa, Triticum aestivum
  Clone ID: PAT_TA_54198.pep
PCVPQKKCCFCRQPSLFRVEGVFYATYSNCLCLQDPKLNNNQTHDRQNEVSLFQVAELTTRKAHYMRYSLRARLKTSPRLLQAMVKHMTSTNSTTNLLSVKSSSTPQ

SEQ ID NO: 159781 - protein, 93 aa, Triticum aestivum
  unsure (1)..(93): unsure at all Xaa locations
  Clone ID: PAT_TA_54199.pep
ELGITLLPLKPRATGGNKTKTPGSGGQTGLKAFARFGIKIGRFXDVSPVPTYSPPRKGGKKRKRLLFPARSRMGQNPAFDILCPAPCFGPPRL

SEQ ID NO: 159782 - protein, 116 aa, Triticum aestivum
  unsure (1)..(116): unsure at all Xaa locations
  Clone ID: PAT_TA_54200.pep
TGAPVXTVRKVPAGTNKKASAAAVPAPARKLDEMTEPAGLERVAGXVRAAIQKARVAKGWSQAELAKRISERAQVVQEYESGKAVPVQAVLAKMERALEVKLRGKAVGAPAPAGTK

SEQ ID NO: 159783 - protein, 144 aa, Triticum aestivum
  Clone ID: PAT_TA_54201.pep
SQLQGVSLRIQTLKSTQAMGEAMKGVTKAMSQMNRQMNLPALQKIMRDFEMQNEKMEMVSEVMGDAIDDALEGDEEEEETEELVSQVLDEIGIDINSELVKAPATAVAMPVAAGKAPVQAEAAGGMDGGIDDDLQARLDNLRKM

SEQ ID NO: 159784 - protein, 62 aa, Triticum aestivum
  Clone ID: PAT_TA_54202.pep
EFLEVKNSRIEAGMPADEARLTGSTKTGRKMILLDLFCHVLSKCLLDGDSFSHLHLGLLAMY

SEQ ID NO: 159785 - protein, 86 aa, Triticum aestivum
  Clone ID: PAT_TA_54203.pep
QETRESFILWKNPTLVFKLLFLRMLKSFYKNFKPPVTLSTILTGPKITITLLELRANCVFPHQWEWEVGKKKFCSPLKKSIFFLLF

SEQ ID NO: 159786 - protein, 54 aa, Triticum aestivum
  Clone ID: PAT_TA_54204.pep
RPMFTSPIKLIDTHLMYPVYCLAQPITVHASPTRAHALPLICCIVSLVFCSSSS

SEQ ID NO: 159787 - protein, 88 aa, Triticum aestivum
  unsure (1)..(88): unsure at all Xaa locations
  Clone ID: PAT_TA_54205.pep
KGKELNQHEPATKTDDTNGLEDIHNFKKCFLKMFARHDKIVVFMETVISSVKQQRHGMIECIPVPCKVXNKVPMYFKKAIDEAEDETS

SEQ ID NO: 159788 - protein, 255 aa, Triticum aestivum
  Clone ID: PAT_TA_54206.pep
RTHEDAVAATLRAGLDLDCGPFLAVYTEGAVAQRKVSDADIDAAVTNTVIVQMRLGMYDGDLATQPFGHLGPQHVCTPAHQELALEAARQSVVLLKNDGAALPLSRAAHHTVAVVGPHSQATVAMIGNYAGQPCRYTTPLQGIGRYVKTTLHQAGCTDVACQGGNQPIAAAVDAARRADATVVVVGLDQKVEAEGLDRTSLLLPGRQAELVSAVAKASKGAVILVLMSGGPVDIAFAQNDRKIAGILWAGYPGQA

SEQ ID NO: 159789 - protein, 151 aa, Triticum aestivum
  Clone ID: PAT_TA_54207.pep
QRQRMAPRTPQWLFRGNAVFPAEGGTHARPRAPGSASTGATNGQRLDRRLCPARQSGQNEKEQRLWISIDSRIEGLNNERQWIPIDSLMKKEKASPAAPASMHLAHTRLSSDASRCLPASNAGHDCVALTSQRGGAARTSTKRQRPPAHQP

SEQ ID NO: 159790 - protein, 79 aa, Triticum aestivum
  Clone ID: PAT_TA_54208.pep
ASVLVAAIYSPDMGLLTRQTYVDRHTGQGASVRSVDRVAVDAGADLVGEGDVALGGERHADWTEVSYAARLACEWMSVV

SEQ ID NO: 159791 - protein, 221 aa, Triticum aestivum
  Clone ID: PAT_TA_54209.pep
MESKSQEVKELARFHSNRHADKHPRSEPYQEGATLSEPNANIRLRFLDGLKTPIYTDKIIASESNAAIRIGVFDGDKMINEGPLSKAKVEILVLRGDFCSDGQESWTEEEFNSHIAQGRHRQGSVLGGDCSAWLNNGEASLGKICFREGSSRTPSRKFIVGGRVCTNRKIGGIRVQEAVMEPVTVLDRRNEANEKKHPPRLDDEVYRLEEISKDGIYHRRA

SEQ ID NO: 159792 - protein, 246 aa, Triticum aestivum
  unsure (1)..(246): unsure at all Xaa locations
  Clone ID: PAT_TA_54210.pep
LPQPSPSYARTHAPVAFINPFAAQAIGFVALASVVARRGGAAAATVRGMSFGGASSVAAGGKRPFEYGRTHVVRPKGAHKATIVWLHGLGDNGASWSQLLETLPLPNIKWICPTAPTRPVAIFGGFPSTAWFDVADLSEDSPDDVEGLDSSAAHVANLLSTEPADIKLGVGGFSMGAATAXYSGTCFAHGKYGNGNPYPVNLSVAVGLSGWLPCARSLKNXIESSQEAAQKASSLPLXACHGKADD

SEQ ID NO: 159793 - protein, 67 aa, Triticum aestivum
  unsure (1)..(67): unsure at all Xaa locations
  Clone ID: PAT_TA_54211.pep
HASEKLKASGVEHEVXIYPGCSHAFMNASPEALKRRKGMGLTDENQGAIDLAWSRFSTWMGRFLGSA

SEQ ID NO: 159794 - protein, 222 aa, Triticum aestivum
  Clone ID: PAT_TA_54212.pep
DFQRQSVEKREKTRRTVDPLDMSPASSFASLCLRRLIHIHCTTRLGCDNPPATAAAHFLALDRRRSFASSGLRRGIRETGSSGGGAGGRGRPAAGFSTWARLAIGSTVAIAAPFLHSKSASILRIGNEVEMVKDAAETAAEVVEEVATAAERVSSEVAGHLLEDGRLRRAAVAVEHASKEVAEEAHLARDIILKVDEIEEDVKTIIEPIMDHGKHERKHLQK

SEQ ID NO: 159795 - protein, 197 aa, Triticum aestivum
  Clone ID: PAT_TA_54213.pep
PRVRPRVRPRVRPRVRQTYTFYFVKVRSFEDPKLRAKLEQAEKDFQNKIQARAKIIDAIKAKKTERAAVLAELRPLSAENRQYNEAFNEKLEEMKPYRNRLGKFHDENNAMRAESAGLCSSLEELEHEIKRLNHRISHESISLDEEKRVIKEIKTLEKTRPKVSCNAAKRAKMQDTGGERDAIQDQGKLMRGGVHGV

SEQ ID NO: 159796 - protein, 76 aa, Triticum aestivum
  Clone ID: PAT_TA_54214.pep
NLMLFLCWPPLSPILYLFFRPGVFGTYCTLPLPWWNCRFFFGLPLGFWDPGVLFAMIPCFWVPVRVLTNNPLFVRS

SEQ ID NO: 159797 - protein, 38 aa, Triticum aestivum
  Clone ID: PAT_TA_54215.pep
INSVLLPKKSPPPPEKKANFPKKKTSPKSPKKKVPPKE

SEQ ID NO: 159798 - protein, 48 aa, Triticum aestivum
  Clone ID: PAT_TA_54216.pep
SGVTVHHMFLTNIYMLHVLKFLGSMWVLVIFRSDPKLEGQACHLAWSL

SEQ ID NO: 159799 - protein, 189 aa, Triticum aestivum
  Clone ID: PAT_TA_54217.pep
MGAEEDAAARRERLKALRAAKELLSTPDGAAPAPGPAPDADQQNGEHGATEEQVDQPALPGGPVDAPEDASKENVSPTKESNEVEDNGEVPLKFRNYLPHDERLRGGKVAPLSLPKFEDPIAADAAEPKQLENPFGNIAPKNPNWDLKRDVQKRIDKLEKRTQKALAEIALEQQKEKEALEEGSDAAQE

SEQ ID NO: 159800 - protein, 136 aa, Triticum aestivum
  Clone ID: PAT_TA_54218.pep
PQLIKETHLDLIRIPWALLKHRIEVDYLAWFSSYLVWSPRPLPSFLATHPSPTLTLVRGPRMRQRWSGELLQQPALASVQHVHQRRSGGGGPRSRWCGGGAPRSHRYSGWHPCRKLAPAASRCSHSPSPPHLLQPP

SEQ ID NO: 159801 - protein, 248 aa, Triticum aestivum
  unsure (1)..(248): unsure at all Xaa locations
  Clone ID: PAT_TA_54219.pep
QKCVVYPIRCELLDLSQILLPFGGSTGTLSCKYLGLPLSFSKPKRVDEQVLIDRIASKLSPWKGKQMTKIARLVLTNSVLMAIVTYFLTSLTLSSWAIKKIDKIRRDFFWTAEEEASGGKCMVNWRRICSPKEFGGLGIKNLECFGRALRLQWLWFKWDDNDMPWKGYATPCAGSDFALFDACTKISVGDGAKTLFWKDNWLNGSAPAKMAPTIFKRSRCXSISIKEGVQEGKMMRGLSRLNSEEDYS

SEQ ID NO: 159802 - protein, 63 aa, Triticum aestivum
  Clone ID: PAT_TA_54220.pep
QIKNHTLDGDDQHNIHLNSFPHESSTRCAHQMKGLALGQNKIKRPRQEDHQRTSCSRQMFHRA

SEQ ID NO: 159803 - protein, 218 aa, Triticum aestivum
  unsure (1)..(218): unsure at all Xaa locations
  Clone ID: PAT_TA_54221.pep
MSVVTKNPFAYLGNDSDGEEKPVVPVKTVDKNTARTTKRNVEPQAPVKAAGAGGNRRGPGGNEGAFQDRATGSRRNQGRSTEETPRDGPRGGAGARVRGGRGARRAHERDDRHTSKFGGHGGSDKQAAQSWGANEGQAELKDEQAGEAIAKDEQKDAAAEEAAAAEAAAEEEAEKQVSYEEYLTQXAEKKAALESGLKVREANEGSKLDKXWANAKPL

SEQ ID NO: 159804 - protein, 223 aa, Triticum aestivum
  unsure (1)..(223): unsure at all Xaa locations
  Clone ID: PAT_TA_54222.pep
MDRLPESTRSMRKYASEAGGLRAARQGPHGRSLTARTAHSMSTTALRTKSKSAASLLRRVPFAPLRPVLANLQEVFLGTKLAVLFPAVPLAIAAQCAHFGQVWVFTLSLLGLIPLAERVSFLTEQIAIYTGPTVGGLLNATCGNATELIIALFALMGGQIEVVKCSLLGSVLSNLLLVLGTSLFCGGVVNLGSDQPYDRTQADVSTGLLXPRVLCQSLPLMLR

SEQ ID NO: 159805 - protein, 236 aa, Triticum aestivum
  unsure (1)..(236): unsure at all Xaa locations
  Clone ID: PAT_TA_54223.pep
HASALSRSAGVEPSLAVFRHFFALCPFPPHGFYTLRGKDANGLLFARIRAKFVKGWKEDFFFLESSAPWPCPVEWGEPSRSSTFDPSLTVQEKAVAESLLRARGSSPIDLFAYLHHRNMAAANITGVSSPPPPTRQAAPVHVAMEEALAAGASAGKVKVKVKSEPGCEVPPCAPSPGKKRKLPEDRPDGGSSASYPSCPPGFSAXSKSPPTTSKDGDWKAARRLLQGTVTPSRERE

SEQ ID NO: 159806 - protein, 145 aa, Triticum aestivum
  Clone ID: PAT_TA_54224.pep
DQRTAGDLESPCNNTQEDYRPASPGTQALLCDEQGTAFGSDYRTSFPSAFHDQDTPELSALQEKTVLTGFRDYLRLLITRGKINANNSAGLTEANTSSEHAMELDARRNHGATTGPGVSSFPSEAVERPKAPGDPENPRTSDPSA

SEQ ID NO: 159807 - protein, 212 aa, Triticum aestivum
  Clone ID: PAT_TA_54225.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACISSRPGQCGRADGYILEGKELEFYM

SEQ ID NO: 159808 - protein, 66 aa, Triticum aestivum
  Clone ID: PAT_TA_54226.pep
AGELFISFDQVHKNYGNMINKKAFQYKWHRHACGTFHNLFSVSTCQLAIQYSYPPTYSSLHSNKNS

SEQ ID NO: 159809 - protein, 59 aa, Triticum aestivum
  Clone ID: PAT_TA_54227.pep
SLDAPSWLSVRFLKPVIRRPQFLGAHPNRTDRCFCGKLTPPQTGSICVKKQNTLIKNFR

SEQ ID NO: 159810 - protein, 55 aa, Triticum aestivum
  unsure (1)..(55): unsure at all Xaa locations
  Clone ID: PAT_TA_54228.pep
CGKSSRRRRXXLFFXXFFFYYYFFFXFFXFFIFFFXFFFFFFFFLEGPPRGIKTL

SEQ ID NO: 159811 - protein, 69 aa, Triticum aestivum
  Clone ID: PAT_TA_54229.pep
TPAPPGPRETAPPPPVPSRSPRSRPPPTPSPTPTPAPDPTFFDDAGGGGANRYGVGPRRRGPGLAGRCR

SEQ ID NO: 159812 - protein, 142 aa, Triticum aestivum
  unsure (1)..(142): unsure at all Xaa locations
  Clone ID: PAT_TA_54230.pep
RCASPSSSSRSSPSPRSRGGPTPPRASGQGTREADVIVALPGQPPAVQLRQYSGYIHVNRAAGKSLFYYFVEAPVDPAHKPLVLWLNGRPGCSSFGIGAFXEVGPFRVDTEGRTLCPNPYSWTAGRNLLXLESPVGVGFCYR

SEQ ID NO: 159813 - protein, 131 aa, Triticum aestivum
  Clone ID: PAT_TA_54231.pep
IRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 159814 - protein, 170 aa, Triticum aestivum
  unsure (1)..(170): unsure at all Xaa locations
  Clone ID: PAT_TA_54232.pep
MLVYQXKLSGDELLSXDTFPYRELENGVLWEVDGHWVVQGAGDVDIGANPSAEGGGDDEGVDDQAVKVVDIVDTLRFEEQPAFDKKQFISHMKRYIKNLSAKLEGDDLNALKKNVECVTKYLLTKLKDLKFFVGESMHDDGGMVFVYYKEGAADPTFLRFAHGLKEGKYY

SEQ ID NO: 159815 - protein, 185 aa, Triticum aestivum
  unsure (1)..(185): unsure at all Xaa locations
  Clone ID: PAT_TA_54233.pep
MVGAGEGVRAGGSGAGVGGGQPFVDRSKVRILLCDSDPDSSQDVLRLLCNCSYQVTCAKSPRQVINVLNCEGAEIDIILAEVDLPVSKCFKLLKYIGRNKELRHIPIIMMSNRDEVSVGVKCLRLVAAEYLVKPAXHXNSLLNLWTHVLRRKQMLCFGPEKLLDXMLRLVRVEPSDANANSTPLL

SEQ ID NO: 159816 - protein, 156 aa, Triticum aestivum
  unsure (1)..(156): unsure at all Xaa locations
  Clone ID: PAT_TA_54234.pep
PMPLHRFNAGAEKSGADQSGYLSRTTAPANPTYHPLVHALLHXLSTGLRYAMMGKSDDGSWWFLVPTGVHEVVRIMGPPMLSASLGPSASTTPSTATVMEKVVLSLGNEKLQQSPLLAEAVQQGRILGQMLPLIEQSRHDRGSGAXLTAAQRARQT

SEQ ID NO: 159817 - protein, 199 aa, Triticum aestivum
  unsure (1)..(199): unsure at all Xaa locations
  Clone ID: PAT_TA_54235.pep
RGFTKDHVKAIIMDTFVGGIDTSSVTILWAMSELIRNPRVMKKAQEEIRAAVGEQRARVQPDDLPKLNYLKMVLKETLRLYPPATLLLPRETMRHVRIGGYDVPAGTRVAVNAWALGRDPASWGEDADEFNPDRFEAGAKHGEVDLHGAHFELXPFGAGRRXICPGMAMALMNVEFALANLLCGFDWALPEGTKAEDPV

SEQ ID NO: 159818 - protein, 233 aa, Triticum aestivum
  unsure (1)..(233): unsure at all Xaa locations
  Clone ID: PAT_TA_54236.pep
KFFRNSVNVWYQFVPQLIFLNSLFGYLSMLIIIKWCTGSKADLYHVMIYMFLSPTDDMGENQLFPGQKTLQQVLLLLALVSVPWMLIPKPFFLKWEHERRHQGHQYAMLEGADESVVAELGEHNEESNHHEEFEFSEIFVHQLIHTIEFVLGAVSNTASYLRLWALSLAHSEFATVFYDKVLLLDAGYNNIFILAIGVVVFIXATVGVLLVLENLSAFFHXLRLHWVEFQTSL

SEQ ID NO: 159819 - protein, 135 aa, Triticum aestivum
  unsure (1)..(135): unsure at all Xaa locations
  Clone ID: PAT_TA_54237.pep
GNSPVCDPTASQHDLADXALSSRMAPVLCVRGXXSPKGAWTMLRGFAGSSSHALQGTPFKKMDHIESNLNELMNSLSPGGPVYAASILGDTNGGSGDMFVPRLCHMIHYIGEIQPERRWCRWQRLRPWWGPPTKT

SEQ ID NO: 159820 - protein, 183 aa, Triticum aestivum
  unsure (1)..(183): unsure at all Xaa locations
  Clone ID: PAT_TA_54238.pep
XTFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPXGGSFDPLGLARDPEAFAELKVKEIKNXGRLAMVLHGSAFFVQAHRHRAEAPRGTLAGPTFARPPVNNNRRGPFRPPNFRP

SEQ ID NO: 159821 - protein, 194 aa, Triticum aestivum
  Clone ID: PAT_TA_54239.pep
STYLLPSCKNSPTKDSCGGMYKKVKIGTQKHTLGSRKKTQTFGALTFLFSFDTNHYGRLLVAKFCRMLEHLLMFIHKRFQIVLVFSFTILSEITVYMGASVLGIRVTLSFSLAQHRWIYVYTGKVISRSADQQGSRSHFPTATVAMSEGRSPPATLTSGFRQLYFFEHKHSEVHLSKISNNFNNSQHPNLNAPT

SEQ ID NO: 159822 - protein, 123 aa, Triticum aestivum
  unsure (1)..(123): unsure at all Xaa locations
  Clone ID: PAT_TA_54240.pep
KRGDGKNPGVPKLNRFEKNPLFPSWVNNKKAPPNPLSKNLPTLNGKWNPPFTGHXTPGGGGVTPRGTVTFARPLAPVLFVFFLSFFPTFAGFPRKVLNGGLLLGSQLRVLRPLPPKNFDWGDG

SEQ ID NO: 159823 - protein, 159 aa, Triticum aestivum
  unsure (1)..(159): unsure at all Xaa locations
  Clone ID: PAT_TA_54241.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDXQWICYVAYPLDLFEEGSVTNMFTSIGGNVFGFKALRALRLEDLRIPPTYSETFQGPPHGIQXER

SEQ ID NO: 159824 - protein, 98 aa, Triticum aestivum
  Clone ID: PAT_TA_54242.pep
LLCYVVIICATHKVWYKCAFIVQQAGISAIFCCLSSWDSLRICCICFRHLGIAQICCIRFSKLGGETFTNWWQVPFWFATLFCCLLGNALISLCLLMP

SEQ ID NO: 159825 - protein, 222 aa, Triticum aestivum
  unsure (1)..(222): unsure at all Xaa locations
  Clone ID: PAT_TA_54243.pep
DIACFRLGGVHVVPITCAKIAREVLKKQDKNFSSRALTFASGAISSGYKDAVLSPFGDQWMKMRKVLTSEIICPSRHKWLHDKRADEADNLTRYIYNLTVGGMSSSTSGLANVNVRHVARDYCGNVIRRLVFGQRYFGEPQPDRGPGPMEVEHMDASFALLRFNFAFCISDYLPXVYLALDLDGHEKIIKEADKKVDRLHDVPIEERXXRQXNSGEGQDGVQ

SEQ ID NO: 159826 - protein, 113 aa, Triticum aestivum
  unsure (1)..(113): unsure at all Xaa locations
  Clone ID: PAT_TA_54244.pep
MSENPEGRRAKRINKVYITLAMXDAKDANVNLKPDGAFFFFGTDVTDGNYYESKLDVNDKRDVVAKQVRVDVRSIFSILEKTNAKWWNKLVREDQKAPHYENVHWDKCVYEGS

SEQ ID NO: 159827 - protein, 83 aa, Triticum aestivum
  unsure (1)..(83): unsure at all Xaa locations
  Clone ID: PAT_TA_54245.pep
KPEQSLFAAYNSKDDPAKEAANFTAQVIIMNHPGQISNGYAAGLYXTPSYIAVKFDEIHTXIGRQNEKEREAVHKFLKNKNVG

SEQ ID NO: 159828 - protein, 93 aa, Triticum aestivum
  unsure (1)..(93): unsure at all Xaa locations
  Clone ID: PAT_TA_54246.pep
GFLNGWYYDGTNNTLVTATXCLPSIDRLRASAHVEKEKFCHHVLQVYWVRKHVFVRVWHSERVGILLYVLVSQILLWALLAGLLHRAGVYWKL

SEQ ID NO: 159829 - protein, 44 aa, Triticum aestivum
  unsure (1)..(44): unsure at all Xaa locations
  Clone ID: PAT_TA_54247.pep
MMXXRNTSVVGLKPAAAVPQSAWXVTAKRVQVSPSKDRRAVLLG

SEQ ID NO: 159830 - protein, 223 aa, Triticum aestivum
  Clone ID: PAT_TA_54248.pep
MEADYYKVLGVGRGATDDELKKAYRRLVMKYHPDKNPSPQADTLFKQVSVAYDVLSDPDKRAIYDQYGEEGIKAGVAPPSPSAAHAHAHAHGFGGGSGPGFRFHPRSADEIFQEMFGGSFFGQGPRGPWSGGSAPQSVPGCAASVAAAAAGFSPGSGEASGGSARKGAAIERQLACSLEDLHKGATKKMKIFRDVLDSVGKPMSVEEILTIDIKPGWEEGTKI

SEQ ID NO: 159831 - protein, 155 aa, Triticum aestivum
  Clone ID: PAT_TA_54249.pep
ANSQPRRRSHHRHGRPLAPLGAPVDVAAARAGLEATLVRHPRFCSVQVSDDVKKNAKPRWVRTTVNLDDHVIFPDLDPAATSADPDRALEDYVSSLSTRPMDHSRPLWEFHVIDFPTSEAAGAVAIRMHHSLGEGVSLISLLTGCTRSAVDPIRL

SEQ ID NO: 159832 - protein, 147 aa, Triticum aestivum
  unsure (1)..(147): unsure at all Xaa locations
  Clone ID: PAT_TA_54250.pep
MPPKKAAASKANVANKHKVVXEDKTFGLKNKNKSXSNASKCEQSVDQAVQSKPRPANTAAKNKKGQEKAREKELNHLXKVVARHPKVPGGEGPKTTLCELLKVGQCHKGYKCKVSHDLHVPKEGKGTFISTMSCAMYRKKDTGWLAP

SEQ ID NO: 159833 - protein, 180 aa, Triticum aestivum
  unsure (1)..(180): unsure at all Xaa locations
  Clone ID: PAT_TA_54251.pep
PTRPPSRRIEDAYVALQTWKRHAIFSDPRNLTADWAGPDVCNYTGVFCAPLPSDPRVLAVAGVDLNHGDIAGYLPPELGLLADLALLHLNSNRFCGMRPGTLRRLGLLHELDLSNNRFVGAFPEVVLDMPALRFLDLRVNEXRGPPCASAPFSTAPLDHLSLNHSPLLGFGDFRDKRCGN

SEQ ID NO: 159834 - protein, 205 aa, Triticum aestivum
  Clone ID: PAT_TA_54252.pep
MSAVSWSIPAIPRAVPPARSGPPGEAFLVAARPRAARSRAAPRRVRLARGGVVVAHAGAAEVPVADSGEAAVVFSEKFPLRRCQTVEGKAWVRVEAEPDADGKCKIVIGCDVEGKWLLHWGVSYHGETGSEWDQPPSEIRPPGSVPIKDSAIETPLETSPNSEGHILHEVQIKFDKDTPVAAINCVLRKEEQVHGFNIRGISEYP

SEQ ID NO: 159835 - protein, 104 aa, Triticum aestivum
  Clone ID: PAT_TA_54253.pep
PHVIILSNYSICQLFFSHLPGVFQELSFRFFSPEANVPEEFFVLRFQLLIPVLRSSVHYSAHDLFVLLHLIPSSICVLPILPVIISLLSVISEFLWGFFQILFP

SEQ ID NO: 159836 - protein, 251 aa, Triticum aestivum
  unsure (1)..(251): unsure at all Xaa locations
  Clone ID: PAT_TA_54254.pep
GGAAFADVPGGALWEEVLHWAVSNHGLAPASWTDYLRLTVGGTLSNGGVSGQSFRYGPQVSNVAELEVVTGEGECRVCSPSAHADLFFAVLGGLGQFGVITRARIPLSPAPQTVKWARVVYASFAEYAADAEWLVTRPAESAFDYVEGFAFVRSDDPVNGWPSVPIPAGARFDPSLLPAGEPGPLLYCLEVALYQHQHKQPDDVDERMGEMMRRLKYVRGLEYAADVGYVEFLSRVNPVEEEGAPDGXWAA

SEQ ID NO: 159837 - protein, 160 aa, Triticum aestivum
  Clone ID: PAT_TA_54255.pep
MAFTDSWTHEIESPVAASRLFRAGVMDWHTLAPKLAPHIVASAHPVEGEGGIGSVRQFNFTSAMPFSLMKERLEFIDADKCECKSTLIEGGGIGTAIETATSHIKVEAAANGGSVVKVESTYKLLPGVEVNDEITKAKESVTAIFKAAEAYLVANPDAYN

SEQ ID NO: 159838 - protein, 97 aa, Triticum aestivum
  Clone ID: PAT_TA_54256.pep
ACAFWHHQSHNGYSLEPFAVLHHHVFPITAALAYSVRLRARIASSLVLFRLRASCPCCQRHSVLFPVSGTMSEGIPSSRGVFSSGLLPFAVTSWHTS

SEQ ID NO: 159839 - protein, 199 aa, Triticum aestivum
  unsure (1)..(199): unsure at all Xaa locations
  Clone ID: PAT_TA_54257.pep
MAPTVMASSATSVAPFQGLKSTAGLPVSRRSNGASLGSVSNGGRIRCMQVWPIXGIKKFETLSYLPPLSTEALLKQVDYLIRSKWVPCPSSSAKGXXCXSFFVERPTAIAPGVTLRWAPGIGSXCWXKLPLCVXVAPDGHXQVINEVEGARRXPDAYVRXIIGFDXMRQVQCGDVHRLKPPGCEESGKAYNGSLTTRHI

SEQ ID NO: 159840 - protein, 35 aa, Triticum aestivum
  Clone ID: PAT_TA_54258.pep
RVGYKDEHKILVHLLVSALCVFLFATSRIKAGRVG

SEQ ID NO: 159841 - protein, 120 aa, Triticum aestivum
  unsure (1)..(120): unsure at all Xaa locations
  Clone ID: PAT_TA_54259.pep
DLLDALDFNQIVIFVKSVGRASELNRLLCECNFPAICIHSGMTQEERLTRYKNFKEGHKRILVATDLXVGRAGRFGTKGLXITFVASASDSDVLNQVQERFEVDIKELPEQIDTSTYMPS

SEQ ID NO: 159842 - protein, 61 aa, Triticum aestivum
  unsure (1)..(61): unsure at all Xaa locations
  Clone ID: PAT_TA_54260.pep
LIGRPVLYSLAVDGEAGVRXVLQMLRDEXELTMALTGCASLRDITRAHVVADGDRDPPARL

SEQ ID NO: 159843 - protein, 132 aa, Triticum aestivum
  unsure (1)..(132): unsure at all Xaa locations
  Clone ID: PAT_TA_54261.pep
MLVYQDKLSGDELLSDSFPYRELENGVLWEVDGHWVVQGAVDVDIGANPSAEGGGDDEGVDDQAVKVVDIVDTFRLQEQPAFDEKQFIFHMKRYIKNLSAKLEGGDLDVFKKNVEXCHKDSFLASSRDLQFL

SEQ ID NO: 159844 - protein, 227 aa, Triticum aestivum
  unsure (1)..(227): unsure at all Xaa locations
  Clone ID: PAT_TA_54262.pep
KNLPRHLCQILNSAELLHLLISKMSIEERKISLINRTTSLNPNAVEFVPSCLRSVSDASNRSDTTKIPVSESSKEISTDQPESVPSNPDEEAHRYWQQQLPDDITPDFNVLGQDETPGPDSLSLTGLSMNDGFGASLFSPNQTSRMQHHASPFVRDTLSTRAKFEFPGQEQPQATIMSPTASTMSPTAAPWVKTVRNGGQYGTXRKDASHYDGDSSIGSPLQSDAYY

SEQ ID NO: 159845 - protein, 167 aa, Triticum aestivum
  unsure (1)..(167): unsure at all Xaa locations
  Clone ID: PAT_TA_54263.pep
PTRPPTRPGDGVWRTYLTLDTDQLLDPRREPKSVLANNKIYIASAQSDIVVFDLIASSISMFQLPQGVEYGDTDTMLAQAQDASGVYLIHAKKLQLHIWLHKGDNWLLVDTICLREMVANMWIPGYRVEDDSYAPLRIKHVGDHAEFMFLEMGRCALXLDVKCMQLR

SEQ ID NO: 159846 - protein, 136 aa, Triticum aestivum
  Clone ID: PAT_TA_54264.pep
PPWMLPPYFLFNVDIYNYHPRELLAAYPPATAADGTSALYFVNLVRPKTATDSRKKRAVPGGTWQSERCPQTLVCEAMQGAPQTFSLTVSGREGRGNAAGLHFAGAYRCRGRRQARRGCRHGRIADIHEPPRRQAQ

SEQ ID NO: 159847 - protein, 174 aa, Triticum aestivum
  unsure (1)..(174): unsure at all Xaa locations
  Clone ID: PAT_TA_54265.pep
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRGIGXDNLRQVQXVSFIGFXPPGGEESAQA

SEQ ID NO: 159848 - protein, 160 aa, Triticum aestivum
  Clone ID: PAT_TA_54266.pep
MAMAPPRLLRGLIAPMSPADWLPCHLQLLASSASLLHRWWLPSLARLRCPSCSDGFKLFLVLLLFSAALAEVRFVASASMAPTLRPGDRAVAKKVTYMFRKPSAGDVVFFRVPAALQNCGINKDVGFIKRGWCHPWRFHRSDKGSLLLMGLRKMDIYTAP

SEQ ID NO: 159849 - protein, 30 aa, Triticum aestivum
  unsure (1)..(30): unsure at all Xaa locations
  Clone ID: PAT_TA_54267.pep
YNCPSHSYNIKCPVHIYTLPIAXTPHACFL

SEQ ID NO: 159850 - protein, 160 aa, Triticum aestivum
  Clone ID: PAT_TA_54268.pep
PRVRSPLAVKSGLARDELLLPQAAAVAVVVAVLAATAGANSFVSAPPLPTVFLFSPPCVLWIAAQVIVVSLWLLCHRGTAVAAGLSSTASDVSAAMGGMLFPSSEHDVFAAAPDAVVAPPAPVSTSRPREARTAKRPFDRPRVRKKLARRGHGHCGRRRG

SEQ ID NO: 159851 - protein, 47 aa, Triticum aestivum
  Clone ID: PAT_TA_54269.pep
GGLKPPSSCRWGSCGVIAFLFKAPLLYKGCGKGKFSPPLSGAPRCFI

SEQ ID NO: 159852 - protein, 66 aa, Triticum aestivum
  unsure (1)..(66): unsure at all Xaa locations
  Clone ID: PAT_TA_54270.pep
PGRVYKGKKMPGRMGATETKISXINIVRFDNDLKVVMIKGAVPAEAGXNLLRITDAKIVRKNIPKS

SEQ ID NO: 159853 - protein, 91 aa, Triticum aestivum
  unsure (1)..(91): unsure at all Xaa locations
  Clone ID: PAT_TA_54271.pep
MGTLEEADLRGISVRALRPHAPVDDSPKITVDTRXRASMPTIKYXLGKGANVILSSHEAAAKRLIPNASLKPLSPPLSELLGLEAEMHPYC

SEQ ID NO: 159854 - protein, 196 aa, Triticum aestivum
  unsure (1)..(196): unsure at all Xaa locations
  Clone ID: PAT_TA_54272.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREXNASPGYYDGRYWTMWKLPMFGCTDATQVINEXWERSRKEYPDRLCPASFGFDNMRQGAVRQLHSPSSHRAAKSPARPKQLTHDRPYIKVPLRVLS

SEQ ID NO: 159855 - protein, 120 aa, Triticum aestivum
  Clone ID: PAT_TA_54273.pep
RRGRPSSPRWVLRRPRPAPRCGAGPRGGPPRARPSNGDDHQPLPRIHHVSSAVQADALEVLLCTQVEGPGRRGGAAHEVEASHARVYCTELRGSGLISFMVRGLGQVCPATLCEHFPTSS

SEQ ID NO: 159856 - protein, 104 aa, Triticum aestivum
  unsure (1)..(104): unsure at all Xaa locations
  Clone ID: PAT_TA_54274.pep
TDRVWNVTKRSIGVXVSKQVGNRIIKERIHVGVEHVQPSRCKKKFLLRKIPNPKLKEEAKARDEVISTNSHPAGANPGFMVQDTSIETVTPIPFDVVNDIKGGF

SEQ ID NO: 159857 - protein, 112 aa, Triticum aestivum
  unsure (1)..(112): unsure at all Xaa locations
  Clone ID: PAT_TA_54275.pep
EGLQLELTHARNACELXQKGNFELVEQRKAMEKSMISMAQELQQMRAELANFDGRPWGTGGAHGMKLGSPEATFPTQYGDKYNIHVGVSEKGPSHPPESSWGSFEKNRFQYR

SEQ ID NO: 159858 - protein, 65 aa, Triticum aestivum
  Clone ID: PAT_TA_54276.pep
PLPPRAPPPPPPSPPPPPLSTPRPLASYLPLPASPPPFPPPSAPSPPPCFCPPPQSPRLPAPPPL

SEQ ID NO: 159859 - protein, 107 aa, Triticum aestivum
  unsure (1)..(107): unsure at all Xaa locations
  Clone ID: PAT_TA_54277.pep
STXALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 159860 - protein, 92 aa, Triticum aestivum
  Clone ID: PAT_TA_54278.pep
LPPCQQGQTAQIPHLNLRTGTPPSTSGPTKEPWADPGIPDSAPVGLPTLLIMLTLRDRSTNGHICLLQESEILSDSHTTFHPACPNPKTRGA

SEQ ID NO: 159861 - protein, 73 aa, Triticum aestivum
  Clone ID: PAT_TA_54279.pep
KVASEGKLKGFLGFFEEDLVSPNFVGATGSGFFFSKAGIFFNAPFFKFFLWYANEWGSTTRVVALIPPMAKTQ

SEQ ID NO: 159862 - protein, 119 aa, Triticum aestivum
  unsure (1)..(119): unsure at all Xaa locations
  Clone ID: PAT_TA_54280.pep
DGAIXIFNXRLVGLVDQMNTLPGAHFTYINAYNIFNDILANAGAYGFTESTAGCCGVGRNNGEVTCLPYQAPCANRDQHIFWDAFHPSEAANIIVGRRSYRAQSPNDAYPMDISTLASL

SEQ ID NO: 159863 - protein, 84 aa, Triticum aestivum
  Clone ID: PAT_TA_54281.pep
GNLGGDLAKTRRKGPKKPQPKNKGNRLGQDKQGKPNTPPETTNQKNRGPNHTTKPSNIRSKNFQALRKLCNTTTKGLKKRHSRH

SEQ ID NO: 159864 - protein, 86 aa, Triticum aestivum
  Clone ID: PAT_TA_54282.pep
PTQTAATTGRLIHSDSYHGASLGNRKVYKVSVSLSPYVSISKLLARWYFNVRLILGFGYILIAVIRIAPTWLVRMTPTWHGHRPPV

SEQ ID NO: 159865 - protein, 114 aa, Triticum aestivum
  unsure (1)..(114): unsure at all Xaa locations
  Clone ID: PAT_TA_54283.pep
RLLLSYALRMDIASPKAQYPFLEDWLPWGIVVLPMSTDQSYSTALVTGALMLPWGQIPLPLVTCSSLSISSSLRYIHXXPFQRSHRPDASMTTASQTXRITRHDSTAHSIGLSF

SEQ ID NO: 159866 - protein, 45 aa, Triticum aestivum
  Clone ID: PAT_TA_54284.pep
PHPPGKQRSFTPPKFVLPKGGGIPNEKPAGVTNPVRVINPGKGNQ

SEQ ID NO: 159867 - protein, 99 aa, Triticum aestivum
  Clone ID: PAT_TA_54285.pep
GGRYAMASTTSHGRQRNAARGGDMDTVRLFATPRKDTHLEQAKKFEEDPPAPLPSAADDPKEEMASNPLAAISAPIAFYNKVAIQALQEIKKLVAPPPK

SEQ ID NO: 159868 - protein, 90 aa, Triticum aestivum
  unsure (1)..(90): unsure at all Xaa locations
  Clone ID: PAT_TA_54286.pep
KFRSPPIADKAYPTMIKIPSFPFLGDNDFFNPLGDQLIESFVGPFFIRPPKGPPVPRFFFXPSLEVMSRFLAKMEKGIFDLPPVKAGAGV

SEQ ID NO: 159869 - protein, 128 aa, Triticum aestivum
  unsure (1)..(128): unsure at all Xaa locations
  Clone ID: PAT_TA_54287.pep
GIGFPISQGMAFGTGSAMGHRAVYSFMGPRTIXAXTVFGEGSAFMTPKGKAVYYKCGNPFKAFQNWINPFGNDISKGQFFLYIFKEGPRGGATFLSTIFGLLGVNWAEPVFSHDDDEKNFLKKSLAKL

SEQ ID NO: 159870 - protein, 140 aa, Triticum aestivum
  Clone ID: PAT_TA_54288.pep
NLHNRARAVDGVGPVAWDNNVARFAQDWAAQRAGDCRLQHSGGPFGENIFWGSGQSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 159871 - protein, 163 aa, Triticum aestivum
  unsure (1)..(163): unsure at all Xaa locations
  Clone ID: PAT_TA_54289.pep
FNLCGXSSQVPYYDYALDLIXDIESSNGDVFTEEQNELIESSAEMLYGLIHARYILTSKGLAAMLEKFKNYDFGRCPRVYCCGQPCLPAGQSDIPRSSTVKVFCPKCEDLHYPRSKYQGNIDGAYFGTTFPHLFLMTYPHLKPQKPSQQYVPRVFGFKLHKQS

SEQ ID NO: 159872 - protein, 76 aa, Triticum aestivum
  unsure (1)..(76): unsure at all Xaa locations
  Clone ID: PAT_TA_54290.pep
RMPEQGTCERCGYISSQKLCKACVLLDGLNXGLPKLGIGRTAKVGAGADGSGEQQGKRAERRNRSSLQGKHGNLDF

SEQ ID NO: 159873 - protein, 128 aa, Triticum aestivum
  unsure (1)..(128): unsure at all Xaa locations
  Clone ID: PAT_TA_54291.pep
DISLNYATFQPGTTVRDQNNGLTYTSLFDAMVDAVYXALEKAGAPGVKVVISESGWPSAGGFAASADNARTYNQGLINHVGGGTPKKRQALETYIFAMFNENQKTGDATERSFGLFNPDKSPAYNIQF

SEQ ID NO: 159874 - protein, 107 aa, Triticum aestivum
  Clone ID: PAT_TA_54292.pep
STEALLKQVDYLIRSKWVPCLEFSKVGFIFREHNAFPGYYHGRYWTMWKLPMFGCPDPTQVINEVEEVKKEYPYAYVRIIGFDNMRQVQWVSFIAFKPPGFEESGKA

SEQ ID NO: 159875 - protein, 96 aa, Triticum aestivum
  unsure (1)..(96): unsure at all Xaa locations
  Clone ID: PAT_TA_54293.pep
RAKRGGGITKPNPPGPGAKVIPGLTPHQPGTQGAGKPANPRGFPGAKPLGPPWAXRPPQPPVRPPAGPPPGGXGGKPPRPSPSPSLGPPKSQRVPF

SEQ ID NO: 159876 - protein, 86 aa, Triticum aestivum
  Clone ID: PAT_TA_54294.pep
MASGWGINGNKGRCYDFWLEFSECMSRCRQPSEWGLLREDYLECLPHSKEFQRRNRIYKEEQRQIRAAARKAKEEAEGAPAVAAPH

SEQ ID NO: 159877 - protein, 77 aa, Triticum aestivum
  Clone ID: PAT_TA_54295.pep
FQAVLVMGILSQANPEFPKCCANCRFFSGAVVCENPGPKSPDGWVKSRVVQTSPPKTFRCANARGEEGTPCPPCKKN

SEQ ID NO: 159878 - protein, 107 aa, Triticum aestivum
  Clone ID: PAT_TA_54296.pep
YGFPNLKNVKELISKKGRGYFDKEPFPLASNDLIEKAFGEPGVICLENVVHEISPVGPPFKKTGSFFMPFKLKCPERRLQIKKKPFKDGGDSGNPGAKINELLKKLN

SEQ ID NO: 159879 - protein, 52 aa, Triticum aestivum
  Clone ID: PAT_TA_54297.pep
NPSKINQVKLKTSRSDQHSTPLQLNCTSFQPSEHTPKTHITSCALRRPRTRG

SEQ ID NO: 159880 - protein, 137 aa, Triticum aestivum
  Clone ID: PAT_TA_54298.pep
RERERERERERDQGLYRGRKERRGRKDVLQVEQQGEGGVLPAGAAVHRAPRRRPLRDGRLPPRLRQAQRARPQPHLLRLPHQLATPSPASAPSACRPTHVHLCMHVCMYSKLCRILLLWYAPEGTDCFCVAAAATIF

SEQ ID NO: 159881 - protein, 129 aa, Triticum aestivum
  unsure (1)..(129): unsure at all Xaa locations
  Clone ID: PAT_TA_54299.pep
RKLLQGSAAPNLQYKLHIHISKLAIKTQAVKKERGKLKEHAATSVQSGRSATAHGYTGNRPAGNLAGLISLGPPEQQVHHLGRLAVAAVVILRAPPQFPPRRXAXTGQVLPLLAVARRRPDSKEPPPPA

SEQ ID NO: 159882 - protein, 107 aa, Triticum aestivum; identical to SEQ ID NO: 159859
  unsure (1)..(107): unsure at all Xaa locations
  Clone ID: PAT_TA_54300.pep

SEQ ID NO: 159883 - protein, 155 aa, Triticum aestivum
  Clone ID: PAT_TA_54301.pep
NTQPQDSGGVYRARPPRLIPHNGGHEYGPAHGRGQEISHPPPQGGGYGSGYGGLTLGGFMENPKQRGLKKKTILFLYTQTLLGGTIAPGAWAKNPPVAGRLVQKNFGNPKEKKGRQGPLEETLPPPGFGAWPGPLFPARLALLPRRRWVPWRGGR

SEQ ID NO: 159884 - protein, 65 aa, Triticum aestivum
  Clone ID: PAT_TA_54302.pep
GGAIWPAVQIANFRFIPVRYQLLYVNLFCLLDSCFLSWIEQQGDAAWKQWFTSFQKKIEDQKSNA

SEQ ID NO: 159885 - protein, 162 aa, Triticum aestivum
  unsure (1)..(162): unsure at all Xaa locations
  Clone ID: PAT_TA_54303.pep
PARGGGRGGGSPAPGPCGGPAPQGQGPPXNRRPKWHPWGPPPPAPVPWCFFPPLGPFGPLGGGGSPRRASKRGVPGPKKSTPPFASPCPPPKFPPPFFGGGAIIMRGGGKNFSPAGFFSFLSSSLNAKGPVGRAWPPPWPVFKVVGLPPPNSGGTPPCFFPF

SEQ ID NO: 159886 - protein, 105 aa, Triticum aestivum
  Clone ID: PAT_TA_54304.pep
LPISVYKTLFECTSYTGFCCMHRNDLDSGHTPHLLLVLSRYRSGENRVWFMHNKPVTRTTTRRCSVQQTNPGALCCSRLKSRHSGWGTYSSGKGPLGYAKMSKPH

SEQ ID NO: 159887 - protein, 64 aa, Triticum aestivum
  Clone ID: PAT_TA_54305.pep
MWGLSLSKFTPNWLPPGGSPPPVHCITAIFACLGRSPTQFCLAPSDFSWLQKQWGGKRVYSFFV

SEQ ID NO: 159888 - protein, 165 aa, Triticum aestivum
  Clone ID: PAT_TA_54306.pep
KQKIPPTFFFGGAKQKKLNGPFYTEKNITHSHDPHKQIKASRGAGGHKPVETNLQKTQISNKTRGFACTKSSLACLFPDALKIILSTFALSLPPLFYLANAQGASKGYTKAHLNLGFTPQSIPGGRGNFNTFSTVLEARFHNILIDTVENRGTADGRYFLGQRDG

SEQ ID NO: 159889 - protein, 126 aa, Triticum aestivum
  unsure (1)..(126): unsure at all Xaa locations
  Clone ID: PAT_TA_54307.pep
DXRRVVELRYEAYGAMARRRLEAILREARAAHALCRLAVAHRLGTVPAGEASVFVATSAVHRADAMEACRYVIDEIKASVPIWKKEVYDDGEVWKENREFLDRTDAEKKGKPAGGGGCCGSKVRVS

SEQ ID NO: 159890 - protein, 148 aa, Triticum aestivum
  Clone ID: PAT_TA_54308.pep
KRVIEKGRGPGLNWGGSLAFHTVHSFQAGPKKGGGGGQKRGAKTGGPTPPPPPNPHPPPPPRGDNPEKKKRPGTPPPPAGGGAKAPQPSGRRGAQKGPPGADGGIGTANRAGVPPPQKKTGGLPPTGAPGPAAPASTPPPPRGGGPGG

SEQ ID NO: 159891 - protein, 224 aa, Triticum aestivum
  Clone ID: PAT_TA_54309.pep
MGCLPSRASNRMASTDAPPANTKALLDGVSGKAREGELFAVMGASGSGKSTLVDALAGRIARDSLRGHVTLNGEPLHGSRLRAISAYVMQDDLLYPMLTVRETLLFAAELRLSRALSPAAKRERVDRLIDQLGLSRAADTIIGDEGHRGVSGGERRRVSIGTDIIHDPILLFLDEPTSGLDSASAFMVVQVLRTIARSGSVVVMTIHQPSARILGILGRLLLLS

SEQ ID NO: 159892 - protein, 82 aa, Triticum aestivum
  Clone ID: PAT_TA_54310.pep
EKSRPTLRVLRNLQLFQWTTGFSKIGQVLNFQPFLGLQNGKHNGQGGLFCPQKNFMPSKFFCRLGLSNNLKLLLGSCPLKTH

SEQ ID NO: 159893 - protein, 211 aa, Triticum aestivum
  Clone ID: PAT_TA_54311.pep
RRLSDDQIIRCFLVVALSTFFCPTSSTKPSTKYMGALVNVEQLKQLNWCMFVHDWELMYIKKYQKEKLKQNRTMMTLGGCIYHLAVCCLDFTDFRSIQIPSLMPRICVWKGDMVKHLSDMTIGRDGKYGCLTIKEVSETCYKDGTFEWASTIKNSNFRKAINNVAGNSLSDKVKEDIFLAYENHMKNEDLNTCIKAKGLLLDTIRIITNLW

SEQ ID NO: 159894 - protein, 75 aa, Triticum aestivum; identical to SEQ ID NO: 106874
  Clone ID: PAT_TA_54312.pep

SEQ ID NO: 159895 - protein, 96 aa, Triticum aestivum
  Clone ID: PAT_TA_54313.pep
GIVLWTAWHPTGCYVMCLTDDNFNNLPVGDTVDKLIAEWKTTSHVGVADADGHYDAELFHGDYQVTVTHPAAAANSTVVQSLSVDRESDNEYTIHV

SEQ ID NO: 159896 - protein, 84 aa, Triticum aestivum
  Clone ID: PAT_TA_54314.pep
SSTDLHQHLVMLFKSWPQQPKLTFACTLSWNKLTGSFSRLFLVSCQFEFSNHTMQAFMYYQKREKPEQKIGRDVIIRVNNTSFS

SEQ ID NO: 159897 - protein, 94 aa, Triticum aestivum
  Clone ID: PAT_TA_54315.pep
YAMLRSSRSVLQGFLSFPSADWVYSPYVAHIRLVVHVQNGVLECVEPANLLIKVTLVVESYCTSRSYKDPRVSSDIKVFIMCPEFHHTIWRLFL

SEQ ID NO: 159898 - protein, 171 aa, Triticum aestivum
  Clone ID: PAT_TA_54316.pep
MDGKEEDVRLRTNKYSERLPIGTEAQGYEDKDYKEPPPAQLLEPGELKSWSFYRAGIVEFMDTFLFLYVTILTVMGYSGATSKSDSVGIQGIGWYFGGKIFDLDYCTGGISSGHINPEVTFGLVMARNLSLTRAVVYIIMQSLSAICGAGVVNAFQDGLYMGKRGSTNVVA

SEQ ID NO: 159899 - protein, 253 aa, Triticum aestivum
  Clone ID: PAT_TA_54317.pep
MVESVAATPSEEQGRGGGLSLPPGLRFHPTDEEIITSYLLRKFLDPSFVSRAVGEVDLNSCEPRDLPGKANMGEKEWYFFVHKDLKYPTGSRANRATKEGYWKATGKDREIFKPRARELVGMKKTLVFYRGRAPRGAKSEWVMHEFRLEGKSRGQTMNNPKDEWVVCKVFNKKGEAKAARAADVDAEYSAVTTPNSSSVVDAGEGAGDFTDSMFTIDPLCYIPNDEYTSNQPAKTTTFTTTNSAAPYNADYYY

SEQ ID NO: 159900 - protein, 232 aa, Triticum aestivum
  unsure (1)..(232): unsure at all Xaa locations
  Clone ID: PAT_TA_54318.pep
ALELSRCLFLMNYHYVHGSPLLESTTPFDSPEFAEKTAEALGRILILDLILRNEDRLRCRPLGWRGNYANLLVAYKEAYANLDSLDDIHDSAIIRYKPEIIKSPKKQKQRRSISISGSVGSDISELLEDSYDQIEPEISSFHIVAIDSGVPRRPPASKRTKDQESYPRLVELTLNNLDYSSNLLFEVSIGKLGTPGPEEYDMSSYYSYHSXLSESDMVAIVNSFPRGFRSAL

SEQ ID NO: 159901 - protein, 191 aa, Triticum aestivum
  unsure (1)..(191): unsure at all Xaa locations
  Clone ID: PAT_TA_54319.pep
MSLFGLGSNSVDGNRNQRTFRPKKNAPSGNKGVQLKKHIDATLGNGNLRDVVRLPPGEDLNEWLAVNTVDFFNQVNILYGTLMEFCTPYTCPTMTAGSKFEYRWADGVQIKKPIEVSAPKYVEYLMDWIEIQLDDESIFPQKLXKIVSLKEEAHLNTCFKHFTLFTCEFKLIDKAELAPLIDLIESIVTVC

SEQ ID NO: 159902 - protein, 199 aa, Triticum aestivum
  unsure (1)..(199): unsure at all Xaa locations
  Clone ID: PAT_TA_54320.pep
PPALPRGATAAASAARRASRGTATPATPRHPPAWPXSGTTSCCAAPPTRPTSPAHGPWPCAASTRTAAAPPASTRASPAXTPPPAAPPPPAGAAAAAPAPPPTPGTAPAWEAASSSRRSSPDYYQIRNPNPGPNHPLLTAISPRPKWDPNASSLPNPIPFAARLRMRLSLASSFDPNLGRGGEGEVGVGEERTGQPTRP

SEQ ID NO: 159903 - protein, 32 aa, Triticum aestivum
  Clone ID: PAT_TA_54321.pep
IPDHLNFSDYLHVHDSSSGGICLQDISLSNIQ

SEQ ID NO: 159904 - protein, 124 aa, Triticum aestivum
  Clone ID: PAT_TA_54322.pep
AAATLHLPTFVLSKASHVDRNASPPRVGHCLLRHLRPPCVKHGAVSAAETSLTRHRAPFDRDASQPCCRLRRRGYSFPRFPAEAAQLLTSSCTTPVPRRGRCLCLLPLKGLGHSTLFICVKPMF

SEQ ID NO: 159905 - protein, 225 aa, Triticum aestivum
  unsure (1)..(225): unsure at all Xaa locations
  Clone ID: PAT_TA_54323.pep
HASGKLXEITMADKAINNMTGEELSRLVSEKHSLSILKIGGCSNLGFLNLSSSSLNVLWLSDLCSLSESVISCPNMSELSLCFTQQSSECTDLVSLMDGLGRSCPNLRNLHISSIQLSNEAVSALEAANLRGLCMLSLILGSKMTDAAVASIVRSCASLELLDLSGSSISDSGVGMICKAFPHTLSRLLLALCPNIXTTCGIQAATAQLPLLQLMDCGMSPTSNL

SEQ ID NO: 159906 - protein, 105 aa, Triticum aestivum
  unsure (1)..(105): unsure at all Xaa locations
  Clone ID: PAT_TA_54324.pep
FGEETRSQQNVYCDSGLRTFFLVXHVLDEKGRENFNEYFSTAXQMLTKMKKHEVADNIECDLLXGATAAEDKLQKKVLECIEKLPQAGIKFCVLTVTKWIAINIG

SEQ ID NO: 159907 - protein, 219 aa, Triticum aestivum
  Clone ID: PAT_TA_54325.pep
MLLDYAHFGDVVTFDTTFGTNKEYRPFGIFLGLNQFRKTTIFGAALMFDERFAVAIARLHGDLQFEEERIVIGDPLTKTVSCSCGMFNRTGILCAHGLKVLDLMNIKTLPAHYVLKRWTREARNGSIQDRQGRNVVENPKMEAELRYKDLSHKFHKMAQKAANSPQCCILLDNALDSVAPHIHDLLNASTSAMNELCKQENVDPVQQVDELLRSARLKK

SEQ ID NO: 159908 - protein, 130 aa, Triticum aestivum
  unsure (1)..(130): unsure at all Xaa locations
  Clone ID: PAT_TA_54326.pep
KEQAHSNKFXMHHGHSWSPSKERSPFQQLWARFPANAAAGCSKKTPWSPWSPWAPSKERIAPAILDAGSSNRRSKSTHPRSGSSKSRCWFQQISTPVPTLTQHNLYPPCSTTAGLLYLMSKLVPAKRVAS

SEQ ID NO: 159909 - protein, 97 aa, Triticum aestivum
  Clone ID: PAT_TA_54327.pep
RCASGRARGCRRGSSRRAPKASSTNFAPLPHQSLGWSFRSNYNIWVLRCIPTDIVQLVSYLILTASGGGPRGPTGIGDHTFVCDPFMYIYSREISTC

SEQ ID NO: 159910 - protein, 34 aa, Triticum aestivum
  unsure (1)..(34): unsure at all Xaa locations
  Clone ID: PAT_TA_54328.pep
CXVKXTHLKYHTSHYSNCNLQLHHAIAIMSYSTP

SEQ ID NO: 159911 - protein, 201 aa, Triticum aestivum
  Clone ID: PAT_TA_54329.pep
VLIYELLDEIMDFGYPQNLSPEILKLYITQEGVRSPFSSKPSDKPVPNATLQVTGAVGWRREGLVYKKNEVFLDIVESVNLLMSSKGSVLRCDVTGKILMKCFLSGMPDLKLGLNDKIGLEKEAQLKSRPSKSGKTIELDDVTFHQCVNLTRFNSEKTVSFVPPDGEFELMKYRITEGVNLPFRVLPTIKELGRTRMEINV

SEQ ID NO: 159912 - protein, 216 aa, Triticum aestivum
  unsure (1)..(216): unsure at all Xaa locations
  Clone ID: PAT_TA_54330.pep
DAWVQGGCRDIDECGDGGISYPCSAPGTCINTPGGFRCACPDKTTGNAYTGTCEAKKSQLGAHIAIGVSISVVVLVISMSCAYLIHERRSLATVKRRYFKQHGGLMLFEEMKSKQGVSFTLFTKEELEEATGRFDERNVIGKGGNGTVYKGTLKDSRTVAIKRCKLINDRQKKEFGKEMLILSQINHXNVVRLYGCCLEVEVPMLVYEFVPTAPCT

SEQ ID NO: 159913 - protein, 45 aa, Triticum aestivum
  Clone ID: PAT_TA_54331.pep
WVGEGSTVWPFQGLKFTVGLPVSRRLSGRLGRVSTGGWMRCVRVW

SEQ ID NO: 159914 - protein, 48 aa, Triticum aestivum
  Clone ID: PAT_TA_54332.pep
ASTIRVAARGLKQKGNNVYCSITYQSISLSFSPFLFNLLTPMSSLNQN

SEQ ID NO: 159915 - protein, 48 aa, Triticum aestivum
  Clone ID: PAT_TA_54333.pep
RKEDTNCWFVCTLFKSTFHSMNILMVMFCAHRMECALEQIAGSSVHCS

SEQ ID NO: 159916 - protein, 201 aa, Triticum aestivum
  unsure (1)..(201): unsure at all Xaa locations
  Clone ID: PAT_TA_54334.pep
QLRRPPAMLHSNTXCVALQLWCRPLCPHCTAALSLTGVLHCSSADGTQHHGRCPASPSPTRNTMAVALQLLRSPPALQLLRSPPTLQLRRRRVAARPLGCSSTAHRRSSPRSRLTAPSPPCRTATAYAAPQHRLCSAGGRDGKKSCFVLLASSVADAVSMFRHRGRKWGYKRESGCWGDKVERAPNDADLFVVAGLMGERA

SEQ ID NO: 159917 - protein, 85 aa, Triticum aestivum
  Clone ID: PAT_TA_54335.pep
AACASVRELDYLSMICSAVAGHQWYGIQLLALAVAIASGVGRPEVRTHGDARKRYNHACRKLRNNEAAGSNFRYSVRGRVGGRVG

SEQ ID NO: 159918 - protein, 85 aa, Triticum aestivum
  Clone ID: PAT_TA_54336.pep
QTPFIGFMQASLRDQTQHGYQLPKVAQDMKRELGWSLERGDHWQHSSAKKGNEQALLKNENNLISSSAVEKEYHMKLQERHKSLP

SEQ ID NO: 159919 - protein, 56 aa, Triticum aestivum
  Clone ID: PAT_TA_54337.pep
FCVGGGDHHRGWCPRVLKLQLCSMLYYKLPNLHSPSQHKQCSSVLQFMKVCHLCWS

SEQ ID NO: 159920 - protein, 74 aa, Triticum aestivum
  unsure (1)..(74): unsure at all Xaa locations
  Clone ID: PAT_TA_54338.pep
MTXIRVWICLFSFSNVYFLFGPEFCRGGKHVSCEHSHVFWNFWKHLDSFFNGCIGHVRVGHMSALDMSVLCKNK

SEQ ID NO: 159921 - protein, 62 aa, Triticum aestivum
  Clone ID: PAT_TA_54339.pep
PPLSLATCPASTLYALCSKFLLKATVRYSFMAALKLYFLMFRVLSFFFHRSGSYLTCVDYML

SEQ ID NO: 159922 - protein, 100 aa, Triticum aestivum
  unsure (1)..(100): unsure at all Xaa locations
  Clone ID: PAT_TA_54340.pep
MASGEAEPLQYTTTVLRVSIHCEGCKKKVKKVLHSIEGVYKVTIDATQHKVTVTGSVAADALVRRLLKSGKHAALWPMPXAPPATEAKKPEEAPVCPGRA

SEQ ID NO: 159923 - protein, 194 aa, Triticum aestivum
  Clone ID: PAT_TA_54341.pep
MAGEGDDVKLLGTVVSPFAVRVRMTLHLKGVSYEDLEQDVFDKGELLLASNPVRKKVPVLILIHDGRPICESLVIVEYVDEVWAGAAPLLPTDPHGRADARFWAAYVDDKVVTAMLGILRATTDVERAERLDAALAAVRPLEDAFAECSGVKAFFAGDSVGYLDLALGCHLFWFEALREMFDVMIIDAGRTPRL

SEQ ID NO: 159924 - protein, 226 aa, Triticum aestivum
  unsure (1)..(226): unsure at all Xaa locations
  Clone ID: PAT_TA_54342.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIXGGKGQGKSFQCELVFAKMGINPIMMSAGELESGNAGEPAKLIRQRYREAADMIKRGKMCCLFINDLDAXCGR

SEQ ID NO: 159925 - protein, 162 aa, Triticum aestivum
  unsure (1)..(162): unsure at all Xaa locations
  Clone ID: PAT_TA_54343.pep
PTRPDGFVEDISTLFTVGQEVSVKLVEVNKETRRISLTMRTGGDYVKEAPTAPSGGRSPTAAAPRSSPRQTKDFKKIDEAKYTRGQSLTGTVKNSTRXGSFVTLPDGEERFLPREEEAAALFTLIGHSALGGGQEVTGKVLNVSRGQVTLTMKGGEDDDHQL

SEQ ID NO: 159926 - protein, 75 aa, Triticum aestivum; identical to SEQ ID NO: 106874
  Clone ID: PAT_TA_54344.pep

SEQ ID NO: 159927 - protein, 188 aa, Triticum aestivum
  Clone ID: PAT_TA_54345.pep
HASAHASAHASGDQLKSSSRIFLAGKKVMQIALGRSPADEAKTGLHKLSKFLQGASGLLFTNLPRDDVERLFREFEVNDFARTGSIATQTVELKEGPLEQFSHEMEPFLRKQGLPVRLNKGVVELVADHVVCEEGKPLSPEAAHTLRVLGTKMATFRLYLVCRWSSDDFEVYKEGLAHLGGEEADESS

SEQ ID NO: 159928 - protein, 53 aa, Triticum aestivum
  Clone ID: PAT_TA_54346.pep
AHGDGKFSRRSPAIVWLRTGRDTLFSESGHTGLFFSIKIRIRCMSSLVEVVIF

SEQ ID NO: 159929 - protein, 44 aa, Triticum aestivum
  Clone ID: PAT_TA_54347.pep
DSAVSSLLKITYGPTKSNVTVTFPFVFQLHPELRRAPSLGLSFP

SEQ ID NO: 159930 - protein, 67 aa, Triticum aestivum
  Clone ID: PAT_TA_54348.pep
TKVLVAYIWSHNIGSSDLDTKRSSQTSPKINNTCASTSAANARSPKKRSKAGNPISGSLGIITSSMM

SEQ ID NO: 159931 - protein, 130 aa, Triticum aestivum
  Clone ID: PAT_TA_54349.pep
MRVKRRSRHRKVVKFYSTCFGFREPYKVLIDGTFVHHLLVHQLLPADDALRELLSVSRAPPLLTSKCVVAELRRLGKSHSEAFDAAQLVATASCQHDKVVSAVDCILSLVGDKNPEHYFVATPDSDLRAK

SEQ ID NO: 159932 - protein, 192 aa, Triticum aestivum
  unsure (1)..(192): unsure at all Xaa locations
  Clone ID: PAT_TA_54350.pep
MSTAEATLEENANMANLLNQAKRYEEMCEMMEKAVKTANVVELTADERILLSVAYKNAIGAPRASCTIISSIEQNEETRANEVYVASIKEYRTTIETELSMICDGILNLMDSHLALSDTATESMVFYLKTNGDYHRYLAEFMAGAKRKETLXNTPVAYKTSHYDALVDLTTTHSIRLGLALNFSVIYYEILN

SEQ ID NO: 159933 - protein, 57 aa, Triticum aestivum
  Clone ID: PAT_TA_54351.pep
THNIHSSDYIWVWLALIYMRNNYSYVASNSYTIGFYLEIDATYDNRFERITYIVLII

SEQ ID NO: 159934 - protein, 170 aa, Triticum aestivum
  Clone ID: PAT_TA_54352.pep
SGRQLTIRNKERKRGRGVVGEGEKKDLQLTHYTTIYFFCDEDSLATHSKHKAELKAEGWKLHSPAQHNHESVLVSFLQPQTSLSSRENKGGGEQRRDDGGEDHRVPPCTGCRVHALPGGSTGGGGGGGGGRSGGGVLALVLTCILFEDLRLLGVRRHVEDLGAVREGGGD

SEQ ID NO: 159935 - protein, 129 aa, Triticum aestivum
  Clone ID: PAT_TA_54353.pep
MANERSAGEERGAADSVVWREEAGKFETPDGEAFLQYRLVVQPRASSGGGGASPAAMDMVHTYVPGSKRGQGLAARLCDAAFAHARRHGMRVIPTCSYISDTYLPRNPAWNDLVYKADEPKHSSTSSSM

SEQ ID NO: 159936 - protein, 202 aa, Triticum aestivum
  Clone ID: PAT_TA_54354.pep
MHGSVSCYEKLPSSGRAPMLPKEALSCSPARASCGFFARQGLAAASPHELAPRARRYNLRSSKPTTCCGSPELLMRRGKEVAMEQPRRLGARPASGPPPLRRPRAPPPRSARPAAGSTSEPPYPPPRPPTKSCILRVLRPGGGRPRGVPIHPPPWSSPSLRAATSPSASIRPPCRPDHQPSGASCLSCGRRSNNKNCRVLYV

SEQ ID NO: 159937 - protein, 139 aa, Triticum aestivum
  Clone ID: PAT_TA_54355.pep
RHGAVLNFTCVEMRNHEQPQDAQCMPEALVSQVASAAKEAGVGLAGENALPRYDETAHDQVLATAAEKAEEDRMVAFTYLRMGPDLFQPDNWRRFAAFVKRMTETGVRDVSREQVEREAQGVAHATQGVIQEAAVALCN

SEQ ID NO: 159938 - protein, 75 aa, Triticum aestivum; identical to SEQ ID NO: 106874
  Clone ID: PAT_TA_54356.pep

SEQ ID NO: 159939 - protein, 98 aa, Triticum aestivum
  Clone ID: PAT_TA_54357.pep
TRHRHAASTDPACFRQMRPDSQAGRSKGTSCAPIEQQQKQEEAIAAMNLQITYEQTIRLKAAEEPDASACKADPACTWQESPQSRLPAEPDLQCTRAT

SEQ ID NO: 159940 - protein, 78 aa, Triticum aestivum
  Clone ID: PAT_TA_54358.pep
ALSSSSRPQFRKPGKSERRSVGLMQPGDHLDAQRASTSGDASHYLAQKAAGEQADSAHADVQEDTQIHPITQEDGSAG

SEQ ID NO: 159941 - protein, 94 aa, Triticum aestivum
  Clone ID: PAT_TA_54359.pep
AFGQVRTGTAAPLSRAFFAGRGIDQRRSMGGGGGGGRGDAAPRHGCSVLGPVPSVFRSGVCVAVLCRYGVFHPVSIVSTRFSDQGAGLTSPSFI

SEQ ID NO: 159942 - protein, 121 aa, Triticum aestivum
  Clone ID: PAT_TA_54360.pep
NKTRTTPGSSGTAAVVVSINRTHASGEEDKKKALSSPLTFESWLPSPLPVAASPLISPRRGATRPPHGSRCLRLLPTGRPSCQQRLTSGCVPVIQGAVPAVKGHMGQELLSPAADAQHADL

SEQ ID NO: 159943 - protein, 267 aa, Triticum aestivum
  Clone ID: PAT_TA_54361.pep
PTRPSRLAQLFSEHGTVVFAKIMRDFQTGRSKGFGFVAMASQEEREEAIAALNGQILEGLALRVSAAEEPDVTVSKAAPGGARVESPPPRHVAEPSFRLHVSNLSSRVDDSRLAQMFSQHGKVAYTKVIRDFRSGRSKGFGFVEMSSRGEMDNAITALHGQSLEGRAIRVSAAEVPGMAVSKAAPGVESPPRHVVGPSFRLHVNNLSLNMDDSRLAQMFSQHGKVAYAKVIRDIHSERSKGFVEMASEDMDNAITALHGQSLEGHVI

SEQ ID NO: 159944 - protein, 54 aa, Triticum aestivum
  unsure (1)..(54): unsure at all Xaa locations
  Clone ID: PAT_TA_54362.pep
PXXRVSFCXGXWVVVLXXARACPLFXLGCXXLFRXXXXASSLLXXXXXPPPPPP

SEQ ID NO: 159945 - protein, 90 aa, Triticum aestivum
  unsure (1)..(90): unsure at all Xaa locations
  Clone ID: PAT_TA_54363.pep
ARRXRGAXAWAAAALRVRAPCXXRXSLLGWVXRPPPRRVXXCASCWAPVPLVVGXCGLPXLXVPSCCPPRWXXXCWSPFSXXXXPRPPPP

SEQ ID NO: 159946 - protein, 91 aa, Triticum aestivum
  Clone ID: PAT_TA_54364.pep
KGVSMLSLPQMTVATAGGGHMNACYTIYNPGLRRIVPRRGRLMSDLSDITGVELSDGLSISRSALPDASVGRTTFCKWLTACGALLRFLVH

SEQ ID NO: 159947 - protein, 163 aa, Triticum aestivum
  Clone ID: PAT_TA_54365.pep
VLFKFVPAPAVKPGLRAFPGIFGRKGFVGGFSSPLSNPRVQPGAGGGNPQIGVLCGQTEFPVERLPSFRSEITPTAQALFWAAPSPKGLKLGALSMAGCFPGPPIFLFGWEGYFLFPDGGGFFLRTPVTEPPPVVVSLAPHCFIVFAPPHVFPVTRLMDSFPI

SEQ ID NO: 159948 - protein, 103 aa, Triticum aestivum
  Clone ID: PAT_TA_54366.pep
SDVYRVEPKEAWDDSFKKGLNPNNARRKVIAKELHVLTKALSAIFSGRGGKQDNSGDIFLFRLIPCGTPYETRNLFDSTLNERDDGLYRWGLRLAGRPVLLDP

SEQ ID NO: 159949 - protein, 80 aa, Triticum aestivum
  unsure (1)..(80): unsure at all Xaa locations
  Clone ID: PAT_TA_54367.pep
SVPASSKLPRILDPVFKSSMAPQHLPPVAPVSVLRVQPHPAHXPFITHVLHSLVPLAPPDLGGTLIVLDPPSPLQLPYPS

SEQ ID NO: 159950 - protein, 157 aa, Triticum aestivum
  unsure (1)..(157): unsure at all Xaa locations
  Clone ID: PAT_TA_54368.pep
LACLPAGGFCLFRPLXCSGXCGCFSPPGVCSGPRCGXXPARPCPFFSWLFPPLCPLXSCSAFXPSLVAPXPXALFRFRVCXFVXVSCPVRVVPGPPXCVPPSPLWWRXLCGSPSRVWLPALXSLFPPCVVGXAAPXAWRVVXXXGLPGPFLWVLXSP

SEQ ID NO: 159951 - protein, 197 aa, Triticum aestivum
  unsure (1)..(197): unsure at all Xaa locations
  Clone ID: PAT_TA_54369.pep
DPRRGIAGEERRGRPPKAREHKETGXQXREXPXXXXXNXGXXGXAATXNXXXKXHKEXAXKQEQAKXXAXPFDSXXNXGXAAKEHXXXGSTAXAXXHXEAKTXXTAQXXXXAXPSEAAXENPKGPSRXSTXRKRXGXTGXNXRXGNPXRATHXXXDKHEXKXDXRAAAXDAXAKANPXXKAEKXDKNEGAPRAEKGP

SEQ ID NO: 159952 - protein, 216 aa, Triticum aestivum
  unsure (1)..(216): unsure at all Xaa locations
  Clone ID: PAT_TA_54370.pep
IGRXQAAFQRKDPIHQHGNVNPPTKNMILNEKGPPILLRATHASVRTAISXAPAVAPRAWGGVEQIAEVAELVHLLHAQRLESCRRWLRRRSHHQLVAAGDARPPLLVGSAAGPWARPVYRGRRRRHLGVLAGEPLHDGLEVGGVGADELRLDELDLHAAAPVALLHGRRHICMLPLVTPLGCKGVADLHARTSPXPLLRFTSGVLYDXXXQXGRG

SEQ ID NO: 159953 - protein, 138 aa, Triticum aestivum
  Clone ID: PAT_TA_54371.pep
LPSASLLLPCAPLSHPCPAGRSQQWRAAAGVGAGSRQVLTAWMKMTVVIDGGLACVAVDGRAAAACGASTRMAATSMEEKGPAGSCTGEKLGALVDRADGGHPSFFNRSGQGHGSYPMKKNMMSSLSLLSTIMFVPGF

SEQ ID NO: 159954 - protein, 50 aa, Triticum aestivum
  unsure (1)..(50): unsure at all Xaa locations
  Clone ID: PAT_TA_54372.pep
RRAYPCSRQCAYINSKLDIFNQNKYLLAXPIRKRREQSHWLVLRFRAPSR

SEQ ID NO: 159955 - protein, 143 aa, Triticum aestivum
  unsure (1)..(143): unsure at all Xaa locations
  Clone ID: PAT_TA_54373.pep
PPPPAPPPPPPPPXPPPXPXPPPPPXPPXPPPPPPPPPPXRXPPPXPXPXPPPPPPPPPPPPPPRAAXXPPPPPPXXPXXPXXXXXPPPPPXLRXLVPPGAPXPVXXXPXLXALLPLXPXCFPPRXLXXCPPPARXSSPPPPP

SEQ ID NO: 159956 - protein, 59 aa, Triticum aestivum
  Clone ID: PAT_TA_54374.pep
PPPPPAPPPHPQHPQPPRPPPVPNPPVQPVTIKIKEKIVVVFCYPILTLNPPPSPQDQI

SEQ ID NO: 159957 - protein, 181 aa, Triticum aestivum
  unsure (1)..(181): unsure at all Xaa locations
  Clone ID: PAT_TA_54375.pep
PAPPPPPAPRPPPAXXPAPRAAPPRXPRRPPPPPPRPRPPPPPXPRPPXPPPPPPAPPRPPGXPPPPARPXPGPPXRPAPXPXXGAPXSPPPPPGRGPGRPPPGPVGAPPRXXSWLGPPXLPCSVWPRGPXXXGXXPXRPFXPPPPRPLWWLWSCCPLGLVVACLVPPGPGVFLLFPPPPP

SEQ ID NO: 159958 - protein, 76 aa, Triticum aestivum
  unsure (1)..(76): unsure at all Xaa locations
  Clone ID: PAT_TA_54376.pep
PPHKNKPPPTTPNWPRLGNXLDPNAFFVSRPGSPKQKKRNGLSLPPPCVSCCKKRCASAPHLWLIQFLGRVTHFFF

SEQ ID NO: 159959 - protein, 127 aa, Triticum aestivum
  Clone ID: PAT_TA_54377.pep
RKHKGGRFNFSIVHHTSSLDSRSCWTGDPLPPPHAWTGSSIPRPPPHKNPEKTSNRRGYTTTEPAGGPMAFGPSINPKKPPHPQNPFTKQLSTVYTGPKSPWRWRWRSPCAGRSPWPYRWPPPPFPF

SEQ ID NO: 159960 - protein, 65 aa, Triticum aestivum
  unsure (1)..(65): unsure at all Xaa locations
  Clone ID: PAT_TA_54378.pep
SKNWKPESPKCSASTEGEDSASAGSTPPVPEMEKLDFTXAPWDESETFHLRKYPSVEIDWDSILS

SEQ ID NO: 159961 - protein, 100 aa, Triticum aestivum
  Clone ID: PAT_TA_54379.pep
CREALLICSIPGHCDAGMKLQVNVAAATAAPTKPRGQRSVAPVAAPAPAPERSSTDEQLPTVSSPTGTPTPSSPSGSGAASINASAAVALAMGMAVVLGM

SEQ ID NO: 159962 - protein, 59 aa, Triticum aestivum
  unsure (1)..(59): unsure at all Xaa locations
  Clone ID: PAT_TA_54380.pep
FHRYWHASYKGNGNDIQHLILMKQLCFNPSMFCHCSNLRTSLTPLAQHRTQRSLXFLSG

SEQ ID NO: 159963 - protein, 99 aa, Triticum aestivum
  Clone ID: PAT_TA_54381.pep
YWSLFLFTCCFIYAFSFLINGRGPHKPLLGGVSRGGLLGTLYHDTPNNFPKERVPATPNHGLLTESRGSDADGGSNHGVHYTRGLTWPRQKIAKIYGWN

SEQ ID NO: 159964 - protein, 217 aa, Triticum aestivum
  unsure (1)..(217): unsure at all Xaa locations
  Clone ID: PAT_TA_54382.pep
AAKTSSPTVAPEAAAVTRPASWSVDSWRKKKALQLPEYPNKEELDAVLKTIETFPPIVFAGEARHLEDRLAEAAMGRAFVLQGGDCAESFKEFNANNIRDTFRVLLQMGAVLMFGGQVPVVKVGRMAGQFAKPRSDNFEEKDGVKLPSYRGDNVNGDAFDLKSRTPDPDRMIRAYSQSXATLNLLRAFATGGYAAMQRVIQWNLXDFMDHNEAGRQV

SEQ ID NO: 159965 - protein, 119 aa, Triticum aestivum
  unsure (1)..(119): unsure at all Xaa locations
  Clone ID: PAT_TA_54383.pep
APGEGXPGSGRSAPTPXXAPAPSWXXTSXAXXXASAAXXXSXTRRLXGGSRXLCSFXLPXXXXXHXXVSRLSFKLKPXVSCFLXIXSXXXVXXCVLXXWCXYXISXXAXXLSHVGFLIX

SEQ ID NO: 159966 - protein, 94 aa, Triticum aestivum
  unsure (1)..(94): unsure at all Xaa locations
  Clone ID: PAT_TA_54384.pep
GVPXPCXXLPPLGPSXXLLPSXXXXXFLPPPALXSXXXXAPPSPLWXFXXXLAFSLGXXXPPXCSXXLSPXACXLXXXRXGSVXXXLFPSXPPP

SEQ ID NO: 159967 - protein, 70 aa, Triticum aestivum
  Clone ID: PAT_TA_54385.pep
KRTINRFFQTFKHSTENNKNLDGYWGSSNKAMTGTVLLNKQDGPTEYGDNILHQKIILFYQTTGENNFGI

SEQ ID NO: 159968 - protein, 45 aa, Triticum aestivum
  unsure (1)..(45): unsure at all Xaa locations
  Clone ID: PAT_TA_54386.pep
KGTHHFPHKLLYTPFTHQAHTSSDSHXHNYIGGNSHKHYGWXIYI

SEQ ID NO: 159969 - protein, 56 aa, Triticum aestivum
  unsure (1)..(56): unsure at all Xaa locations
  Clone ID: PAT_TA_54387.pep
NRLIRSGNSSSSDPSPSPPPMVGRWCXTTGGPVVKWVTALPQLYLKKILSLYFGVA

SEQ ID NO: 159970 - protein, 59 aa, Triticum aestivum
  unsure (1)..(59): unsure at all Xaa locations
  Clone ID: PAT_TA_54388.pep
PPXKVARIKTSFLCTPVSCESSRGIFVQKTVSVSSYLGSIQVIDFGCLGFTVGGAACFS

SEQ ID NO: 159971 - protein, 130 aa, Triticum aestivum; identical to SEQ ID NO: 108435
  Clone ID: PAT_TA_54389.pep

SEQ ID NO: 159972 - protein, 135 aa, Triticum aestivum
  Clone ID: PAT_TA_54390.pep
MMRGKDQRPAAFSPMRESVAAAVQEEVWEVRPSGMLVQKRTPDSDPPPGGAPVPTIRVKVKYAGVYHEVYINSQASFGELKKLMSEKTGLHPDDQKVVYKDRERDSKAFLDMVGVKDRSKMTLLEDPTGQAKRLI

SEQ ID NO: 159973 - protein, 151 aa, Triticum aestivum
  Clone ID: PAT_TA_54391.pep
HASAHASGTTERRARHFGWPNTYVFTKAMGEMIMGNLPIDFPVVIIRPSIITSTLKEPLPGWMEGIKTIDSVVIGYAKQTLPFFLVNLDLIMDVIPGDMVVNAMMVAMAAHSDDQQVQVIYHVTSCVRNPAPYSMLWKSVFECLNDNRRCS

SEQ ID NO: 159974 - protein, 88 aa, Triticum aestivum
  Clone ID: PAT_TA_54392.pep
FLLAYLHTTNRNLLQVEVTREIIGLKKPFSLPYSIIMEKVATKRNKRYDSSQASPFLILPSRKRVSDRGQMIQAPDSTCPLLVKYLKA

SEQ ID NO: 159975 - protein, 30 aa, Triticum aestivum
  Clone ID: PAT_TA_54393.pep
NLGVNTFDMDNYTYVANRHKLVASVGLGLQ

SEQ ID NO: 159976 - protein, 68 aa, Triticum aestivum
  Clone ID: PAT_TA_54394.pep
LYPHSTPLKPMETVPHKPSNQTIQKNALILQLVERLEEEGLESGDVDHDVLLHDDLEERQTTLRVGLR

SEQ ID NO: 159977 - protein, 95 aa, Triticum aestivum
  unsure (1)..(95): unsure at all Xaa locations
  Clone ID: PAT_TA_54395.pep
GLLMVSRGIDIAHLXPWVVAEPETRTVDLGADCELLILASDGLWDKVGNQEAVDAAAASSGDLPAACRRLVDMAVSRGSSDDISVLVIQLQRPLR

SEQ ID NO: 159978 - protein, 73 aa, Triticum aestivum
  unsure (1)..(73): unsure at all Xaa locations
  Clone ID: PAT_TA_54396.pep
KDVDQLLGSLFLGTRVQGPIDQGNKLLKFGARXKGNAEISTPRQVEYSAQIFFPAGVPQSWVKNGRFPLGPPG

SEQ ID NO: 159979 - protein, 77 aa, Triticum aestivum
  Clone ID: PAT_TA_54397.pep
SNQDRVLPRKHRPLAPKQCGLHLRSDSCSWVHALCNRRSILVCLCPPCVNWSTLAVRLGSLYICDCNLRCTCDLVTQ

SEQ ID NO: 159980 - protein, 117 aa, Triticum aestivum
  unsure (1)..(117): unsure at all Xaa locations
  Clone ID: PAT_TA_54398.pep
ATTPGASDTPSGYQGAARPASLGLGWSFGGLIFVLAYCTARLFGGHINPAVSFCLFLARMLSLTRAVFSIVMHCLGPICGAGGVXRGFPTTLHLGIGGGAHSRGPGSTRGDALGAAI

SEQ ID NO: 159981 - protein, 51 aa, Triticum aestivum
  unsure (1)..(51): unsure at all Xaa locations
  Clone ID: PAT_TA_54399.pep
IQYLFKKPPPPKXSPTMQQTSLFILNNRSCSASGSSRPWRHWPGTRICKIR

SEQ ID NO: 159982 - protein, 179 aa, Triticum aestivum
  unsure (1)..(179): unsure at all Xaa locations
  Clone ID: PAT_TA_54400.pep
MQIFVKTLTGKTITLEVESSDTIDNVKAKIQDRGGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGXTLADYNIQKESTLHLVLXLRGGMQIFVKTLTGKTITLXEVESSDTIGQC

SEQ ID NO: 159983 - protein, 194 aa, Triticum aestivum
  Clone ID: PAT_TA_54401.pep
WVLRPPDSSNSTALDDILPCADAAATSKALRRSKEVNHQLVATLNDVLANVSNANAFPPGAGPPLNYNQSGPPVPLLCSPYRADLSDRPCAAGEVPAAFAPQAWRGHVCQVSGAPGQSQETCATPGRLTPSMYAQALAVANASAGLVDYGPALAELADCTFVRQTFEAVVADGCPGLRRHSGRVYRALAAVAVA

SEQ ID NO: 159984 - protein, 183 aa, Triticum aestivum
  unsure (1)..(183): unsure at all Xaa locations
  Clone ID: PAT_TA_54402.pep
SAVALVXMHSEASQTSIISHGDVKSGNILLNDGFTPKVSDFGTSRLMSIDKDHTNWVVGDSSYIDPVYMKTGLLTEKSDVYSFGIVLLELVTRKKARYDGNHSLPLDYVKASMGGAVREMFDPEVASRGKENEECLEEVGKIAVQCLKEDVNDRPTMNEVAERLKICKCRWLEYDRKTNEICT

SEQ ID NO: 159985 - protein, 42 aa, Triticum aestivum
  Clone ID: PAT_TA_54403.pep
HAGMQHHATRLSSVGLTVNLLLISPLQKESNGFLVQAMHVVV

SEQ ID NO: 159986 - protein, 65 aa, Triticum aestivum
  Clone ID: PAT_TA_54404.pep
LELLRVLGTTVAKRTGGTLKEYKKMPHDYLASRLLRPLFFNLKPAHRGLWTGGHPLLQVPYGSIT

SEQ ID NO: 159987 - protein, 50 aa, Triticum aestivum
  Clone ID: PAT_TA_54405.pep
HRHSTRFFIENVLLLYCSLYKKSPLTRTQHQTWRISSYTDVMQQAYHISG

SEQ ID NO: 159988 - protein, 91 aa, Triticum aestivum
  Clone ID: PAT_TA_54406.pep
EGKKGTGKLHLSNEIVLNKQTIPKVHPTWRLKNNRTDSPPGTASRGAMTKSRSHHFCGGLERPMFLFTVQKNTTSTSIGIIRKGLARRKGY

SEQ ID NO: 159989 - protein, 46 aa, Triticum aestivum
  Clone ID: PAT_TA_54407.pep
QLEMLVPTALLLEYPPVATQWVIIQFLAGKGMLSNMRLLVTNIGWH

SEQ ID NO: 159990 - protein, 107 aa, Triticum aestivum
  Clone ID: PAT_TA_54408.pep
RPFNIFKFFNLSHKYDVRKHVIRREVPSKKEGKKPKSKAPKIQRLITPRRLQHKRALRAAKLHRAEANKEAETQYKKLLASRLKEQRDKRTAILKKRRLSSKSQSEA

SEQ ID NO: 159991 - protein, 49 aa, Triticum aestivum
  unsure (1)..(49): unsure at all Xaa locations
  Clone ID: PAT_TA_54409.pep
MDTITVXENVFGEVERKVQKSYWEEHSKDXTXEXMMLDXXXXDXXXEER

SEQ ID NO: 159992 - protein, 173 aa, Triticum aestivum
  Clone ID: PAT_TA_54410.pep
GPQSCQTNDAGPSNQETLPFSQPTYGQTVHQGTPYYLAQGNFINDQGQGSFSAEPTIPSHIPVPVPEDDPITFTAASLTGQQNGHFSFSTTVAPVTSYPVAGVAGTSSDGVSLGTSSVNNVQADIFSGLSPFESEELLELQAHLTEQDFVQANIELPNSDSQFYGYEHDGGDH

SEQ ID NO: 159993 - protein, 90 aa, Triticum aestivum
  Clone ID: PAT_TA_54411.pep
SSLGHASREVHGGSLGVCCSICAVLLSSMCVCVCVKLQYFFLGQRLTTRMHTHIYEYTHAKPYPYEQLRETEPAVQYWLCTKVMKTCHIA

SEQ ID NO: 159994 - protein, 50 aa, Triticum aestivum
  unsure (1)..(50): unsure at all Xaa locations
  Clone ID: PAT_TA_54412.pep
MSCTKLISVTLVVLFSIGLASAGRVSRYSSSQGTGTGGGEGGGAVNXXXG

SEQ ID NO: 159995 - protein, 62 aa, Triticum aestivum
  unsure (1)..(62): unsure at all Xaa locations
  Clone ID: PAT_TA_54413.pep
DNQNNHSFGSLMLXIDPSPXASPHSNQELEVSRCAVHFCCSSRLCSSPLQSTPSESLSKDQR

SEQ ID NO: 159996 - protein, 120 aa, Triticum aestivum
  unsure (1)..(120): unsure at all Xaa locations
  Clone ID: PAT_TA_54414.pep
MSYAYLFKYIIIGDTGVGKSCLLLQFTDKRCQPVHDLTIGVEFGARMITIDNKPIKLQIWDTAGQESFRSITRSYYRGAAGALLVYDITRRETFNHXASWLEDARQHANANMTXXVGGNG

SEQ ID NO: 159997 - protein, 215 aa, Triticum aestivum
  Clone ID: PAT_TA_54415.pep
GAMAMEESPQLFLCPISMELMEDPVTVSTGVTYDRRSIERWFFKYGKTTCPATMQRVASLDLTPNHTLKRVIASWQDRASTSSGPADALKPMARERLPSVLAGIEGTPFKVTALKGLRLCMAGDQAARDDFVACDGIQVLGRVMAQALAESGAGGDFSAFRTCEEAAAVLATLPLSDEESVDLVLRPECMRPMVALVQRGSAEARLHAMSILTKV

SEQ ID NO: 159998 - protein, 95 aa, Triticum aestivum
  unsure (1)..(95): unsure at all Xaa locations
  Clone ID: PAT_TA_54416.pep
LSSLLLPPLPLIDQEELQLSAMEPIPLLTPYKMGQFDLAHRVVLAPLTRQRSYGNVPQPHAGVDYSQRATXGGLXIAEATGXXDTXQXYXDXXGM

SEQ ID NO: 159999 - protein, 57 aa, Triticum aestivum
  Clone ID: PAT_TA_54417.pep
RAGKKKRTPKEAPQIWYFKIEPPHFFFFYFFFFIFFFLFFFFFFFFFFFFFFFFFLI

SEQ ID NO: 160000 - protein, 88 aa, Triticum aestivum
  Clone ID: PAT_TA_54418.pep
DEGTLYITLQTFSVQHRTSHGKIEIQIVLRHCISFNSSLCLNYWGICFWLSVPVYELAAEVTLGSHARRVCICRKSKPEGSVWRRLLP

SEQ ID NO: 160001 - protein, 30 aa, Triticum aestivum
  Clone ID: PAT_TA_54419.pep
SMKNLPSTFKWDINIFLRQIHPRKGSAPKF

SEQ ID NO: 160002 - protein, 61 aa, Triticum aestivum
  Clone ID: PAT_TA_54420.pep
GLTIKSMSGGVENTRHYLELSSASQSGGLTLGSRLMYHELFIKGFLYIETYFPHNLPTWSV

SEQ ID NO: 160003 - protein, 131 aa, Triticum aestivum
  Clone ID: PAT_TA_54421.pep
RLKSRFFQIQRIRIMNWALEKRLRNLFMQAQMWRDIAQSNEATANVLRGDLQRALDSQAVRDGGSGDGQEDDAESCCWGENQVPLCAEEEVGTPAVEERPATAVGRCKGCREDAAVVLLLPCRHLCVCAPC

SEQ ID NO: 160004 - protein, 70 aa, Triticum aestivum
  Clone ID: PAT_TA_54422.pep
VVWSVGICLYCIQSDPSDLRLSLKNICSLQYSADTSFFSLDSIHGLALHQNSSHGKICQALVKVYFLWAN

SEQ ID NO: 160005 - protein, 198 aa, Triticum aestivum
  unsure (1)..(198): unsure at all Xaa locations
  Clone ID: PAT_TA_54423.pep
PPPPPXXPXPPPPPPPPHPXXPXPXXXPPPPPPPPPPPPPPPPPPPPPPPPHPPPPPPPPPPPPXXPPPXXXPPPPPPXXXPNPXPXPXXPSPRAPPPPPPPPXXXPPPPSXXLXSSXPXARSXXXXTPXRRPXAPPPCAQKTPPLTVATDTPQHHAAKYHQPTQPGRRRPHQQRPPPQTLGPSPSSVAAEGLAATLI

SEQ ID NO: 160006 - protein, 72 aa, Triticum aestivum
  Clone ID: PAT_TA_54424.pep
KEIGYCIISLVIEPYRYRSEYYDQHCHPKLTIKTTANVRRYIHPSYTISKGRYTRKKRIKITSKNQIRKHVK

SEQ ID NO: 160007 - protein, 90 aa, Triticum aestivum
  Clone ID: PAT_TA_54425.pep
PTATPVASWASSPWIWVRWYCWSLPSTDRSRRVVASRASLLSSRDSRAGTSTGTPQHVPVPVRRRMKCEVGFRISLCEKKNRYFSTLLSW

SEQ ID NO: 160008 - protein, 240 aa, Triticum aestivum
  unsure (1)..(240): unsure at all Xaa locations
  Clone ID: PAT_TA_54426.pep
PPAPPXPPPPPPXXXPPPPXPPPXPXXPPXPPPXPPXXPPPPPPPPPPPXPXPPPPXXPPPPPPPPXXPXPPPPXPPPPPXPPPPPPPPPXXPPPPPPPPPPPXXPPPPPPPXPXXPPXPPPPPPPPPPXPPPPPPPPPPPPPPPPPPPPPPPPPPPPPPPPPPPPPPPPPPPPPPPPPPPPPPPPXXPPPPPPPRPPPPPPXPPAPPHPPGIYXVLEXXLFHGPPPPMHHMIECDDFFL

SEQ ID NO: 160009 - protein, 50 aa, Triticum aestivum
  Clone ID: PAT_TA_54427.pep
APTHPARIPKRPQFTAKAGNIACPHADVEASHSVHFCCLVPSAVYVRSGM

SEQ ID NO: 160010 - protein, 73 aa, Triticum aestivum
  Clone ID: PAT_TA_54428.pep
MGNCWGAKISSDSSSSSPSGTNSKYASRNGAVLSSSSSYASAALVPRSEGEILESANCKAFSFNELRTVSRNF

SEQ ID NO: 160011 - protein, 184 aa, Triticum aestivum
  unsure (1)..(184): unsure at all Xaa locations
  Clone ID: PAT_TA_54429.pep
MLAERNSEKKHLRLRWKRIDNFLSRTGSSEDIFSELFGHQNAEDTFWLDSSSVDQNRARFSFMGGKGGPLWKQMTFHLSNQRANCRGTITIRDAHGSAVKNSLKDGFLEFLHKEIQXIKYDEEDFEGLPXDFHXGXXGYLGYXLKGEWDAXSNKAKXXTXDAXXXXADNXXXIDXNNXDRYMMI

SEQ ID NO: 160012 - protein, 210 aa, Triticum aestivum
  unsure (1)..(210): unsure at all Xaa locations
  Clone ID: PAT_TA_54430.pep
QAPRRATAAPQGGRREXXGXRSXXXXPXRRKATXDDXXXAXXXRTXAXSTSGGXGGAPTEAKXKGAXNGXGRXGRNXXRXXHGRGDSXPXEGXAXNDTGGXKQAXHXXKDDXTRGXXDADXKPXGDNAXXXDGEGXKGXGDRNPRNRPRGEKGXGRGXEGTGRGGDRAGAGGXRRAGAGKGRXAGPGGGGGGARGGGGGGGARRRAPRRG

SEQ ID NO: 160013 - protein, 103 aa, Triticum aestivum
  unsure (1)..(103): unsure at all Xaa locations
  Clone ID: PAT_TA_54431.pep
SLIFLRKEGDSLDLAPREPHMHLVKRILRYIKGTPDLNFHLSSSSSAALTTYSDVDCAGCPDTXRSTSGYCIYLGGNLVSWSSXRQITVSRSSAGAEYRADAH

SEQ ID NO: 160014 - protein, 165 aa, Triticum aestivum
  unsure (1)..(165): unsure at all Xaa locations
  Clone ID: PAT_TA_54432.pep
DPRRAPDGDAXQRGAAAPAEAXARRAXXAXPGXXRAXXXPRAGPTPAEXAXAXRHXXDPXPXXRRGGAXANQANXEAXEXEKNXHXXDPGGADPTQXXEXXHXXAARPEGPPHXXXTXXHEHKDXXXQTXXAXTKEAERXDXPXXXNPXXXXRDAXDXERPRXKT

SEQ ID NO: 160015 - protein, 68 aa, Triticum aestivum
  unsure (1)..(68): unsure at all Xaa locations
  Clone ID: PAT_TA_54433.pep
DAPXSGAXSAAGGGXTRSXTXTXASAQAPXXXXXXXTPXATXAGXPRQXXKRGPPXRGRXRXXRHXGP

SEQ ID NO: 160016 - protein, 84 aa, Triticum aestivum
  unsure (1)..(84): unsure at all Xaa locations
  Clone ID: PAT_TA_54434.pep
PTXPPTXPPTXPPTRPPTXPAAGAAEAEQAAAAGAPAGPGAAGRPQGHHQKASRAAGGEADGGRKRPGNGRGTEAPRSRRQTGA

SEQ ID NO: 160017 - protein, 124 aa, Triticum aestivum
  unsure (1)..(124): unsure at all Xaa locations
  Clone ID: PAT_TA_54435.pep
PPXXPARRPGGNXKXRRAPPXXPXPPLAAAXGRGXAKPSXRRRRRGPNXPXXGRXXRGGAXRXGAXSXAGRHGXAAGRGGAPXPXXPXDGRPXXXASTXXRERXRRGQNRARKQGPGDADRGRN

SEQ ID NO: 160018 - protein, 82 aa, Triticum aestivum
  unsure (1)..(82): unsure at all Xaa locations
  Clone ID: PAT_TA_54436.pep
NTPTKGKRTTPARTAPSGPPTHTARKATTPTADTTRRGQPIPRSTPTRSHAAXIXHLTTTAAQGGESEISRPRRRQARXQKQ

SEQ ID NO: 160019 - protein, 100 aa, Triticum aestivum
  unsure (1)..(100): unsure at all Xaa locations
  Clone ID: PAT_TA_54437.pep
LFRXXVCRLLPVXVCXVXCPGFXACXLXVXXGXXVGLFXXXAAAPLXXXVXXXXSXGGXPLXXPSXAXXSXPXGXXXXVRWPXRLGXGXWXFCARSSVCP

SEQ ID NO: 160020 - protein, 163 aa, Triticum aestivum
  unsure (1)..(163): unsure at all Xaa locations
  Clone ID: PAT_TA_54438.pep
VVLLGVVARNPRFLFRDGSCPQPDLPWVTPPLPPTPTAAPHAAGSPPPPSPXTRSPHAAPPPAMGAGYPPPPPPAPPDPRTTRPWRWLLPPLGIPAPPAMKGSSSSGRALQHRQPRSYSCNSTATPPSDGRPWHADMPSQRKSFSLYLDPGPFFLYLQFGSLP

SEQ ID NO: 160021 - protein, 268 aa, Triticum aestivum
  Clone ID: PAT_TA_54439.pep
PRPELDKSFKATGKLKGPLHGVPVALKDFHFVAGRPTTTGYVSRRDFRPEHDSALVKTLRDAGAVFYCKTTMPQSGMAIETVSNLWGRTLNPYNTALSAGGSSGGDAVLVALKGTPITPSTDLGGSIRVPAAFNGLYAIRPTSDRIPKGGMDNINSGQISIKLSCGPICHSMEDLESFTKLINAYPENQNDPTSVPVPWKTVKPIEGKLTIGLMKWDKVVMPHPPVIRALEHTKRTLEKAGHEVVEFDVPFDCWDAIQTTFDTYYQSG

SEQ ID NO: 160022 - protein, 141 aa, Triticum aestivum
  unsure (1)..(141): unsure at all Xaa locations
  Clone ID: PAT_TA_54440.pep
MVKAVAVLTGSEGVKGTIFFTQEGEGATTVTGSVTGLKEGLHGFHVHALGDTTNGCMSTGPHFNPAGHVHGAPEDEIRHAGDLGNVTAGADGVANINDTDCHMPLTGPNGMDGRAWDEHGDPDDLGKGGHELRKSTGNAXA

SEQ ID NO: 160023 - protein, 160 aa, Triticum aestivum
  unsure (1)..(160): unsure at all Xaa locations
  Clone ID: PAT_TA_54441.pep
GPPPPPARXPLRPPSPPLVSPFPLSXPLXSPPCSPCSSSSAARARAPPLPSRGAPPPPLPXSPXXXRPXRLXPLPXPXXXPPPPPPPXPRRLGXGPLXSXGGASAPXXRPPRPPSGCSWGRRGRARRCGRRRRRWSGSGAAARGAPGARAPPSLAAWAAG

SEQ ID NO: 160024 - protein, 235 aa, Triticum aestivum
  unsure (1)..(235): unsure at all Xaa locations
  Clone ID: PAT_TA_54442.pep
MAAELPFYLLLLPLLAIVPLLYLAVSRGRPGSGRRLPPSPWALPVIGHLHHLAGALPHRAMRDLARRHGPLMLLRFGEVPVVVASSPDAAREIMKTHDVTFATRPIGPMQRRIMEGAEGLLFSPYGDAWRQLRKICTVELLSTRRVHSFRPIREDEIGHLLRSVASEASPARPVNLSERIATFVADSSVRAIIGSRTPNRDTFLXLLEEGLKVXPGMSLPDIFPSSRLAMRLSRV

SEQ ID NO: 160025 - protein, 43 aa, Triticum aestivum
  unsure (1)..(43): unsure at all Xaa locations
  Clone ID: PAT_TA_54443.pep
MNEQEPRVPRSIQALHLLPLXREVVHGVPSCDLQLRSFTGQPL

SEQ ID NO: 160026 - protein, 186 aa, Triticum aestivum
  unsure (1)..(186): unsure at all Xaa locations
  Clone ID: PAT_TA_54444.pep
FXLLAPLXCPXFLXSLLXARFXAVGPAALSVGVFXRPLLXXVXPVLVLXXWCFXXRCFXXXXFLGXXXXXPXVPXPVRXVAAXLFPLGFLXXRVXXGXAVGXLXLVVRXRXRSVXRGCRXRXRRVPXRRCPXAAPPAPPRXXXXRCXXSPPSXSRPGGXAVAGAXXXXRRGGGCXGSPAGLRXASA

SEQ ID NO: 160027 - protein, 98 aa, Triticum aestivum
  unsure (1)..(98): unsure at all Xaa locations
  Clone ID: PAT_TA_54445.pep
NNCILNAINTEHLVAISALAHLERGCPRQRFGEDTVFDITFSNGHLYCLLGLSDQLVRCEFGLTEYGTAVFGAVHCLPMPNRHLVMEGKXGGIYQIHS

SEQ ID NO: 160028 - protein, 146 aa, Triticum aestivum
  unsure (1)..(146): unsure at all Xaa locations
  Clone ID: PAT_TA_54446.pep
APXXRXDARGXXXGXTRGTNKGHXXRAGREXXXXQXXXXXSXXXKXXGEAGEXKXAEGEXXXXXXXXXXXNNXXXQNQAXXXGSXXXRPADTETTAXGAAXAAGXXAGXXTKEEKXAGPHKENTTXXRPKXXDAXTGRREEXXGTR

SEQ ID NO: 160029 - protein, 103 aa, Triticum aestivum
  unsure (1)..(103): unsure at all Xaa locations
  Clone ID: PAT_TA_54447.pep
CCFXXXFXSVPXVXXWFXFXWXXXLLFXLXXRXXFXXLXLXGLXXSRFLLPPFWCFLRPALCXRGSLXXPSSSFSXSXXVFSXXSXPSVRPCXXXXCFFLCFS

SEQ ID NO: 160030 - protein, 109 aa, Triticum aestivum
  Clone ID: PAT_TA_54448.pep
HMEPREANMGGDLLLLEFNGVGSEVKQILPGLIRRHRHSDSTGSTTSSRSNPMREDMLNRSNTHRSRSQFLENHLAKLFEQKMEIFTKLEYTQESVISTVLKLCLKSLQ

SEQ ID NO: 160031 - protein, 127 aa, Triticum aestivum
  unsure (1)..(127): unsure at all Xaa locations
  Clone ID: PAT_TA_54449.pep
THARPXARXEKKRGKEEAQQPARGGETXGAXKGPXKGGKGKQXXGSXTAQEXXDXXKXQXNRDXDGRXXEGPENREXGEXXAENKXHPXXTAKGRXXXXAKARKEGQRAKNEAGSRGQQKAPEEKQG

SEQ ID NO: 160032 - protein, 159 aa, Triticum aestivum
  unsure (1)..(159): unsure at all Xaa locations
  Clone ID: PAT_TA_54450.pep
DRAVFGDDFYMCSFQEPGAIGVSFNSVVSHLVLRKFFSDXTPGALFMQKSGWGSPDHXVTFLVWISEKSLKLYKTQFSKSGFVGGFXYYRALNNTWQLASPCKGPXIMVTRKFTVGKLVLAXHYCMGKSFHYXGGLKQFVPLLHHVVTMKHVGHFINER

SEQ ID NO: 160033 - protein, 105 aa, Triticum aestivum
  Clone ID: PAT_TA_54451.pep
LFKSSSLLLKRSGLAVNQSGPSGSASCCSSACRRRRQLHRSAPPLSGRRSVSCRPSCRCRRRRHSRGGWCWGCTCWRRTHRRRSPARCRSRTRGSSHRSTCRTPT

SEQ ID NO: 160034 - protein, 121 aa, Triticum aestivum
  Clone ID: PAT_TA_54452.pep
DWLTERMRTNNFTISAMHGDMPQKERDAIMSEFRSGTTRVLITTDVWARGLDVQQVSLVINYDLPNNRELYIHRIGRSGRFGRKGVAINFVRKDDIRILRDIEQYYSTQIDEMPMNVADLI

SEQ ID NO: 160035 - protein, 68 aa, Triticum aestivum
  Clone ID: PAT_TA_54453.pep
NLTRQKNLQDNRKTNGAGMVFFSGKGGGGSQIIHWKEVVPGGIGKIPGVLAGPKYEKKTIYGFSGGYP

SEQ ID NO: 160036 - protein, 103 aa, Triticum aestivum
  Clone ID: PAT_TA_54454.pep
CYLSTTAGPIAGMLFVSSERVAFRSDRSLALTSPKGDTVRVPYKVAVPLSRVKAAKPSENQHRPEQKYVQLVTDDGFEFWFMGFVSYQGSLQHLEQAIAESHL

SEQ ID NO: 160037 - protein, 110 aa, Triticum aestivum
  Clone ID: PAT_TA_54455.pep
ARGCPPAVAQMSASPMALAASFFRFCGLARSGPRGSHVADPPLRMDHLGVRVSLASLRVTEQAHGPVPLAIGPDGPRPWLLEERGAPALARVFLRLAPAVPSIYAPIFRL

SEQ ID NO: 160038 - protein, 133 aa, Triticum aestivum
  Clone ID: PAT_TA_54456.pep
SGGRAASDMYNSTAEDVLYVLKESSDDDRRDYYALGRFDAAANTWTPIDSERELGVALRYDYGRYDASKSFYDPVKQRRIVWGYVVETDSWSADAAKGWANLQSIPRTVVLMRRVSSSSTGHWMRFVRVFSSS

SEQ ID NO: 160039 - protein, 55 aa, Triticum aestivum
  unsure (1)..(55): unsure at all Xaa locations
  Clone ID: PAT_TA_54457.pep
KNESGAYYFNCNCGIARTNPFGGVKQQITISCGWSWXXTKTTRGGAKRWXPVGWR

SEQ ID NO: 160040 - protein, 49 aa, Triticum aestivum
  Clone ID: PAT_TA_54458.pep
GTSCCLVPIKSPKVCGTCIMHVSESALSCMLSSCWGFKILQLSFLMRFN

SEQ ID NO: 160041 - protein, 117 aa, Triticum aestivum
  unsure (1)..(117): unsure at all Xaa locations
  Clone ID: PAT_TA_54459.pep
SAPAPHARARDXGGWPSCPGGCHGLSTAHPSICGIPVDLTPVLHLPCYALRDYLASLGQLWLFVTVVFSTPPQTAFGLCQKVGGWFWLRRCFAIFVLRDGNAQVASQRHDWYAIWNV

SEQ ID NO: 160042 - protein, 169 aa, Triticum aestivum
  unsure (1)..(169): unsure at all Xaa locations
  Clone ID: PAT_TA_54460.pep
GPNQGGEGRPTNKGPSPTNKGGHKGRGGGTTHDQKEATTQDKGAAAKADAEAHQSQPHRERKDPKPPRHGPPQPGERPGARRAPPGQGGGTGGGPRKDPPRRPREPPEGATPQGPGSGGQPXXPGEXPQKPRERKPPXEQXKXXRGPGGPTKSNRSRGETGGPAHPPRG

SEQ ID NO: 160043 - protein, 58 aa, Triticum aestivum
  Clone ID: PAT_TA_54461.pep
LKETNFTRAEQPYATMSMHGGQRRTHTHLGTRFAHQKPNIKYYSLRYHTVCLHIIFVG

SEQ ID NO: 160044 - protein, 63 aa, Triticum aestivum
  Clone ID: PAT_TA_54462.pep
APPCITRTPGTCTNHSWDIAPPQLLCTRLQSSSPALLTQHCICMKHCRIWPPFASISRMSFTS

SEQ ID NO: 160045 - protein, 109 aa, Triticum aestivum
  Clone ID: PAT_TA_54463.pep
SGRHGSTQQQLNISEYTQLEGLTSSICRKLSSRVLSQGGQKMENIEDIDRQVDLDMRELTQHVLQSCNGVSGLTRQTFMHVVKSFNYVTLCPHDTIDCHISKVLFEDVI

SEQ ID NO: 160046 - protein, 99 aa, Triticum aestivum
  Clone ID: PAT_TA_54464.pep
NSSQEVDHTVIKPNIVYHWGLIPQSDTLLDSSSLKEDFMKYVINDVYGKVKCTNSELTLSIVGASELPKSMYNDSFYSRHLHQYGVGYQAADDCWSTIG

SEQ ID NO: 160047 - protein, 213 aa, Triticum aestivum
  Clone ID: PAT_TA_54465.pep
PTRPRGSVTDVETVDLSSKMQSWRSRNSVPSSSYVSVNAISQMSHSTVPVEQVLEIPPEFDPDSTEFVSDISDYATEFKQRDVVEIPLEFDPDATQLVSVERHNATKLQWEGIEIPLEFDPDSVELAPDITEYTSKLKQSHERARKLRADLAVEEQREQELSRMLKGIVTVPSLSETHKRRPRRKSSIERLRVSRHLAEEAISYFEECVSISH

SEQ ID NO: 160048 - protein, 100 aa, Triticum aestivum
  Clone ID: PAT_TA_54466.pep
NHYCRKWRPKFIASVSRDQTGATSRLRTSAEDRDNRLKREGARAATQEARNGAPLLPANDLVHVVTHTNIAPQHACFDRAPRGQLNDTCPLVSGRAWDPC

SEQ ID NO: 160049 - protein, 37 aa, Triticum aestivum
  Clone ID: PAT_TA_54467.pep
TLRLIIDVRHLGSAWSTVVNSHRRISIERPSHNMLFI

SEQ ID NO: 160050 - protein, 215 aa, Triticum aestivum
  unsure (1)..(215): unsure at all Xaa locations
  Clone ID: PAT_TA_54468.pep
GDTRVAAVARSIAERDELLGDVRYRLQQAQAVYKSYYDRRHRDIRHDVGDWVWLRLRQRTASSLNLPTRGKLKPRFYGPYRISEVVNDVVYRLELPARSRLHDVFHVGLLKKFFGTPPTAPPGLPPIHNRAAVPEPERVTRARLARGVCQLLVHWKGEAASSATWEDLDSFVERYPAFQLEDELLVEXGRDVMWGTXYRRGPRDQEQQPAAIGKA

SEQ ID NO: 160051 - protein, 91 aa, Triticum aestivum
  Clone ID: PAT_TA_54469.pep
PPKKQRDPRAKCSRSCSPRRRRLRRASRRYGGGLPRPAPPPPPAARRPPSAPRPSGPASPPRGRVPPSRSPRRCPPRRRPSAPSSPRLAKG

SEQ ID NO: 160052 - protein, 125 aa, Triticum aestivum
  Clone ID: PAT_TA_54470.pep
HASAHASADAWVLSSSSAYHIIRWPRLFPHGHDKPGVALAAARDAVQQPAGAQGEVDLRAVVYLWKVLFRRCEAPDSNLEHPCKLAAAVLLHVLQQQQQQQEQALQFTSWFVNRILDRYTIYCYY

SEQ ID NO: 160053 - protein, 161 aa, Triticum aestivum; identical to SEQ ID NO: 157638
  Clone ID: PAT_TA_54471.pep

SEQ ID NO: 160054 - protein, 107 aa, Triticum aestivum
  unsure (1)..(107): unsure at all Xaa locations
  Clone ID: PAT_TA_54472.pep
QSTDGGVPLPWGVPANGSXVFFNDPGLAKPGWGGWYAPFPPGCLFPSKGGLKSFEPPMNPLKGLPRVDNKGVLWGPNFKVDAFPKINSMPRVGRAPNWAPPWEDPPF

SEQ ID NO: 160055 - protein, 70 aa, Triticum aestivum
  Clone ID: PAT_TA_54473.pep
NTLVLENAFNYLIPNTFLLANILTGPVNLSPPLALSLFLHCLLHSVSIPLYFMHGSCPYPFIMILEINSV

SEQ ID NO: 160056 - protein, 196 aa, Triticum aestivum
  unsure (1)..(196): unsure at all Xaa locations
  Clone ID: PAT_TA_54474.pep
VISILIXPEEGITXAGVLFQXTIEKMEAEVERLTELKTNRLKEIVTKRRAELEDICKNAHIQPDLSTAPEQTNALIDSGTIDPSELLANIESQILKAKEESLSRKDIMDRINKWIAACDEEAWLEEYNQDSKRYSSGRGAHVNLRRAEKARILVTKIPAMMDNLINRTFAWENARNKPFLYDGGRLVSVLEEYRLN

SEQ ID NO: 160057 - protein, 106 aa, Triticum aestivum
  Clone ID: PAT_TA_54475.pep
PYKPPPPTSRVHSSSTPPCQPSTTTPSPMCSPVMPVTARLTSMSSSKASIRFTIKLIDSTLCSNSPLVLSLFYITQAGSCINIHPVFMFPPTRVATNLIFFPQVWD

SEQ ID NO: 160058 - protein, 141 aa, Triticum aestivum
  Clone ID: PAT_TA_54476.pep
QSKKLGKNGLCLEVPGRVRLFSLVPQSFFGGKIKKGVFLGDGSLGQVCEGYAYEGPLVFVWGGAANFYGLGGLPLGFIFPLSNGLDWGRAKFPAKGFLESCRAGGAFWGLYPYKQRGKPWGLKSFAPKSRVFFRNVPLFGP

SEQ ID NO: 160059 - protein, 71 aa, Triticum aestivum
  Clone ID: PAT_TA_54477.pep
RKTGPLDFQKGGGWVFPGKHENKKAPPLRGLFPVQVQGAFFSPFRTNPGQGALKSGGIQAPRGQLSSLAIP

SEQ ID NO: 160060 - protein, 104 aa, Triticum aestivum
  Clone ID: PAT_TA_54478.pep
FPPLDVEEPSNWSTLAQSEVPVLKETVVGRWGSSIDWSLPRKKRDQPSVKPLFVQTLLLSPLFRAQYLRGDPMFPLPGCPLALNAASEGWVPPAQVPECDTHEK

SEQ ID NO: 160061 - protein, 37 aa, Triticum aestivum
  Clone ID: PAT_TA_54479.pep
YTCLKKEFWFLELERFSQVGEVGKNYVWLSPFYIYFH

SEQ ID NO: 160062 - protein, 116 aa, Triticum aestivum
  Clone ID: PAT_TA_54480.pep
GGGNNKGVNHQPVKVVTIVTPSVLKNHLAFAKNQFISPIKRNIKTLFPKFKGNALNVSKKNVKFPPNYFLTKPKALQFFVAKTIHNKAGVVFPSSKKEAVDPPSLSLAHGLKKAKS

SEQ ID NO: 160063 - protein, 210 aa, Triticum aestivum
  unsure (1)..(210): unsure at all Xaa locations
  Clone ID: PAT_TA_54481.pep
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGNVLPLRSVPEGGVICNVEHHVGDRGVFARASGDYAIVISHNPDNGTSRIKLPSGAKKIVPSSCRAMIGQVAXGGGRTEKPMLKAGNAYHKYRVKRNSWPRCXGVAMNPVEH

SEQ ID NO: 160064 - protein, 103 aa, Triticum aestivum
  Clone ID: PAT_TA_54482.pep
IFRAGEGTTATIVVKTATGEEFHGGKCIITVGAWTSKLVKSVTGADLPVQPLHTLICYWKVKPGHERELTTEAGFPTFASYGVPYIYSTPVMEYPGLIKIGMH

SEQ ID NO: 160065 - protein, 217 aa, Triticum aestivum
  Clone ID: PAT_TA_54483.pep
MEVGTWAVVASAVAAYMAWFWRMSRGLRGPRVWPVLGSLPGLVQHAEDMHEWIAGNLRRAGGTYQTCIFAVPGVARRGGLVTVTCDPRNLEHVLKARFDNYPKGPFWHGVFRDLLGDGIFNSDGDTWLAQRKTAALEFTTRTLRTAMSRWVSRSIHGRLLPILADAAKGKAQVDLQDLLLRLTFDNICGLAFGKDPETLAQGLPENEFAFAFDRATE

SEQ ID NO: 160066 - protein, 75 aa, Triticum aestivum
  Clone ID: PAT_TA_54484.pep
SMAEMVRANHIGSSEDLEELLACYLALNAAEHHRAVLAAFRRVWHSGFTSPAKECGTCAIKATSCLHRRRTTPNS

SEQ ID NO: 160067 - protein, 68 aa, Triticum aestivum
  Clone ID: PAT_TA_54485.pep
FRRSLLNYFSCNSEAEVLSAPPRLVYNNFVLRLARDMLVAVAGGWDQHVEVINKIIPQHWKVDNCFTI

SEQ ID NO: 160068 - protein, 258 aa, Triticum aestivum
  unsure (1)..(258): unsure at all Xaa locations
  Clone ID: PAT_TA_54486.pep
EDITNRNKRTTCMSLNETADNCVALKKRARMFQNTDELSSNIHHEMPHTLGTVSASSHEKDQSSSDANLGQIQQTPVHGTSSATNKDFPWDDPDMVAQLIESTDRIEEEWFSQQRQTQYTTSVTQDIHISEIKPNEICCNFTSNPVESAVFSDIVSRIPPHSRQKSPRIVQMGSTWVEHRVFGLSMQVYGRVNKYLINMLGKAVMAEQTEKERLNLLPRSYWSRYYVECNTAKLFQNAFETXFGVICSPEGDNDRIPS

SEQ ID NO: 160069 - protein, 193 aa, Triticum aestivum
  Clone ID: PAT_TA_54487.pep
MRRHYAELLRRAASLPSLSLVASLHAAALRRGAVLVPSLIHAYSACGDPASALSVFDGLPAQERTLSARTALASAMSAHGRCRDVLGLFRGREGEMDDKAVTVVLAACARAGMVSEGREVFARVRRPALQHYTCMVEMLGRAGEVEEAEGLLARMEARPDRVICMVLLASCRAHGRVDVAERVARLMSEYGIV

SEQ ID NO: 160070 - protein, 83 aa, Triticum aestivum
  Clone ID: PAT_TA_54488.pep
LLHTNSKQTIDHRADHKHPPRRNRLEVAIRKKPVGNDRDGASRREDEQQHHGTAHRVVLLPGLSLTRSHAPTRRPELRQAHWR

SEQ ID NO: 160071 - protein, 168 aa, Triticum aestivum
  unsure (1)..(168): unsure at all Xaa locations
  Clone ID: PAT_TA_54489.pep
IGFYAGFVGASYMLGRTLTSTAWGMVADRIGRKPVIVLGLFSVILFSALFGLSVHYWMAVSTRFLLGSLNGIIGPIRAYAIEVCRPEHHAIALSLVSTAWAIGLILGPTIGGYLAQKXYPKLFPVDSLFGRFPYLLPCLCISVFSFPVLISCVWLPGPNNAKYPMVVH

SEQ ID NO: 160072 - protein, 70 aa, Triticum aestivum
  Clone ID: PAT_TA_54490.pep
APNISGKTLANPIVFMLSAVIMLPPLQFNAQAAGFPNPFLQTIPKGKYRPLVFGGRSSPSDSPKPVCVHI

SEQ ID NO: 160073 - protein, 85 aa, Triticum aestivum
  Clone ID: PAT_TA_54491.pep
GQTGTTLFFKGDEAGNTTRPIKGGGAKPAEGASRAGPPGGGTGPPGPRANYKLFNGNNLKKRYGSGNYRGGGHQTCPPRGPREGS

SEQ ID NO: 160074 - protein, 122 aa, Triticum aestivum
  unsure (1)..(122): unsure at all Xaa locations
  Clone ID: PAT_TA_54492.pep
PPEELSPPPRVQGGYMPFSCGXKRSVWLLKVPREIKGFKAFGKLRFERFNQCQLGAPIKKPPQAEKEKKKFLVFFFFFPASECFPRGLFFIFFLGLEKKTPGGFLYLGLVCIIFCSVFPLLA

SEQ ID NO: 160075 - protein, 136 aa, Triticum aestivum
  Clone ID: PAT_TA_54493.pep
GLPAQEGTLFAGPALASPMSAPGRSRDVLGLFPGREGEMDPKAVPVVLPACPRPGMVSKGREVFPRVRRPALQPYTCMVEMLGRPGEVKKPKGLLARMEAPPARVICMGLLPPSRGHGRVNVAKKVARFMSEYGLV

SEQ ID NO: 160076 - protein, 201 aa, Triticum aestivum
  Clone ID: PAT_TA_54494.pep
MVSLAAPAFHSLVAKTSRACTTRASSQRESAPGRPGAKARPRAAGTAQAAAVEAEETPRFRWDELGSDLSEPQEQAMRGLSPKLPNRCRALMPRVVSLSPGDENLGVVLAFWVKAMKPKRADWLLVLKELKAMESPLLAEVLEYALLEDSFEANVRDYTKLMQIYGKQNLLPEAEEAFQAMKARGLPCDQVMLTALVDMYS

SEQ ID NO: 160077 - protein, 163 aa, Triticum aestivum
  Clone ID: PAT_TA_54495.pep
MAMMGIIKTDIAPETAYETEPMSQATASSAAAGARYRRGLLSRMMPRGHYSSVGAENGRAPEAAPMPPAAADGSEVAEKPRRGWLRRLIPQQRRRWKNLGGASASRLAGLSRSLRWKRLSVNLRGSWASALLDTVAFRVMYVVEAIVLGLALSCFFCCCGCQI

SEQ ID NO: 160078 - protein, 76 aa, Triticum aestivum
  Clone ID: PAT_TA_54496.pep
DCELDLSIMAPRELSLVIKVAEHACYYLDFTVFPPSVCGDDITTLYQCDVRTRNASVIGCIKCAMNFINYILFLMI

SEQ ID NO: 160079 - protein, 115 aa, Triticum aestivum
  unsure (1)..(115): unsure at all Xaa locations
  Clone ID: PAT_TA_54497.pep
PRVRVNLCLTNQTEXTVGPFEVFLAPSVSGEQKTVLVNGLQKLVLPLVEAFESINFDLSMVATQLGVQKISGITLYAVQERKHYEPLPDIEVKCSNFGVKFVSSFAEVNGRILVC

SEQ ID NO: 160080 - protein, 148 aa, Triticum aestivum
  Clone ID: PAT_TA_54498.pep
MESPPPKRDVSHGGEDGISALPDSLLLDILERLDLREAVRAGALSTRWRHLPGHLSRVRLDVAHFRGARRFEVMDAFTGAVRALLTRVPPAEGVCGSSALKVLFLSFYTSSPHLSSIGRLIEDIVSLGHTQCLEFCISPPGTNPLGSN

SEQ ID NO: 160081 - protein, 71 aa, Triticum aestivum
  unsure (1)..(71): unsure at all Xaa locations
  Clone ID: PAT_TA_54499.pep
CPPGTPARITKKXPPLPPTSIKIKVVAPPKRKSSVWIEGSILPPLSTSPQMWIPKGEYNKPGPPIAPRKSF

SEQ ID NO: 160082 - protein, 119 aa, Triticum aestivum
  Clone ID: PAT_TA_54500.pep
ALNIHPIFSNISAKLSNFPHESPVYTRVKLKGTNMQMRTEIQMYIYILCTPSEASFTSPPCAPGRLLLPWTTLCTAPSPPSQRSSSRIVHSRSWGRVFAVWNPPDMDIDHHSRRQRTIT

SEQ ID NO: 160083 - protein, 51 aa, Triticum aestivum
  Clone ID: PAT_TA_54501.pep
PGGGTPQHIGRVSPAPRNAPPGQKVGFFPARRPGCFKGQVPPFSAKAAKAL

SEQ ID NO: 160084 - protein, 69 aa, Triticum aestivum
  Clone ID: PAT_TA_54502.pep
IKIIPFGVGRRICPGLGIPMLPLEYFVANMVREFEWQEVPAKEVDFPEKNEFPVVMKKPLGPPLVPRRA

SEQ ID NO: 160085 - protein, 101 aa, Triticum aestivum
  Clone ID: PAT_TA_54503.pep
PNPEKKNSPQKGGRPMGEWLLKPTPANLFRRGFLKGAGIQKWAGVFTKQPNYKKPHSLFQEKPYKVGNLGFIPPPKKLEHLKGGGLKILGGPPHHVGFLGA

SEQ ID NO: 160086 - protein, 38 aa, Triticum aestivum
  Clone ID: PAT_TA_54504.pep
FRGPTLLTFYIHTLKRLESCSDMETQMNRSWADQGEQV

SEQ ID NO: 160087 - protein, 123 aa, Triticum aestivum
  Clone ID: PAT_TA_54505.pep
GEQSRAAKQSKEIKRDGVQGIPSSGPSRAHLRPARGRRPCPALHRRHQGRRRICRRTAATDFHRHPWPLLHHWRIRRDWKAFSHGRRQVLHDQHPAGARPPASCPAVRSVDHEVQPSLRPTTV

SEQ ID NO: 160088 - protein, 112 aa, Triticum aestivum
  unsure (1)..(112): unsure at all Xaa locations
  Clone ID: PAT_TA_54506.pep
RGRPTTSRPRVSPTHAVEKPVRELVQYDEWLNGEMIDTVQLCGAEIVKXRKLCSALSSGRSASDHIRDWGLGTAQETLDIMRESSHGRYRATGAVMYFMLATGTALERTAST

SEQ ID NO: 160089 - protein, 90 aa, Triticum aestivum
  Clone ID: PAT_TA_54507.pep
FFFFFFFFWVFFFFFFFFFFFFFFFFFFKNGVPPNFYKPHLYFAPIKFQGGPFFHPLKSTSELIFLHTFYFTTSSQTLTRAFFLLNWASH

SEQ ID NO: 160090 - protein, 145 aa, Triticum aestivum
  unsure (1)..(145): unsure at all Xaa locations
  Clone ID: PAT_TA_54508.pep
KKESEVQNTNKRNXNLRDQIKQMPGKVGGWHQRXAKSNESMISALKYNLEQVCAHQSKDFKKGCGASEVDDTASCCNGGAVNLQLMPKENNHPKDLPACRVCKSSKGCMLLLPCRHLCLCKEWESKLSFCPPPPPSKILGKKKNM

SEQ ID NO: 160091 - protein, 109 aa, Triticum aestivum
  Clone ID: PAT_TA_54509.pep
PPPNGRGRWPAKSAPFVLDFLKNAERNPGVKGLGVDTLSLSPIRGDQAPKQGGGTYRGPGGINPYRANPCPLELFLSKKEEPVKKGADNVVAPREAFLAPGRGAFVPPF

SEQ ID NO: 160092 - protein, 84 aa, Triticum aestivum
  Clone ID: PAT_TA_54510.pep
ASTIHVASLTYWACMLYRNSKIILVNKTCYLILLQTAKVCLMLYRLATILCLHSSSTAIYVIRHDNKLCFITFCKSHDLQSLMH

SEQ ID NO: 160093 - protein, 205 aa, Triticum aestivum
  unsure (1)..(205): unsure at all Xaa locations
  Clone ID: PAT_TA_54511.pep
PRVRASVIHERHVRSCPQDHRQFKQRYFEFLDYHDDPNGPVFLRICGESSCDGLPNDYLAVIAKKFGAAVVTPEHRYYGKSSPFDSLTTDNLRFLSSKQALFDLAVFRQYYQEKLNSQYNRSAGFDNPWFVFGVSYSGALSAWFRLKFPHLTCGSLASYGVVLAVYNXTDFDKQVGEFAGPECQARLXEITRLVYEQLRFDSHSV

SEQ ID NO: 160094 - protein, 115 aa, Triticum aestivum
  Clone ID: PAT_TA_54512.pep
EQGQGPKGPQTLFGVTIRVFFLEQPGPQGGGNYNALPEICQKGPKDFKRNPIRSKPLPIDSKLAGAGDITTWSDEFFTGASREHWARVALPPILLQGLEEEVWPPFGQRIWGRGG

SEQ ID NO: 160095 - protein, 98 aa, Triticum aestivum
  unsure (1)..(98): unsure at all Xaa locations
  Clone ID: PAT_TA_54513.pep
RELFAPVLVPPRKGGFRSWSTSDGRGRGNKDXSEGDVRCTANAKRKVPPHVLVERGGRLAERSRGAYSMCTGKGRTFKGGDFXKIRNLVLRMTGFFQK

SEQ ID NO: 160096 - protein, 119 aa, Triticum aestivum
  Clone ID: PAT_TA_54514.pep
FPRPRGPGPTGPQRKPGPDGAWGVHPIARVPGKGQGGPPVARAPVARFPQAHHPAQGQRGDPPGPEVRVEPVPRRQRPPRGGHLLFPAGAGPRRRRPGAQRQGAQGGRPPRPVTTTGSC

SEQ ID NO: 160097 - protein, 85 aa, Triticum aestivum
  Clone ID: PAT_TA_54515.pep
PGEKPCNALDACCMVHDHCVAANNNDYLNTRCNENLLGCLDGVNPAGPTFPGNKCSVGETAFVIKGVIEAAVLAGKILHKRDIGQ

SEQ ID NO: 160098 - protein, 54 aa, Triticum aestivum
  Clone ID: PAT_TA_54516.pep
GGLPKQNQVWSQRGLPKWSGGTNKGLKKKNYFQKKRLPINLIKGQTENWGLTKL

SEQ ID NO: 160099 - protein, 161 aa, Triticum aestivum
  Clone ID: PAT_TA_54517.pep
MKGAKSKGAAKADTKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAVAKEVEEEDEEESDKSKSVINDDDDDEGSDEDEDDDE

SEQ ID NO: 160100 - protein, 77 aa, Triticum aestivum
  unsure (1)..(77): unsure at all Xaa locations
  Clone ID: PAT_TA_54518.pep
FLPDPPDRGEAESAAGGXRGQRPDRRPLQVRPCSASLRSFSAEWSARSGPWATLKILTGRCSAPAWSWSGERVRTGS

SEQ ID NO: 160101 - protein, 98 aa, Triticum aestivum
  unsure (1)..(98): unsure at all Xaa locations
  Clone ID: PAT_TA_54519.pep
PPTPPPPPPPPPTPTPPPSTSHPSPPPGAPPSSPPXPPPPSPAXPDQPRXPPRQAPDPVRQAPQGPKTDLPCQGKRWQVSSCAGLPTCQTWEQGPLGG

SEQ ID NO: 160102 - protein, 69 aa, Triticum aestivum
  Clone ID: PAT_TA_54520.pep
RTRGRTRGRTRGRTRGRTRGRTRGRNSSIKRRQDVILNRNDDSVYRTLVVTSCFAHLFSQELMRRCCLN

SEQ ID NO: 160103 - protein, 226 aa, Triticum aestivum
  unsure (1)..(226): unsure at all Xaa locations
  Clone ID: PAT_TA_54521.pep
PTLPPTRPPTRPPTRPLGTALMQDPTMSSMLENLTSPTHKEELEERMSRIKEDPALKPILDELENGGPAAMIKYWNDPETLQKIGQAMGTTMPFSTVSTAEPSGTEETEEEGEDEDESIVHHTASVGDGEGLKKALDGGADKDEEDSEGRRALHFACGYGEFKCAEILLEAGAAVDAMDKNKNTPLHYAAGYGRKECVDLLLKHGAAVTLXNMDGKTPIDVAKLNN

SEQ ID NO: 160104 - protein, 136 aa, Triticum aestivum
  unsure (1)..(136): unsure at all Xaa locations
  Clone ID: PAT_TA_54522.pep
ALPARPNIRKTNGLTKSNQRGLLNRASEESAEEQSYSSAVLTPNLFTFTAADAYGSIHEFXSPLINMMKAACXDLAAAANSIEPDVHDTRRAHIDVCXESYMCQTIFAGLHDENLSLDAANATVSNEAFLHQFLCL

SEQ ID NO: 160105 - protein, 117 aa, Triticum aestivum
  unsure (1)..(117): unsure at all Xaa locations
  Clone ID: PAT_TA_54523.pep
PPPVAAPGPLPPPTRRPRSXRPPRRXGXXXRAAXRAXXXATGRXRRPARTGTPAGGATATTXPRRPXXPANPPGATRXTPGAPPKGQPPPPAPRSXRAQPNRTTXARXTTASRPPDD

SEQ ID NO: 160106 - protein, 49 aa, Triticum aestivum
  Clone ID: PAT_TA_54524.pep
MPRRAQLMRLFLGEPVWTAHNRPQEDHPVRQEYVKRLMDDNAGLALAAH

SEQ ID NO: 160107 - protein, 105 aa, Triticum aestivum
  Clone ID: PAT_TA_54525.pep
GISVIREIPGGPFILNVGSAASASIFGCNIYPIVWPPFQYLCWHTRSPSVPADLNPERRYRSTPFLGGREGTPGSSLFPGRRPLYYRLLAMMVSGVPLVPPYNFG

SEQ ID NO: 160108 - protein, 88 aa, Triticum aestivum
  Clone ID: PAT_TA_54526.pep
PSPGPAPTTSVGGRGGRGERRRRRSAGGRRADEWSAAEAHSVAGRGGEYGEGRMQRRVDRRHWSGGVSLRVSPRVRPRVRGRVGGSVG

SEQ ID NO: 160109 - protein, 113 aa, Triticum aestivum
  Clone ID: PAT_TA_54527.pep
IPRPVLGSTTMLVHAFLQGILPAIRAQHIELKHLLTVRGELGNQVLDVGDAAGLLLGAPAGLVDHGGARGVLLLARATELGVLAEASGRSRDLTTLAFRLAAIISCSPFLFNL

SEQ ID NO: 160110 - protein, 264 aa, Triticum aestivum
  Clone ID: PAT_TA_54528.pep
PTRPVGHATVSPSPPVPLRVAPGTREMLVYTGLVQVVLWFGAMPLGFLPPVLASNCRWLPFLSSSSSPWWRKGGGAGSGEIPLNKLAGHSDLELKLLLPYFSSSCHGGGLEEEEERGFGCSILSACPWSPSSAANGWGSWCREHQEFLATAPLYLLVERRPLGVLATTSGSCISSWPPSHMGGSLSGSLSWYFHGLPPVVCRRCCSHSFTPSGFVPGGGGIGPGSKTAKRTRLLFIFVGWGPICKCPAWGVFFLLLGLLYMLHA

SEQ ID NO: 160111 - protein, 246 aa, Triticum aestivum
  unsure (1)..(246): unsure at all Xaa locations
  Clone ID: PAT_TA_54529.pep
STQRVRWFSKLQEFVVAGATLTAENDLAISICPALVPSAESSNEYICYFNSHWNPSREAPATSRAADSPLTSSEFLSRCYRVTSDGDGVLHIAAWHGNVKLVVDIWKNHGALSRVLLSAVNNRGDTTLHYAAHRGHDDMVKLLFGIMSDMGIAKFQRAQNLKGDTCLHEAVRHGHAKVVEILISEDENVQGLESPSLVQIVDNDGISPLYLATTLRRIDIVRALTQRPYKYVASFAGPAXKTALHA

SEQ ID NO: 160112 - protein, 120 aa, Triticum aestivum
  Clone ID: PAT_TA_54530.pep
KVTSSKNLPPRKSTCRPTRPRRRCVHTIMYPPDLRDAERRLCLIHLPLNHVAAAPARWHDAALVTSVRLRLARHGMRRDPGPPRHLDAQHQPRPSAQVHLQGAVPCANYADSIRCQGGRG

SEQ ID NO: 160113 - protein, 69 aa, Triticum aestivum
  Clone ID: PAT_TA_54531.pep
KARGHTFLQIHKSRAGTPAFLKLKQGLQRAKNVMGGNYTYNWMARVNYRKSGDLFPEHKSWGMGHCFIA

SEQ ID NO: 160114 - protein, 127 aa, Triticum aestivum
  unsure (1)..(127): unsure at all Xaa locations
  Clone ID: PAT_TA_54532.pep
GPDSIMFDIFSNVWPNSYKPDRCKVPVDQHLDGGTFSWVKKNWGLHPPPGFPVGIDLRGSLPSPTPGNRRRVRQTWGRGFXRGCAWETGRGQAASAAAALRLALGLAGPGGPGTWAGRRGLCRGPGG

SEQ ID NO: 160115 - protein, 75 aa, Triticum aestivum; identical to SEQ ID NO: 117166
  Clone ID: PAT_TA_54533.pep

SEQ ID NO: 160116 - protein, 169 aa, Triticum aestivum
  unsure (1)..(169): unsure at all Xaa locations
  Clone ID: PAT_TA_54534.pep
MASGGVLPLASLNHISIVCSSVEESLRFYMNVLGFIPIRRPGSFNFNGAWLFNYGIGIHLLQCEEPQSLPGKTEINPKDNHISFQCESMMAVERRLKELGIPYIQRCVEEGGIYVDQIFXHDPDGFMIEICNCDNLPVXPLADHTFXHGRLQEGRRRQATAEAGGGTSS

SEQ ID NO: 160117 - protein, 168 aa, Triticum aestivum
  Clone ID: PAT_TA_54535.pep
HSSAESLMFLAHFVGDVHQPLHVGYEEDEGGNTIMVRWYRRKANLHHVWDVSIIDTVMKDFYNKSLDTMVGALQTNLTEGWSDDVGHWENCANKRATCANDYAIESIHLSCNYAYKDVVQNITLGDDYYFTRYPVVEKRLAQAGVRLALILNRIFDKKKADTMPLYVQ

SEQ ID NO: 160118 - protein, 122 aa, Triticum aestivum
  Clone ID: PAT_TA_54536.pep
DYLGNPSLVHAQSILAIWACQVVLMGPVKGSPIAGGPLGEIVDPLYPGGSFDPLGLADDPKAFAELKVKEVKTGPLPMFSMFGFLGQAIVPGKGPLKNLVDPLSDPVNNNAWGFAPNFVPAK

SEQ ID NO: 160119 - protein, 63 aa, Triticum aestivum
  Clone ID: PAT_TA_54537.pep
LTSAGPKFIARIMEHYICGAGSLPAVYMYANTRCAKVRNWLANKANGTCSLKPRPELDLVTTD

SEQ ID NO: 160120 - protein, 88 aa, Triticum aestivum
  Clone ID: PAT_TA_54538.pep
GIGFIHMGAVAFYTGQKIKLVPHVHLQKFVQKYNYMSTVLIRPDDFKPSSYRCTHLWYNLQMIILFHNVFASVHVIACCTSMFFSTDF

SEQ ID NO: 160121 - protein, 77 aa, Triticum aestivum
  Clone ID: PAT_TA_54539.pep
LSLCHITSMWSAVFICYLNFFTVAFSLAKLLRIANPGSLSFPSQISRCFYCWVVLGCSSLEPKEFCVVLRVFEMSFK

SEQ ID NO: 160122 - protein, 79 aa, Triticum aestivum
  Clone ID: PAT_TA_54540.pep
GVPKSRGASTLPNFFFFNPLGKSPPPPQKKSDGQISPFFAFVQFSRFFGPNHCPFCWASRGGMTWGPAAPAAALYPPLP

SEQ ID NO: 160123 - protein, 130 aa, Triticum aestivum
  unsure (1)..(130): unsure at all Xaa locations
  Clone ID: PAT_TA_54541.pep
PPPPPPPPPPPTPPTATPPPPPPPPPPPPPPPPPPPPPPPPTPPPPHAPPPRTPRPPTNENTXXAPPSALXDXPPHRAXGXPLXRRHALGPGLHRGXTPRTPPPAPPRTGPEPRPPPMHPLACSPPGQPL

SEQ ID NO: 160124 - protein, 185 aa, Triticum aestivum
  unsure (1)..(185): unsure at all Xaa locations
  Clone ID: PAT_TA_54542.pep
SIAPLLYARPGLTLAPRSSVHYTASPWTPVLRLRLRSVLPDAASANPSTAVIGALHGVTMDAGAAPAAPISPPRPRLSPCALHRLLVVVPGASIDWRSDGPLSSCQCASVKEMNRDVPPQIHCVKGDGSQRERCSPPELLDPKIGRVTWLFDAVVLVGGMVQHATXMRFLAGWTVFXRTPVLTEY

SEQ ID NO: 160125 - protein, 100 aa, Triticum aestivum
  Clone ID: PAT_TA_54543.pep
TSPRGRGAPSTPPGPPGRGKRASPKSPVEETPNPPPLGPHWGQLPFSGFTSRPPRMGNPGPMDVSPPPPRARGGPFKNKAPAYPPPQFFIPPPGFCPPPP

SEQ ID NO: 160126 - protein, 128 aa, Triticum aestivum
  Clone ID: PAT_TA_54544.pep
TPPGTRQTKPPQPKIFFPPLPPAQGENGPHFPHPGPQGGDQDPPQKGYPPLFPQLPTPPKQSQWSNCFPRLNIFRFQGGGGPFFPIFFFPLNFKFDSPPGPFLGEFIFFFFLKAPPLLGLKKWNPSLA

SEQ ID NO: 160127 - protein, 103 aa, Triticum aestivum
  unsure (1)..(103): unsure at all Xaa locations
  Clone ID: PAT_TA_54545.pep
PRFVPLXXXSXGCRCLRSFVRGVXXCVXXLXPXPPASPXXXPXXXPCPPPGFAFGSGXFVPVPVVLXXVWGLLALXFCPVGXXPXXXALFRPXXXXXPPPPPP

SEQ ID NO: 160128 - protein, 69 aa, Triticum aestivum
  Clone ID: PAT_TA_54546.pep
NHIRNAIKKNDAHLVNSTMRPCDGLGCSRTCTLMTNNTWLIGLDVSNDDPYMKTHLAKQKNDVHAPNLL

SEQ ID NO: 160129 - protein, 222 aa, Triticum aestivum
  unsure (1)..(222): unsure at all Xaa locations
  Clone ID: PAT_TA_54547.pep
MEKHSDEENISGGGKIAGLEPMNFIASATPHLGSRWNKQLPFLFGVPLLEQTAAETAHLIVGRTGKHLFLSDRDDGKPPLLVRMVEDCDDGKFMSALRSFKRRVAYANITYDLGWSTSSIRRQHELPKLELEANNEKYPHVIHVDTANSEGSQQEDSVDTSLTDSLEEEMIRGLIQVTXERVDVCFHESRLKYNAHYNIQVRTPMNLEGEDVIYHMIDNXLV

SEQ ID NO: 160130 - protein, 80 aa, Triticum aestivum
  unsure (1)..(80): unsure at all Xaa locations
  Clone ID: PAT_TA_54548.pep
IGLCPESINTSFLTNFYGVSALLSGESDSAGKPGARTGRERWFDGXVEPAQLGLCACLCGPAGSPLFCVSAVSWCVSPLG

SEQ ID NO: 160131 - protein, 82 aa, Triticum aestivum
  unsure (1)..(82): unsure at all Xaa locations
  Clone ID: PAT_TA_54549.pep
RGGPRTKTPPSPSSRGPXCLPPPPTSSRPPPPSSPPKFYPPPPLRFPLWPLNLPNHPPLKSIFGPAYFNVCKPQTLPVSPPP

SEQ ID NO: 160132 - protein, 87 aa, Triticum aestivum
  Clone ID: PAT_TA_54550.pep
PGHAQRPRTKASTPQSITQGGKRLKPKSKICFTAFFSPPGPEKMARIAKLDPPTRVSQFCRSAGIVDPPPPAAVGGRHLVHGSPPNI

SEQ ID NO: 160133 - protein, 145 aa, Triticum aestivum
  Clone ID: PAT_TA_54551.pep
ITGASTLPKDEVERMVEEADKFAQEDKEKRDAIDTKNQADSVVYQTEKQLKELGDKVPAPVKEKVDVKLQELKDAIAGGSTQSMKTAMEALNQEVMQIGQAMYNQTSAGGAGSTDAETEPGAGSTSSGKGPNDGDVIDADFTDSN

SEQ ID NO: 160134 - protein, 143 aa, Triticum aestivum
  Clone ID: PAT_TA_54552.pep
SIYTCSTSEINFDIDLFLIWVNAASPCLALSITMHKAATTHSAEIQQVKEELYHMMSENRDKIGNHKGLIKHLSSHVEPKPEDPVWRFYRRAKWYHLVMMYSPTFLYGYMSMCDVPDGKKEMTPADKDDFNKRMAALMPNVQL

SEQ ID NO: 160135 - protein, 73 aa, Triticum aestivum
  unsure (1)..(73): unsure at all Xaa locations
  Clone ID: PAT_TA_54553.pep
VGVGQLARVXRTRHPVGDGPQVVDGLGAHGVERVVVERAHQGPAARGLRRGVDAVRRGGVEVEVVEGSEREAA

SEQ ID NO: 160136 - protein, 113 aa, Triticum aestivum
  Clone ID: PAT_TA_54554.pep
ICRGKHSKLSCVCGPHGALILVLNYFPVGGDAYWEISRPFKSKGGGNGERVPRHLWEHSWGFFFLSGRGRIIGGSWNVGRRRGGGLLGAHTGTHWCLGGVLWPGQPAVRLRAG

SEQ ID NO: 160137 - protein, 254 aa, Triticum aestivum
  unsure (1)..(254): unsure at all Xaa locations
  Clone ID: PAT_TA_54555.pep
ELRRSCSGSNGRYSASPSSSRSAAAAHGGRVSGEGGAPPPAPAPATSHPSGWRTFPRHCLQTLVIATGSTCKIVTKRRDSTCYNVTALKEAVRTSIVSTSCKMLWTFHCNLCFYDPNELDDDPSMLPLESDEEATVDEYVKTSQAKMKTKXDKFIEAVNCVIQRHSGVGVSKFSIWCGLHKEEFEHLDRWISFAAXSKEKIVDFDLKKIDSPSKEVHQFPLEALVVQGSSCVQSLYLADASIKPHXSICGFQLL

SEQ ID NO: 160138 - protein, 127 aa, Triticum aestivum; identical to SEQ ID NO: 124219
  Clone ID: PAT_TA_54556.pep

SEQ ID NO: 160139 - protein, 50 aa, Triticum aestivum
  Clone ID: PAT_TA_54557.pep
NAPPLFFFFFFFFFFFFFFFFFFFFFFFFFFFFFFFFFFFFFFFFFGRRG

SEQ ID NO: 160140 - protein, 208 aa, Triticum aestivum
  unsure (1)..(208): unsure at all Xaa locations
  Clone ID: PAT_TA_54558.pep
MLAPPPSAASSMPAPRHGVAPRLLRCPKGSSTAAPAPXSTFATSTLPWRPRAPAPVSPSSAATGGPPVARPSPCRLPSASSLPCRGSTGPTFLAALPMLLRPRSTPPXAPSPQAPPXPARSNKSGAFPSPAAVLLLPPRRPTSSTPSLPALAGLSHPSYAVAAAAPPASPSSASSLHHRPSTSTPAPAIFSRCLCNPFTANLHESSTC

SEQ ID NO: 160141 - protein, 33 aa, Triticum aestivum
  Clone ID: PAT_TA_54559.pep
RAICFAEACPSTVLSRRSQSVKLRKRDQVGTID

SEQ ID NO: 160142 - protein, 95 aa, Triticum aestivum
  unsure (1)..(95): unsure at all Xaa locations
  Clone ID: PAT_TA_54560.pep
AQSCDDQSKAGLDAFFLGKALAEALTERAKMAVVEVSNXLCTRQAEQQKQVQEFQDEVLQRAQKANERAAEDVIHDKGPETLIGPSTSIRTPAPM

SEQ ID NO: 160143 - protein, 82 aa, Triticum aestivum
  Clone ID: PAT_TA_54561.pep
NWGPQKKKLTPPTPGRKNGAPKNGPPLFFFFFFFLFFFFFFFFFFFFFFFFFFFFFFFFFFFFFFFFFLLSKVKINMIDIAN

SEQ ID NO: 160144 - protein, 185 aa, Triticum aestivum
  Clone ID: PAT_TA_54562.pep
PRVRAHHINKHNFRVPFVCGCRDLGEALRRIREGAAMIRTKGEAGTGNVVEAVRHVRSVMGAVRALRNMDEDEVFSYAKQIAAPYDLVMQTKQLGRLPVVQFAAGGVATPADAALMMQLGCDGVFVGSGIFKSGDPARRARAIVQAVTHYSDPEILANVSAGLGEAMVGINLSDPNVERFAARSQ

SEQ ID NO: 160145 - protein, 83 aa, Triticum aestivum
  Clone ID: PAT_TA_54563.pep
IKGPAGLGENLAEKILGVKKSPGGLLVEKGSPLVLKKKKKKRKKKKKKKKKKKKKKEKKKKKKEKKKKRKEKKRRKKRGGAGF

SEQ ID NO: 160146 - protein, 251 aa, Triticum aestivum
  unsure (1)..(251): unsure at all Xaa locations
  Clone ID: PAT_TA_54564.pep
VGGAANPLASKGFFLRLAVRALFPTTVRAKRDKAAAKRATPPQRKQSDAQGRGGNSGGGGGGGGGADGGGGGRGKKRKNKGGAFIYGNYRNYYGYRIDRNGGEDPRLEIFKKEWFAGKDCLDIGCNQGLVTIGIAMKFECQSILGVDIDKGLIDLANWNLRRISRTGNMAPESAKVHNSSDSTTKSCPEEVVSEMPNGNISKYEQPDLFEIVSFRSENFVQSXHKYAEQYDTIMCLSVTKWIHLNWGDDGI

SEQ ID NO: 160147 - protein, 145 aa, Triticum aestivum
  Clone ID: PAT_TA_54565.pep
MFKKKGGKGNKILFSIGATETNQKHPKTWVTWEGKKFQGKILKTGPIEGEGPFFPGAPVEKKQVHPHLGGFFSPPKKILGRVKNLPEELGGPQSNFPKWEKVPSQIGTLPRENQKGRAWVEFEKKGHAYNLFQRKAMEKNIIAGG

SEQ ID NO: 160148 - protein, 253 aa, Triticum aestivum
  Clone ID: PAT_TA_54566.pep
PFSRATFMLPALSSVRLRPPNAVAKWSLEDGSKVADPYTTWMHINTEKLHISKLLLCSPNLVAALVGIGHTSQILMCQPGASSWSVRAYDQCKGFEDMAFYQGKLYAIANDENLLVVNISQDHSTGDPQVSRIGQIIKGEPWYPAVFEDDTMCCKKLYLVESHGVLLMARRTIMCQVPGPGAVPIEVAGLTGFEVYKADFEHSRWVKVSTVGDDQLLFLGRRCSRAMSVSQYRLPGDYILFLDDDEENRMDYC

SEQ ID NO: 160149 - protein, 128 aa, Triticum aestivum
  Clone ID: PAT_TA_54567.pep
PMSRLQNNPGTTTFIAWPDNLGAACIYIALRLILIGPEGRAMQPDASHRKASRRYRDEGKGHRRIPFYRRRKKCSPCRSSSPYDSPHHHPRRGYNHQATCTETQTWPWSTFALEQQLVIPHGRYLDPP

SEQ ID NO: 160150 - protein, 44 aa, Triticum aestivum
  Clone ID: PAT_TA_54568.pep
FTWNYRGNSELDKSDNHRALGSGRGATKRTRGRTRGRTRGRTRG

SEQ ID NO: 160151 - protein, 249 aa, Triticum aestivum
  Clone ID: PAT_TA_54569.pep
FRWSHMKSIVKQYVQHCTVCQQAKPKRVPYPGLLQPLPIPSLSWEMVIMDFIEGLPSSGRFNCILVVIDKLSKYGHFIPLVQVVAEAFLNFVYKLHGMPLSIVSDRDRIFTSLFWKELFQRTQGTQLRMSSARHPQSDGQTERVNQQVECYLRCFVSAHPSKWAKWLPLCEYWYNTNWHSATSKTPFEIIYGHLPRHFGITPDCTVASPDLALWLDQRQVIFESVKQQLLRTQQRMKAQADKHRTERTF

SEQ ID NO: 160152 - protein, 133 aa, Triticum aestivum
  unsure (1)..(133): unsure at all Xaa locations
  Clone ID: PAT_TA_54570.pep
VLAKFAGATLETERLQSCGVAGGWRPCYQLSPIYFCTGXHKSPDHFGSNTFGHAPGMHYGRVDALAPCAVCXNAGRTINPKVFNEGDHEGSXCMWLETFEGEALQCTTALTSILYECLIHSMLGGATDHEEST

SEQ ID NO: 160153 - protein, 152 aa, Triticum aestivum
  Clone ID: PAT_TA_54571.pep
VVEQPQKKAVKDEIFLQSLQDLFVAADKYNFQRLKFFCENQLCEHVGVSSVGSTFALAEQPPCHGLKAACFKFIQVLFPSGLRALMATDGWGHIATTSPFFLYELIAILGSNQRKCPFGMHVFQVPLFCILYKNRSLCAPLLIVPPCNLHEC

SEQ ID NO: 160154 - protein, 205 aa, Triticum aestivum
  Clone ID: PAT_TA_54572.pep
KVVFASPAEHFTDSAPIGNGSLGAMVWGGVASEKLQLNLDTLWSGVPGDYTDPKAPAALAAVRKLVDEGRFVDATSAASGLFGGLTEVYKPLGDMNLEFDTSNQEYSSYKRELDLHTATTIITYNIGEVQYTREHFCSNPHQVIVTKISANKPEHVSLTLSLNSKLNHRVRVMNANEMIMDGTCPVQGHKLQENEAHDATGIGFA

SEQ ID NO: 160155 - protein, 75 aa, Triticum aestivum
  unsure (1)..(75): unsure at all Xaa locations
  Clone ID: PAT_TA_54573.pep
LWTPNXAAPLFLFYFFILFFSFLFIFIFLFFFFFFFFFFFFFFFFFFSKPNQKNGQDWGAKNWGKKTRGARSGAG

SEQ ID NO: 160156 - protein, 95 aa, Triticum aestivum
  unsure (1)..(95): unsure at all Xaa locations
  Clone ID: PAT_TA_54574.pep
HKMGYNGVFTDTGVTDYRRSDDPIAPKGAIDGQLYLADPNDKQAKLDTCLIAKTNMGRLXHPRLAHVEMKNLDKLLKGEHSSGLTHAHAETDLGS

SEQ ID NO: 160157 - protein, 98 aa, Triticum aestivum
  Clone ID: PAT_TA_54575.pep
KAAEGVNPFGSSFGFANTALPKPYLESEVAENIVGAQSDVIPRDSGPKVVSAPQNPVVPIQKPKHDRLFTLAAFGLTLAIMALVIKKFFKINGLAGFI

SEQ ID NO: 160158 - protein, 40 aa, Triticum aestivum
  Clone ID: PAT_TA_54576.pep
QPPKPPAGLKGPPPENFPGGLKGPPAGNPPPELTGPLPGG

SEQ ID NO: 160159 - protein, 71 aa, Triticum aestivum
  unsure (1)..(71): unsure at all Xaa locations
  Clone ID: PAT_TA_54577.pep
QTGSHFSFFDALVQRKMATKVGMSGSGRTDRIALGSVNPFITHLRAAEKQLAIRLXLDQRVVWFSKGTLER

SEQ ID NO: 160160 - protein, 83 aa, Triticum aestivum
  Clone ID: PAT_TA_54578.pep
VLLLLNLSQNGNLTVKTLQIISGLPALVSLNLSSSRVSNAGLHHLRPLQNLRSLSLDSCKVTACEIKKLQLAALPNLVSVRPE

SEQ ID NO: 160161 - protein, 228 aa, Triticum aestivum
  unsure (1)..(228): unsure at all Xaa locations
  Clone ID: PAT_TA_54579.pep
MRLQCSLVLLIALSVGCAAAQESGKQAGYDFFYLVLQWPGSYCDTKQSCCYPRSGKPAADFGIHGLWPNRDDGSYPQNCNPDSAFDPSKVSDILSSLRSSWPTLACPTNDGLRFWAHEWEKHGTCAQNLFNEHGYFQAAXPPARPAPXLDALATAGISPDGGYYTMGAIKGAIQEGTGFAPHVDCNRDESRNSQLFQLYFCXHADAXRXVECPVQPRRRPCGXRIEFP

SEQ ID NO: 160162 - protein, 187 aa, Triticum aestivum
  unsure (1)..(187): unsure at all Xaa locations
  Clone ID: PAT_TA_54580.pep
PASAHASVLASRSFVHGRLPYDNIKPDPVLKQILKNMRMRKLIFTNGDMIHAVRALKRLGLEDCFEGIICFETLNPPCLLTPCDQAPEIFDIAGHFAGLGSADDLPRTPVLCKPNVGAMEAALRIANVNPYKAIFFDDSVRNIQAGKRIGLHXTVLVGTSQRVKGADHALESIHNIREALPELWEEA

SEQ ID NO: 160163 - protein, 174 aa, Triticum aestivum; identical to SEQ ID NO: 138445
  Clone ID: PAT_TA_54581.pep

SEQ ID NO: 160164 - protein, 223 aa, Triticum aestivum
  unsure (1)..(223): unsure at all Xaa locations
  Clone ID: PAT_TA_54582.pep
GRVGEDNLHGKRSKPALPWEKRYRAAVGVAEALSYVHSGCSRPVIHRDVKSSNILLTDDFEPQLSDFGLAIWAPSRPSSLTHSDVVGTFGYLAPEYFMYGKVTDKVDVYAFGVVLLELLTGRRPITGDGSPKGHHQSLVMWATPILNGGDISDLLDPSLDVKHDEVEVRRMAVAASLCLGRSARLRXPISQILSILRGEEDATSLAASEPDCVVDDETYPAAT

SEQ ID NO: 160165 - protein, 93 aa, Triticum aestivum
  unsure (1)..(93): unsure at all Xaa locations
  Clone ID: PAT_TA_54583.pep
DCMIAHGAAXFLKERLFXQSDAYRVHVCEKCGLIAIANLKKNSFECRGCKNXTDIVQVHIPYACKLLFQELMAMAIAPRMLTHEVKGARDKHR

SEQ ID NO: 160166 - protein, 167 aa, Triticum aestivum
  Clone ID: PAT_TA_54584.pep
GAGHVNPARAADPGLVYDLGVTDYAGYICWLLGEEGLVTIVRNSSLTCAKLPKVKDVQLNYPTLTVPLASTPFTVTRTVTNVGPADSTYAAKVNSPSSMTLHVSPKTLVFSKAGEKKTFSVTVSCQGVGASEIFVEGSLSWVSKKHVVRSPIVAIHGVGGHASAPSP

SEQ ID NO: 160167 - protein, 99 aa, Triticum aestivum
  unsure (1)..(99): unsure at all Xaa locations
  Clone ID: PAT_TA_54585.pep
PQPRXLQIPLPRPRLLNPVTSPSPKPLPSPQQNPPPSPLPSPQPMPLPSPLRKRLPSPQMAKPATRPPPMPRPSLLPQAATICELLALASFSLSLPSCI

SEQ ID NO: 160168 - protein, 81 aa, Triticum aestivum
  unsure (1)..(81): unsure at all Xaa locations
  Clone ID: PAT_TA_54586.pep
QQAQLRDALNQALTGEVQRLKLATGEITXARMSKAGLQQQMNSQLIQMQQLQIQQQQQQQSSQTQQAQQQHQQQQQSQQSA

SEQ ID NO: 160169 - protein, 96 aa, Triticum aestivum
  Clone ID: PAT_TA_54587.pep
DLLQQISCIDTGESAHAAPAESVGSKSGQQAVAPAAGKSVSERSSGCSTEPTPVREARSRKERAWYAGRCCLPTFVHSLALDDEGRQKTGPGPCAV

SEQ ID NO: 160170 - protein, 129 aa, Triticum aestivum
  Clone ID: PAT_TA_54588.pep
SRGDTGAYYSAMRRAPERRRRGAASAGLMFSSASSLGAAGPAGGQAGTSGCGGAGAGCGMVGSTAPRRSDGGNEERGSRDAFLHRGIFFLTSGLWIFLFRRSPESIDSLNGERAILDEICYLYKGKRHQ

SEQ ID NO: 160171 - protein, 90 aa, Triticum aestivum
  Clone ID: PAT_TA_54589.pep
LLSEKKNDVAANKKKKKKKKKKKKKKKKKKKKKKKKKKKKKKKKKKKKKKKKKKKKKKKKKKKKGGLFLRAHFFTPLWLEKNFFFWAPKF

SEQ ID NO: 160172 - protein, 116 aa, Triticum aestivum
  Clone ID: PAT_TA_54590.pep
RSRTSSTQPLTLAAPPPPSTSPSPPDRRCRLLRPARRTADWIQTSTGTMCQGSRRCRRACSVLCHPFSLPSTSFSGSSSIPARSSSTCIVRSVAAVAGGSSLRDWVCGCLFGDRIW

SEQ ID NO: 160173 - protein, 98 aa, Triticum aestivum
  Clone ID: PAT_TA_54591.pep
TAGTRGRNITVNEAHSRRSGGGGGGGGYGGQRGGGGGYGGGGGGYGGQGGGGYGQGGGGGYGQGGGGYGGQRGGGGYGGGGGGYGGQRGGDSGGQWRN

SEQ ID NO: 160174 - protein, 83 aa, Triticum aestivum
  Clone ID: PAT_TA_54592.pep
KRRRGGREGKGARRRRRRYTPPPGKVLSAREKAESAPRVSTLGSHKWSAQVSMVGSCGVVLTIRYLASRVGGAGLGSICVRLP

SEQ ID NO: 160175 - protein, 97 aa, Triticum aestivum
  unsure (1)..(97): unsure at all Xaa locations
  Clone ID: PAT_TA_54593.pep
RTVSSLCRTWWKVGYNRPTGYTRVRQGQLGGLTHTFKAIGDDVWDALSETSRGGXAGRMHRMTGDKSMELLIWVXIYKIEMIPFGSKIGFLTPGRLC

SEQ ID NO: 160176 - protein, 63 aa, Triticum aestivum
  Clone ID: PAT_TA_54594.pep
MSKQGGKAKPLKQAKVAEKDYDENDLAYLQKREDEQKALKELKAKAGQKGALGGSGLKKSGKK

SEQ ID NO: 160177 - protein, 78 aa, Triticum aestivum
  Clone ID: PAT_TA_54595.pep
YSITHHGPHVMRHWGCVNYDIVPGFPLHINTFLFATKIRIEHAHATNMTQESMLGCDMVPHGYAYAHAHNIIRTIRLL

SEQ ID NO: 160178 - protein, 26 aa, Triticum aestivum
  Clone ID: PAT_TA_54596.pep
IFIFSSNKLGQTLGSLTSVNTNMRSK

SEQ ID NO: 160179 - protein, 193 aa, Triticum aestivum
  Clone ID: PAT_TA_54597.pep
IDPPAYQATDQLAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKF

SEQ ID NO: 160180 - protein, 139 aa, Triticum aestivum
  unsure (1)..(139): unsure at all Xaa locations
  Clone ID: PAT_TA_54598.pep
REXXIWRXRXSYPLCFSSXRPFAFGPSXXXPCPFQXPXXLHSGGGAVHXTFQEFIHLXMXRIGXXXPXXGXXGXRHPXXRRXDGRXXAMAIVGPXIPAMDPXTGRIHSPVQSMAPCPPPXFRRXGGGGGLFSGRGAXXA

SEQ ID NO: 160181 - protein, 170 aa, Triticum aestivum
  unsure (1)..(170): unsure at all Xaa locations
  Clone ID: PAT_TA_54599.pep
TVVANWCYATVAPRARSYSIVGSLGTSVPWNYFYFRPNLMTNTQVQSAPVGPELMDADVDRLKDRFRSKLKTEDYDMIANVFEPVKAGQAPXSYMAFECADSRVCPSVTLSLEPGEAFTMRNIGNMVHYYXKNNYAGVGSDIEYPRCALRDEVIPWIGHSRCGGINALLS

SEQ ID NO: 160182 - protein, 51 aa, Triticum aestivum
  Clone ID: PAT_TA_54600.pep
CTYGLHRTCLGEVNPFYSITKLSLFFILEIDCFIILTLYMLVFLKCYLLRT

SEQ ID NO: 160183 - protein, 162 aa, Triticum aestivum
  Clone ID: PAT_TA_54601.pep
MAPIKLYGMMLSPNVTRVATLLNELGLDFDFVDVDLRTGAHKQPDFLKLNPFGQIPALQDGDEVVFELELNPPKSSTNLVAESRAINRYIATKYGAALLPTPSAKLEAWLEVESHHFYPPARTLVYELLIKPMLGAPTDAADVDKNAADLAKLLDVYEAHLA

SEQ ID NO: 160184 - protein, 107 aa, Triticum aestivum
  Clone ID: PAT_TA_54602.pep
QSRFCPVYFLCSSAPNVHDDMCPFRFTSQQRQSVQSWSCIAPSQQAIMCVHALCRCTPSPCGVSVRVLCRALLARTNRYRSWFSLPGLLFKHVYRSVRDASCAVYST

SEQ ID NO: 160185 - protein, 138 aa, Triticum aestivum
  unsure (1)..(138): unsure at all Xaa locations
  Clone ID: PAT_TA_54603.pep
ADAPMHSDSVWAGRYEPRPVYPLVXENLRIIAIVSRDXCSSKQHSFIHQLLSXQGRAWIIMCTNGDASXIIPADLDLAFALPTVYDXLQSEINILPLQLLAYHHDRCLLDSDLNQPTNLLEQRDHPTSLRKNMQINSL

SEQ ID NO: 160186 - protein, 137 aa, Triticum aestivum
  Clone ID: PAT_TA_54604.pep
MEELDEFEVLWPEYYAGHAHADDDHKPLPSVQSPATSWQRRAAGSRPVDVPPSRAAVLLLRWKDGTDHQDDLMEKDGGGGKIMVPPHLLVSGRRLSDGEAAAAYTLLRSGAARHGKRARDLRHLRNSVLRMTGFIEG

SEQ ID NO: 160187 - protein, 187 aa, Triticum aestivum
  unsure (1)..(187): unsure at all Xaa locations
  Clone ID: PAT_TA_54605.pep
PSHXKFLFLCFLLCFGLELAFFTAASDDQLLYHGFTAGTNLTVDEAASVTLNGLLELTNGSLGCKGHAFYPTPLHFRKSHDDTVQSFSVAFVFAIHSTYPIMSRQGLAFVVAPSMNFSTALANQYLGLMNSQNNGNLSNHIFAIELDTVLNIEFKDINTNHVGIDINSLQSIESNPAGYYDDRNGTF

SEQ ID NO: 160188 - protein, 142 aa, Triticum aestivum
  unsure (1)..(142): unsure at all Xaa locations
  Clone ID: PAT_TA_54606.pep
DEGGDAXPPXXRPXRRVXXAXXIRXXPVSVXRRXRKXXHXQNSXXHFXFWXVXXNMGMVKPXRRFGAXGTLXQXXHWVHXXLSMPTXFLPGWXXRMSHMSKPPXPSXQGVLVXTFDSFLPTAAQTXXAKEXXPRRERXXGTL

SEQ ID NO: 160189 - protein, 120 aa, Triticum aestivum
  Clone ID: PAT_TA_54607.pep
AIAVLSTLALLWHFIYWSVRRVTRVLGPCTHLTRQAARSQAGAQLSGSAHTARGRSKLLQVGTIEGITEAEDCAHSRRGTQLRLFLLKLITPIIYHMHAPRRASMIDHIDLLLPYHVAEY

SEQ ID NO: 160190 - protein, 106 aa, Triticum aestivum
  unsure (1)..(106): unsure at all Xaa locations
  Clone ID: PAT_TA_54608.pep
ALVEHLRANPISVCGLNVFEDEPYINPGVAXMKKAVVVRYMGFAWKWPRQGMARLRVLNVFGKIKGXPVWGNPNPVEPFLDEKAXPPLGCPSIVNGKQIGVPFSQL

SEQ ID NO: 160191 - protein, 88 aa, Triticum aestivum
  Clone ID: PAT_TA_54609.pep
ASLTCLLSPEAAHRCEHSMPRCIPSHSGAYSTCSVSDISCPPGSPFMFPIGGLGYYGNKKNTCAKCVSLLCSTLHTHPGTSSEYPPVP

SEQ ID NO: 160192 - protein, 97 aa, Triticum aestivum
  Clone ID: PAT_TA_54610.pep
YLIRSKWVPCLEFSKVGFIFREHNASPGYYDGRYWTMWKLPMFGCTDATQVINEVEEVKKEYPDGYVRIIGFDNMRQVQCVSFIAFKPPGCEESGKA

SEQ ID NO: 160193 - protein, 112 aa, Triticum aestivum
  Clone ID: PAT_TA_54611.pep
CHWGSRFSYTYYDKKHGAIHKSIKALDRLGMEIIETGDPDAFKQYLEEYENTICGRHPISVLLHMLKHCSTKIKVGFVRYEQSSQCKSTRDSSVSYASAVAKVDSPGEEGKD

SEQ ID NO: 160194 - protein, 142 aa, Triticum aestivum
  Clone ID: PAT_TA_54612.pep
YYQRTKKDYPSYTYYPSVVELAANSDILVVACPLNEQTRHIVNREVIEALGPKGLLINIGRGPHVDEPELVSALVEGRLGGAGLDVFEDEPNVPEALFTLDNVVLVPHVGSGTHETRQAMADLVLGNLEAHVLKKPLLTPVV

SEQ ID NO: 160195 - protein, 113 aa, Triticum aestivum
  unsure (1)..(113): unsure at all Xaa locations
  Clone ID: PAT_TA_54613.pep
QLAMGATFGLEPPTEVVDVDIATHIEIYDDGXXRSLLVVESADRPGLLVDLVKIIADINITVQSGEFDTEGLLAKAKFHVSYRGKPLIKALQQVLANSLRYFLRRPTTEDASF

SEQ ID NO: 160196 - protein, 182 aa, Triticum aestivum
  unsure (1)..(182): unsure at all Xaa locations
  Clone ID: PAT_TA_54614.pep
PGFPTRFFXSPSLTSCAVPGIHPEKPGVVRAAGYGSKGAFRPLPXXLMXXAAXSESXXREGQAVSYSYPSXAMACWWGWGSECVPQASFQPRCSVGWGXAGHWRSLAAPTLLVLLASSLLAFRXAAGAAFQAANLSAAWGGRTASSYFTXSISQMGPXEKLHSAHGFIFCILLGXSVLYLFH

SEQ ID NO: 160197 - protein, 96 aa, Triticum aestivum
  unsure (1)..(96): unsure at all Xaa locations
  Clone ID: PAT_TA_54615.pep
STGGLFWVMHKTDFLTAKLGVMAIRDSESEMIXGLQPQASIVSQALIXATCSRXWSFGARPAWLLTTAFLLAHLVATLICDYANWEFARIKGIRRC

SEQ ID NO: 160198 - protein, 70 aa, Triticum aestivum
  Clone ID: PAT_TA_54616.pep
FVVQGKHSANGNGQNTVCGFHSTKYPRDRDHLPEWTSSIVWSSNHGVYLKDKVDPNHMNSRKGAQVYNTC

SEQ ID NO: 160199 - protein, 83 aa, Triticum aestivum
  Clone ID: PAT_TA_54617.pep
GAKTLLDHVWVVEKGRAQRVQGGEPAPPPVRAHPGPRVRGHDGHRQPLHHRRLSLSDSRHLPLLRRLRVPGVDQHVTQPNWRP

SEQ ID NO: 160200 - protein, 114 aa, Triticum aestivum
  unsure (1)..(114): unsure at all Xaa locations
  Clone ID: PAT_TA_54618.pep
ESRPLSYAAXLSTEALLKQXXTTLIRSKWVXPCLEFSKVGFIFREHNASPGYYDGRYWTMWKLPMFGCTDATQVINEVEEVKKEYPDAYVRIIGFDNMRQVQCVSFIAFKPPGC

SEQ ID NO: 160201 - protein, 136 aa, Triticum aestivum
  Clone ID: PAT_TA_54619.pep
GEQPKVAELSIKSLVDGVDFSGSLTRAEFEELNHDLFLKAMALVESAMRQAGLDKNKELLDEIVLVGGSTMIPGIRRLVTDYFDGRELKNINASVMPDQTVTLGAALLSHPMANGYPCMGGDRRQWGYSTDWCFTD

SEQ ID NO: 160202 - protein, 63 aa, Triticum aestivum
  unsure (1)..(63): unsure at all Xaa locations
  Clone ID: PAT_TA_54620.pep
HYGHTLSHDAAHGTCTLGSCVTGTAHVSHERPTAQRERRSAWRPACLLARMWSRAXWFGLGSX

SEQ ID NO: 160203 - protein, 126 aa, Triticum aestivum
  unsure (1)..(126): unsure at all Xaa locations
  Clone ID: PAT_TA_54621.pep
AAFQSFKVNIRCLITLLLFLKLQKIVPQLTPLQTGSRSPCMARLGSPAHMSAQQVPITFPFSCPFPGLCCSYRGDHPSLGLSFFHVPCLSRXXSHAFCLCCXCXLGLFXVXXSLXXXGSXXGAGAA

SEQ ID NO: 160204 - protein, 96 aa, Triticum aestivum
  unsure (1)..(96): unsure at all Xaa locations
  Clone ID: PAT_TA_54622.pep
EMAHSIAGNLSSPRLEVTRVELLLKVXTFCVAVGTLIGWIFGMNLKWSLENTTWAXFWATTGVIPVGAVAGFFIXMYMHLKDRKILQTPCTICGIA

SEQ ID NO: 160205 - protein, 50 aa, Triticum aestivum
  Clone ID: PAT_TA_54623.pep
RTQPFYSLLLVQKGSLSMGLAGGRAEQSTWGGGGMNKIRLHKKTKDKHWN

SEQ ID NO: 160206 - protein, 180 aa, Triticum aestivum
  Clone ID: PAT_TA_54624.pep
ITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKEL

SEQ ID NO: 160207 - protein, 80 aa, Triticum aestivum
  Clone ID: PAT_TA_54625.pep
KKAQNGPPRGFQKGQKPGRAHKGRDPRKNRGGTKPRPSGYAKKKQRKGGGHLEEKPYMPERTTNPTTIQAELPKQTHNNG

SEQ ID NO: 160208 - protein, 133 aa, Triticum aestivum
  Clone ID: PAT_TA_54626.pep
GSNFHHPFCKSLCKKTHQPVAFFQSDQGRVKQETPRPLFPGKKGATHSLTNSTTFTFTFHFIGPGNLPPKTSHPMKNIYLSIPGLGKNQARRRSHQAFNCIVSWVGPGTNPVSQCETRKKKKTRFTTLSEGYE

SEQ ID NO: 160209 - protein, 154 aa, Triticum aestivum
  Clone ID: PAT_TA_54627.pep
SGKGDSLFFQIVRHCPSLGVYSNRGATHMRLISHHYSFDYRHTFPNQPPDSSDAPGVYLFIRFHWAPAESGVAYQGWGIEFPNYYNSHPWNLASLIKGGELNFLTTTTATLGRFPGGGRCYSLLRLFFLASIFLFSVGILGESGPSFLFAVDGP

SEQ ID NO: 160210 - protein, 82 aa, Triticum aestivum
  Clone ID: PAT_TA_54628.pep
QACRRDGHYFGSPSITLSRTWNWNRTWKSTTTLPGSEGLLILSAWYNPVKGGEKLAIYVLEVLILVLGGLGRDDGFIDLEKC

SEQ ID NO: 160211 - protein, 88 aa, Triticum aestivum
  Clone ID: PAT_TA_54629.pep
RLVYPPAFVKSSWPLAPLVLVGRPLNNHVVLGALAPVKMTPFTRGACACASLTGSELCQYVRPSAAELERVLDPRFARLYERETRYQW

SEQ ID NO: 160212 - protein, 53 aa, Triticum aestivum
  Clone ID: PAT_TA_54630.pep
KKCGCRFAFPSFQFGFGPFRFFSPFVVPGPIFFGGVGVTKARPLSLLGIPCWS

SEQ ID NO: 160213 - protein, 136 aa, Triticum aestivum
  Clone ID: PAT_TA_54631.pep
MLSGSTAIADISKLPGHYVLFWELTNARSNHVVGDIPDQTVMENCCSTVEECFDQMYCKIRQRANITALEIRVLEQGAFDALMDFFVSRGASAGQYKTPTAIRSKEAMMVLEERVVARFFSKEIPRGSLYDDYVKK

SEQ ID NO: 160214 - protein, 58 aa, Triticum aestivum
  Clone ID: PAT_TA_54632.pep
GLLATTFFFFPPPPPFNVMWYAKWVFVPFSFFPPLGGFLPSKGDLGKYPYKCPFSFMS

SEQ ID NO: 160215 - protein, 111 aa, Triticum aestivum
  unsure (1)..(111): unsure at all Xaa locations
  Clone ID: PAT_TA_54633.pep
PLTIPFSEANPNKPPKSKFRQGFFHRKCIPXGTVCLSIINEDSSWRPAITVKQILVASQDGLDRPNPALLSQSAWCSPVYPEYIREPPPHGVPFQPCICYGLRAQRSSWAS

SEQ ID NO: 160216 - protein, 86 aa, Triticum aestivum
  Clone ID: PAT_TA_54634.pep
TAKAYAAHIQQPHIYRTTAALPFCVTAQGCPKPLILFGCSSESVYAQDHVPTWLDESCSYGYPCGAYAYERTHNINQFDPDMRFNG

SEQ ID NO: 160217 - protein, 70 aa, Triticum aestivum
  Clone ID: PAT_TA_54635.pep
IAPSSLPPSHTASHPTPTSPSFLCTPPALLHDESSPDFACLNNSSYPAPSLSLTSFGASSAPHLGVDIYL

SEQ ID NO: 160218 - protein, 93 aa, Triticum aestivum
  Clone ID: PAT_TA_54636.pep
NWGAPRLNTKPEQRNPVRKPGGPKASLGQGAEKSAPQGFFYLKKENPGGEKPRGVKRPKNKQEKAHEKSGWPGQYCSRSSPKKRGVNETKPPP

SEQ ID NO: 160219 - protein, 78 aa, Triticum aestivum
  Clone ID: PAT_TA_54637.pep
TDSLVHFTGVVSLSRHLLVLSERTYFSGPEFFLRVLGVKASLQCNLPMMRLNYRSVSSDDLVERLLILFRVRGFGDAW

SEQ ID NO: 160220 - protein, 78 aa, Triticum aestivum
  unsure (1)..(78): unsure at all Xaa locations
  Clone ID: PAT_TA_54638.pep
TGQWDLYGKNPASPYIGLQSNFFNTFAAPFTKWGFLLKVFLLXGGSLFAXVSASASPNLLPIKKGPQLPPTPGPRGKI

SEQ ID NO: 160221 - protein, 61 aa, Triticum aestivum
  Clone ID: PAT_TA_54639.pep
VRETLPNWAALCVCMSVVSGMPDGSINGVVGKEVRSENCTRSTCHNAMGITTIIHDHLTAQ

SEQ ID NO: 160222 - protein, 93 aa, Triticum aestivum
  Clone ID: PAT_TA_54640.pep
ALRVQGSLLGAYEESPLRCAHVWNCMCMQKGIYQIMIPLASKRRVLLDCSPPMHIYPWESIEFLTILCLFHPQCWLSLVHMYRRTPTCVNEQD

SEQ ID NO: 160223 - protein, 168 aa, Triticum aestivum
  Clone ID: PAT_TA_54641.pep
SKLDQPGATKSFIAECQALRNTRHRNLVRVITVCSTSDLTGHEFKALFLEYMVNGNLESWLHPTLHEHHLKRPLSLSSRIAITVDIAAALDYLHNHCTPPMTHCDLKPSNVLLDDVMGACVGDFGLTKFVHSYTSTIDGSTSLVGPRGSVGYIAPEYGFGSKISTEGD

SEQ ID NO: 160224 - protein, 139 aa, Triticum aestivum
  Clone ID: PAT_TA_54642.pep
GRVGGRVGSRLHPTPPPLLPLHLPVSRETLVPSSPLLPSLAESPENAAAAPAPAPPAGAAPAPAPKPSPPARSGIPPRYDLDAKWDACLDLSIRRVAYSSLAGAFGGLILFRSPTTRWASVALGAGVGIGAAFTEWLIH

SEQ ID NO: 160225 - protein, 117 aa, Triticum aestivum
  unsure (1)..(117): unsure at all Xaa locations
  Clone ID: PAT_TA_54643.pep
PQWWXAREAXAELXRGXKXQXGSXFCPXYLLPTSXGVESPGVXSSTSTTXPCRIPTRHREXSRXYIREXELSGKGXLSTFVRGEPGXSPKGKXTPGPAXAAPPSSPSDTLXATXXHC

SEQ ID NO: 160226 - protein, 127 aa, Triticum aestivum; identical to SEQ ID NO: 124219
  Clone ID: PAT_TA_54644.pep

SEQ ID NO: 160227 - protein, 73 aa, Triticum aestivum
  Clone ID: PAT_TA_54645.pep
RTSVRDMCEQFMYEKFNAKIEMPIDKAMETLLRLGLVVELSTNGSSSSVIALPCPDAYEILKGRWDSLLEHKT

SEQ ID NO: 160228 - protein, 116 aa, Triticum aestivum
  Clone ID: PAT_TA_54646.pep
YSYGVIILEMLTGKRPTDEMFKDGLSLYNFVEKSFPEKIGEILDPRIIPCYADQDEEAGRAVHQENHHQMAGMSCIIRLVKIGLMCAAETPKYRPSMQDVYIEVPAIKEAFSSLQG

SEQ ID NO: 160229 - protein, 106 aa, Triticum aestivum
  Clone ID: PAT_TA_54647.pep
NEFRRAAQRGTVAMTLEASRRQQSHWQQLNSLLATTFVFPPHRLRGGLHAWPRLLPGLEHVAVVHLGEPPSHPRLAVSQSLPASILDLSAKVPLDLLLPVPVELLL

SEQ ID NO: 160230 - protein, 134 aa, Triticum aestivum
  Clone ID: PAT_TA_54648.pep
ARGIAASGNPDYRGGGSYGGVDRTGSHWLGQGIFGGFTNHTPFRKLGFTGKLGGFDGVDISLLTLKYLRGELEIHPGWVRIFFWDHWLKQDVSHGFSEWERGEPAAGENGQFKLGWEPLFSLVVGKPNFRCGEL

SEQ ID NO: 160231 - protein, 103 aa, Triticum aestivum
  Clone ID: PAT_TA_54649.pep
CLCRRHSIQAKCASFNASGSLLQGHHAMRNPARCKEQVEVHARHVMLVTFVAGSLFRLLTSRCPHMLIHQRTYVVTQQCSVRKMHVSASMPAFVIHISSFPCM

SEQ ID NO: 160232 - protein, 61 aa, Triticum aestivum
  Clone ID: PAT_TA_54650.pep
SGTSPPFPQRSIRSTRRPLVASFSPPSTGLTTHTRPRAPPRPKRPTPRPRAVFGDPRAKSG

SEQ ID NO: 160233 - protein, 85 aa, Triticum aestivum
  unsure (1)..(85): unsure at all Xaa locations
  Clone ID: PAT_TA_54651.pep
RSGIRWFFPQSSVSWVPVIQVRSGRIGNKHISHMSLFVGKNCEAFFGCPNLPKLXCHEQVLFPPFLTWMACAPSRAKVMLPARGM

SEQ ID NO: 160234 - protein, 104 aa, Triticum aestivum
  unsure (1)..(104): unsure at all Xaa locations
  Clone ID: PAT_TA_54652.pep
DWYNPGSMGKQFFLVLKKYLGGSGDPAYPGGPIFKPIGFGTKSEKKMKELXKLKKIKCASLAMVAFLGMSLQPIFAGVGPFQKXYIDHLSDAVTNNILSSLMFH

SEQ ID NO: 160235 - protein, 77 aa, Triticum aestivum
  Clone ID: PAT_TA_54653.pep
LSIHINPFVWGKACLFLWAVTQPVVLGAFAPGVLRPGAPVYYSLYAVPEYASKICVLNGPMRLMHMKLLVKNRNHSQ

SEQ ID NO: 160236 - protein, 64 aa, Triticum aestivum
  Clone ID: PAT_TA_54654.pep
GGSHGFYEQKYKGTLTPGGGARNSHQLPLSNYIKKKGIKTFSFFPSLGTIGIQQIEKTKPGNRP

SEQ ID NO: 160237 - protein, 75 aa, Triticum aestivum
  Clone ID: PAT_TA_54655.pep
MSDLDVQIPTAFDPFAEANAGDAGAAAGSKDYVHVRIQQRNGRKSLTTVQGLKKEFNYSKILKDLKKKFCCNGTV

SEQ ID NO: 160238 - protein, 92 aa, Triticum aestivum; identical to SEQ ID NO: 108506
  Clone ID: PAT_TA_54656.pep

SEQ ID NO: 160239 - protein, 136 aa, Triticum aestivum
  Clone ID: PAT_TA_54657.pep
ANRSLNVLLHFFQSVPRPSVPRCSKPRRVDLYYSSWCIRPVESRNGDGAMTACEVLLFHHEDMGIPWSIAKLGVQQGMWGCVKRIEPGLRAYQTARASGEPISKCAAMAHANTKFVADELTASENNTEAGSTSNNA

SEQ ID NO: 160240 - protein, 168 aa, Triticum aestivum
  unsure (1)..(168): unsure at all Xaa locations
  Clone ID: PAT_TA_54658.pep
MASVTARAPVAALRPSASLKSSSSSAAAFLGHSSRLGRXATASPTRRRVKAEAKGEWLPGLPSPAYLDGSLPGDNGFDPLGLAEDPENLRWYVQAELVNGRWAMLGVAGMLIPEVLTKAGLINAPQWYDAGKSEYFASSSTLFVIEFILFHYLEXIRRWQDIKNPRQR

SEQ ID NO: 160241 - protein, 158 aa, Triticum aestivum
  unsure (1)..(158): unsure at all Xaa locations
  Clone ID: PAT_TA_54659.pep
SPRPPRVRPLSPYAAYEDLKPPSSPTPSFSSGTTGQAVKESPPAPAPAXAAPAPPPPAAPAASAKPRPLSPYAAYEGLKPPSSPTPSRSSXKKNDDDSPSATAASPGPSTTAEAAGPTPLCRFVGFSKRPRGVFRAPRPGPPLVGPRGGPPFFFPFSP

SEQ ID NO: 160242 - protein, 52 aa, Triticum aestivum
  Clone ID: PAT_TA_54660.pep
IIQPALIYCDARQILYDFTQYTIMYHIYIPLVQLMLSHTLQLPANVYVHIIL

SEQ ID NO: 160243 - protein, 171 aa, Triticum aestivum
  Clone ID: PAT_TA_54661.pep
YDGNLPEQVPSSTHSTLDAAFILGPDAALQPNENQLQYRINNITEPSHQNEYIHGDQSTVNTHYYQGESILPVGQQQPTIFTGSGQVNIHSQMQAPMSMDGGSVMQASTSVQHNLLSQQFAPTQVQESMHGIHYSENPPNHAVGPSTWHDDIIPAREPSANLFPGPDYGNF

SEQ ID NO: 160244 - protein, 159 aa, Triticum aestivum
  Clone ID: PAT_TA_54662.pep
PASAPRPPRVRPRVRSKYPHIKGVNFDLPHVISEAPPYPGVQHIAGDMFKKVPSGDAILLKWILHNWTDDYCMTLLRNCYDALPMNGKVVIVEGILPVKPDAMPSTQTMFQVDMMMLLHTAGGKERELSEFEELAKGAGFSTVKTSYIYSTAWVIEFVK

SEQ ID NO: 160245 - protein, 134 aa, Triticum aestivum
  unsure (1)..(134): unsure at all Xaa locations
  Clone ID: PAT_TA_54663.pep
PAXVAGRAXLPGPTXXGAPAGSLVRGXXSAEGGGPPGRRAGPWXSWFFWXVVGRRVVLQGGXXAGXXSRPFKGLAHARAALSGGLPXGTDNFSDEARGLSTLPLEENRFYLCSRLPTGRRAGGSPGPREFGPQG

SEQ ID NO: 160246 - protein, 88 aa, Triticum aestivum
  unsure (1)..(88): unsure at all Xaa locations
  Clone ID: PAT_TA_54664.pep
LFAATGVAIXGICAFSLLRNITGNHRGRVNKMGRAAXVIGNHEEGRHYARARTQKPMCGSKTPEIMPGNQQYMNQPKMNYFSMSETCN

SEQ ID NO: 160247 - protein, 170 aa, Triticum aestivum
  unsure (1)..(170): unsure at all Xaa locations
  Clone ID: PAT_TA_54665.pep
GXXPTPSRSHXFFPSPXSGXTGAQGNPAXLFXFFWFLPFRXSVXPAMRPLXXPLPQXGWGAXXHAXPQXLXXSGXPAXXQWXGYRAXIPAKGPRRXXAVXXRPSPLPSPALWWRHRXXRLAFRLQVPKNPSSTEVDLVALTXKXTWDTHWXDSREQSXAGALVXVNMGAP

SEQ ID NO: 160248 - protein, 40 aa, Triticum aestivum
  Clone ID: PAT_TA_54666.pep
LVPTKGTCLFNNFHSTKLVLISRIYLHYLSRKRHIIITHI

SEQ ID NO: 160249 - protein, 97 aa, Triticum aestivum
  Clone ID: PAT_TA_54667.pep
SPSAPKEGLPATGITPTQYTRGFAPVATKIQGGLGCNLYSLGTATAPAPVRVMFPGGPGGFQDLKKSPVWLQFAQAFQAVLWGYAKACLFFVQNVCL

SEQ ID NO: 160250 - protein, 68 aa, Triticum aestivum
  unsure (1)..(68): unsure at all Xaa locations
  Clone ID: PAT_TA_54668.pep
VSFVVNQADRSGLLVDLVKIIPDIXITVQWGEFHAEGPLAKAKFHVSYRGRPLIKALKQVLGNSMRYF

SEQ ID NO: 160251 - protein, 75 aa, Triticum aestivum
  Clone ID: PAT_TA_54669.pep
LPPHECGYPGSVFNPLNFAPTLEAKEKELANGRLAMLAFLAFLIQHNVTGKGPFDNLLQHLSDPWHNTIIQTLSG

SEQ ID NO: 160252 - protein, 78 aa, Triticum aestivum
  unsure (1)..(78): unsure at all Xaa locations
  Clone ID: PAT_TA_54670.pep
LYCXNMVQCEKNXXQITIRRXCSCNRNXXAMNCVXXRCTLYXYIPIIXHYLGNASEYYTPGGWXTHLCPAPGSFQTFS

SEQ ID NO: 160253 - protein, 96 aa, Triticum aestivum
  unsure (1)..(96): unsure at all Xaa locations
  Clone ID: PAT_TA_54671.pep
PPHWADDYCXDLLRNCYDALPLNGKVVLVEGLPPVKPNAMPRPPTMFPVPIIMLLPPPGGKERELSQFXKLAKGPGFSPVKTSYIFSPAWVLEFAQ

SEQ ID NO: 160254 - protein, 95 aa, Triticum aestivum
  unsure (1)..(95): unsure at all Xaa locations
  Clone ID: PAT_TA_54672.pep
VRKNAHHLKGSFRNLFVYCGATYVTYQHXHKDVSCAECVSRFVPSVKGQLSSISKLSVVRPYTLDLICSLTQSRLRVSGVAFCPGVHHVCIISSA

SEQ ID NO: 160255 - protein, 68 aa, Triticum aestivum
  Clone ID: PAT_TA_54673.pep
VANKDMTYATQLRNYEKQVMEKRLESLSEAELQVLLEQVEEEKERLPPTRRDQGITINRKTEDQTTAN

SEQ ID NO: 160256 - protein, 131 aa, Triticum aestivum
  unsure (1)..(131): unsure at all Xaa locations
  Clone ID: PAT_TA_54674.pep
RKNGYTPKNPRPPKYPGGTPRVAPTLGFLYFQPQQNASGAFWGPPPPPTKKALVGTPQSSSLFPPLYPPGGTGPPPGKAREPPHKXSKEPVFQPPMNQXQGPPPPFFPPNFPLPKWGGNPENPFFPPPLLG

SEQ ID NO: 160257 - protein, 134 aa, Triticum aestivum
  unsure (1)..(134): unsure at all Xaa locations
  Clone ID: PAT_TA_54675.pep
PTASGLALWTVLFGWXTATFQVSSYRGRCMASAERGGQSRSYLGDGSTTLLSPSRVGRGTKSXRELLHSRPLVPTGECTAXPAMXSGRWPXRPCWCLXXRXRQQKCCLXGAXLSSPSLVXRVAXGPDGRGFXPG

SEQ ID NO: 160258 - protein, 83 aa, Triticum aestivum
  Clone ID: PAT_TA_54676.pep
ATNLSTPYLIALYRRQLLPKSALYLRTLCTPLVPTLINKGSNSFWLNLDATDLTLVIASCWERDDRVPSGGGRHCCRSYRCYM

SEQ ID NO: 160259 - protein, 33 aa, Triticum aestivum
  Clone ID: PAT_TA_54677.pep
SDTQWLAFLHKPALCSHRNARKIKRYGTSAGST

SEQ ID NO: 160260 - protein, 86 aa, Triticum aestivum
  unsure (1)..(86): unsure at all Xaa locations
  Clone ID: PAT_TA_54678.pep
RRTGSCHFQRSPYVVISPVNLQKAMRGLAITDADHYGRLAITRXKRKDXAKAEYEKRXEQQNKQGLQQEEISQEHDLLKESFTILS

SEQ ID NO: 160261 - protein, 100 aa, Triticum aestivum
  unsure (1)..(100): unsure at all Xaa locations
  Clone ID: PAT_TA_54679.pep
GTXRWEQSFHRKTXRKYLGTTIIXDYXKISFHISATPIRLVQVVRRCPSMLQFLHFPGLRGFLGASPLSGHVVRFFGDVSPYRAFTPTEFLVLMHFLAIS

SEQ ID NO: 160262 - protein, 118 aa, Triticum aestivum
  unsure (1)..(118): unsure at all Xaa locations
  Clone ID: PAT_TA_54680.pep
GRIXGIVNXQVLEEATEEEINGVASLAERCLRLSGEERPTMKQVETELQTLWAKQMDSSQVDTRNEEQRQPSSLTQRSRAARQSSATELGKRVYVRPEDSQQRYSLEREFMSSASLPR

SEQ ID NO: 160263 - protein, 87 aa, Triticum aestivum
  Clone ID: PAT_TA_54681.pep
SWCQLVYSMEKKSMSSLCVTSKAGFSHNKVRLEKMSHQMCVPLWVTVPMELQLFNPVEQRSLFFSQKRCRTIEPTLKSIIPRLPSAK

SEQ ID NO: 160264 - protein, 33 aa, Triticum aestivum
  Clone ID: PAT_TA_54682.pep
YCLHLYRTSLFSLAFLWLHNAGLCKKANHCVSL

SEQ ID NO: 160265 - protein, 81 aa, Triticum aestivum
  Clone ID: PAT_TA_54683.pep
NIMGMGIYIATGWIHIQTPFFEPCCYMNMGIHIFLGTRKKDKWGRKTQSNGRVDKTAMALYMWPGGRELFRPCRTPRNPGV

SEQ ID NO: 160266 - protein, 138 aa, Triticum aestivum
  Clone ID: PAT_TA_54684.pep
KKTPSGGGGITRPKNWGGGGSKNPNFKKKLQGSKKNLPLKKEGNFLAKGPQQFNKNCGAPPWGGVKKNQPGTKMEGKGMLYFGGPPPFFFFLFPPRLHLEKKTSHLFGLPKNGATRGPLFNPPFLFKGLWSLFSKPPP

SEQ ID NO: 160267 - protein, 125 aa, Triticum aestivum
  Clone ID: PAT_TA_54685.pep
RWPEFKQWLRRFNVDLDARISPSEMRCFMRTIRTRFSGYKSKCGIEYPNAVDYGYVHYGKVVRAHLVRAKEPSGLRICPPLDSRPHLGSQLNEASSISEPTHARISPDLSFVTPLYLCFLVSLFA

SEQ ID NO: 160268 - protein, 81 aa, Triticum aestivum
  unsure (1)..(81): unsure at all Xaa locations
  Clone ID: PAT_TA_54686.pep
LRCTLKKHGRKAGSGWXVDARHHVPRMGAXWRHTHTRTLYTPDXRTPLXRMSHTRTYARRTQMRIXTTRAHGRRPRHGGET

SEQ ID NO: 160269 - protein, 43 aa, Triticum aestivum
  unsure (1)..(43): unsure at all Xaa locations
  Clone ID: PAT_TA_54687.pep
RDLXTSHINDHLPSKLSLFFSSLLLMILKSPPTKIGSCSDPQI

SEQ ID NO: 160270 - protein, 175 aa, Triticum aestivum
  unsure (1)..(175): unsure at all Xaa locations
  Clone ID: PAT_TA_54688.pep
MAPTVMASSATSVAPFXGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 160271 - protein, 137 aa, Triticum aestivum
  Clone ID: PAT_TA_54689.pep
TVITNKVYSSHPLSIVHKLSCEGRIRYIVRHVILDVLKEQPLFVMHREVVEGHAAEAHVEERVNRPGLDVVIHVTVHRVVGVLFQLDYVRRVFTLVRSLGPFIAGISLSSACCPMCLTFYISRPFPSRAAVQHSLVV

SEQ ID NO: 160272 - protein, 85 aa, Triticum aestivum
  Clone ID: PAT_TA_54690.pep
KVLNSIRKAQQMSQYSTLIVVVRIRLVTGSVDNNQGHPSLGTSKRQGNRCTAQSSTIIRPPSGVTYSRSAHVLLCYAISNGKAKT

SEQ ID NO: 160273 - protein, 33 aa, Triticum aestivum
  Clone ID: PAT_TA_54691.pep
VRYVEISFVLSMKDVIYTSAIMRRADPVACTVL

SEQ ID NO: 160274 - protein, 109 aa, Triticum aestivum
  Clone ID: PAT_TA_54692.pep
VDAVSFDITGPYPAQEGIECGGQARGLGLHILGQHECNVHGQLGQSVRELVLQVFAVRPVVRHPHGGAPGCAPRHGPDSNGILEGIDDQGPLDGGQVLGGGLACSCVGA

SEQ ID NO: 160275 - protein, 65 aa, Triticum aestivum
  Clone ID: PAT_TA_54693.pep
HATCIDFTLLSTFLPICGLTVLCTSLLWHNSWLLPLAVEPLLGPSLPLLLRPSMSSLLGATSSSC

SEQ ID NO: 160276 - protein, 76 aa, Triticum aestivum
  Clone ID: PAT_TA_54694.pep
ECRNGSSNVQERLSISVKVRASVLGMDMLPLVSIRVGRTAIITPCCFPAQGKRPPLRACCLGCGTGMAAWKGSCST

SEQ ID NO: 160277 - protein, 37 aa, Triticum aestivum
  unsure (1)..(37): unsure at all Xaa locations
  Clone ID: PAT_TA_54695.pep
RLPGSPSVLPAYSCTAGAIDDSWVSSLDSTAXRTYEH

SEQ ID NO: 160278 - protein, 89 aa, Triticum aestivum
  Clone ID: PAT_TA_54696.pep
RGEKSSIRSTMLYGGIYGYPSDQKSKNGKLRLLYECAPMSFIAEQAGGKGSDGHQRVLDIMPTEVHQRVPLYVGSVEEVEKVEKFLSSE

SEQ ID NO: 160279 - protein, 92 aa, Triticum aestivum
  Clone ID: PAT_TA_54697.pep
KWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 160280 - protein, 57 aa, Triticum aestivum
  Clone ID: PAT_TA_54698.pep
YCKTLVLLVHWQKCLMTIVMHSQTEVVYDKTRRELNNGLAQGRAVLGTQKKPAITYT

SEQ ID NO: 160281 - protein, 99 aa, Triticum aestivum
  unsure (1)..(99): unsure at all Xaa locations
  Clone ID: PAT_TA_54699.pep
DYLIRSKWVPCLEFSKVGFIFREHNAXSPGYYDGRYWTMWKLPMFGCTDATQVINEVEEVKKEYPDAYVRIIGFDNMRQVQCVSFIAFKPPGCEESGKA

SEQ ID NO: 160282 - protein, 77 aa, Triticum aestivum
  Clone ID: PAT_TA_54700.pep
MLPPMASKSGAKLVASGSKTSRGKGPVESKGSKGPARTKKTAPIFKKWKCFPSQGFGIRKSPPSAKGAPPPDQRGEK

SEQ ID NO: 160283 - protein, 26 aa, Triticum aestivum
  Clone ID: PAT_TA_54701.pep
LSELLNYLPAWENLMLVLVIKLVFLL

SEQ ID NO: 160284 - protein, 61 aa, Triticum aestivum
  Clone ID: PAT_TA_54702.pep
ATEEDASRSISNRGYFRTFTPFHLVGTEPPAINIMEHREYIQIPTILLPKLMGAAMRTIMV

SEQ ID NO: 160285 - protein, 73 aa, Triticum aestivum
  Clone ID: PAT_TA_54703.pep
SQKEDSIMYMGCTSTGQVHIPTGKKGWRISWSTSTASHIAKERIYRSSSNILHCGFTLRILVYDCDHPSYLGE

SEQ ID NO: 160286 - protein, 176 aa, Triticum aestivum
  Clone ID: PAT_TA_54704.pep
GPPFFFFFFFYFFFFIFFFFFFFFFFFFFFFLGEKFTGGICSMSLKDSRFLKDEHYFGKMGFGYPPGNQSVNPKSVFCRRPCRTRSALNGKNAAPELACDLLGDGEAKKKPAEEGRPNRCRQPRLHSSRDHWIQKHHNLVFESSFLDEPKPFSWLLLRSMNLHHPFDLGVTEPRRG

SEQ ID NO: 160287 - protein, 38 aa, Triticum aestivum
  Clone ID: PAT_TA_54705.pep
CFEWKGFVSNVHSCIHSTPIKPMLASGLHQGGSLSCRH

SEQ ID NO: 160288 - protein, 126 aa, Triticum aestivum
  Clone ID: PAT_TA_54706.pep
QTALVDERRCCNAPTRRRPPVCDTTTCPRASRCVATSSVMQCNLVCRCSTRATAAVSCSCARDVSCNGALYADDRATMDLLDAGSGAAMELLDTGCGAAMELLGTAGGAAMGLGAASPAPFGASPL

SEQ ID NO: 160289 - protein, 160 aa, Triticum aestivum
  unsure (1)..(160): unsure at all Xaa locations
  Clone ID: PAT_TA_54707.pep
SPPLELHVSRRSNGARLSRGSHAGRIMCMQTGPIEGLKKNETLAYLPPIITVALVKTCRLALKRVQVXGSLARASCKVCHRIITPITTHTLRYYDGTVLPQCGKLPMFGCAGDSQVIXNVKDVKKDYPDSYNHIIRIHTMHQVTXVTFIVLKPPDCYKPG

SEQ ID NO: 160290 - protein, 62 aa, Triticum aestivum
  unsure (1)..(62): unsure at all Xaa locations
  Clone ID: PAT_TA_54708.pep
MIVSKASSGFNAPHQSRSPSAFSLRNCWQERTIRAXSIILNLKKGECSARRLNWDATGFFQL

SEQ ID NO: 160291 - protein, 71 aa, Triticum aestivum
  unsure (1)..(71): unsure at all Xaa locations
  Clone ID: PAT_TA_54709.pep
SPTSXSPPASPXSQFLAVXWWTVAPXGLFIRASXLRPXIGFKGQXTEXXYFQXSSVIYTSXLVHLHVRSWL

SEQ ID NO: 160292 - protein, 186 aa, Triticum aestivum
  unsure (1)..(186): unsure at all Xaa locations
  Clone ID: PAT_TA_54710.pep
RSHSPPIAGGVVSLPFKAGTYEYEDFWLDPTFFTGKVRGMQNTSRRPSRKTNLMTRLTYTLGEMEGPLGGQCRRXTLKFTGRXDWIDYTGVTVQLPGGERVPLLFTVKQLVATGKPYSLNGPFLVPTYXGSSFLXPKGRGGSTGYDNTVALPAGSTRNNAELPKDNLKNASSCTGNITLSVNQYQA

SEQ ID NO: 160293 - protein, 81 aa, Triticum aestivum
  Clone ID: PAT_TA_54711.pep
LWRPKPSSYFTCSLHSSSSSLWFLRLKLLENQLMITQDFHLFHLPTAAYHHQHHDPRPEFASYDGGVYNYIHTYTYLKNNV

SEQ ID NO: 160294 - protein, 107 aa, Triticum aestivum
  Clone ID: PAT_TA_54712.pep
GARGLALARGGSLAVIWRSCLNKTQFGLYKDAHATRSYWPPQRAIAGHGQHVATTPANTESTWWEAHYASDNGAYAAPKRPPERDASGRAGSTHGSRKYYLAEGKEN

SEQ ID NO: 160295 - protein, 115 aa, Triticum aestivum
  Clone ID: PAT_TA_54713.pep
TGKIHTSIALNILSTGKMAVTSLSGIKLYVSSYWESPTADRFLSTPSCTFWYRNSPRSSILGRDLHYTSTLLCYCTYVILRTLNLIMVTLWLLFYNYYFHKTDCIYCKNTADWSL

SEQ ID NO: 160296 - protein, 133 aa, Triticum aestivum
  unsure (1)..(133): unsure at all Xaa locations
  Clone ID: PAT_TA_54714.pep
MARTKQTVRKSTGGKAPLKQLATMRQRKSAPTTGGVKKPHRFSPGPWCSMRSACPKYTELMILKLTFQRLLRXIAHDFKXTDLRFQNHAVLSLQEATEAYFVWLFQDTNLCSIQAKRVIIMPNDMQLSHRICC

SEQ ID NO: 160297 - protein, 70 aa, Triticum aestivum
  Clone ID: PAT_TA_54715.pep
VLLSSIARLCALHFLRSHSLCLCPLGFVFDYLSDITGGVAEAPASRLRHKVLVFAVEKVERPQGRLEPPQ

SEQ ID NO: 160298 - protein, 125 aa, Triticum aestivum
  Clone ID: PAT_TA_54716.pep
ALLNALLHSEVDYVYYMDSASVNTPEFVLVSIMLLDPARLMVYYSSRYLVWSSDGEGISPNKQLGRISRRSCHQIQYIHMWCTFRCRCGSWGCTCRVTLVRCHSVPPFRPLAAIGAGRPLASTKG

SEQ ID NO: 160299 - protein, 89 aa, Triticum aestivum
  unsure (1)..(89): unsure at all Xaa locations
  Clone ID: PAT_TA_54717.pep
GGVLVFXPTKFRVKSGEPLPFKNNPGFPPTVFFFKAPVPSGVEVSKFSPGGFLYAPGEAFSVPLPGPGPXGFFWEPPPGAGMVAKVPLN

SEQ ID NO: 160300 - protein, 74 aa, Triticum aestivum
  Clone ID: PAT_TA_54718.pep
GKKPFKNPFVPPGAFVPPGFLPTGLVTFRGGNFWVGQKFIRARLVFQRVSVFFMGGRGVFFCFQNNLFKKGFSP

SEQ ID NO: 160301 - protein, 158 aa, Triticum aestivum
  Clone ID: PAT_TA_54719.pep
KLLLCTAMFIITRVADLTRTTLHKREPWPTPRRSKSLHPSLNMTTRGRTDHLLIHTLSILSTLNYNANHLKPTRSLNIISTTGARWLSINHAVPWAGHELMEDLERPLVEHAFAAPTNPTNARIPSLPVASNYCLPSRGATNMMRLKKVAVNPYSMGG

SEQ ID NO: 160302 - protein, 104 aa, Triticum aestivum
  Clone ID: PAT_TA_54720.pep
GQDVEVLADCPVPAGRPSITITSGEGLEDQVYSKDRVIVAVRQGNILATAFHPELTSDSRWHRLFLDMDKESQAKALAALSLSASSNDADVGSKNKAPDLPIFE

SEQ ID NO: 160303 - protein, 81 aa, Triticum aestivum
  Clone ID: PAT_TA_54721.pep
LWRPKPSSYFTCSLHSSSSSLWFLRLKLLENQLMFTQDFHLFPLLRGAYHHQHHDLRPEFASYNGGVSIYIHTYTYLKNNV

SEQ ID NO: 160304 - protein, 67 aa, Triticum aestivum
  Clone ID: PAT_TA_54722.pep
RTYGDQELIDHKAHLLLLIILLLHLHRQNQVNYLHGIHLIKLHVYVQLHYFFSIVQNNRWMGLSSNV

SEQ ID NO: 160305 - protein, 62 aa, Triticum aestivum
  Clone ID: PAT_TA_54723.pep
SLQLLYIGSRSIFSGVLVHQLIHIRGCIVRWVVSCGPLQRFSCFLALLCRMFRIMNIYGGNF

SEQ ID NO: 160306 - protein, 120 aa, Triticum aestivum
  unsure (1)..(120): unsure at all Xaa locations
  Clone ID: PAT_TA_54724.pep
SETXIQNCIKSRQMQIVTGGQIQQSFMVQYFLTMQFNCYTGRYSRELNRYNTSHSLSRRGIWHASGASLGDTPELISRRKPRRPAEVSFRYKVSWRICTKSPCARSNTHYINATVLLQPM

SEQ ID NO: 160307 - protein, 127 aa, Triticum aestivum
  unsure (1)..(127): unsure at all Xaa locations
  Clone ID: PAT_TA_54725.pep
MLAVLELAVAVLPVLELTAVVAVPAAVASVAARHGYPSGGHGYPPQQHGYPQQGYPPQHGYPPQQHGYPPQQHGYPPAGYPGSSGHSGSHGGGGMGMGGMLAGGAAAAAAAYGAHKLSHXGHGGRGT

SEQ ID NO: 160308 - protein, 65 aa, Triticum aestivum
  unsure (1)..(65): unsure at all Xaa locations
  Clone ID: PAT_TA_54726.pep
GWPNSFLPTLLKNRSSQRTYMPSPALQLYQGLLXILPPPTYXRSFSKKKKKATLASLNGLTFPPD

SEQ ID NO: 160309 - protein, 88 aa, Triticum aestivum
  Clone ID: PAT_TA_54727.pep
PIFSYIQLVCSCSPLYSYQQKGGNPPSHEAMSDEWLENGQCPLARSYRAMSGVLPLVAKALQPPAGMKLKCPPAIVAARAALARTTLV

SEQ ID NO: 160310 - protein, 183 aa, Triticum aestivum
  unsure (1)..(183): unsure at all Xaa locations
  Clone ID: PAT_TA_54728.pep
MSPQTXTKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTYSKTFQGPPHGIQVERDKLNKYGRPLLGCTIKPKLGLSAK

SEQ ID NO: 160311 - protein, 44 aa, Triticum aestivum
  unsure (1)..(44): unsure at all Xaa locations
  Clone ID: PAT_TA_54729.pep
TLCSARRGTXALAEWHGEDRPELVALLGAGSCRSHGRALITTNA

SEQ ID NO: 160312 - protein, 140 aa, Triticum aestivum
  unsure (1)..(140): unsure at all Xaa locations
  Clone ID: PAT_TA_54730.pep
AFSAWDGHHRGWRGGANWPGAPREGRRGAAARGADPGGGGGXEREIVLGRNMHASCFAVKEPDADDEFTGEREATMAGVLARYRRSLVERTKHHLGCPYNLYFEYGAFFQVXHLFINNLCDPFHGRATMVVHSRQFEVVS

SEQ ID NO: 160313 - protein, 72 aa, Triticum aestivum
  Clone ID: PAT_TA_54731.pep
LTAGRTNTTGSPGTPMTLKPPLPRPSYSGEHPNLDTTVREANIFLTSDGQAMKIKGHWVKPLANPMTLHILH

SEQ ID NO: 160314 - protein, 122 aa, Triticum aestivum
  unsure (1)..(122): unsure at all Xaa locations
  Clone ID: PAT_TA_54732.pep
SGGINSRPCRYLPPLNTEALLKQVDYLVRSXWVPCLEFSKVGFIFREHISSPGYYDGRGGTMWKLPMFGCTDATQVINEVEEVKKEYPDAYVRIIGFDNMRQVQCVSFIAFKPPGCEESGKA

SEQ ID NO: 160315 - protein, 111 aa, Triticum aestivum
  Clone ID: PAT_TA_54733.pep
GKDDQVLLDGDEVENDQRTAPDDTARRRTPPAHNAKQEVLKPRGQTPGSSAYPDLRAGTSRSQPRLAAVQPRPVRFYLARDAEATPPPDPFMPHRRDKHKPCATGQGAGTT

SEQ ID NO: 160316 - protein, 110 aa, Triticum aestivum
  Clone ID: PAT_TA_54734.pep
FNSEGLLGLSVMQNLRLQLFRATQKDYSEAARWIIGLMAKSGTEEGGGFTEAQLQELREIKPKKDSAQRNVLASMLRVQRKIVRTISESMDELTSQRKSIWWSRWIPREE

SEQ ID NO: 160317 - protein, 125 aa, Triticum aestivum
  Clone ID: PAT_TA_54735.pep
KEKIDPILDWVKTEFGFKPVVYTSFLGGKQDERLVKAVETVLKDANDCELASIDAMAAAAHSLVIPLAIFRGRLGVDESIELIRLEEDHQVDRWGLVEGGHDVDIADLKVQMSSAVVFLQLSWLK

SEQ ID NO: 160318 - protein, 86 aa, Triticum aestivum
  Clone ID: PAT_TA_54736.pep
YLISPITCTQKRKLSTSQSSQQSSYAHTEGAPILQAAPKPRLQIYRLKPSKQTGHLDSHFRTRKTASGKLPSNPMIFTQDSTSWPN

SEQ ID NO: 160319 - protein, 104 aa, Triticum aestivum
  Clone ID: PAT_TA_54737.pep
HRLLLLSSINDHACSPFYQPHVNASYSPSPADAYSLLCPYFFFPLSRLILIHFMSRCCCFFSCAYLTLLSVAAPLYASPLASSSSAAPHLLLLSLSTSPDTFLL

SEQ ID NO: 160320 - protein, 107 aa, Triticum aestivum
  Clone ID: PAT_TA_54738.pep
SAAATPGVYGVAITGGGNAFARRGMTPGRAWCCERAQHGGCDYELVQGRSPELTAPISGIPCAWGFFLIWQRREEDEATRGVLLRESDAVYVDRSNIRGLLIGRLAI

SEQ ID NO: 160321 - protein, 88 aa, Triticum aestivum
  Clone ID: PAT_TA_54739.pep
AVKACAPAAQGVLAAVSDSVRVHEVLVQGTVLVAQHVPCSSIVSAGVVLEVIAESVVAVFRFDVRQEGLIACVAFSGPDPSPCISITF

SEQ ID NO: 160322 - protein, 42 aa, Triticum aestivum
  Clone ID: PAT_TA_54740.pep
QEASHASQDGAYNVFILRGLLCNNIQAGNYIQGLLDLIHREY

SEQ ID NO: 160323 - protein, 62 aa, Triticum aestivum
  Clone ID: PAT_TA_54741.pep
QTILSESLIGSVFVSCRYTSVVLLQQGVMYDNCSILEYFKIICVPRPYLFVVSSRISSVTCA

SEQ ID NO: 160324 - protein, 80 aa, Triticum aestivum
  Clone ID: PAT_TA_54742.pep
KEKTPHGTGLFLPVARIMYTSAWMDGLLTLRLLINRRAVWLGYWSSGRVRWGSWRRCRTRAMGRNGGSWAGEVRRGGWVG

SEQ ID NO: 160325 - protein, 130 aa, Triticum aestivum
  Clone ID: PAT_TA_54743.pep
QRVPLSVRILNVISQHASGPVRQIHCIQSTGMQVVRQGIFSLLYTGHIFSAIAVLSTMTLRWVFFIHLSFLLVLNNMCMSMYHVSTWLKTACFYVNTIGGYVYAHAHHFLAHLFTMYYGFLIMSNIFATA

SEQ ID NO: 160326 - protein, 93 aa, Triticum aestivum
  Clone ID: PAT_TA_54744.pep
KSKRHPERNPNSPRGKNPPKRGGPSANQGGQPVGKANGAGLLTTNPAGQKGISPTGDKVGNPKVFPVGKVKPPPHKIVFRGQKKKKIGAPARG

SEQ ID NO: 160327 - protein, 81 aa, Triticum aestivum
  Clone ID: PAT_TA_54745.pep
YIMCMCIYIATDCIHIRARFLEPCCYMNMDIHIFLGTSKKDKWRRKTQSNVRVDKTAMALYMWPVVSELFRPCRTPRSPVA

SEQ ID NO: 160328 - protein, 175 aa, Triticum aestivum
  Clone ID: PAT_TA_54746.pep
RVDPAFARWPSWAAGWGLCPRTQGEPCVTEIYDDVVVFPGAVSDKKRVHNLVMTVDWADINFDDYECMVMPGGRTSELLVTNEKAVALVEQFADIGKVVASIDQGHLVLAAAGLLKGKRCASGMPMRVVSNLSGSVVVEPQGAVVDGKLVTDASWTDLAEFIVPLLNLLGITVSF

SEQ ID NO: 160329 - protein, 134 aa, Triticum aestivum
  Clone ID: PAT_TA_54747.pep
MVFVWLAAFFLVVTLIVLVIFQLMCLADLEFDYINPFDSSSRINKVVMPEFIVQALLSALFLLSGHWAMFLLSAPMVYYNYTLYERRQHLVDVTEIFNHLSREKKRRLFKIAALIVLLFLSLFWMIWSVLEEHE

SEQ ID NO: 160330 - protein, 58 aa, Triticum aestivum
  Clone ID: PAT_TA_54748.pep
INDHNLNHILAYNTWALLLSANMDCYNSKLNSPFFQELNCRKRRIIKLLSKKRISQIY

SEQ ID NO: 160331 - protein, 44 aa, Triticum aestivum
  unsure (1)..(44): unsure at all Xaa locations
  Clone ID: PAT_TA_54749.pep
PAKINRRIVQQGAILTNAGYCKGSXEWGREVPGHIRTARKPQYX

SEQ ID NO: 160332 - protein, 159 aa, Triticum aestivum
  unsure (1)..(159): unsure at all Xaa locations
  Clone ID: PAT_TA_54750.pep
MATTAMALSPSSFAGKAVKDLPSSALFGEARVTMRGGAAKAKPVSSGSPWYGSDRVLYLGPLSGDPPSYLTGEFPGDYGWDTAGLSADPETFAKNRELEVIHCRWAMLGALXCVFPELLARNGVKFGEAGWFKVGSQIFSEGGLDYLGDPSLVHAQSML

SEQ ID NO: 160333 - protein, 111 aa, Triticum aestivum
  unsure (1)..(111): unsure at all Xaa locations
  Clone ID: PAT_TA_54751.pep
QLLWTDXFTNLDRYKRLCYHIKPVXAGEDNQWIWYVSYSLYLFEEGSVTNMFTCIQSNLLAFKDLLSLLWXDLQITPTYSKTLQGPTHGIQVERDKLNKYGLTLLECTIKP

SEQ ID NO: 160334 - protein, 99 aa, Triticum aestivum
  unsure (1)..(99): unsure at all Xaa locations
  Clone ID: PAT_TA_54752.pep
MRWNISTVAWIRSMLTDAGGETATYEIIYPTKYALHVHLLARRDQLPSCNAIQDRLLNNPYITAHLNTKTAAVVGLTKGQMSXIQMRRIPAAEEKALEV

SEQ ID NO: 160335 - protein, 65 aa, Triticum aestivum
  Clone ID: PAT_TA_54753.pep
PFFPRGFFGLSFGEVCSPSGSGPVFPGRAPGPIKKEKKREKKKKKKKKKKKKKKGGGGGGGGGGG

SEQ ID NO: 160336 - protein, 104 aa, Triticum aestivum
  Clone ID: PAT_TA_54754.pep
PRVRNTGVHECRSCGYLYDQAKGDPSYPVPSGLPFNKLPDDWRCPTCGAAQSFFDSKSVEIAGFAQNQQFGLGGNSLTSGQKTLLIYGSLLVGFAFFLSGYFLQ

SEQ ID NO: 160337 - protein, 69 aa, Triticum aestivum
  Clone ID: PAT_TA_54755.pep
GGGGNFPHLKKKGPRNFKGPTLTLNLTNEIDWGGSKSYTREFVLKKRFKKKNFLGKNFPSPAGDPMGKI

SEQ ID NO: 160338 - protein, 82 aa, Triticum aestivum
  Clone ID: PAT_TA_54756.pep
VGYFGRSGGHFPGFLRHHCNIISFVESGTSLLGSWHRRCDSASRPRHLQINWRQLRACVIHARLGPNAMGSRVPFGRRVSVW

SEQ ID NO: 160339 - protein, 42 aa, Triticum aestivum
  Clone ID: PAT_TA_54757.pep
CIGGGKGAQQGTLPVPAGCPDQTAKNFDPTARSDDGSCLYPF

SEQ ID NO: 160340 - protein, 129 aa, Triticum aestivum
  Clone ID: PAT_TA_54758.pep
MRVICFNSIRYWYRGGGTKRYSIFIQDTQVSHEIITNYITTQLVIPYKLRSHPKINTQVMPWAGDIATVKQREAEDEAISILCRRAAFSGPHPWRGTWRGSPPPRRSPCRAALPPGDAFPPPLCAPSRR

SEQ ID NO: 160341 - protein, 95 aa, Triticum aestivum
  Clone ID: PAT_TA_54759.pep
IRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 160342 - protein, 92 aa, Triticum aestivum
  Clone ID: PAT_TA_54760.pep
YREFTRSNKSLSIIVRSTVMKCNGIHWHIYCVYLGVALVGNCWSNHQVGVVSTACHSKLSLRPKGSRIYYLLSNRTSCARLSHDLSTNGHAP

SEQ ID NO: 160343 - protein, 60 aa, Triticum aestivum
  Clone ID: PAT_TA_54761.pep
RIKYWRGGGYFINRPTVQNISSSMSRFKVNSSDKPQTLHTEHWRMRLVHYHRWECYLPPI

SEQ ID NO: 160344 - protein, 159 aa, Triticum aestivum
  Clone ID: PAT_TA_54762.pep
RGQIQGAVKADTKLAVKSRGRRSRPPRGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 160345 - protein, 82 aa, Triticum aestivum
  Clone ID: PAT_TA_54763.pep
GHPLASNTLMSGNEVYQSSVTWDACWMKQPGLTSGKGSPRRLNEFNRAGSSRVTSEHHIDLCSPIDLLCKTNQAMHLHSWLH

SEQ ID NO: 160346 - protein, 194 aa, Triticum aestivum
  unsure (1)..(194): unsure at all Xaa locations
  Clone ID: PAT_TA_54764.pep
SVSSRQXNSAASRKHLVSWKXDVLTTDALPIHGYEHYKAKDYTLAHAPFSGSSNAGGQWAAGDEPLYYIVSPKDIVVAKPRDTEDHIAWLLQHGWHEKALAAVEAGQGRTELLDEVGTRYLDHLIIERKYAEAAQLCPKLLRGSPSAWERWVFHFAHLRQLPVLIPYIPIENPQLSDTAYEVALVALTTNASFH

SEQ ID NO: 160347 - protein, 167 aa, Triticum aestivum
  unsure (1)..(167): unsure at all Xaa locations
  Clone ID: PAT_TA_54765.pep
VDPAFSAWGAIDDAARYFKXAYDRGLTPYEFVEGXKKKGIRVPGIGHRIKSRDNRDKRVQLLQKYAHTHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 160348 - protein, 106 aa, Triticum aestivum
  Clone ID: PAT_TA_54766.pep
TEALLKQVDYLIRSKWVPCLEFSKVGFIFREHNAFPGYYDGRYWTMWKLPMFGCPDPPQVINEVEEVKKEYPYGYVRIIGFDNMRQVQWVSFIAFKPPGFEESGKA

SEQ ID NO: 160349 - protein, 91 aa, Triticum aestivum; identical to SEQ ID NO: 156473
  Clone ID: PAT_TA_54767.pep

SEQ ID NO: 160350 - protein, 138 aa, Triticum aestivum
  Clone ID: PAT_TA_54768.pep
PGPWGPFRPLGKGPRAFPLGFIGSSPHFFLVAPPPLIFFSGRFGLAPSANRKAPAGLQLEGRESGLQTGDPAGFPFSDPVALGSFGPLFGVGLVVGPQNPGVPAPIFGLNLSSFRRKLFCLPLGRSLLWVHLCPPFGF

SEQ ID NO: 160351 - protein, 152 aa, Triticum aestivum
  Clone ID: PAT_TA_54769.pep
SYGIISENSVTRSFHKQQFNLIFLLFLYTTNNFQILSFERGSQGLILHASRFVFGSCGFELFLQSLPSDQVCEACFFKLCPWCRHGYQQAMGVGEASSDPRVPARLPLCRTRTLPAAILRNLSLPLIFKFSSICSLPMFAHDPNFSFMLMSF

SEQ ID NO: 160352 - protein, 74 aa, Triticum aestivum
  Clone ID: PAT_TA_54770.pep
YKTKCKNSIHHVLYITAYAQQPDLNRNGWSGQAHGVGLGFTHSSDSSKAASARSSTKPTATPTSVSAFMTTAIW

SEQ ID NO: 160353 - protein, 186 aa, Triticum aestivum
  unsure (1)..(186): unsure at all Xaa locations
  Clone ID: PAT_TA_54771.pep
PVVSVLVYLITTWXXWRNARNSLSSGANGFMEFGYRDLACATNRFSRDALLGEGKFGAVYKATFKGQEVAVKRIKAEGKLEDFHRELQTVGNTRHENLVDLKGWCGKVRVIDGKTWWKRVIKVELFLVFEFIPNGDLEHHLHNSDQVLSWDKRYKIVKGIGSALHYLHHECNPCILHRDIKPGNIL

SEQ ID NO: 160354 - protein, 142 aa, Triticum aestivum
  Clone ID: PAT_TA_54772.pep
RSSTYPLLYSLSRAASCAIQEARNGKPAPRRRLHRDDKKWPPPSALPGSQSRSKLPRFEAALQFARTEGIIPAPEPTHAIAAAIREALECKRTGEEKVILIAMCGHGHFDLAAYDRYLRGDMIDLSHSAEKLKESLGAIPKV

SEQ ID NO: 160355 - protein, 182 aa, Triticum aestivum
  Clone ID: PAT_TA_54773.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTYSKTFQGPPHGIQVERDKLNKYGRPLLGCTIKPKLGLSA

SEQ ID NO: 160356 - protein, 178 aa, Triticum aestivum
  unsure (1)..(178): unsure at all Xaa locations
  Clone ID: PAT_TA_54774.pep
RRGVTSYRPXVSWEGGDGCRELLHTGAGAGAVKGGVGLVLNEASSSSSGGASLLGACEWSVADVDSDSYDAVQVELGCSAKGAKLEVSYVVTLYPLSMATAVIVKNNGAKPVELTGAVLSHIKFDKRRGTAVEGLRGCPYCSHPPPASGFALLTPAEAMKREESGWFGGGGEEPRQGA

SEQ ID NO: 160357 - protein, 53 aa, Triticum aestivum
  unsure (1)..(53): unsure at all Xaa locations
  Clone ID: PAT_TA_54775.pep
NXSLVLRSRSGTLCDHRTRGTRGTDAWGGSRGFSPGKTGPVRGGGPAFPMESR

SEQ ID NO: 160358 - protein, 90 aa, Triticum aestivum
  Clone ID: PAT_TA_54776.pep
SEQQVHVDGVVDDRLSFFDHTEMERVVVFGLKCSHSEEAQRLSMEDAMKFLEDGQEFPATTQGHGSYGAPCTVNEEAPMMTHGDVSSCYP

SEQ ID NO: 160359 - protein, 43 aa, Triticum aestivum
  Clone ID: PAT_TA_54777.pep
FFFFFFFFFFFFFFFFFFFFFFFFFFFFFFFKRGPWGPFINVN

SEQ ID NO: 160360 - protein, 107 aa, Triticum aestivum
  unsure (1)..(107): unsure at all Xaa locations
  Clone ID: PAT_TA_54778.pep
STEALLKQVDYLIRSKWVPCLEFSKVGFIFREHNESPGXYDGRYWTMWKLPMFGCTDATQVINXVEEVNKEYPDAYVRIIGFDNMRQVQCVSFIAFKPPGCEESGKA

SEQ ID NO: 160361 - protein, 33 aa, Triticum aestivum
  Clone ID: PAT_TA_54779.pep
YNMHESCMYYILCKKEKSYRVNTRSEQSSGIIE

SEQ ID NO: 160362 - protein, 53 aa, Triticum aestivum
  unsure (1)..(53): unsure at all Xaa locations
  Clone ID: PAT_TA_54780.pep
EEILATSVKDFKEFADAVETIXDNGVVVAVASPDDVEAANKEKSLFPDIKKCL

SEQ ID NO: 160363 - protein, 69 aa, Triticum aestivum
  Clone ID: PAT_TA_54781.pep
KELGKTGKKIFIGGLPNSIIGPGGPQFFNRLIQTFFSSVLEDFRPQNWTKLSSQNNLPGFGEADLKPPN

SEQ ID NO: 160364 - protein, 81 aa, Triticum aestivum
  unsure (1)..(81): unsure at all Xaa locations
  Clone ID: PAT_TA_54782.pep
GFPVDIDPTGRKVGKKGVSQFFSKXGPKVGGYSPFYPPKEWFXFGAPYPGGTPGFFFWAVPLAGLLGGGVLLFYNPRAFPG

SEQ ID NO: 160365 - protein, 90 aa, Triticum aestivum
  Clone ID: PAT_TA_54783.pep
CVFFFFFFFFFFFFFFFFSGQKHLATLTIHTFFLQQGTPGGGGGANPQRGRESCQLTLTRRLGRGGPGHKIWRGGRSSHGRGRALHRTKP

SEQ ID NO: 160366 - protein, 106 aa, Triticum aestivum
  Clone ID: PAT_TA_54784.pep
RAHLGPGRNIGPLAGPPTFGQPYIGQRIGPLTWGEKAPASWAPHLEAHPTVKTPRGEYMPPRGPHVFTCSLGKTNWGHCQLPKQGADWGYPLPSGGSSISQGGSGG

SEQ ID NO: 160367 - protein, 94 aa, Triticum aestivum
  Clone ID: PAT_TA_54785.pep
DVTLIRKQFMGRSLLAMNVMWKYREQRSFPLTEEEYLLRLDDVANTLRSWGAVAHVRNSLETTKDRPRIGKAVSIFIDVDSAGGGKRSDEWIYK

SEQ ID NO: 160368 - protein, 64 aa, Triticum aestivum
  Clone ID: PAT_TA_54786.pep
ISKYPNHRLVHTISQFCCHVDLCIAFIHVNLGTILRRSEYNSVLLLRALLLVLCYRVLITKERP

SEQ ID NO: 160369 - protein, 96 aa, Triticum aestivum
  Clone ID: PAT_TA_54787.pep
ARSLVQYCARDQRHNQVPASSIEQQPCHDTNTIVGPSTAGTNIQDPPRASSDNDGQPNQKRQHLPAPMTTKITDLYLKSCCLREWVFHGWVQAIGN

SEQ ID NO: 160370 - protein, 69 aa, Triticum aestivum
  Clone ID: PAT_TA_54788.pep
PYKENGAPRFSEPMLSCLFKDYLLRLKVKKKTSTPERRVKNPLVKVERFDPPPQSKNLLDFLSRAGASY

SEQ ID NO: 160371 - protein, 118 aa, Triticum aestivum
  Clone ID: PAT_TA_54789.pep
GGSYIDLGELFNLALLDDCADLLHSVLFMHNILRPMRPASCLSSGSVYPVHNCNLLWLRTYRHQVWLHANDAYANLLGERLSPDNLCEMRETLTIHYSQLDGYHTHAGSAISMVRHAL

SEQ ID NO: 160372 - protein, 91 aa, Triticum aestivum
  Clone ID: PAT_TA_54790.pep
STRAARTILELEAPMAARYLLGAATMMAGDQLPVDCMIYPRKRSSWAAASWSASSPWWSRPAACATLQTQGSNIHLASFINFGAVLTASAS

SEQ ID NO: 160373 - protein, 83 aa, Triticum aestivum
  Clone ID: PAT_TA_54791.pep
EAGRQSTYTPTELRESWNGVSKHGDKYMAYAAATGQSTHHILVMSLVTATRSERPSLLYWGVRLDSLLIGGVLLNYMTSALQR

SEQ ID NO: 160374 - protein, 57 aa, Triticum aestivum
  Clone ID: PAT_TA_54792.pep
RWRLSWPRDARTTSCASGERPLGAGGEGRDGHGCTGEGGPWLLASQVGKSTGRGEKR

SEQ ID NO: 160375 - protein, 142 aa, Triticum aestivum
  Clone ID: PAT_TA_54793.pep
VDCAEKCCSLAIKLSSSCFFCSALDTASYSSSFFCCTWRAEGARACSVERLCERMSLLGRRHRSSATGAACVGSPKNSVEIWRGRMSRRPSSSTAACVRWSREPPSLLAEYRSAAIVAGLADLGFLVRLRLRREEKSGCGVV

SEQ ID NO: 160376 - protein, 127 aa, Triticum aestivum
  unsure (1)..(127): unsure at all Xaa locations
  Clone ID: PAT_TA_54794.pep
VHAEQLLSVSSIGPSVPFGIHVGIRWIKRRCRGRRGSWTRACTLRCGLRLGRRPRTMGCPGGGEXHPHAPVGCGCPLKNFRGLPAPAIMGFCACTRTRAVQSPPQARHAAFLFCGNPRTRAVCALAC

SEQ ID NO: 160377 - protein, 161 aa, Triticum aestivum
  unsure (1)..(161): unsure at all Xaa locations
  Clone ID: PAT_TA_54795.pep
PAWRPLPLVWRSASTRQTALAAVPVARTNMAXVTSRFMLAAGIPSGTNGCMSRRVSFHPSNRLXLKLADLTEEEPTAALPRXPAPDEDEKPDASEDTNEPNKDKPPPLGPNIKTKVKILKTECYWYNGTGSIATSDQYLNIRYPKVVRFSKVNYKCVSTYN

SEQ ID NO: 160378 - protein, 140 aa, Triticum aestivum
  unsure (1)..(140): unsure at all Xaa locations
  Clone ID: PAT_TA_54796.pep
MAALSSAAVSGTLLRRQVAATPMRINKMVARAFLDNKAASAGVAMTASAMLMSSSAMAHDVLLGTNGGVLGIEPNEFNNKSSXTITFKNNSGFQHNEPFHXDAVPAGVDVYKIFQEEYLNATGXTLFVTLTVPGTYGFYC

SEQ ID NO: 160379 - protein, 179 aa, Triticum aestivum
  Clone ID: PAT_TA_54797.pep
TGTTVAYLLFPMRSLGQDGWKIAAALMGSYIGGAVNFVAISEALGTTPSVVAAGVAADNLISALYFTALFALASKIPPEAKSASSPEDGGGGEPRGGMSVLHGGAALALSFAICRAGTAIAAGLGVAAGGTLPCVTALVVLLATAFPGALGRLAPSGETMALILMQVFFAVVGANCSVV

SEQ ID NO: 160380 - protein, 172 aa, Triticum aestivum
  unsure (1)..(172): unsure at all Xaa locations
  Clone ID: PAT_TA_54798.pep
SVMASSATSVAPFXGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 160381 - protein, 145 aa, Triticum aestivum
  unsure (1)..(145): unsure at all Xaa locations
  Clone ID: PAT_TA_54799.pep
WVASSGGPFEGVKSTAGLADSGRSNRTSLVXLSNGGRITSMPAWPIXACNKYKTLCYLTRLSTEALMGRSTTMIXRCKRLPCVKLNTVGLIFREHRAYPDYYHGLCWTMSKLPMLVRTDCSQVINYFDDVKNEYLDAYVRIIGCY

SEQ ID NO: 160382 - protein, 160 aa, Triticum aestivum
  unsure (1)..(160): unsure at all Xaa locations
  Clone ID: PAT_TA_54800.pep
TPXSVRHTRRAARAPPAPPPPLPGXXPRRAWAGGGSRPPXXRRXSSPHRXXAPSXGASCFLCKRRXAASRRGGARDEDPPAXGVGRAVEWGAGHAAGVFDXCRPEPHCRHPAXTPXXSPRLFWXGGPTHXKLPRPSSVPVHCGPSRRLLSLWLLCGVCPW

SEQ ID NO: 160383 - protein, 119 aa, Triticum aestivum
  Clone ID: PAT_TA_54801.pep
SATLPKNAGISLARQQLHALLREYLLACGALHHSDHELLAILHARHLLPFLAYTRFDKPVGLNNKFITEHEDQDDRCFSIRSLTKMLTTTALTADIIQTQCILQEKDLSLRKVTLLYRP

SEQ ID NO: 160384 - protein, 83 aa, Triticum aestivum
  Clone ID: PAT_TA_54802.pep
RLPRPETEAINVKQCIFVAFDCLTPSPKQRASLPKVHRGLSLLTFIFTPSGWVLFRFVSSEQNFTCLPCPRPVSPIITALFVG

SEQ ID NO: 160385 - protein, 57 aa, Triticum aestivum
  Clone ID: PAT_TA_54803.pep
PLFGPVPITKIFGKVIIFLKTFFFHGPVANTRVPMFQDSPVLGVKLPVEKMVKTNKM

SEQ ID NO: 160386 - protein, 85 aa, Triticum aestivum
  unsure (1)..(85): unsure at all Xaa locations
  Clone ID: PAT_TA_54804.pep
DSSCPGQAVAPPSLVFRMQVGANXAQPLHGVYETVWDQQPRRQGVLAQSSRPGCSRYLTMRAAVFCAQENLRRPHGTPYVIHRTV

SEQ ID NO: 160387 - protein, 63 aa, Triticum aestivum
  Clone ID: PAT_TA_54805.pep
RVTYLTQISLGDKQIRGEFISPLTTREWGSNETIHHMEGGPDIIKDRVPQWVHGNHVPDTLNI

SEQ ID NO: 160388 - protein, 108 aa, Triticum aestivum
  unsure (1)..(108): unsure at all Xaa locations
  Clone ID: PAT_TA_54806.pep
MLPYFLCFVLFIFLFLWAAARNQGRPFNHIETQKKQREGNRDERRDPNTQVLKNANATVSYHEKHNGXTQHGNHIHFGAENYPRGPHPRSTKQRMGHPIIKKPILLLI

SEQ ID NO: 160389 - protein, 81 aa, Triticum aestivum
  Clone ID: PAT_TA_54807.pep
SHRTQLPPSVSQAIRACTRLLASTVPSTGPTSQGPPQSNGITLVDRYIRRTWPGFCSGPATLEGLHDDGVCFVLNPSALAG

SEQ ID NO: 160390 - protein, 56 aa, Triticum aestivum
  Clone ID: PAT_TA_54808.pep
PWYCPIYPLLISRPRLRHFFLRPLYPPPLLFCPGVFYPVAPPPGLYAPPAPPFCFP

SEQ ID NO: 160391 - protein, 48 aa, Triticum aestivum
  Clone ID: PAT_TA_54809.pep
FLRRGSFCYNGAGSVVPVDQGSVSRYPVVVGFSHVNYPGVSTSSYALV

SEQ ID NO: 160392 - protein, 135 aa, Triticum aestivum
  Clone ID: PAT_TA_54810.pep
VMLRSSVVRHGVRQYINERLVHVTSLTFMSWVWVVSIMLCWDSKRYRSACTSPRSPSTSPSSQASRPFPSPSPCTARRAFTVSPTLGPAWSSRSPSTKLGPHRCAIDPSNLGRLLTCHACIFINCSNVHYMNMFS

SEQ ID NO: 160393 - protein, 41 aa, Triticum aestivum
  Clone ID: PAT_TA_54811.pep
FFFFFFFFFFFFFFFFFFFFAHKKTPFCPTSQRPNIQHGRP

SEQ ID NO: 160394 - protein, 59 aa, Triticum aestivum
  unsure (1)..(59): unsure at all Xaa locations
  Clone ID: PAT_TA_54812.pep
LVASNANVGGPTTAAAMAMAKGWSSLVVPGILVGXFGISIATFLGIGFGMFALRRMSGF

SEQ ID NO: 160395 - protein, 87 aa, Triticum aestivum
  Clone ID: PAT_TA_54813.pep
YDDRYCTMWKQPMFGCPVATQVIIEVEQVNKECHYEYVRIQSFDDMSQVQCVKFIPFQPPGCKQSGEACSAHSPRATYEVPLRFCHH

SEQ ID NO: 160396 - protein, 141 aa, Triticum aestivum
  unsure (1)..(141): unsure at all Xaa locations
  Clone ID: PAT_TA_54814.pep
IFMKSFQLRQGGYSDLPSSKISXMMKSTSLDNAPTQSLLSVVNGILDEIIERKNGEIPYVGYSKAXAHLAFLLRKFVLEVERRISTQAEHIRNQNTLMKAREEKFESRIRVLEALASGKRHVSSNAPEWHERMLLQSLCPR

SEQ ID NO: 160397 - protein, 138 aa, Triticum aestivum
  unsure (1)..(138): unsure at all Xaa locations
  Clone ID: PAT_TA_54815.pep
VLEGKRPHGLPSFLVEGRXGVSTVVRSDQRMTAEXTRQXEESIPXSRVLLLKAPKGSGPVCPSRRTSRLVAPDAKRRVPAGQRVTRAPHAAEQGDAPGPRGRWXXQGFASLWRALEVARTLHPARFLVPQPGRRPKGL

SEQ ID NO: 160398 - protein, 120 aa, Triticum aestivum
  unsure (1)..(120): unsure at all Xaa locations
  Clone ID: PAT_TA_54816.pep
STLNVSMPNFPVEEKXDFSFKLYDMDGTGFIERKEVKQMLIALLGESEMRLSDEIVETILDKTFSDADTNQDGKIDRTEWENFVSRNPSLLKIMTLSYLKDITTTFPSFVFHSEVDDIVT

SEQ ID NO: 160399 - protein, 85 aa, Triticum aestivum
  Clone ID: PAT_TA_54817.pep
MDARGGDASAIALLLCACFLTALACDSNGAKFAYSGPLGPDHWGGLDPNFTRCAMGTYQSPVDIKTSDVVYNPMLGPLHREYTAA

SEQ ID NO: 160400 - protein, 176 aa, Triticum aestivum
  unsure (1)..(176): unsure at all Xaa locations
  Clone ID: PAT_TA_54818.pep
YQHPTVMASSATFDAPXQGLKFTAGLPVSRRSNGASLGSVRNRGRIRCMLVWPIKGIKMCETLSYLPPVITKALLKQVHYLIRSKWVPCLEFSMVGYIFREHNAYPGYYYGRYWTMRKLPMFGCTDTTQVINEVKEVNKEYPDTNVRIIRFDNMRQVQSVSFIAFKPPCCEEYGKD

SEQ ID NO: 160401 - protein, 78 aa, Triticum aestivum
  Clone ID: PAT_TA_54819.pep
FEETFVFSRVLFEAKICKVLVFCFSPKLMHKRFRLGLCTLHAPLFPYFSAVVSLLPCLHPFPPCRLFYRTGLHLWRGS

SEQ ID NO: 160402 - protein, 78 aa, Triticum aestivum
  Clone ID: PAT_TA_54820.pep
RPGPAGWLPGSCPARTVTNTGTSRRRRRCRRSRRRRSCSDDGGGPTMTTTKTKQQNRESIYRLLLLSTYCRTKDLYRK

SEQ ID NO: 160403 - protein, 79 aa, Triticum aestivum
  unsure (1)..(79): unsure at all Xaa locations
  Clone ID: PAT_TA_54821.pep
GPKFGSDCKFGKMSPDFTDQGSAAAQVNRXVSCLGVAPKNKAGQFQVAPGQXSGEGCTYGNNCKCNPPPCNPASTRVMV

SEQ ID NO: 160404 - protein, 76 aa, Triticum aestivum
  Clone ID: PAT_TA_54822.pep
SLVMLCLVGAYVFKFKLNFILPFLPSWILDKFPYAYCLDLLPWCFFKERCILLNLNAFLVILRVPITKSYSAILYS

SEQ ID NO: 160405 - protein, 126 aa, Triticum aestivum
  Clone ID: PAT_TA_54823.pep
RRAPQGPGGLGLGPPALRGAELLPARCFSGLWALLKVGFLPPCARLGPRVPLCGVGGPPLCLLWPFGPPLPVLGARAPPPCSPPGPFLFFRGPFFFPPPALKYVPYFGTPPGLPPPVNLDPQSPPI

SEQ ID NO: 160406 - protein, 101 aa, Triticum aestivum
  Clone ID: PAT_TA_54824.pep
EWKLHWNKSAPYNKLLVYAFYDKNSTLYKAMEKLLEKLAKQYIGKADFCKLDVDNFEYLAGLCGVEGAYPTFVLFKNCKQVGKVVGLKDDELERSIERALN

SEQ ID NO: 160407 - protein, 168 aa, Triticum aestivum
  Clone ID: PAT_TA_54825.pep
VRLKKYALPLAISHFIIIPAWFTPPCHGPGKMTPMGGGGAHTTQAVHVHGHGGQGLPLAKPNPSAGTREKNRKGLTKGTDALLLLEPVNFHYHRARNTSLTLGPKCPLLCKVLSMWTVGLGMELLGRITCTTSLSTTSAGCWMVELAAVPEDPLAVLGALHRCTAWPR

SEQ ID NO: 160408 - protein, 69 aa, Triticum aestivum
  Clone ID: PAT_TA_54826.pep
VAKKGVSHFFSKYGPKVEGYSPIYPPEEWFYFGARYPGGTPGFFFWAVPLAGLLGGGVLFVYNPRAFPG

SEQ ID NO: 160409 - protein, 82 aa, Triticum aestivum
  Clone ID: PAT_TA_54827.pep
LIGRVVFNGPPAVVFPELLCGPPGAFGFCGPQWGPPLGGPPNFVLFSQNIYDVGRPPEILEMGPLWAFQNGEDPSGILNLNS

SEQ ID NO: 160410 - protein, 81 aa, Triticum aestivum
  Clone ID: PAT_TA_54828.pep
KIRGRGIYIAIGGIHKGGGVLEAWREHGHTHILILGTNKKDKGKRKTQSNGRGDKTARALYMGPGGRELLRPCRTPRNPGG

SEQ ID NO: 160411 - protein, 188 aa, Triticum aestivum
  Clone ID: PAT_TA_54829.pep
YNYSYDPLQEYLSFISDGGFSVDGVLTDYPITASEAIGCFANLNESKADHGKPLIISHNGASGDYPDCTDLAYQNAIKDGADVIDCALQVTKDGVLICMSSINLLETTNVQRTPFSTLTSVIPEIKSTAGIYTFNLTWNNISDSSLKPKISSPLSSYYLVRNPRYTNNGKFVKFSDFLEYGKDQDLSG

SEQ ID NO: 160412 - protein, 70 aa, Triticum aestivum
  Clone ID: PAT_TA_54830.pep
QTYNVKTSIIRKEIWSICPIFCYSLGYRSKGNCYVLSVASLCQTNNVKTSTIKGNNKFQKTCFIFPIFPL

SEQ ID NO: 160413 - protein, 174 aa, Triticum aestivum
  unsure (1)..(174): unsure at all Xaa locations
  Clone ID: PAT_TA_54831.pep
MAPAVMASSATTVAPFQGXKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKP

SEQ ID NO: 160414 - protein, 194 aa, Triticum aestivum
  unsure (1)..(194): unsure at all Xaa locations
  Clone ID: PAT_TA_54832.pep
ATDNFAAXDKLGEGGFGAVYKGNLPDGREIAVKRLSRSSAQGIGELKNELILVAKLQHKNLVRLVGVCVQEHEKLLAYEYMPNKSVDTILFDPERSKELDWGKRLKVISGIARGLQYLHEDSQLRIIHRDLKASNVLLDSDYTPKISDFGLARLFGVDQTREVTNRVVGTYGYMAPEYAVRGQLSVKSXVFSFG

SEQ ID NO: 160415 - protein, 167 aa, Triticum aestivum
  Clone ID: PAT_TA_54833.pep
HSLVLLLGREEKKVRRKRSELFRKNGGLLLQQRFSAFTSQSKDSSAKIFSAEELKTSTNNYSETRILGRGAYGTVYKGVLPDETLVAVKKSRVFDESQVEQFVNEITILSQTDHPNVVKLLGCCLETEVPLLVYEFIPNGTLFQHIQNKSAPLSLTWEDTLRIAAQI

SEQ ID NO: 160416 - protein, 51 aa, Triticum aestivum
  Clone ID: PAT_TA_54834.pep
QLLAGNFEEACKAAGAPLTLRMQPGYDHSFFFIATFIDDHIAHHAQFLKSG

SEQ ID NO: 160417 - protein, 85 aa, Triticum aestivum
  Clone ID: PAT_TA_54835.pep
HRHLLTKDNKFHKFLNILNNKNRSFQKRMGIESHTTIDKNELILGIVQHNDHVADLIVMPWCMRLLPIRSSPLTLTMAFCLVPGR

SEQ ID NO: 160418 - protein, 77 aa, Triticum aestivum
  Clone ID: PAT_TA_54836.pep
SRPRPRPRRKPPLLAGVWKHEKSDGHEYYGLLVSESARKYAIVKELDSPVTLKDVTVVLQFEMRLQNGLECGDGVGG

SEQ ID NO: 160419 - protein, 58 aa, Triticum aestivum
  Clone ID: PAT_TA_54837.pep
VGTSLQCMMSIFILKLTLFNSIAIFPPSSIVDTPSAKKICRDSTIVENVNKSSIGQNG

SEQ ID NO: 160420 - protein, 59 aa, Triticum aestivum
  Clone ID: PAT_TA_54838.pep
FRVRVWIWKGSSRRRFFYYLQIQLEFFLFLQVVICFISPPESINMIRQVEYIFLPCVLS

SEQ ID NO: 160421 - protein, 194 aa, Triticum aestivum
  Clone ID: PAT_TA_54839.pep
AYYREAYGGYGMATPGYAAPVPYGMSQVNIDGNCGGRPMPPQPTVKIYCRANPNYAMSVRNGKVVLAPANPKDDYQHWIKDMRWSTSIKDEEGYPAFAMVNKATGQAIKHSLGQSHPVRLVPYNPDYLDESVLWTESRDVGNGFRCVRMVNNIYLNFDALNGDKYHGGVRDGTEVVLWKWCEGDNQRWKLQPYY

SEQ ID NO: 160422 - protein, 139 aa, Triticum aestivum
  unsure (1)..(139): unsure at all Xaa locations
  Clone ID: PAT_TA_54840.pep
EAVWFKAGSXIFSEGGLDYLGNPSLVHAQSILAIWACQVVLMGAVEGYRVAGGPLGEIVDPLYPGGSFDPLGLADDPEAFAELKVKEIKNGRLAMFSMFGFFVQAIVTGKGPLENLADHLADPVNNNAWAFATNFVPGK

SEQ ID NO: 160423 - protein, 103 aa, Triticum aestivum
  Clone ID: PAT_TA_54841.pep
LHLACNKYTHLIVVAIASLASILRRLHCGTVSISTEESLHSPPLSAPWDNPTSAQIGFPDPTVNSVRLIVSNKAGFHLALYTAARWMEVTSAKPAGLLGRGLG

SEQ ID NO: 160424 - protein, 65 aa, Triticum aestivum
  Clone ID: PAT_TA_54842.pep
AQPPAVAPMPELNKTEVQQPPFPPVAPKNAPPGAAAPPGSSPFDAHTTAVSTCILLVAACAALLL

SEQ ID NO: 160425 - protein, 48 aa, Triticum aestivum
  Clone ID: PAT_TA_54843.pep
CYMNMDIHIFLGTTWLEKACSYVNAIGGYVYAHAHNILYNLSTMYSGN

SEQ ID NO: 160426 - protein, 99 aa, Triticum aestivum
  unsure (1)..(99): unsure at all Xaa locations
  Clone ID: PAT_TA_54844.pep
LLAILIFILMFLLLWLMFHTYIALTNQTTYKVARRKRIFYXRGIPDRVHPFSKGICRNIYDFCFTRENGFVLEAVPPIEELEARAAPYTCRDLFCCRCC

SEQ ID NO: 160427 - protein, 143 aa, Triticum aestivum
  Clone ID: PAT_TA_54845.pep
VRGQLSVKSDVFSFGVLMLEVVTGRRSSCSWNFDESVNLSSLVWEHWTMGTTAEIIDSSLRGHAPGNQVVKLFHIGLLCVQDNPADRPTMSTVNFMLSSNTVSLRSPSKPSFLMCMSPTSSESTRMPGMASPNEASITGLEPR

SEQ ID NO: 160428 - protein, 116 aa, Triticum aestivum
  Clone ID: PAT_TA_54846.pep
MHMVIVVNEGRLLKEIEPHILEEASEEQLYAVAQLSVRCLSMNGQERPIMKEVASVLEELRRSFTKEQTMRKTGEPFNEQGNLLREASSTSSLHHSEGITQLSMEAEMKASCQTPR

SEQ ID NO: 160429 - protein, 79 aa, Triticum aestivum
  Clone ID: PAT_TA_54847.pep
RCCMYHLVITRYRETCCWFQLVFHGTLCPSNSKHILWLCPAFGHGLVFAYPSTWQCLVLALLNCIYLQVEVECPCVASE

SEQ ID NO: 160430 - protein, 94 aa, Triticum aestivum
  Clone ID: PAT_TA_54848.pep
GGRTRGYTGIKQNPMGRGLFYGQGLRKKHSKGDLGGNKGGGRALKNRGGEKGLLRGSKGEKGKTAPGKPGKTTPPDTMLRRKFLGEGESPGDAA

SEQ ID NO: 160431 - protein, 171 aa, Triticum aestivum
  Clone ID: PAT_TA_54849.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTYSKTFQGPPHGIQVERDKLNKYGSSFIW

SEQ ID NO: 160432 - protein, 120 aa, Triticum aestivum
  Clone ID: PAT_TA_54850.pep
PCQVAANFTSQVIIMNHPGQIGNGYAPVLDCHTSHIAAKIAELVTKIDRRSGKELEALPKFLKNGDAGIVKMISTKPMVVETFATYPPFGRFAARYMRQTVAVGVINGVEKKDPTDSKVT

SEQ ID NO: 160433 - protein, 69 aa, Triticum aestivum
  Clone ID: PAT_TA_54851.pep
FKGSTKLSSWMPGCFAARSRQATGPTEYGCLMTTSRGWRTYFQVCETGIMGSQDIIQISSCTEKAHHCT

SEQ ID NO: 160434 - protein, 43 aa, Triticum aestivum
  Clone ID: PAT_TA_54852.pep
PLRSQSVDKAYCVSNTGLHFVKINHIYSSPPRFVNQDGLKPFT

SEQ ID NO: 160435 - protein, 120 aa, Triticum aestivum
  unsure (1)..(120): unsure at all Xaa locations
  Clone ID: PAT_TA_54853.pep
MAPAGMASSATTVAPLQGLKSTAGLPDSRRSGSAGLSSASNGGRIKCMQVRPNEGIKKFETLRYLPPLXSEALLRTXDYLIRSKRVPCLEFTKVGCAFREHNNSPEYXPGRYWTRVTCLC

SEQ ID NO: 160436 - protein, 130 aa, Triticum aestivum
  Clone ID: PAT_TA_54854.pep
SCDVPGIKRLLPSEWREWDMFDNIYKLDGVPVVTVQLRYNGWVTEVQDLEKSRQLQKAVGLDNLLYTPDADFSCFSDLALSSPADYYIEGQGSLIQAVLTPGDPYMPLPNEEIISKVEKQVLDLFPSARG

SEQ ID NO: 160437 - protein, 102 aa, Triticum aestivum
  unsure (1)..(102): unsure at all Xaa locations
  Clone ID: PAT_TA_54855.pep
LTTVTTAALLKQTTYQILSKXVPCLELTKTGTMLRQHNAFADYYNGTAMQQCXNLPIFGSTDTTHVINAIPEAKTNYPHTNRRIISLYNTTNLQSLRFMLLL

SEQ ID NO: 160438 - protein, 38 aa, Triticum aestivum
  Clone ID: PAT_TA_54856.pep
LWLLTCFSSPVSGLPAHGVCRLFNTGDLFVNLQDRCAL

SEQ ID NO: 160439 - protein, 73 aa, Triticum aestivum
  Clone ID: PAT_TA_54857.pep
AGGCPSLSDQLNVDAFLEQARSYDKASSNPVGWYIRNAQTRELSHPLPVMRAREMDEWSRSQEYRTLLQKMFR

SEQ ID NO: 160440 - protein, 76 aa, Triticum aestivum
  Clone ID: PAT_TA_54858.pep
QRDLTCIVFFIYNLSNTKTLQYSRTSPCLYTQAADRNNLGLHRHDNRSQLAPYDMQANNNHSATLITISLNIIEYD

SEQ ID NO: 160441 - protein, 121 aa, Triticum aestivum
  Clone ID: PAT_TA_54859.pep
TSGVDQQASLVRGMPALSDSAPCVRFTWSASYPSTPRTSNSPASHNQLTLARPYIKRHRISCNSDHAVGSPCSTNPCDLFLRICVCPCSCTVMCSKKPACISMLSVTMYMPDMHNISLYDL

SEQ ID NO: 160442 - protein, 92 aa, Triticum aestivum
  unsure (1)..(92): unsure at all Xaa locations
  Clone ID: PAT_TA_54860.pep
LAFGKQKRNAVISQGSYTVVVSEYGKVQTLPVFLLSKXNLVCTNAPGHAFVGGFLYQLVQEKSFXSCVKAGWLATNVIIQQSGCTYPKKPDF

SEQ ID NO: 160443 - protein, 73 aa, Triticum aestivum
  unsure (1)..(73): unsure at all Xaa locations
  Clone ID: PAT_TA_54861.pep
GHIVKVPVNYXPSGSSPIKGDVTWDCYGLTEEADNLGYLSMMSTDAIKTIGNDTCDDESDYAEYDEFPGLLFI

SEQ ID NO: 160444 - protein, 99 aa, Triticum aestivum
  unsure (1)..(99): unsure at all Xaa locations
  Clone ID: PAT_TA_54862.pep
SASRYWYAXEVTXVVELGCMHSMTGVKIKDMLMWVAIYKMVISPSGSKIVFRTTSVIGGPFPVFAFQISHPAPKCKAKSTEESSPNCSICYGVKSPVTC

SEQ ID NO: 160445 - protein, 57 aa, Triticum aestivum
  Clone ID: PAT_TA_54863.pep
GPEEKLTGGGFHTCRRRSDLQRVWTEGNILVLYFTGLRAKHLAFQKKCWAGYSYSTK

SEQ ID NO: 160446 - protein, 33 aa, Triticum aestivum
  Clone ID: PAT_TA_54864.pep
SLTKFIEENINIYHNKFILCESIFDNESNGVDF

SEQ ID NO: 160447 - protein, 86 aa, Triticum aestivum
  Clone ID: PAT_TA_54865.pep
QKQPHKLNARLQLSNTKERNRDTRYTPRINRPDFGAFMMHHNSIPTGLGGSPLSVGILHYMNINVKNIRMTRDYRTNGNRHSTGLT

SEQ ID NO: 160448 - protein, 138 aa, Triticum aestivum
  unsure (1)..(138): unsure at all Xaa locations
  Clone ID: PAT_TA_54866.pep
PGGPFEPVGLATDPDQGGLLKVKEIKNGRLAMFSLVGFFIQAYVPGEGPFXNLWGPLNDPFGNNLLPVISGAPQRVPPLLTGRLFPVPPPRLFMDQLRSMRPMQHHFLCEFFPGKVLKYEFPVRVNFPGPKKHGRSLF

SEQ ID NO: 160449 - protein, 68 aa, Triticum aestivum
  Clone ID: PAT_TA_54867.pep
CRYVVTLQIKGVPVPEHLEFGLYLKVQQSEDRHLRVVGAIRGGACISSPAMTRLTVGEWFGQASAYAV

SEQ ID NO: 160450 - protein, 210 aa, Triticum aestivum
  Clone ID: PAT_TA_54868.pep
PRVRGCSVAQKMKQLREKLQHEKASGIIITALDEVAWLYNVRGNDVHYSPVVHSYAIVTLHGAFFYVDKRKVTTEVKNYMSESGIDIREYDMVQLDVSLLASGQLKGSAVNGSLHMEKDINVAEHSKIWIDSNSCCLALYSKLRPDQALMLQSPIALPKAVKNPMELTGLRKAHIRDGAAVVQYLAWLDNQMQENYGASGYFSEANGSQK

SEQ ID NO: 160451 - protein, 106 aa, Triticum aestivum
  unsure (1)..(106): unsure at all Xaa locations
  Clone ID: PAT_TA_54869.pep
MSCNEAACTLAALILHDDGIPITFDKIATGVKAAGIKVEAYWPALLNKLLENRRRDDLILSCESGGGGAPDVDAATPAAVAAAAPEENKEDKSERLXEDSHDYMGF

SEQ ID NO: 160452 - protein, 117 aa, Triticum aestivum
  Clone ID: PAT_TA_54870.pep
PRVEGGRRDRRGVRCIWIRAAKLTFSAPRILLHLLPATPVVLYHAVVARWCAPSLLRSSFSRRRKMAAKKNAGVLALLVVDGTLTVPCKEVTPVLLVFMKRLRENVTVGVVGGSDLD

SEQ ID NO: 160453 - protein, 74 aa, Triticum aestivum
  unsure (1)..(74): unsure at all Xaa locations
  Clone ID: PAT_TA_54871.pep
CDSSSKTCMRVNAWXRQAAAGVLNGRLRSANHFKEVSYKLFFLVXELFLCVAQHXEEKDQLRVKANELAGLFMS

SEQ ID NO: 160454 - protein, 108 aa, Triticum aestivum
  Clone ID: PAT_TA_54872.pep
SSTRSEKKKKKKKKKKKKKKKKKKKKKKKKKKKKKKKKKKKKKKKGGLFLGVPCFFSALFGNFLVFFLGPLNLISLAVFLQLRVWKNLGFPQFIGFATFPLFASWFFS

SEQ ID NO: 160455 - protein, 96 aa, Triticum aestivum
  Clone ID: PAT_TA_54873.pep
GHLYWDARGEIVGLTEDKLLRKHLTLDDCIDQGLKLRDRTRLDTATVYNHILCRLEIDHVYYDSLNILAKVKVLSSGRRVERRELYGVLQACSYPC

SEQ ID NO: 160456 - protein, 64 aa, Triticum aestivum
  Clone ID: PAT_TA_54874.pep
ADYFPKCCNNCRSFSGVDVCDDAHPKCPKGCSACRVVSTSPEMWRCADMKSTVDGTCGGPCKKY

SEQ ID NO: 160457 - protein, 201 aa, Triticum aestivum
  Clone ID: PAT_TA_54875.pep
MSIAPESEFVIPNQSTINLGVQLKEKDDLQLVEIPVPKPEKDHVQVQLKCVGICGSDIHLWKYGEIGIFPVTQPQLLGHEGAGIVTAVGENVTSLRVGDRVAIEAGIPCSFCDQCMSGRYHLCPDVIFKSTPPYDGILAKYITHPARWLHKIPASISFEEGALLEPLSVAIAAVDRVRAKFGKSLLITGCGPVGLLILAGA

SEQ ID NO: 160458 - protein, 132 aa, Triticum aestivum
  Clone ID: PAT_TA_54876.pep
KQTARKSTGGKAPRKQLATKAARKSAPTTGGVKKPHRYKPGTVALREIRRYQKSTELLIRKLPFQRLVREIAQDFKTDLRFQSSAIGALQEAAEAYLVSLFEDTNLAAIHAKRVTIQPKDIQLARRLRGERS

SEQ ID NO: 160459 - protein, 124 aa, Triticum aestivum
  unsure (1)..(124): unsure at all Xaa locations
  Clone ID: PAT_TA_54877.pep
ETQLXRSPHNQGGRKAPPPRNCWCVKTPNKRAPRSGTPXPEPTPXTXKRTRXEXKRTQNEQGKXRXXXKPPPPPPAXXXXEEPGPPRXXRAPXXXALAPRARPXXXXXSXXPPRDLDQTSSRSR

SEQ ID NO: 160460 - protein, 107 aa, Triticum aestivum
  Clone ID: PAT_TA_54878.pep
AFWACQVGLMGAVEGYRVAGGPLGEIVDPLYPGGSFDPLGLADDPEAFFELKVKEIKNGRLAMFSMLGFFVQAIVPGKGPLENLADHIADPVNNNAWAFAPNLVPGK

SEQ ID NO: 160461 - protein, 174 aa, Triticum aestivum
  Clone ID: PAT_TA_54879.pep
GITTFNDLVMRRNFNSWKRAMQIQYNITRLEEWCKSHEASEATNQLEHLTQATKLLQLKKATLEDIKIIYDVCWFLAPTQVQKLIQNYIVADYEEPIHNDILRAVASRVSSSDTEDILLLDNVSLEESDYDQPEPHNVTISSYVPDYLNIQHVQKLIALTNLSEQLKPQRMDSI

SEQ ID NO: 160462 - protein, 127 aa, Triticum aestivum
  unsure (1)..(127): unsure at all Xaa locations
  Clone ID: PAT_TA_54880.pep
RKSFWVLGGVWNGGSNMEYCRFLQSLDDPEISYSVAITTFWIIETVYQDSFAFCIEEGNKTPAELXGTCQRWGSPEFKQYCQSLQRIADRCLANAPHDVVVVKRAEEAFLGVLELEIGFWDMSSSQS

SEQ ID NO: 160463 - protein, 71 aa, Triticum aestivum
  Clone ID: PAT_TA_54881.pep
KCQLLGEERKQNGPGSEPEGQEGHVPEGTHPLMRAGQDDLYMKGTSFSGVLFSNYWCEQPITRGLVPTTVS

SEQ ID NO: 160464 - protein, 63 aa, Triticum aestivum
  Clone ID: PAT_TA_54882.pep
QIAGQKDELRLILTGRTHTTLQITHKTTRGGGERRTRAGATLPLLRRNVHTDGRGVARESGRT

SEQ ID NO: 160465 - protein, 159 aa, Triticum aestivum
  unsure (1)..(159): unsure at all Xaa locations
  Clone ID: PAT_TA_54883.pep
VHPIGMTDVQDHRLEYAXKMGATFXYKIVPGNSETETVNEIRNCLVGEGAECSLECTGIESSFRTAIMATREAGTCCLVGVGKNDQTIPVNNFAMREVDIRGLFRYHHTYPRAIALLSSGAIQDIKHLVTHKYEFKDALKAFETTSDYSRGAIKVQILN

SEQ ID NO: 160466 - protein, 169 aa, Triticum aestivum
  Clone ID: PAT_TA_54884.pep
YAKEHEPCIIFMDEIDAIGGRRFSEGTSADREIQRTLMELLNQMDGFDYLGQTKLIMATNRPDTLDPALLRPGRLDRKIEIPLPNEQGRLEILKIHAGNIAKHGDIDYEAIVKLSDGFNGADLRNVCTEAGMSAIREERDYCIQEDFMKAVRKLQDAKKLETKLDYEKI

SEQ ID NO: 160467 - protein, 54 aa, Triticum aestivum
  Clone ID: PAT_TA_54885.pep
FRFQPSAIGAFQEGGEASLVSLFENPNLAAVHAKRGAIPPGGFPLARGFGGDRF

SEQ ID NO: 160468 - protein, 103 aa, Triticum aestivum
  Clone ID: PAT_TA_54886.pep
LVIKFVAIAFAEHQRTMEKAPEKKKYPGGAFDPLGFSKDPAKFEEYKLKEIKNGRLAMLAFVGFCVQQSAYPGTGPLENLASHLADPWHNNIGDIIIPRSISP

SEQ ID NO: 160469 - protein, 75 aa, Triticum aestivum
  Clone ID: PAT_TA_54887.pep
WAKSMGAKIIASDVIPDKVEHAIKLGCNGYVLRQKEEGIDPESDSLTDMMATKIVGKSWPNYLNMLKKSGILILV

SEQ ID NO: 160470 - protein, 62 aa, Triticum aestivum
  Clone ID: PAT_TA_54888.pep
TRARAASRRRTARGRSTPPAEAAGTARGRGGPAERCHADRGQPPGAGDAPPNQRGQSLAPRP

SEQ ID NO: 160471 - protein, 134 aa, Triticum aestivum
  Clone ID: PAT_TA_54889.pep
LMKKTTSPEIQLAINGNEYYDDTYINNNHGNKKNIKNKSSRDNIEYNNYNKFYKVESININTNQVISDRTLELVNNLQEEFNKYIKDIKRNIDETFLDDKKQYGTNLKIDLNKISSELNLFKNNFKDITFRRIK

SEQ ID NO: 160472 - protein, 73 aa, Triticum aestivum
  Clone ID: PAT_TA_54890.pep
RTTFICATLRAPVSSRVQCRNQQKMALQPTIVWTMSGLIQLITPGCQMSLPQVMISITGSMHHRNFCSTVSPG

SEQ ID NO: 160473 - protein, 211 aa, Triticum aestivum
  Clone ID: PAT_TA_54891.pep
PTLQYQNATQPDITYLPDLKNYKQRTARRLANEQLENDLPEGFPAQLEGPKLWKGSDYEGKESEWVYQLTEQELEEVDKAVHDFEATEKPLGEINKETFPLPNLGPKLKELIEKHVLDGRGFVVVRGLNPDKYTRVQNIIAYTGISAWVGKRGLQGLHTIAHIKDLVPEKGLDDIVAPAFTNDHQVYHTDVGDIISLYALGVAEEGASHVS

SEQ ID NO: 160474 - protein, 213 aa, Triticum aestivum
  unsure (1)..(213): unsure at all Xaa locations
  Clone ID: PAT_TA_54892.pep
ELIANCLKTQGVEVVFGIVGIPVVEVAEACVAAGIRFIGFRNEQSAAYAASVYGYLSGRPGVCLSVGGPGVVHALAGLLNSKINCWPMVLLSGSSETDQVERGAFQELDQVEACKPYCKYAARPTSLEQLPFIVEKAFRTALYGRPGAAYVDLPADFIQYPIRNKQVMEDIQVPKVPNAPKAMADVDDLNKAVSLLXNAKHPLIVVGKGASYA

SEQ ID NO: 160475 - protein, 65 aa, Triticum aestivum
  Clone ID: PAT_TA_54893.pep
ALLLNKDGPSEASSSAMRDLESKLDATTKECLAEKEQNRKLTVENEKLQYRVSHLIRTIKEAEAR

SEQ ID NO: 160476 - protein, 96 aa, Triticum aestivum
  unsure (1)..(96): unsure at all Xaa locations
  Clone ID: PAT_TA_54894.pep
KRRNWKNPGVTKLNRLKKNPLFPSWRKSKKAPTDPPSKKLPTLNGKXEPPLKRKINPGGWXVTPRGTVKLASAQTPPPLLFFPSFLPKFAGFSPKI

SEQ ID NO: 160477 - protein, 211 aa, Triticum aestivum
  Clone ID: PAT_TA_54895.pep
PRVRDYSKHISEASKARNPSAIRALMPYLNRKDMISLGAGQPNPATFPFASLTLTLKTGEKIEIDDQLFDRSLSYDLTSGQPLLNQWLTELQKIEHAPPVDFDVSIGSGSQDLLTKALEMMINPGDAVMVEEPTYTGALAFLETMPCTLAHIATDEFGIVPESLENMLAHWPESNPSGKKDQPRPHVLYTIPSGGNPTGISATYERKQAVY

SEQ ID NO: 160478 - protein, 108 aa, Triticum aestivum
  Clone ID: PAT_TA_54896.pep
MGVTVETIQPGDGKNFPKQGDTVTIHYTGTLQNGSVFDSSEKRNEPFVTKIGVGRVIKGWDEGVPQLSLGQEANLICTPDYAYGPRGFPPVIPPNATLNFRVKLLKIN

SEQ ID NO: 160479 - protein, 101 aa, Triticum aestivum
  Clone ID: PAT_TA_54897.pep
VTLLGCAHVPACPIAWKCGPRQPRGEQGRRPNLEYNATTTLRAFLRALVEPPDPNFWLHRLQARCALRAVPGLGGWMETQPTNVGLKRQAVIVQFNASYCW

SEQ ID NO: 160480 - protein, 201 aa, Triticum aestivum
  Clone ID: PAT_TA_54898.pep
MATTVPPQQITAAQKLAQVNEQTWLTMGNLAEMMTDYEKAMNCYESALRHNPYSVVALSQIASLYRGREQFGRAVEYFKRILAIQENNGETWAALGHCYLMMDNLQEAYQAYQQALYHLSNPKDPKLWYGIGILYDRYGSLEHAEEAFSAVMKMDPKFEKANEIYFRLGIIYKQQQKYDLSLQCFRYILHNPPRPLTESDI

SEQ ID NO: 160481 - protein, 56 aa, Triticum aestivum
  Clone ID: PAT_TA_54899.pep
KGPPPFYFLFFFYFFFFLIFFLFYFFFFFFFFFFFFFFFFFFFFFSPARVCSSSVV

SEQ ID NO: 160482 - protein, 93 aa, Triticum aestivum
  Clone ID: PAT_TA_54900.pep
RLSRRGHNSVPLKLPSWLRQLKHCALFPAAARLDTTHEDTDEDEEALLRQCPYTTLVRRMAKHPDWHTLQPDHETGCITPLTSHDLHMYNHKL

SEQ ID NO: 160483 - protein, 128 aa, Triticum aestivum
  Clone ID: PAT_TA_54901.pep
MAMISPAAATVVAARPGQALGLPQLRVTRAERLRCGCSKDRKEAAAASPAVVKGVPLLAAASAAATAAAPALALVDERMSTEGTGLSLGLSNNLLGWILLGVFGLIWSLYTVYSSTLDDDDESGGLSL

SEQ ID NO: 160484 - protein, 67 aa, Triticum aestivum
  Clone ID: PAT_TA_54902.pep
IPPASPPVPLRRSLSSPSFLTPSVLMSMSAPSLFVLSRYSSSNKLGALLKSTNLLLKFLLQLRFVAA

SEQ ID NO: 160485 - protein, 79 aa, Triticum aestivum
  Clone ID: PAT_TA_54903.pep
SGYVALGNAGVAAYKEQNKTGEFELEVAVTGEVRYMLQLKKNKLAGTCKLKLKLDSPATASVVFERVKCKLEKEKKDNE

SEQ ID NO: 160486 - protein, 47 aa, Triticum aestivum
  Clone ID: PAT_TA_54904.pep
AARRFVASWQLAASMYVPESYIVCFPLVSSMYLMQWSAGFCAVKVLA

SEQ ID NO: 160487 - protein, 91 aa, Triticum aestivum
  Clone ID: PAT_TA_54905.pep
QCQTVLMYPYGASSVKCAICNFITNIGMNTVRPLPPTMHAPNGISYSVPSTSAPSAQSQNVTVVVENPMTVDDKGKLVSNVVVGVTSGGKK

SEQ ID NO: 160488 - protein, 52 aa, Triticum aestivum
  Clone ID: PAT_TA_54906.pep
KGKPFWVFKNLWGENWGGKGFFKIFRGLNVANKWGVGSMVSPGSPPPPSKEE

SEQ ID NO: 160489 - protein, 98 aa, Triticum aestivum
  Clone ID: PAT_TA_54907.pep
KDLSAACKNEPESTEAKRAVELLYETALISSGYTPESPAELGGKIYEMMTIALGGRWGRSGTEEAETNADVDSSEGVVTEVVEPSEVRTENENDPWRD

SEQ ID NO: 160490 - protein, 163 aa, Triticum aestivum
  Clone ID: PAT_TA_54908.pep
MADVEYRCFVGGLAWATDDQSLQNAFSKYGDVIDSKIITDRETGRSRGFGFVTFASDEAMRQAIEAMNGQDLDGRNITVNEAQSRRSGGGGGGGFGGGGGGYGGQRREGGGGGGYGGGGGGYGGGRSGGGGGYGSRDGGGYGGGGGGGYGGSRGGSGGGNWRE

SEQ ID NO: 160491 - protein, 39 aa, Triticum aestivum
  Clone ID: PAT_TA_54909.pep
HISLYDAIFGRVCLFEYGGQVLVVRAQLDIFRIVIHCGS

SEQ ID NO: 160492 - protein, 100 aa, Triticum aestivum
  Clone ID: PAT_TA_54910.pep
AIRWGSYLVIAHPSETLLTPCLARSKLGQTDRARRYPLMFETDVEADDIENKAMASFQRSRIATILSDFLVLTTYAYAWMFRLNSKCNSHVTRARSIFYI

SEQ ID NO: 160493 - protein, 73 aa, Triticum aestivum
  unsure (1)..(73): unsure at all Xaa locations
  Clone ID: PAT_TA_54911.pep
TTSQVDIVGVSCYSSKDLWAWKNEXXSCLRGEKKNVTHXLHVSNVLERPKVIXKRSDRXNTVMWMHIDDANYT

SEQ ID NO: 160494 - protein, 80 aa, Triticum aestivum
  unsure (1)..(80): unsure at all Xaa locations
  Clone ID: PAT_TA_54912.pep
MVEKFAESGNNVIIREVPKGLTPAIIVLLVVATPLXFLFVGNYALCLYGQYTLPPKKKKPVSKKKLKRENLKQGGFAPGE

SEQ ID NO: 160495 - protein, 91 aa, Triticum aestivum
  Clone ID: PAT_TA_54913.pep
KVQAILCCLDCLKATLQNSEPLSAQLADTFEQVMPHYAMHGLHQLGCCLFTFLHAGTGGFLVAMAAKRGGCRLQPCAQALLWWITAKCGWL

SEQ ID NO: 160496 - protein, 85 aa, Triticum aestivum
  Clone ID: PAT_TA_54914.pep
PRSDPSVVRHSARASGESGAKLTLVVRFRPCAKRLSPDPGLASFGRLRPDRIAHTTVYRGHATSEFQALGSMRIREWRTRPKVVS

SEQ ID NO: 160497 - protein, 83 aa, Triticum aestivum
  Clone ID: PAT_TA_54915.pep
PVLLQTQFIHWLNTPGTIQDAPEELLLNNDRKLNLHSKDGTNKNTPTGGACQHDSDMTNTLLPATILLLIARTALGIVRASSV

SEQ ID NO: 160498 - protein, 162 aa, Triticum aestivum
  unsure (1)..(162): unsure at all Xaa locations
  Clone ID: PAT_TA_54916.pep
VKQLLSLIQQLPXLYMDLVKGREDFIPKPEETRRXIKSYYGISRNLLVKFEDDQIDETSIIAQVLSSESAISSLLDMSIRSLPGDHGLPLQXGMADAVSRGVELLANLTTGTPWEAVAKEVGTTFGTDSGVRRTQAPEDVNALVDVIVSWIASNSGPKLLRS

SEQ ID NO: 160499 - protein, 104 aa, Triticum aestivum
  unsure (1)..(104): unsure at all Xaa locations
  Clone ID: PAT_TA_54917.pep
NDLRGLDEKSRYXERVPIQSFKKXIRDQILGFEAELKNIDNNIVDVVEKPLKFVDVSPLPPRSQLLENVFADPKVFGIGPDVKYRCKNPKFTQGRCASLRDLLI

SEQ ID NO: 160500 - protein, 76 aa, Triticum aestivum
  Clone ID: PAT_TA_54918.pep
EVYEQYIIAYMCTVSHVDYIHEASLHHRYNSFNQDYCLWKHRSRVCKVPNSPAESSNLGQAHIDLSIYMVEIRCTM

SEQ ID NO: 160501 - protein, 81 aa, Triticum aestivum
  Clone ID: PAT_TA_54919.pep
KGSYSNWPVGVNRYEYDQLRAPVGGRVYFTGEHTSEHYNGYVHGAYLAGIDSADILMNKVLNNVEFKVRPKYDEEQKAEAK

SEQ ID NO: 160502 - protein, 112 aa, Triticum aestivum
  Clone ID: PAT_TA_54920.pep
MVMASSSGLRSCSAVGVPSLLAPSSRSGRLAPFCANATTSGRVTMSAEWMPGQPRPAHLDGSSPGDFGFDPLGLATVPENFERFKVSEVYHCRWAMLAVPGILVPGALDLCN

SEQ ID NO: 160503 - protein, 64 aa, Triticum aestivum
  Clone ID: PAT_TA_54921.pep
CTSYVYSRIHRLHGGTWRAASATCSNIRSETEVLPRRARCQVISRRRCVLYHPLTTLTKSYYFI

SEQ ID NO: 160504 - protein, 44 aa, Triticum aestivum
  Clone ID: PAT_TA_54922.pep
GPASRSPRVRSQVPDESVSALSLAAYVEALKLRNLTQASLLTSN

SEQ ID NO: 160505 - protein, 135 aa, Triticum aestivum
  Clone ID: PAT_TA_54923.pep
IGPKDLANKQVRIVRRDNGTKVDIPSTDLVEQVRVLLDGIQVNLLETAKAKRDACIEIISTWDEFIAALNNKKLILAPWCDEEEVEKDVKARTKGELGAAKTLCTPFDQPDLPSGTVCFASGKPAQKWSFWGRSY

SEQ ID NO: 160506 - protein, 139 aa, Triticum aestivum
  unsure (1)..(139): unsure at all Xaa locations
  Clone ID: PAT_TA_54924.pep
XNLIKTKTQLCKYYKSSKGCDKGPNCSFAHNENELRCIFDQSCINEECKRIHIKRDIKPITKNNKEIAIIDEEEKIPEIQLTINGNKYYDDNYINKNHENKKNIKNESSRDNIEYNNYNKFYKVESININTNQVISDRT

SEQ ID NO: 160507 - protein, 48 aa, Triticum aestivum
  Clone ID: PAT_TA_54925.pep
IQAQHAARVVGHLVQVEDEASEQVLGRGHGLKKRMITLLYMTCLTCYS

SEQ ID NO: 160508 - protein, 90 aa, Triticum aestivum
  Clone ID: PAT_TA_54926.pep
MDADWTWACRAWEKWTAKHVGSSVAGMPVKAALLLNYDPTGPSRLLPIVAEEEGTKFTAVDLQPFINFFRRNNLQTEFFSIGPNQCNGGC

SEQ ID NO: 160509 - protein, 42 aa, Triticum aestivum
  Clone ID: PAT_TA_54927.pep
GEVISTKRQPAGPKPGFMVEGTTMETVTPMPYDVDNDQKGGY

SEQ ID NO: 160510 - protein, 72 aa, Triticum aestivum
  Clone ID: PAT_TA_54928.pep
GLMRGMRLGVRGLRRRRPRRRQRSRWEGGRVLWILWRRMRRLLLRRRGLPLLRFISGYGLGWGGDMLPHHLL

SEQ ID NO: 160511 - protein, 210 aa, Triticum aestivum
  Clone ID: PAT_TA_54929.pep
CTWFTGTWLFNECYIYRRLEEIFQNSQYWVGYDCFESQKLATFKGSHSAVYDLARKMPELIREMSQEKLEIVYNELIEVCLWGNATDLSLLTNMSQEDIQRLQAIEKDKLAERKKFIVCDDTDKLWFKLKDLDQGRIDFVLDNSGFEVFVDMVLADWLLQSKKASKVVFHCKTIPWFVSDVMPKDMPMMFEKVLTETSCLEKNLKKILMP

SEQ ID NO: 160512 - protein, 159 aa, Triticum aestivum
  unsure (1)..(159): unsure at all Xaa locations
  Clone ID: PAT_TA_54930.pep
FVKGAVELTKEYYISEEQLGVGSFAVVKKCINQSTGEHCAIKIILKKAVARKLHMLDSEIEILTKVRHEHIVSLHDINEFDDAVYIVTDLCTGGELFHRIVERGTYTEAIAADLARQXLEGLAYLHSHDIVHXILNRKNLLFKTLDXDFELMITDFGLS

SEQ ID NO: 160513 - protein, 151 aa, Triticum aestivum
  Clone ID: PAT_TA_54931.pep
AIPPARPAIFSEFAPTCFAPGLASRELPRHMGRQGASLLHRGVFALADRTHAPASTNPSGCTAAGLRSPLRPRGPRILPRRVRWLSRRPASAGSPSLRVQPAGHTQLRLLVMHPGPSGSTCSCCARRPCVTAWGPYQFGGRMLRLHSTCPA

SEQ ID NO: 160514 - protein, 164 aa, Triticum aestivum
  Clone ID: PAT_TA_54932.pep
MEITINSLTYKGSIPDAINQSRRKKKLFVIYISGQDETSSSLEQSTLVDEHVAAVISRCCIFLQLKQGDVDALQFSAIYPQKSVPSISVVGLSGAMLWNHEGYISPEDLKESIDKAWAALQLQIWKPHCMSVLKPARPLLSFQIVNLLKWQGTNRHCHPVIWIA

SEQ ID NO: 160515 - protein, 73 aa, Triticum aestivum
  Clone ID: PAT_TA_54933.pep
SKKKKASFIGKGRVPLFSGSPPPHQKLGLEEGAPVSLPPGLLGPCELGPKTSPRQLLVMKGVLEFSAPKRAGG

SEQ ID NO: 160516 - protein, 166 aa, Triticum aestivum
  Clone ID: PAT_TA_54934.pep
VYNELAKTRPDLIHTLANDWPFQTDLNKEKEPYVLRPLLYYVDNKLIIQYARRNFTGFGKNPRREDIPPITEAQAEALDALHYTAEKFNLGVDFQKGDIQYINNLSIFHARDGYTDSPKNTRHLLRHWIHPENAWKLPPQLESTWKRIYHDEREEIFPLEATFRLI

SEQ ID NO: 160517 - protein, 106 aa, Triticum aestivum
  Clone ID: PAT_TA_54935.pep
FYCISPHLQKNKKGHEIFFPPLIKQGTLKTPYGAMPLTRSKKNQLLEIDGGGETELYRGGENGLGPLDVGGLGALHLVPINMGVAVGPKGGVGCPAPCLGAEPSAA

SEQ ID NO: 160518 - protein, 191 aa, Triticum aestivum
  unsure (1)..(191): unsure at all Xaa locations
  Clone ID: PAT_TA_54936.pep
IKHLLPKXDVVYISEGANTMDIGRXFFDVHQPRHRIDAGTGATMGVGMGYAIAAQSYYGPAKRVVSIVGDSAFGFSAMELETAIRSKLPLLIIVINNNGIYHGLDDSEYNASLNNGTLPTTALLPETRYEMISQACGGKGWLVKDKVELRKALKEALDSKDQTCVINVLIAPGGRKKLAFAWQQKTEKARL

SEQ ID NO: 160519 - protein, 55 aa, Triticum aestivum
  Clone ID: PAT_TA_54937.pep
GGIKEPSLQALARKDNQQKMISRKCYARRHPRAVNCRKKKCGPSNQLRPKKKIKN

SEQ ID NO: 160520 - protein, 142 aa, Triticum aestivum
  Clone ID: PAT_TA_54938.pep
GFFGQSFPPPPKIFFLKGTKPGTCPWGPKTPRFFFPFSPGPSKGGGPVKKPFFKGAPVKIVFFGVGKGVFFSPPVFGAGFPPLFGVCFPGCPRFFKMGRGGFSFFTRFVLSRPQKKKKKKKKKKKKKKKKKKKKKKKKKKKK

SEQ ID NO: 160521 - protein, 133 aa, Triticum aestivum
  Clone ID: PAT_TA_54939.pep
QVMAYQLLANWGHQGFFEHVKRVADFYKEKRDDFVECLDKHMTGRAVWTVPSAGMFVWLRLLGGITDSYDLVMTKVLKENVLAIPGLAFMPRGNKNEYIRVSFSNVNKPQMDEALRRLAMVIDKEAEIHNLKI

SEQ ID NO: 160522 - protein, 122 aa, Triticum aestivum
  Clone ID: PAT_TA_54940.pep
GRGPFQVKKTLFFKVSPGAKLGIFLEKRTLFFWGGFIRTLSFSPKIFPGFLSPGGVFFPFSGHWPAKKERAPFWAPPRGGSPIGGGVFSFSRGGPCFSLKGFFFRPFSPGNIFLKPVWGILN

SEQ ID NO: 160523 - protein, 102 aa, Triticum aestivum
  Clone ID: PAT_TA_54941.pep
QCGRTFRLLDQKIHQLLDLLRKRQIFLHLLNRLSRILNQHQSATSTTRGVATHLPLLENEHWLVRERREYLTFVFNLQHFQWMIQWMMHTSLLHEYIHLVAV

SEQ ID NO: 160524 - protein, 99 aa, Triticum aestivum
  Clone ID: PAT_TA_54942.pep
LFLFFAVRTPSRPGCWFTTSPPRSGAVRALCTAYPMVGQCAIVGSLLHVLGGLVLETFEPATDQHQLNTFIIWWQTLHTDAVVAHLFLLNLCWLSNLRY

SEQ ID NO: 160525 - protein, 96 aa, Triticum aestivum
  Clone ID: PAT_TA_54943.pep
QGEVGAQTAEIMVAKETVTASKPPSGGSKKPDLTALTTKIHEGGALYPPGGKIMTTMPTMLPGGVSMCQKLTKMMAPPSPMWMQFAQPYIGTIQMA

SEQ ID NO: 160526 - protein, 137 aa, Triticum aestivum
  Clone ID: PAT_TA_54944.pep
MEMDTAVNTEVIKQEPKLGGGEEHFRDEKKFRQTSGVDEDYDESAADALLSIGNPQLGQKRSLEHDHEESKRPRGDEEVKEEEKKEESKEDEPEEGEVEEEVKKEEESKKETMADAPATSNTQSKEESLANETAGSA

SEQ ID NO: 160527 - protein, 89 aa, Triticum aestivum
  Clone ID: PAT_TA_54945.pep
ENKPPNPLFIEKRAGSTKTRFWKTRGQQAKGKKLGGGGGHREPRFKKKKNKLRGRPGQEKRDPPPGGQKGAHPTRRDPEERETSAGGTS

SEQ ID NO: 160528 - protein, 123 aa, Triticum aestivum
  Clone ID: PAT_TA_54946.pep
HLICFVQRSGIMVKKGPTTLNMFPLIVTTPLNTLHHKSVLLDSPPKLHTHYLFFYYQRSGTQPYVERESTQTFWRATTWCIYGCLDDIMTTNILQSVCLSLHQEATGGPTPGHAGELRRQWLE

SEQ ID NO: 160529 - protein, 80 aa, Triticum aestivum
  Clone ID: PAT_TA_54947.pep
PPPNFSLPPFFFPFSGLVHPGALPPAQSFRDPTRVRFSRSSLGEFKKPLFGGPNFLGFFGCFFLATFDWFSGFPPNLGFF

SEQ ID NO: 160530 - protein, 100 aa, Triticum aestivum
  Clone ID: PAT_TA_54948.pep
AFPPPPLCDKGKGTQISPCLSPPLPYFFRGTHLPPEFFFFGPNPPKGGFLPVSRAPPPGNPLPSWGGDPGPPRGGETPPPPLRSLLFFAPGGCGAKQKFF

SEQ ID NO: 160531 - protein, 149 aa, Triticum aestivum
  Clone ID: PAT_TA_54949.pep
VNIIEYIDEVWGQEARLLPGDPADRADARFWADFIDHKVFSSQTRFFTSKGEEKEAAKEELVEHLKRLEEVLGDKCFFSGDNFGFLDVVFIPFSSMFYGYEQHGGINLEVECPKLKRWEKRCRERESVSEVLPDGKVQYELHKKFYGIE

SEQ ID NO: 160532 - protein, 154 aa, Triticum aestivum
  Clone ID: PAT_TA_54950.pep
IGNEVLKSIVAQFDASELITQREVVSAKIREELYKRARDFNLALEDVSITHMTFGREFTNAVEQKQIAQQEAERAKFIVERAEQEKQAAIIRAEGDSEAAEMISTALANAGDGFIAFRRIEASKEIAQTLSKASNVTYLPSNGNGNNVLLGVKA

SEQ ID NO: 160533 - protein, 51 aa, Triticum aestivum; identical to SEQ ID NO: 158296
  Clone ID: PAT_TA_54951.pep

SEQ ID NO: 160534 - protein, 173 aa, Triticum aestivum
  Clone ID: PAT_TA_54952.pep
CKTIPWFVSDVMPKHMPIMFQKCLDRDFFPGEKSQQDIDALETMVHRWQQYVKNNQLEIVSDDFWCSGLSYWYMKSHAPQLFESMKKSDLVIYKGDLNYRKLCFDCEWPMTTPFRDAIGSDMANDFTNIVSLRTNKADVLVGVSEQMKKDIENRGIAKEVLCFSGKYAVVEYN

SEQ ID NO: 160535 - protein, 61 aa, Triticum aestivum
  Clone ID: PAT_TA_54953.pep
GHGATDLVGTKRTSGGLYFGRGGDKHQTYRITTQNPQLRGKANVPPPPGGGRCPLFTNPAP

SEQ ID NO: 160536 - protein, 42 aa, Triticum aestivum
  unsure (1)..(42): unsure at all Xaa locations
  Clone ID: PAT_TA_54954.pep
LFDAIRKGQYEFAEEDWLRYSDESXHLSDKVLKHDPKERITA

SEQ ID NO: 160537 - protein, 96 aa, Triticum aestivum
  Clone ID: PAT_TA_54955.pep
VTASGSVPPVPWRLPRLSASSAGCAPRQLAPALAASRLGWKRPTAQPLPTGKREKSQQPAAPHGDKKRRRERPAVSVKKKKREKKKSRVEKESRLL

SEQ ID NO: 160538 - protein, 114 aa, Triticum aestivum
  Clone ID: PAT_TA_54956.pep
CSPPLGGGEAPQVCQGICLKAWHFLGLPPFKFVKPGSCCSWEVKRSISPLSAPLPWSCCLVVSVKFLTVLSKIYPFPFESLKPLSNVQFALLVALPLSLFKFFVGEFPHNALFS

SEQ ID NO: 160539 - protein, 122 aa, Triticum aestivum
  Clone ID: PAT_TA_54957.pep
PQGIFVFSMFCPAISKNPFFFRGFKGQIQPLCSTKALSFYFEASAALPPKSPFWAHFHASIRGSGPKPSQFGFFFPDLTMFFAFKITGALNPRSSFFPSRKVFFFWGNPPPLKKGVVTKENQ

SEQ ID NO: 160540 - protein, 108 aa, Triticum aestivum
  Clone ID: PAT_TA_54958.pep
SRGWGFLGAALSYVNPLSYLRGNPPPSHPDQLGNEGSQQYRPSSESQPLGGDRSQQTTTHSSGNTLRRRPRQFGGNIHTLSSEEQDPSDNRNVFWNGNSTEFGGDEKK

SEQ ID NO: 160541 - protein, 151 aa, Triticum aestivum; identical to SEQ ID NO: 115597
  Clone ID: PAT_TA_54959.pep

SEQ ID NO: 160542 - protein, 124 aa, Triticum aestivum
  unsure (1)..(124): unsure at all Xaa locations
  Clone ID: PAT_TA_54960.pep
ALPLAGSCASVCGAPPRAAFGRLRWVVLPCVGPAPCSWAAARPVAARLRVGGVRRRAPPPPPARPXCSPPARPPCSPPARLPSXRXRCLPAPXPRGLPGSPPXRPPWLPAPPPPACVCFARPLG

SEQ ID NO: 160543 - protein, 193 aa, Triticum aestivum
  Clone ID: PAT_TA_54961.pep
PRVRRAASASGEDGGGVAEADGCNGLLLYYASCPAAFHVVNPTTRRWAALPEPRRKTLLSVLSFDPCASPHYKVVCFTGWLPRGASVEVFGSETGAWGEHELDFGLETDAMSATMHCFAGAVHVLAYSGHVVRIDLGTMVCAVTALPAPVSYRARAGHCRGRLRYPSSDGSRLTLWELVDAGKSEWVAKHELG

SEQ ID NO: 160544 - protein, 154 aa, Triticum aestivum
  unsure (1)..(154): unsure at all Xaa locations
  Clone ID: PAT_TA_54962.pep
AFPPXRXVVSLWXPSXLXAFPLAPXRVXXACVFGSGXXXAXLXXXWLFPFSRXLAXCLAXVAXPXAPLXXXXCXRLXXCGSVSSSXXXXLRXXLXXXAPPPVLLWXARSXSRFXXLXXXVLVXXGXXFAFCXXGLVXXLAFLXXXXLFFPPPPP

SEQ ID NO: 160545 - protein, 130 aa, Triticum aestivum
  unsure (1)..(130): unsure at all Xaa locations
  Clone ID: PAT_TA_54963.pep
PRPSPGRXRCPPXLVGAGPRRCXSXGLWGLXWLXVPSXAXXXAGSSAAVASXXGSFXPWLXXLGXLCGSXXSSLVRXGLLGSVXXXVSXXCXGCRPRPPFLVCLVLSWSLLGVRLLSLVVFLSFLVPPPP

SEQ ID NO: 160546 - protein, 79 aa, Triticum aestivum
  unsure (1)..(79): unsure at all Xaa locations
  Clone ID: PAT_TA_54964.pep
MLWCQVESFSYWIEAXPLATRARVAVFRFIRSSNVCPFLFSKGISLXSATLFDMEAFREFCGYLGSLIYCASVRPPASI

SEQ ID NO: 160547 - protein, 103 aa, Triticum aestivum
  unsure (1)..(103): unsure at all Xaa locations
  Clone ID: PAT_TA_54965.pep
XGGGGGDREXARAGSXXXRQGREXXXXRDNAAPXTXXXAATEXKGGEXHTGHXGEGAXXXXXAPQQPXPXXNTTTAXXXPHXRDXPXNXXRXRXXRKXRTERR

SEQ ID NO: 160548 - protein, 85 aa, Triticum aestivum
  unsure (1)..(85): unsure at all Xaa locations
  Clone ID: PAT_TA_54966.pep
QYKPRGPPSLSPSHRTGHHSPHRSSPPPPPAAVPTKKSXPPPFCLHTIHESSPSPQSSWSPLFVPENLNAHAWRTKRPPPPSPPQ

SEQ ID NO: 160549 - protein, 108 aa, Triticum aestivum
  unsure (1)..(108): unsure at all Xaa locations
  Clone ID: PAT_TA_54967.pep
AQTSPGDHPPPPGPGAGPTAVGRAQPRGNGSTQRTKTPPPRELREGEWERXISPPPTQLVKPRKDLARCVGVPTVTCWAPGRLPIPGPHPASXTKCPENIVLKPPHPP

SEQ ID NO: 160550 - protein, 96 aa, Triticum aestivum
  unsure (1)..(96): unsure at all Xaa locations
  Clone ID: PAT_TA_54968.pep
AAPGAPREARAXRPPGAPRPLRPVRRRQDGPRTGTPKAENDRRVTRGTSAHFPAGPGQXXXGSTLSTKPATXGGCACVRVWVCASVXVCXQRPVTD

SEQ ID NO: 160551 - protein, 140 aa, Triticum aestivum
  unsure (1)..(140): unsure at all Xaa locations
  Clone ID: PAT_TA_54969.pep
GVGXPPXPARAAXPPXGRPXCGGRRRLPLSRCPPAAXPAVAAALPARRRXRAXGVWCVVWXXRXFFSRXPWGRGASPPCXXXXRPPPPLAXCLLXXLSRGARALXXVXLSGRFLPLAAXVPXSGLCACVXXXXXPPPPPP

SEQ ID NO: 160552 - protein, 137 aa, Triticum aestivum
  Clone ID: PAT_TA_54970.pep
PRMIRVGWKMQLLDQLLRVLLKMIRIKWIAPPIAQPVRVSERGHRHVLPCMFAQVLISVRFCMVVALALGQEPTLQGVVDTVLGQLSEQSNAVGSDTGPIAQMFKNGRLPPARQVKSPRTVVHLFFLFFLVAWYTAR

SEQ ID NO: 160553 - protein, 127 aa, Triticum aestivum
  unsure (1)..(127): unsure at all Xaa locations
  Clone ID: PAT_TA_54971.pep
VDESKVRAVKDRPAPPEVSPVRRFRGRAGLYRSSVRELSTIASPSKEVPPKGVAATWGRSHEDVFQQVKKRVRTAHGLIHSGSPRASKLXCDASGIGIVGVLVPQGASHGHMRACVGGARLKASGDT

SEQ ID NO: 160554 - protein, 161 aa, Triticum aestivum
  unsure (1)..(161): unsure at all Xaa locations
  Clone ID: PAT_TA_54972.pep
CPFFXPFAGXLLAVAAXFXLPXXXVXCVSXLCXXXSXXSVXXXXALAXRXPAXGLXSVCLXFAAXXLXAXXRXXXFXSLXXXCPALPSXXLRXXAGCXXXCXXGGXXXXVWGPXSXGGAPXGRRVXPPLRRRLCLCRPAAARRPLLCPLFLLPLCCPPPPP

SEQ ID NO: 160555 - protein, 70 aa, Triticum aestivum
  Clone ID: PAT_TA_54973.pep
VAVDAAIQWLHANHLGEVTEFEHMIKDMKGLCDPIIAKMYHGAGADMPGGMYYCAPTANVGHGPKSQEVD

SEQ ID NO: 160556 - protein, 43 aa, Triticum aestivum
  unsure (1)..(43): unsure at all Xaa locations
  Clone ID: PAT_TA_54974.pep
SXRXPFCSXXXXWXRALLWGXRPLRLPGWVXXRCPWRXLGRPG

SEQ ID NO: 160557 - protein, 56 aa, Triticum aestivum
  Clone ID: PAT_TA_54975.pep
YPDPAAVPDQLLSHCLPMLVNIFSPPIVERNEVPTWAVLRKKDLFSHLCRRLKTLF

SEQ ID NO: 160558 - protein, 84 aa, Triticum aestivum
  unsure (1)..(84): unsure at all Xaa locations
  Clone ID: PAT_TA_54976.pep
MALPNQNTVDYPSFKLVIVGDGGTGKTTFVKRHLTGEFEKKYEPTIGVEVHPLDWTTNCGKIRVYWWDTAGQXKVGGLRHGHYI

SEQ ID NO: 160559 - protein, 143 aa, Triticum aestivum
  unsure (1)..(143): unsure at all Xaa locations
  Clone ID: PAT_TA_54977.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGXFEDTNLCAMHPKRXVTMMYKGIQLAPRDLCGEGIGCFCN

SEQ ID NO: 160560 - protein, 41 aa, Triticum aestivum
  Clone ID: PAT_TA_54978.pep
FPPCSRSVSEMILPEVVPQGIDLVLLDPIHCPCYQVTILAG

SEQ ID NO: 160561 - protein, 57 aa, Triticum aestivum
  Clone ID: PAT_TA_54979.pep
VPGNEGPDPRPAMPTHAKKPTLCMGHNNRIRLPIPLGPPTVTRIEGSAGRAPWSARR

SEQ ID NO: 160562 - protein, 219 aa, Triticum aestivum
  Clone ID: PAT_TA_54980.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAADMIKKGKMCCLFIND

SEQ ID NO: 160563 - protein, 152 aa, Triticum aestivum
  Clone ID: PAT_TA_54981.pep
MLPALSTRPLHSQDRCTHTLVGAGPRRCDSQGLWELDWLHVPSAATTIASSSAAVASVTGSFKQWHHRLGHLCGSRLSSLVRRGLLGSVSGDVSLECQGCRLGKQIQLPYSHSESVSQRPFDLVHSDVWGPAPFTSKGGHKYYIIFIDDFSR

SEQ ID NO: 160564 - protein, 85 aa, Triticum aestivum
  Clone ID: PAT_TA_54982.pep
AQTGSTYETKGAGKADKPDAHGSQNRQEPTVYTQGNCYLEPKKTRERGSDLLTSHATTGTLLPATTDPWILPSLNSTGRRRPTPS

SEQ ID NO: 160565 - protein, 34 aa, Triticum aestivum
  Clone ID: PAT_TA_54983.pep
TAACTINLLLTAYKIYISAKILHFFNTPATVSHN

SEQ ID NO: 160566 - protein, 48 aa, Triticum aestivum
  Clone ID: PAT_TA_54984.pep
AAGRMDVFGFIIQPWVWLINYLRIDSLTSRDRNCCLLLWCMTGTIGYV

SEQ ID NO: 160567 - protein, 157 aa, Triticum aestivum
  Clone ID: PAT_TA_54985.pep
SHHRKGQEKVGHGREKPVISGFRFRSLYPKREPSWPWCKERPTSPLLRREPPPWICTPWQPPCAPGWAFRHGHCCKWRDTCNAPGRAFGSGSRQRVRRTRDYTNCLLHPSDGVVACRAIGAVSRRRGDVPLFFPSTSSSSKRRITPRGCGFFSTNGE

SEQ ID NO: 160568 - protein, 79 aa, Triticum aestivum
  Clone ID: PAT_TA_54986.pep
MRHKHSTPRFNIQQQQEHQEFEAPSLKSSLFHQRGRIPFSPRLGKQPAPRLTTPPGTGLEATVFAQAGLPETLYSLDTT

SEQ ID NO: 160569 - protein, 70 aa, Triticum aestivum
  Clone ID: PAT_TA_54987.pep
RMIFLLLSEVKDFNYPPGSLFSGFLMFFVFPSGVCQCAHPDNKHRPSKEVSPLGIIERDYRLARFCGIVN

SEQ ID NO: 160570 - protein, 108 aa, Triticum aestivum
  Clone ID: PAT_TA_54988.pep
KNLIPASPKTRGWAPIIGPMQGVGFPPELKINWGLLLPLKASTQKTGGRGFMHARLWGICWGGFFSCVPVPKNGRGNLCFFCVQPKIITVWAGFWLVPSVGWVTNCAS

SEQ ID NO: 160571 - protein, 97 aa, Triticum aestivum
  unsure (1)..(97): unsure at all Xaa locations
  Clone ID: PAT_TA_54989.pep
MWFPCSLVKDILXVMCNIRKERAQMLAHMVNMRVKQAGAGVFQQNIFLLWDDKLHVFPVRMGRXLKEALFKKKLFRTLSKLGHXAQLKRPCVYNPFS

SEQ ID NO: 160572 - protein, 91 aa, Triticum aestivum
  Clone ID: PAT_TA_54990.pep
LPPSCFFSWPLCFGFSFGDNANAFGGRFPPFLNPFYVSLSLKGVKGFFFPGGVVKFLKFVFLFLGGFFSHNPGGFFLLFPLFLNLFFWAVP

SEQ ID NO: 160573 - protein, 159 aa, Triticum aestivum
  Clone ID: PAT_TA_54991.pep
RLGGIYGPGRSALDPIVKRKSCSRRQKLRGSNQYTARIHVAVVYQAILGSMSIKSPRKIFNVVDDVPAPKSEVFAFAQSFIEKRYPDLVGDFAESNSQSRVIAVEKRVSNGRFFQELGVRLGPPSYRSGGQSIFDSWLEGNHSCVACAASSISFNPWFG

SEQ ID NO: 160574 - protein, 98 aa, Triticum aestivum
  Clone ID: PAT_TA_54992.pep
VLSKHIAAAQPLPGFRRLKGGKTPNVPKEVALHLIGPSKVKKAAIKKIINRAVAEYVEKENLDAAKNLKVLQSYEELEATFEPGKEFCFDAAVHLTGS

SEQ ID NO: 160575 - protein, 74 aa, Triticum aestivum
  Clone ID: PAT_TA_54993.pep
KPKDACDDSYKEGLNLNNARSKFIAKELHVLTRALSAIFSWLGGKQDNSGDIFLFRLYPVHPLRDTGSFCFYPK

SEQ ID NO: 160576 - protein, 90 aa, Triticum aestivum
  unsure (1)..(90): unsure at all Xaa locations
  Clone ID: PAT_TA_54994.pep
KPKETGGGEEERGHARPKGREEERKNXGTRGGRRGGGRGGGGGXGRGXARXDEXSXGXGKAKGXQXGXHHERGXXGARNXGPRAXEGSRR

SEQ ID NO: 160577 - protein, 75 aa, Triticum aestivum
  Clone ID: PAT_TA_54995.pep
KGPNPVGFINSEHNLIGKGLRPLYRGNKQAGYVGYPPTSHIYLTRPKRPIFSIFTLTFSSCYSASRAKFKMGGSL

SEQ ID NO: 160578 - protein, 120 aa, Triticum aestivum
  Clone ID: PAT_TA_54996.pep
RCLSLQTLQPLEKLKKKGFFSSRRLIHGRLVNWAPPKRRIAISSSLVSSAALGWGCRAPPDAASVEKASLSKGLEASPTPLSAPPRHPLTLKPPRAVTDELDGPREKGKGRRRVGARESD

SEQ ID NO: 160579 - protein, 219 aa, Triticum aestivum
  unsure (1)..(219): unsure at all Xaa locations
  Clone ID: PAT_TA_54997.pep
PPPPPPPPPXPXPXPPPPPPXLPPPPPAPAXPXPPAXXPPPXXPPXPPPXPPXPPXXPAPPAPPXPXRXPPPPRRPXPPSSPPPPLPPSSPXXXPXAXSXPXXXPPPXXPXXXXXXXSXXPXXXXXXRXXPXPPXSRXPXAXSXPXGSPRXSSAXSPLCLCFWLLGSAAGSCAPSSSAPRWPWPLLAPPPCCGGFVFPFGLLVFFPPCLFPCPFPPPPP

SEQ ID NO: 160580 - protein, 159 aa, Triticum aestivum
  unsure (1)..(159): unsure at all Xaa locations
  Clone ID: PAT_TA_54998.pep
PPXVPPLPPRGPPXAAARPGGXXXXAXXPLGLAGGCPAAXXAPGXXVGPXGVPPFVXXAGAXVXGXXPXXXXXXWSXSGXRSAGXPPGLLXWAVXLAGLLGGGVLLVXXXGALAGGLVSPRAGSLLCSLSPPPPPVCPCLGPPRWFCSPLRSSFPCVAS

SEQ ID NO: 160581 - protein, 129 aa, Triticum aestivum
  unsure (1)..(129): unsure at all Xaa locations
  Clone ID: PAT_TA_54999.pep
RAPLRRRARPPXGXXRAPRLLXXLPLXVCXVVRXXGGPRSXRXAXPVLWLVAGWPVLCXPFVXXXGLLXXLXXXXXAXXWXPPPLXXRAAXXXFXSFSFXFFLGCSFSFXLRXLPCXPAXXXXVCALXL

SEQ ID NO: 160582 - protein, 107 aa, Triticum aestivum
  unsure (1)..(107): unsure at all Xaa locations
  Clone ID: PAT_TA_55000.pep
GGGGGGEQEGSERNRDNKHGTAATARTRNRGARRGGGSERHRQKKGGNGPXXGPTXHXXQXPPPEPPRRPPEPPPPPXPEPPAARPPEPPPPARRPPPGPAAPAARP

SEQ ID NO: 160583 - protein, 108 aa, Triticum aestivum
  Clone ID: PAT_TA_55001.pep
PRASPKARPAPAPATTRPSTGDAAGPQARHQCHGQEAAASGPHQLAFLVRRLTPPPAIWGTAMARPRSRPLSTCTYPATVQPPPCYDTTGGNVGASPQTIAKKKKTQT

SEQ ID NO: 160584 - protein, 147 aa, Triticum aestivum
  unsure (1)..(147): unsure at all Xaa locations
  Clone ID: PAT_TA_55002.pep
VLECIIIPFINLGGGAAPNQTLLDXKLERLKGVLGIXKAGLEKTRYLSGKSIRFTDLTHIPFPFXLMTPPMHKVFYEYPKLKAWWKMLMGRPTVQRVCKHIPTEFKLGAQKXRVLSTPGGFVPSQAXCRAGEDSVQKKKPPSRGWVI

SEQ ID NO: 160585 - protein, 118 aa, Triticum aestivum
  Clone ID: PAT_TA_55003.pep
KDWPAPPNVSQVTSFQGLAGFYRRFVRDFSTIASPLNELTKKGVEFKWGNSQEDAFQELKKRLTEAHVLILPDFTKTFEVECDASGIGIGGVLMQQGKPIAYFSEKLGGAQCNTSGVT

SEQ ID NO: 160586 - protein, 96 aa, Triticum aestivum
  unsure (1)..(96): unsure at all Xaa locations
  Clone ID: PAT_TA_55004.pep
NPQAPXPRPGXPPPTPPPPPAARXTPRPSTPGVRKPSXTXXAYPPPPYNKAXSAYVCRNPPPPIIVFRTKGKISSPVKMQKLDGGNKGELNHLSRV

SEQ ID NO: 160587 - protein, 91 aa, Triticum aestivum
  unsure (1)..(91): unsure at all Xaa locations
  Clone ID: PAT_TA_55005.pep
KPTAPEXGXXRAQXGTAXGAPNPNGXAGTXGATKESQXGENXKAXEGXPXXTPEGXEKXEAXXQSKPKRXEADRSRQRAARRPPETSPPPR

SEQ ID NO: 160588 - protein, 162 aa, Triticum aestivum
  Clone ID: PAT_TA_55006.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTYIVGNVFGYKALRALRLEDLRIAPTYSKTLQGPTHGIQDERDQV

SEQ ID NO: 160589 - protein, 78 aa, Triticum aestivum
  Clone ID: PAT_TA_55007.pep
AHASKKQNNLKCRQLVDTYMSQTAMGDANQNPIRAGTLYVGKGAQQGTLPVPSGCTDQTPKNLDPPARSDDVSCLYTF

SEQ ID NO: 160590 - protein, 68 aa, Triticum aestivum
  Clone ID: PAT_TA_55008.pep
MAGFGTLAPKTKNVVVAGGLTGFVFGVYYSPMWAVGSPAELQVPIAKFEALKKKEEAPSPSSSPPGSS

SEQ ID NO: 160591 - protein, 156 aa, Triticum aestivum
  unsure (1)..(156): unsure at all Xaa locations
  Clone ID: PAT_TA_55009.pep
PIVEQPEYNXSFSRHKVESEFVPLYSTYGIGLTTWSPLASGVLTGKYSKGNIPAESRFALDNYKNLANRSLVDDTLRKVNGLKPIASELGVSMAQLGIAWCASNPNVSSVITGATKESQIVENMKALEVIPLLTPEVLEKIEAVVQSKPKRLESYR

SEQ ID NO: 160592 - protein, 73 aa, Triticum aestivum
  Clone ID: PAT_TA_55010.pep
ARQACCCRPPCATSPPASATAPSASPAPAPPPPSPPAAAPAPAPAPPPPSPSRRPTAPRRSTLTPPLRRCCFA

SEQ ID NO: 160593 - protein, 127 aa, Triticum aestivum
  unsure (1)..(127): unsure at all Xaa locations
  Clone ID: PAT_TA_55011.pep
EKGNKIPSATNFLDQAWQLHLPQPPFPPPAAAAARPARRCANQRHPATHPRHLHHPPLHHPPSSIHIAATSAASPPPSXAPLARPARRASGPSSLTLLQLPSPISLCCSLHPSSLNPLRCCFLLSLE

SEQ ID NO: 160594 - protein, 154 aa, Triticum aestivum
  Clone ID: PAT_TA_55012.pep
PASAHASAHASAHASAHASAQPHHFCKSCRRYWTKGGVLRNVPVGGGCRKAKRSSSSASAPSTPAATDAKSQRRASSSSSSRSNSGSGSASPTANGEDTPTTTTDPPPGTPSCNSNANAGSFASRMTNYPFAADVPPSAPIFADQAISLACLFA

SEQ ID NO: 160595 - protein, 132 aa, Triticum aestivum
  Clone ID: PAT_TA_55013.pep
MEANFLKVQEQDDKDTPNWISVSHQDEAEEMELEDRLFARRRKGWESAWGDRSDFEDLTLLSPMHFTHCTLGLIPYTASTVSALQIYSVKIVETKGKLKWPLYVYGVVAARDAVDHNRNILFSRQREDYQEL

SEQ ID NO: 160596 - protein, 205 aa, Triticum aestivum
  unsure (1)..(205): unsure at all Xaa locations
  Clone ID: PAT_TA_55014.pep
PTRPKWDAQGGKSKALFAKTLDDRFIIKQIKKTEFESFIKFAPDYFKHVYHSLDTGSQTCLAKILGIYQVKQIRHGKEIKMDLMVMENLMFGHNVSRIYDLKGAMFSRHITNSNDPDTVYLDQNFVEDMNVSPIYIGGRTKHLLQRAIWNDTSFLIAVNVMDYSLLVGVDNKRMTCVWIIDYLRXYTWDKQLETWGKVFFWYQNV

SEQ ID NO: 160597 - protein, 146 aa, Triticum aestivum
  unsure (1)..(146): unsure at all Xaa locations
  Clone ID: PAT_TA_55015.pep
MGVTFSDLHTADGXKGLEAHLAGKTYISGDGITKDDVKVFAAVPVKPSAEFLNAARWYDAVAAAVSXRFPGQASGVRASSAPAAAAPASSKDEDDDDDMDLFGDETEEDKRAAXEXVRAASPAKKKGKGQILPVLMDIQAHGDDGD

SEQ ID NO: 160598 - protein, 215 aa, Triticum aestivum
  Clone ID: PAT_TA_55016.pep
MAAEGGGVRALSQREQDIQMMLAADVHLGTKNCDFQMERYVYKRRTDGIYIINLGKTWEKLQMAARVIVAIENPQDIIVQSARPYGQRAVLKFAQYTGANAIAGRHTPGTFTNQMQTSFSEPRLLILTDPRTDHQPIKESALGNIPTIAFCDTDSPMRYVDIGIPANNKGKQSIGCLFWLLARMVLQMRGTILPGHKWEIMVDLFFYRDPEEAKE

SEQ ID NO: 160599 - protein, 176 aa, Triticum aestivum
  unsure (1)..(176): unsure at all Xaa locations
  Clone ID: PAT_TA_55017.pep
PRVRPRVRPRVRGVGFQAGVKDYKLTYYTPEYETKDTDILAAFRVSAQPGVPPEEAGAAVAAESSTGTWTTVWTEGLTSLDRYKGRCYHIEPVAGEDNQWICYVAYPLDLFEEGSVTNMFTSIVGNVFGFKALRAXLRLEDLRIPPTXSKTFQGPAYXYPKLKEDRLNQXGRPFIG

SEQ ID NO: 160600 - protein, 89 aa, Triticum aestivum
  Clone ID: PAT_TA_55018.pep
PAFDKKQFISHMKRYIKNLFAKLEGDALDVFKKNVEFATKYFFSKLKALQFFVGKSMHNNGGVVFPYYKEGAVDPTFLYFAHGLKKVKC

SEQ ID NO: 160601 - protein, 69 aa, Triticum aestivum
  Clone ID: PAT_TA_55019.pep
MEFLVHPQRSSRTKWFVPGPRHYWIPLKTVWTRSLFPSSFEVPFLSIRDLPVIFRFFGVPFLKFSAPPF

SEQ ID NO: 160602 - protein, 89 aa, Triticum aestivum
  Clone ID: PAT_TA_55020.pep
PTRPLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 160603 - protein, 98 aa, Triticum aestivum
  Clone ID: PAT_TA_55021.pep
GCATSSGGGEELWVSVDGKRAVQAQRLRWNFRGNQTVFVDGAPVDVMWDLHGWWFRDTPGCAVVMLRARSALESRLWLEEEGAAPGFSLVVQAFKAPP

SEQ ID NO: 160604 - protein, 107 aa, Triticum aestivum
  Clone ID: PAT_TA_55022.pep
CYSRNLSGVPSNTKPYTLESSKRKQANMVHTKASSNYGFICHHCSCLSGIQIINYPIHAREPNSFRAAIHVLVQQRENSWDWHVIELQPQRSKQNYRCGCDSNQILL

SEQ ID NO: 160605 - protein, 114 aa, Triticum aestivum
  Clone ID: PAT_TA_55023.pep
FQWSQNFKNSPPVWGEMLRPIPVGLASCPGFFGAMFAIRESFFIFQTLGVGHFFLSMTPGGSSDDLKFLPPPQRKDGSPLNSWKQVDAVTPESDGLANITQRGLSWPSPINRAL

SEQ ID NO: 160606 - protein, 128 aa, Triticum aestivum
  unsure (1)..(128): unsure at all Xaa locations
  Clone ID: PAT_TA_55024.pep
LWVITSPKGTVVHINVSQFLKIXRYWINPEEFRPERFDNNXNVNYNGTYLEFIPFGAGRRQCPGIQFSSSVTEMALTNLLYHFNWMLPDGVSPASLDMSEKFAIAVSRRHDLKLKAAPHVWFKAMSPK

SEQ ID NO: 160607 - protein, 117 aa, Triticum aestivum
  Clone ID: PAT_TA_55025.pep
ENLLQKSTGQGRGHLKTGKPLVNKQLFFDPSYNTTAPGLERPGGQQLGGKKNPWGIPHTHMTGKFEKMFIKGASPPGKNFRAKREEGLFMPVHKHGLWWIFSDPWADPWADPWADPW

SEQ ID NO: 160608 - protein, 97 aa, Triticum aestivum
  Clone ID: PAT_TA_55026.pep
KQKTTLGKGPKKKRGAPKKISQTLGGVGHKQKLKEILKTHSRGGSLKSPLKKKPLGGFKNAGPHKKGKKGPTPKKEKTYFCPPRGHKREKREGLRGG

SEQ ID NO: 160609 - protein, 149 aa, Triticum aestivum
  unsure (1)..(149): unsure at all Xaa locations
  Clone ID: PAT_TA_55027.pep
HSFCTIELCLSDLQKPXQATILSVCVVEGWPSPFEYGGRIMCSXHPQEVKDPLSRHVVLVDSHDFDGEMPMGSAGYVDLSRHVVSVELGHNLQFVIQAYSQSGAIARQSRLTFRTKHCNISRGICEIGDSKVEITVAWSQLIKSKMEIL

SEQ ID NO: 160610 - protein, 104 aa, Triticum aestivum
  unsure (1)..(104): unsure at all Xaa locations
  Clone ID: PAT_TA_55028.pep
MAKFFAFKKGLLVGIFFGGAAAVAIKVVQRPXNAGKFFFFVFPSFGKGSLLWVFFPSIKKKAKSMVVDLRLGFFFSRGGNFFSKPNPSFFRSPFFQKINFWGPC

SEQ ID NO: 160611 - protein, 123 aa, Triticum aestivum
  Clone ID: PAT_TA_55029.pep
MLGKLPNDDMLSKLPNDVLLNILERVGTLDAVKTCILSKQMQKLPGMLSQIVIDLSPRDLVRMNGVVANVTANILSKRSPQITVRKLKVKFFLSPRGLPIGKAVALAMATQKLDAAEFEILTL

SEQ ID NO: 160612 - protein, 126 aa, Triticum aestivum
  Clone ID: PAT_TA_55030.pep
SGPAATVPAAYKDEYDDDDMDLFGAETAEDKKAAAAREAAKPAKKKESGKYYVLMDIKPWDDETDMKKLKDAVRSVQMEGLTWGASNLMPAGYGIKKLQIMLTIIDDLEYFNTLIEEQLCEAPIIE

SEQ ID NO: 160613 - protein, 73 aa, Triticum aestivum
  Clone ID: PAT_TA_55031.pep
IPDSHDLVVQDVSALRAAVHAGPGCRWPRRGRLGSSGTLRWPCLFSSTRLIIALSPANGIRDREPRTEWGEEA

SEQ ID NO: 160614 - protein, 73 aa, Triticum aestivum
  unsure (1)..(73): unsure at all Xaa locations
  Clone ID: PAT_TA_55032.pep
VFRRERLSGHYGVAEFVISNTLSATPYLAVIAVIPGAMLYYLXGLTKGPDRFAYFVVNLCMGTXLXEGMMMII

SEQ ID NO: 160615 - protein, 161 aa, Triticum aestivum
  unsure (1)..(161): unsure at all Xaa locations
  Clone ID: PAT_TA_55033.pep
WYLQRDTMVALLDLITRLAAVADQYLRECLQMLVNNFTPPIVERNEVPTWAVSRKKDIFSHLCGSLKTISDTVPLAPRMLRDIIDRSMPKLFDNKAKMISFVECMLGLDTDRMGDLIGAILLAKVVDLLTKLDVNITWEDIXQEEHDKGIFEIELEDFGCR

SEQ ID NO: 160616 - protein, 44 aa, Triticum aestivum
  Clone ID: PAT_TA_55034.pep
STSAYHPKALATRKRAGCSLFRSMAKGANAWPWRVDGCSGRTRG

SEQ ID NO: 160617 - protein, 200 aa, Triticum aestivum
  unsure (1)..(200): unsure at all Xaa locations
  Clone ID: PAT_TA_55035.pep
MNHVKSALLSGHRPHRLAAAAPQQLAATASFHSTPPLQRKRKTQWQHRFNFYAKRRRNRDTKRTMIRNMSEYAEQLFNSWRDEDEKKDASSGPSWFRGHRWVRDSRNNGFRPHEFFYDTVKSRGGFEFCTSDDDDEPETVFRXAFRGNQHTYYWSFESDDFPRRNSRRSHSESSGHWSYXTDDEGEIXPQTEVSVARQAL

SEQ ID NO: 160618 - protein, 84 aa, Triticum aestivum
  Clone ID: PAT_TA_55036.pep
VCRFTGVWPCAEALSSALWEMATGACMQLLVGDAGAFCSDSMADAYRNEPNLANPPIISLLLHCDQTFVDIFSLTTDKVEYLID

SEQ ID NO: 160619 - protein, 107 aa, Triticum aestivum
  Clone ID: PAT_TA_55037.pep
PRVRYRRKEVSYKMNNKFQANMQKYLVSGGCLPREPLPFSVTGRLPTLVELENYALDQWECFLLQLINSSQVEKGTTFSSSMMKTFQRGLLSSRDGESANSYSSPLV

SEQ ID NO: 160620 - protein, 65 aa, Triticum aestivum
  Clone ID: PAT_TA_55038.pep
ILSKCSEENFAIKKKPTCSQASEVYCSLVSCNYGLTFNIPIISNLFYINGLDQTSPICDNLGEIC

SEQ ID NO: 160621 - protein, 147 aa, Triticum aestivum
  unsure (1)..(147): unsure at all Xaa locations
  Clone ID: PAT_TA_55039.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAXAEKEAXSPKKKTTAKSPKKKTAATTE

SEQ ID NO: 160622 - protein, 209 aa, Triticum aestivum
  Clone ID: PAT_TA_55040.pep
MAAERVKDVGILAMDIYFPPNCVLQEELETHDGVSKGKYTIGLGQDSMAFCTEVEDVISMSLTVVKTLLKNYNIDPKCIGRLEVGSETVIDKSKSIKTWLMQIFEECGNTDIEGVDSSNACYGGTAALFNCVNWAESNSWDGRYGLVVCTDSAVYAEGPARPTGGAAAIAMLIGPNAPISLESKFRGSHMAHVYDFYKPDLASEYPVVD

SEQ ID NO: 160623 - protein, 89 aa, Triticum aestivum
  Clone ID: PAT_TA_55041.pep
ASLQRVVAPELSGSSTAYRRLQFKSNLTIRRDNPVSVRPLKVQHSFCCWSEHGGHGPERLRPLHVVVGAAQYQRHNYYLTCVACVLGVH

SEQ ID NO: 160624 - protein, 78 aa, Triticum aestivum
  unsure (1)..(78): unsure at all Xaa locations
  Clone ID: PAT_TA_55042.pep
APDDTYILDSXETAGVELPYSCRAGACSPCAGKIXAGPVDQSDGSFLDHAHQEGYVFTWVPYPKSGWVIPPPKEGALY

SEQ ID NO: 160625 - protein, 121 aa, Triticum aestivum
  Clone ID: PAT_TA_55043.pep
NDYMLGKLPPDYMLSKLPNDVVLNILQRVGPLYSVKTCILSKQMQKLPGMLSPIVIDFSPPDLGGMNGVVAHVAANLLSKRFPPIPVCQLKGKFFLGPPGFPPGKTVAPPLAAPKLNAAGF

SEQ ID NO: 160626 - protein, 56 aa, Triticum aestivum
  Clone ID: PAT_TA_55044.pep
PRIVHADKSTTVAQPLASSSILQALLQGHLPRSCAPPWGLRHCHSNSSHWHCPHHP

SEQ ID NO: 160627 - protein, 60 aa, Triticum aestivum
  Clone ID: PAT_TA_55045.pep
MAKIKPRALLAQSKQKRSPTKIAPTMFAFIVVGALVVSSLYAYKYWMSKGPAGAESVAGN

SEQ ID NO: 160628 - protein, 65 aa, Triticum aestivum
  unsure (1)..(65): unsure at all Xaa locations
  Clone ID: PAT_TA_55046.pep
RGTLKIAVSTDDGDSWNEVMTLEDTKGXMEFSYPAVIQTMDELVHITYTYNRTQIKHVVFRHSET

SEQ ID NO: 160629 - protein, 56 aa, Triticum aestivum
  unsure (1)..(56): unsure at all Xaa locations
  Clone ID: PAT_TA_55047.pep
LVGVPIGIIMGWSLXLGVRGIWSGLIGGXLCQTLVLVYLSMRCDWEDEAKTHQCLI

SEQ ID NO: 160630 - protein, 57 aa, Triticum aestivum
  Clone ID: PAT_TA_55048.pep
SILESLKRLVFMNAGGIRAIGGHIKSFTNYIFFSPIHFYIFIGILALNLGTLIHAQL

SEQ ID NO: 160631 - protein, 108 aa, Triticum aestivum
  unsure (1)..(108): unsure at all Xaa locations
  Clone ID: PAT_TA_55049.pep
PKHFEDFVAAHFRKHGRNVLVXCKAYLDGAQXVGCLAGNGVQDVDEGDKSCSLRFKTSLKRLFEELLMEFTVKGADCSKFLSEKAKQSAASASGTTSRGPPADTTLRL

SEQ ID NO: 160632 - protein, 98 aa, Triticum aestivum
  Clone ID: PAT_TA_55050.pep
KILYKMSIKKNGPPALGSFGPRERPVVQLWVGIHYGGVKTFPGVGPLLGVPRGRIWPIQLGAFWELGGQKKGKGFLGFLGPGGHWGTVCLPQGFFFPI

SEQ ID NO: 160633 - protein, 96 aa, Triticum aestivum
  Clone ID: PAT_TA_55051.pep
RPPPPRGLGGFLVPVVPLPLHGHGVFPARNFCAALIFNRGPFLMCPWIFWVGPFLGGSLGGVSPEGVFEGVSFAKNRCLCPLSSLQKPCWGIRGFF

SEQ ID NO: 160634 - protein, 128 aa, Triticum aestivum
  Clone ID: PAT_TA_55052.pep
TTSLHGLLTQYTTSHGHIYLTVEITSCMSKRKPHDSMAPQEHTSAISSMSMETRENLDTYLHRKCLSAPPCVTLHYLCLQRLNQTMVSLVLLSALLSIALLSTLLLARLLMQPLSSKEFFRLWNVPGP

SEQ ID NO: 160635 - protein, 38 aa, Triticum aestivum
  Clone ID: PAT_TA_55053.pep
CSHALLFMNRRMSDQDKQDYEFYSRQLKLIHSCNQTTY

SEQ ID NO: 160636 - protein, 94 aa, Triticum aestivum
  Clone ID: PAT_TA_55054.pep
RGGGTPTNFMPIEWTRNSSPQVEPRFAGGGGALVVPQDGLKGPHKRLHLGHLPQLQKFDPRPLNRLVGGCRPPPPRGFGIKRPLPRGRPHPGAL

SEQ ID NO: 160637 - protein, 150 aa, Triticum aestivum
  unsure (1)..(150): unsure at all Xaa locations
  Clone ID: PAT_TA_55055.pep
QSASPAWSKRVQVPPHKDRRPALLGLAAVLAVCAASTGSARASVFSEFLEKSKLGEXVTDKKRGPTKGASFGRAYTVQFGSXSCPPGSRFFXDLAKQYKVRLVNNGVEMECLCKHKXCKWGSNFFWKWWNRSLAQTLCGENGVFTLPACT

SEQ ID NO: 160638 - protein, 92 aa, Triticum aestivum
  unsure (1)..(92): unsure at all Xaa locations
  Clone ID: PAT_TA_55056.pep
APGVPIILVGXKLYFRDDEQFFVGPPGAVSIFPAQGXKLKKVIGAPAFIECSSKTQQNIKAVFYSAIKVVFQPPKQKRKKRKFQKGFSLLLN

SEQ ID NO: 160639 - protein, 81 aa, Triticum aestivum
  Clone ID: PAT_TA_55057.pep
LHVCQSVFKTDLRGVLGMVQAPCVVVQTTRDVSVPANVAAYLRAHLGGRTTIEPLPTEGHLPHLSAPSLLAQVLRRALARF

SEQ ID NO: 160640 - protein, 103 aa, Triticum aestivum
  unsure (1)..(103): unsure at all Xaa locations
  Clone ID: PAT_TA_55058.pep
PDYPCGSLLIIQNSKLKDGSTFTFTKPTGGRFHLMILVSSFSFASEFDVWIISDAISQAHQHACEMFMVVSPWYLLFLRVQFVHMPXRIAQQSSCGQKALSTI

SEQ ID NO: 160641 - protein, 160 aa, Triticum aestivum
  Clone ID: PAT_TA_55059.pep
KAPPFPPRECCSFCDPPVPQKRGAALLGASPPQAFFGDFPRLLKFPPLPKPQGVGPSGGSPGPPGGFFLGPPPLCPPPPRGVPLAPGHFPGFRGPWPKGLRGCAPPPRGEPPGGRLCVLFFLTPLLVCCTPKTGGVWKNPRRPLCPPMFLKRGPFFFGGL

SEQ ID NO: 160642 - protein, 133 aa, Triticum aestivum
  Clone ID: PAT_TA_55060.pep
RYWPMWKPPMFGGPPPPPVIPRVGGVKKGAPPGDGPLLGFATMGQGQGVSFFPFKPPGFEESGKALTGPSRRAIYKGPLPFCPPPPCFGVSFPPYLFYLFPKKWGWPCSGPPRAPKSKLVFETHRGLCKCPAP

SEQ ID NO: 160643 - protein, 67 aa, Triticum aestivum
  Clone ID: PAT_TA_55061.pep
SVQLTDTYMSQKALGYTKQDKMKTGSLYEGKGAQQGTLPVPAGCTDQSAKNFDPTARSDDGRCLYTL

SEQ ID NO: 160644 - protein, 39 aa, Triticum aestivum
  Clone ID: PAT_TA_55062.pep
CTRSSARAAPCTASAVRGWLAWLQCVYQVAALRMLVLVV

SEQ ID NO: 160645 - protein, 155 aa, Triticum aestivum
  unsure (1)..(155): unsure at all Xaa locations
  Clone ID: PAT_TA_55063.pep
GINGDLVHMAALAGVTSVIVIVVVLPMTEGRVRVATTLIRHRLELGHNVLAATVAHESRSGTPDPALGENMDSVLGLDHHYFEEMVVDLTPTLGGCRCRRPTRVLGPSQHKTGVREDPIPACLLDCRLVIPSCCARSSHPRHHVKKGKGKAPXAC

SEQ ID NO: 160646 - protein, 131 aa, Triticum aestivum
  Clone ID: PAT_TA_55064.pep
PPIWMGCPPGGGFVFLTPFCGVCFPRGVPLKRFFPPFPTTPGWATIGGPLPGVAFPGDLRIGWFFFFLLLASSQSFCWFWFLPPPLRWFGEFGLFSCGPGPESRPAPFCLGCGPPPIVFCGLVSGCSPRWG

SEQ ID NO: 160647 - protein, 140 aa, Triticum aestivum
  Clone ID: PAT_TA_55065.pep
PPFRVWERVGPLRLGFQRGLGPLTQGVPPRPPERGGSFPPKPWGGGAPPWVTPPPSPQSGGFRFFSPQAPKPFPPPFFFFFPGFFFPPGWLPPRGFRVFPPRGVFFFSQGFPPPFFPFFQLGPFLPRSPKKKFFRLFFFS

SEQ ID NO: 160648 - protein, 73 aa, Triticum aestivum
  Clone ID: PAT_TA_55066.pep
GSSIPGTFFNPTNLQFPGRETGPKNKNPDPKPPDHQTRGGITSKRSPPPTNYLIRPKKPPFFTGPQIFKPWKA

SEQ ID NO: 160649 - protein, 141 aa, Triticum aestivum
  unsure (1)..(141): unsure at all Xaa locations
  Clone ID: PAT_TA_55067.pep
KKAKKVQIAHPYGPGGGVXFKKGVNASERAPKGKGVSHFPPKYGPNFFGSSPIYTPKKWFPSGAVFFGGKTGLFFWPVPFFGILLGGAFFVSKNSPLVFLSLWGIPKYAPPFFFVRVPPVPPFVIECKSQSPPSIIPPFFF

SEQ ID NO: 160650 - protein, 78 aa, Triticum aestivum
  unsure (1)..(78): unsure at all Xaa locations
  Clone ID: PAT_TA_55068.pep
RTGGIRQALNALKFXGALLVLAPKKPGPTFFPLPELGVLGSPVGGGSDPQNPGGVFECGSSGANAGKGFSVRDKLLDP

SEQ ID NO: 160651 - protein, 81 aa, Triticum aestivum
  unsure (1)..(81): unsure at all Xaa locations
  Clone ID: PAT_TA_55069.pep
DVRRHLDVHKKKIRFFLNCIYYSFGFTVYVGVXELEADSWPLPSICGGNIRGPCLWGGMGMGMLGMMEMGGNGGEMNWGMG

SEQ ID NO: 160652 - protein, 139 aa, Triticum aestivum
  Clone ID: PAT_TA_55070.pep
DVTNRKASKEHGYYIAVNELKTISEGKVRELTGDVLFPVTFTCITQRPMKGEILVGSVEKILKHGVFLKSGPIESIFLSEKSMSDYKYMGGENPMFMNDHSKLERDTAVRFKVMGFRWMEADRQFQLLASLAGDFLGPL

SEQ ID NO: 160653 - protein, 85 aa, Triticum aestivum
  Clone ID: PAT_TA_55071.pep
PFSAFSCFMEGLTKHQPPMGPPPPGDPFPFAPANGGGVLPPFLFPPIFDASEAFPPCCQALVPHPKKPLPPAFGGREWDLLRNPS

SEQ ID NO: 160654 - protein, 88 aa, Triticum aestivum
  Clone ID: PAT_TA_55072.pep
STIASVERLKKTEIWAQAIAMSDLPKNAKKSFSEMIKDMYLPYNERFELLFCGFQTLNVCLEVSLVFCFGFTAFHMYHPFRPLDFQRN

SEQ ID NO: 160655 - protein, 100 aa, Triticum aestivum
  unsure (1)..(100): unsure at all Xaa locations
  Clone ID: PAT_TA_55073.pep
QVGYLIRSKWVPCLEFSKVGFIFREHNASPGXYDGRYWTMWKLPMFGCPDATQVINEVEEVKKEYPDGYVRIIGFDNMRQVQWVRFIAFKPPGCEESGKA

SEQ ID NO: 160656 - protein, 68 aa, Triticum aestivum
  Clone ID: PAT_TA_55074.pep
GKPKVPKREFFFGGEKKNGPKRDAHAIKKKTGALRGTPKNKPTFWGKKKLFSWGEKKKEKLRKSTSKS

SEQ ID NO: 160657 - protein, 114 aa, Triticum aestivum
  unsure (1)..(114): unsure at all Xaa locations
  Clone ID: PAT_TA_55075.pep
NPNEMLARNTPKFEVERKEEDTRVEIXCAAKPGLLLSTVSTLDTLGLDIQQWVVSCFNDFAMHASCSEMQREMISADAIKQELFKNAGYGGTSSSRRKDNKVVEVAVEVSRIST

SEQ ID NO: 160658 - protein, 213 aa, Triticum aestivum
  Clone ID: PAT_TA_55076.pep
SKGIILAAIDNPSNAVEWALAEMVNNPELLAKAVEEMDRVVGRERLVQESDIMQLNYLKACIREAFRLHPIAPFNLPHVAIADTIVAGYHIPKGSNVILSRLALGRNPTVWDEPLHFKPERHMGDNINVVLTESELRFISFSTGRRGCIAASLGTTMSVMLFGRLLHGFTWTKPAGVSAINLSESKHDLFIEQPLVLHAEPRLPVHLYPLMHC

SEQ ID NO: 160659 - protein, 141 aa, Triticum aestivum
  unsure (1)..(141): unsure at all Xaa locations
  Clone ID: PAT_TA_55077.pep
NGPSFVWTKAGLPKMSHNGSVPPDAESPPXAEWVEQTHPGVYFPLPPLPGGARVFKRVWFTRKRFIXNQADQWWQGTRARVSPPSNVSMVSKSIPPMVCEISPHFFFLGKKKIFFQVGFGPHIRGVKAFLSVNVFPQRGPL

SEQ ID NO: 160660 - protein, 148 aa, Triticum aestivum
  Clone ID: PAT_TA_55078.pep
EYAENTFDVIYSRDTILHIQDKPALFRNFFKWLKPGGKVLISDYCRSPGTPSEEFAAYIKQRGYDLHDVKTYGKMLEDAGFHDVVAEDRTDQFLRVLERELGETEKNKEAFLADFTQEDYDDIVNGWSAKLKRSSAGEQKWGLFIATK

SEQ ID NO: 160661 - protein, 129 aa, Triticum aestivum
  Clone ID: PAT_TA_55079.pep
PPNSFFDRGVGVPGVPGVASPVSQAQVTPLMGEAHVDGNAPIGHVGFPGAPMDIHRLVRGDLFFRAFRFFYRGGSGFLSKLFLGPPFIERPLPPGEAGRGVLSFVDPVLCGGVHPGVLDFFVPGGAVHL

SEQ ID NO: 160662 - protein, 75 aa, Triticum aestivum
  Clone ID: PAT_TA_55080.pep
SERRNTRSCYHPPCLHGVTHQNINRAPNQKLNFTKLSQARVPGDKKAMAPYGLSYNQEIITLKPLNRGKGGKKLP

SEQ ID NO: 160663 - protein, 99 aa, Triticum aestivum
  unsure (1)..(99): unsure at all Xaa locations
  Clone ID: PAT_TA_55081.pep
GGDNIQSGPVVGXVRGPLXSTLGFVLFVPGFYIEKDCARGIFFPRDWVSPPGVKPVIPGGIHVWGTPARTGCFAXGSVFAFGEGNLVRLLGRTHHGSIT

SEQ ID NO: 160664 - protein, 84 aa, Triticum aestivum
  unsure (1)..(84): unsure at all Xaa locations
  Clone ID: PAT_TA_55082.pep
VYVHLLRDDLVQKHRAQGFFLNQHCVSPPGVIRVHSAGVRVCDIRLVHRIFGXDSXTPFGGGSLGNPWANASGRPSIPMNFKRL

SEQ ID NO: 160665 - protein, 117 aa, Triticum aestivum
  Clone ID: PAT_TA_55083.pep
NYPEKKPQFFWPKLNGAKLEKKKKTFPLEKIPQKANLKFGPRKKGKPGVFFFFPQKKKGGAKKNSIPRALEQGWASTFKKKGRGNSSSHRNYGREPKNPLGALGGKKKKQGLFGGRF

SEQ ID NO: 160666 - protein, 95 aa, Triticum aestivum
  Clone ID: PAT_TA_55084.pep
ETKATGGGRANTPGRKEPNLKRGPKHLGTHPPDQKPGPPGPSERKQLGGHEKTGRGTKTTGPGGAPPFTPSKGPKTTPGGGRLKPRPPNRNTGGP

SEQ ID NO: 160667 - protein, 61 aa, Triticum aestivum
  Clone ID: PAT_TA_55085.pep
GPTKTRKKGPRGVPGSSPSSKKPPPGGGGREGPPKKRSGKRGPKGGSPPFLGAKPGKKRGF

SEQ ID NO: 160668 - protein, 34 aa, Triticum aestivum
  unsure (1)..(34): unsure at all Xaa locations
  Clone ID: PAT_TA_55086.pep
PISGGMAPIYGAAGXIPNRVPVKEWLVEFMDSSC

SEQ ID NO: 160669 - protein, 55 aa, Triticum aestivum
  Clone ID: PAT_TA_55087.pep
CILVPRGFRDFFFFKFERNKRYVRAQCELITCPCAQEWSPCYHDVWICTIRTQLQ

SEQ ID NO: 160670 - protein, 100 aa, Triticum aestivum
  Clone ID: PAT_TA_55088.pep
GGDFLLIMPSVKNMPFYVSCVPLLFLWEFFCSFVKNSPHVFLPLCKTFMENLGGALFINGGPGLESFYPLFLTKFLGFRPPWGGGVPQKTAHFCWVLFCS

SEQ ID NO: 160671 - protein, 58 aa, Triticum aestivum
  Clone ID: PAT_TA_55089.pep
AVEPPQSSAVSHGGTSARAGGSRDELQRVRASRPRAAGRRVVRLAARPVMCMERRCHV

SEQ ID NO: 160672 - protein, 60 aa, Triticum aestivum
  Clone ID: PAT_TA_55090.pep
CPRTSSSTSASAWSSPKRSSQVQPPVATVATFAGITSPSSLASRVQYNASCGPLCTTWCD

SEQ ID NO: 160673 - protein, 95 aa, Triticum aestivum
  Clone ID: PAT_TA_55091.pep
LIIFSVGPTGVWAHGVSLNAGLWEFLCRPIVGGPPLCPLTGRWISAWGTPGSASWASEVASVESASSWGYAAGVLAGSSCLCMPYSSCRPHVISA

SEQ ID NO: 160674 - protein, 87 aa, Triticum aestivum
  Clone ID: PAT_TA_55092.pep
MNDVHDMQQFDEDSDYMGHYVVICGYDADACEFEIRDPASSRKREMVPMKSLDEARKSFGTDEDILLVSLTGKNGTKLSHKLPVGSP

SEQ ID NO: 160675 - protein, 136 aa, Triticum aestivum
  Clone ID: PAT_TA_55093.pep
DASAKFHVHGGSGNGSTLSTTPAPAPTPPRPDEGILLSGCQTNETSADVPAYEASGGKACGAFSSPVQSVLAAHPAPLSNRELVEKARAVLEEQGFEQHPCFYCTDANAEAPFLSQDKKEETAVGAASPAMSAALL

SEQ ID NO: 160676 - protein, 100 aa, Triticum aestivum
  unsure (1)..(100): unsure at all Xaa locations
  Clone ID: PAT_TA_55094.pep
VEVLRGPPTMILKQTAQIGVVSEISDQLDSVNLVNCSVYKRHVNLVIVLSDGTLWKWAGIFKVXVRPKQGKVVGXSCVVVKDCGEYSEGIHIEQVLVDFQ

SEQ ID NO: 160677 - protein, 140 aa, Triticum aestivum
  Clone ID: PAT_TA_55095.pep
LGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 160678 - protein, 112 aa, Triticum aestivum
  Clone ID: PAT_TA_55096.pep
QNVDAALKEVRQRKYHVITTQTETYKKKVKHSQEAYKNLQQELGMREDPAYGFVDNPAAGGWDGVAAGGWDGVAPVAMGGGSAADMYAFRVVPSQPNLHGMAYGGSHDLRLG

SEQ ID NO: 160679 - protein, 155 aa, Triticum aestivum
  unsure (1)..(155): unsure at all Xaa locations
  Clone ID: PAT_TA_55097.pep
LEEKILFSLPKKKWGDGFIFKKFFAHSKTNXKLFXEIFSLPLKFTKPVQKEDXFPLXKLPKANLGRQNSKKLFKKHVSNFMLSKIVQPLGPMLYPVVFFFPPSVVPKSFPPFLYPKAFPNPTRPIWVLPVCFQTQFFGGQFFACLISPPFFWGPF

SEQ ID NO: 160680 - protein, 140 aa, Triticum aestivum
  Clone ID: PAT_TA_55098.pep
RTIFLFLFRGGQGFFFGLKREIEGIHPRVYAIGKLGNPNLSGGKNVLFRVGKRDVKLGLGREGTNRDFFFGGDHHVINKLGVGLVNLGLTPRGLGGDLKGDFHLRVHKRRDPGGDGGLNPGLERKPGVPSARLGLGEQQG

SEQ ID NO: 160681 - protein, 92 aa, Triticum aestivum
  Clone ID: PAT_TA_55099.pep
CVNTFFVLCAHIGKSHKKRVCPGINFSRKGTRGPVWLHICVKRCGFFEPKALANTCVVCASVSGVLKRAQKRFEFHIKDPCEQIHFSTHILF

SEQ ID NO: 160682 - protein, 77 aa, Triticum aestivum
  Clone ID: PAT_TA_55100.pep
RVFLDGNSGPWIRRNIGAVHFLPMSKLVLSIYALEQVSVGMQICRARFIIFVHFVQEGVLIQYKHMILRRIKVFPSF

SEQ ID NO: 160683 - protein, 84 aa, Triticum aestivum
  unsure (1)..(84): unsure at all Xaa locations
  Clone ID: PAT_TA_55101.pep
EFISFIAREASAKCMKKKRKSISGLDLIWSMGTLGFXTRSSPTXLYLKLYRXCSGYTSKGSKFEQAAKKVGALNGQHGSSLDGM

SEQ ID NO: 160684 - protein, 99 aa, Triticum aestivum
  Clone ID: PAT_TA_55102.pep
MLAWPPVESCSSMTTGQSSPFRTLALAIHLSNGADWLPCNFFNLSFAPSMKIYLELAGLSLSAGNMGGQIILRGWISPKRTSSSAMTYTLRNCMHLTSN

SEQ ID NO: 160685 - protein, 168 aa, Triticum aestivum
  Clone ID: PAT_TA_55103.pep
VFGVAPIFASFDAPFIPVAALSGRETLVRIPGGMKAQAVRDASSPFAATPASQEVAPRCKELGLPAVPIKLRAPGGLNPSPPGPGAQSALRAFARSGMKIGGVEAVSPVPPGSARRKGGRRGCCLLAFFLLFWWLSRFLFLFGLSCCFFLCLWGLFFCSVGDLFLLVL

SEQ ID NO: 160686 - protein, 176 aa, Triticum aestivum
  Clone ID: PAT_TA_55104.pep
SPGPVSLSSVPPPAGIFPGGAVRPLPCEAPSGAPASRPRAFFCHSSFGGEPWPGPFVLSLSLPPPAMGISFSPFAPGDSPTQGPRGENPAFWRFFFQKRRRPMPKNRVCCFFFPPNFLLHNPMLGFALFPPLWICPCFCGFFPRPFPPQFGLAGVFFGFVLFLPPRPPVFLVFFQE

SEQ ID NO: 160687 - protein, 71 aa, Triticum aestivum
  Clone ID: PAT_TA_55105.pep
FYFGWAVDPSPARGFLILELDGISPVGEDFFPQNIFRASEVIGKKRVPVDCANVVLLQKKKKLSAGAYFRP

SEQ ID NO: 160688 - protein, 163 aa, Triticum aestivum
  unsure (1)..(163): unsure at all Xaa locations
  Clone ID: PAT_TA_55106.pep
LMGFDLQGNTYWXFRLVXAPRSRERXRRIVQYPGSTHLSSVKVSPMWHQWLRHTREEPPTIEEQQDDVVRQARMKTLAAQADARWEAKPRVMEAPQAAPAPLLQPANASPSGQDSKTVQADAGAKNIKDEVEKKDDPWAKAKASAPGETWQPSAWTPPATKRR

SEQ ID NO: 160689 - protein, 144 aa, Triticum aestivum
  unsure (1)..(144): unsure at all Xaa locations
  Clone ID: PAT_TA_55107.pep
VGMMTYFDPENGKPVPATVVGFREGGNVLTHVKTVATDRYHAEQVGFHGVREDKLTRPELGHLGKASTPAIHHLQDXRVVGVNSFDPGQALQYNELFKEGDLHYVSAKSIXRDLXGGIKRHNFKRGLMTHGYYSHTALRYIGAG

SEQ ID NO: 160690 - protein, 138 aa, Triticum aestivum
  unsure (1)..(138): unsure at all Xaa locations
  Clone ID: PAT_TA_55108.pep
FRTSQFVHWCLLGFKVWYEVXVSGVVPGGYLNKVQRAVCMLXGCPSVVWVMCRIGRWLKLGLAKSIIVIWYVGXGMLEAELSQGPSELFFPLKGRMVNLVLRSTRVRALLFGISTRGMPSGVLCREVSFLIGVVAKVA

SEQ ID NO: 160691 - protein, 115 aa, Triticum aestivum
  Clone ID: PAT_TA_55109.pep
MYWSLLRQPQPEISEASEPSSMASDATSDIGSEDGASTAAPSESEEANSLSDSLSTLTTDDATSNAPAAENGSDTTSNAPAAENGTGATPDAPPAENGNNATPDAPPAENGNDAT

SEQ ID NO: 160692 - protein, 136 aa, Triticum aestivum
  unsure (1)..(136): unsure at all Xaa locations
  Clone ID: PAT_TA_55110.pep
GISLQTVLXFGPTISIFGVCMGVQPIGEAFARKIIRVRSGVMHEKSSPVYYLQVLGQSILEGLFIPFTAARYHSLVIEYFPFPRDELGVPAWIEDVLVMAARPKKYTHIQGVQFPPDSIITLEGKKIIVNFARYVP

SEQ ID NO: 160693 - protein, 214 aa, Triticum aestivum
  Clone ID: PAT_TA_55111.pep
PPFFFLLFLFIFIYFIFIFIFYFFFFFFFFFYKKPRPSFYYSPPPGEGNKKQRTDRHKPKQKIGPARPGGEAELNPDFLNSPPPPREGNGTGLPAQAEENTTGRKYDREGGVESDWAGGMKLKGHRKPREFTRPPRAGSPRRPRKEKPPLSGPPPTTQGGPPGGGGGDPAREPSPSPDGKGQPKLGGGRAACQPKRRAPRPQKKKTCKGRGGGT

SEQ ID NO: 160694 - protein, 161 aa, Triticum aestivum
  Clone ID: PAT_TA_55112.pep
MGTRGLALLLLAAVLLQTLLPASHAEGLVRIALKKRPIDRNSRVATSLSDREDLLGGGGANTLRSEEEGDIVSLKNYMNAQYFGEIGVGTPPQKFTVIFDTDSSNLWVPSIKCYFSIACYLHARCKERACKTYKKNGKPAGIRGETGGMGGCGEGDGGAGG

SEQ ID NO: 160695 - protein, 160 aa, Triticum aestivum
  unsure (1)..(160): unsure at all Xaa locations
  Clone ID: PAT_TA_55113.pep
HAPYARLRRATPYGLGRLLILRPCGNSGRNNRLVNRGCPSSYDATSSVEPYNSVLSTHSVLYHTAKLTXLDIQAIYYIXRHLLDIDRPTYTXNLNNVGKLCHLHYLTAFLKIHVSPNGDVNKMHTNLVLYTRIHIHAGLLHPTFSADKAHHDQVSLAKIT

SEQ ID NO: 160696 - protein, 89 aa, Triticum aestivum
  Clone ID: PAT_TA_55114.pep
VAAHRSKKKKKKKKKKKKKKKKKKKKKKKKKKKKKKKKKKKNKKKKKLKKKKNKLKKKKIKKKGGGVLKGSIFLTRVWKNFFFFLGPPI

SEQ ID NO: 160697 - protein, 175 aa, Triticum aestivum; identical to SEQ ID NO: 115797
  Clone ID: PAT_TA_55115.pep

SEQ ID NO: 160698 - protein, 59 aa, Triticum aestivum
  Clone ID: PAT_TA_55116.pep
SSKPGLTLLSRDTPVPFDSWPVRRSSLVPVRVRRSCPSHPSQWGPWCCSQRQVSARVVA

SEQ ID NO: 160699 - protein, 233 aa, Triticum aestivum
  unsure (1)..(233): unsure at all Xaa locations
  Clone ID: PAT_TA_55117.pep
MSFLRQEPAAPAWFLSLAFLGTLYASAVSFRLLAYLALCLRRPKDLRRRYGAWAVVTGPTSGIGRSVALELASRGLNLVLVDLDADNLREISNTIRSHHAVQTKTVVFDLSLVSTAQGDEALRRLREAVAGLDVGVLVNNAGVAKPGAVYLREADVEACVRLMRVNLWAVTEVTAAVLPGMVERGRGAVVNMGSASSEAIPSFPLYTMYAXTKRYVAQFXRSLYVEYRSERID

SEQ ID NO: 160700 - protein, 124 aa, Triticum aestivum
  Clone ID: PAT_TA_55118.pep
HASAHASAHASGWAMLGALGCVFPELLARNGVKFGEAVWFKAGSQIFSEGGLDYLGNPSLVHAQSILAIWACQVVLMDAEEGYRFYVGPLFEIEDPLYPGGRWDPLGLGKDPEAWGELKGKEIK

SEQ ID NO: 160701 - protein, 171 aa, Triticum aestivum; identical to SEQ ID NO: 141856
  Clone ID: PAT_TA_55119.pep

SEQ ID NO: 160702 - protein, 157 aa, Triticum aestivum
  unsure (1)..(157): unsure at all Xaa locations
  Clone ID: PAT_TA_55120.pep
RTHAFGRLYTYIAQPWAPTEMASSATYVAPLQGLRCTAGLPVSRRSNGASLGSLSNAGRIRRMQVRPIEGIKKIETXLSYLPPLXLEALLKQDHYLIRYTGPPCLEFTRAGFIFREHSPSPAYYDGRNCTMRKLPMFRRTHPTQVINDADEVMKEHP

SEQ ID NO: 160703 - protein, 169 aa, Triticum aestivum
  Clone ID: PAT_TA_55121.pep
QLICGNFFQENHKAKKHKKEKTDGGKRERKEKDRGYRKDKHKKKHKREKHKDRREKKERDKDKRQNLELGTQKKDDLDNRRPKQIVHNEAVKYSKHKEELATQITGQEGHANRTRSNTGKLLPRSIESFGVVGSKEKERTSISRVNGKSGQIAHHNHASVKGKNKTRIL

SEQ ID NO: 160704 - protein, 63 aa, Triticum aestivum
  Clone ID: PAT_TA_55122.pep
RATPPPAHMSSSLQSPNLRGCTQLKDDLLCRTAAEAPPAGAATGARGCTILPSWIAVPTETPL

SEQ ID NO: 160705 - protein, 197 aa, Triticum aestivum
  unsure (1)..(197): unsure at all Xaa locations
  Clone ID: PAT_TA_55123.pep
ANLASMTGLSQGVRLPGPTGRRXQQVTXRAXXXEAXAXXXXXXLXXMXXXXXXXAXVQVVHAGTXAXIXVXPPXXLSXGLSXTDNXDEARDXDXXLKNRFYLQPLAPAEAXXRAKELAQDILNLKPLIXKKQWPXYXMNDLRLQAFYLRYDLKTVISXKTTQEEKKDLKDLTGKLFXPLTGLTHAAXIKKPTEAEEV

SEQ ID NO: 160706 - protein, 78 aa, Triticum aestivum
  Clone ID: PAT_TA_55124.pep
LTGARTGLETMAYESSFARGESLPAHRPPLAFTSYRLWYGAVFSRAIRRVDARRAARAASQGAVRTMPRLSRSEGARE

SEQ ID NO: 160707 - protein, 104 aa, Triticum aestivum
  Clone ID: PAT_TA_55125.pep
MADVEYRCFVGGLAWATDDQSLQNAFSKYGDVIDSKIITDRETGRSRGFGFVTFASDEAMRQAIEAMNGQDLYGRNITVNEAQTRRSGGGGESGYSGVGGGYSG

SEQ ID NO: 160708 - protein, 89 aa, Triticum aestivum
  unsure (1)..(89): unsure at all Xaa locations
  Clone ID: PAT_TA_55126.pep
EPGMQEPNCPALGGRTEPKRGRRWRTTQSAKERVQRGDAILGAAVKSSFLQNLCEELQFDPAADSDYPXQRSADGSHPGXVPEPVAAGV

SEQ ID NO: 160709 - protein, 113 aa, Triticum aestivum
  unsure (1)..(113): unsure at all Xaa locations
  Clone ID: PAT_TA_55127.pep
MATAARAVAAAARPVHPVFLSRRLPCPSARPARPRVGRAVRCMARRPDASYSPLRPGQGGDRAPTEMAPLFPGCDYEHWLMVMDKPGGEGATKQXMIDCYMQTLSKVFGERGG

SEQ ID NO: 160710 - protein, 124 aa, Triticum aestivum
  Clone ID: PAT_TA_55128.pep
DAWAALSSLIIPSLKEASGDKYEGPVVHAVLSSLMDLEQEIPGSCEVLVGRILHRLGSSKDSSLQSLNETAISIFTKKPEPPSEAGSNKKQASTPPLAAPTVSPLARFLLTRWQNQVSQDLNSV

SEQ ID NO: 160711 - protein, 175 aa, Triticum aestivum; identical to SEQ ID NO: 115797
  Clone ID: PAT_TA_55129.pep

SEQ ID NO: 160712 - protein, 149 aa, Triticum aestivum
  Clone ID: PAT_TA_55130.pep
HTQANKSKQGAGGHQPLETNMQETQISNETRGLACTTSSLACLFPDALHIILSTFALSLPRLLHLAHARVASKGYTAVHLNLGITRRSSPVGSGNFHTFSTALEARIHDILIDTVADRRTADGRYILGHSDGAHQRDQCRHDNEPWEHC

SEQ ID NO: 160713 - protein, 133 aa, Triticum aestivum
  Clone ID: PAT_TA_55131.pep
MAESAAIAPPPQPMTPPQPMAENATEAPPQPMAPPQQMAENATAAPPPQPMAENATAAPPPQPMVENATVVVVVPPPPPDSTTTFLCLILAFFLPPLGVFLKYKCEIEFWICLILTFLAYAPGIIYAVWVIVK

SEQ ID NO: 160714 - protein, 106 aa, Triticum aestivum
  unsure (1)..(106): unsure at all Xaa locations
  Clone ID: PAT_TA_55132.pep
SADESPGGSVRGEQTVQRALAQAAHSTTTALQNEVIEIDQEQSAPPRRPSEHEQRQLPGGIXERDGKGAGVEXGEAXRERSXWIEGGGXGGREGGVCDVSASPRVR

SEQ ID NO: 160715 - protein, 251 aa, Triticum aestivum
  unsure (1)..(251): unsure at all Xaa locations
  Clone ID: PAT_TA_55133.pep
RKQALVALYSFTCFTQAGSRIVMTTRAKICSSTFKADASIILNGIKDREVTDLLNHIANLTTDGTADNNSDQRIQELINKQVPKLKGSPLAAVEIGEELKKQTTSDEIERCNILHKIEDHLGSVLQAHLFTYRLLPPHLQRCLQFCSIFPYNWRFEPDKLTKMWIAHGFVEDARQAQSESMEDVARGYFESLVDRSLFSLVQEEXEPXARGTTTYVIHEQIHWMLRLASDKNCINIXCHNTAXRSIPATVR

SEQ ID NO: 160716 - protein, 167 aa, Triticum aestivum
  Clone ID: PAT_TA_55134.pep
NILRWAGCTTSKRGQRIDEEWSSTPYHPPVWAAKSLLLQHRFGSPSVCPGSPPCRPAHHASFRLKCSWSGRRRTRGDEICIVADPVAGAGEPLGVTRGVGVDEEAQLLAAVVQGAEGIVAVAAPAVVPVALPPPAAARRGSRAGHRSARAPVLAARAGGGGRWGWRR

SEQ ID NO: 160717 - protein, 68 aa, Triticum aestivum
  Clone ID: PAT_TA_55135.pep
RDLNLDLCISPPSPEEPMVAPKPWVKREAVVGLCSSCRMGLPRSADCKCSSFIGLRTPMLDFRSIGMN

SEQ ID NO: 160718 - protein, 96 aa, Triticum aestivum
  Clone ID: PAT_TA_55136.pep
SQFIYGIRFSISPYIHIAISEKYCHCPAFHVYTIPFWKKINRLTTGVLHTGKRKPSPQNCLTKGAFIVLNSSPSKNSIFFWHPKIWLPWCDSANIF

SEQ ID NO: 160719 - protein, 122 aa, Triticum aestivum
  unsure (1)..(122): unsure at all Xaa locations
  Clone ID: PAT_TA_55137.pep
PGSPEGYSLWFCAPKSQEGAPVSXVPLPKVGGFLHRMDLFRKYPFGKRLVFGFEAPPQVKGLWLFRGQDTPEFVMKGVFSMDLYEWPKVPLSSEAQKKGVEPMIEPLSPFKGQPFLDAKCFK

SEQ ID NO: 160720 - protein, 93 aa, Triticum aestivum
  Clone ID: PAT_TA_55138.pep
KADGSVKFGQGEGSAYLFDPDIYTDGRISVQGINPVLLPEDDKKPATPVSAPDRKAPPVPGSRKNKLRQGKLLEATCKMAGVFGQRSRLTSSQ

SEQ ID NO: 160721 - protein, 50 aa, Triticum aestivum
  Clone ID: PAT_TA_55139.pep
WLVLNKSIGVGFSKAPAPEIEFPALERRGIMCSFYSLPIEPRKSLICSSY

SEQ ID NO: 160722 - protein, 62 aa, Triticum aestivum
  unsure (1)..(62): unsure at all Xaa locations
  Clone ID: PAT_TA_55140.pep
PPQVQAXWRFPPKGLQKGPHKVVPGQVKGCLPLQVPCGVKRGELFLAPEFFRFPGVLGMYGP

SEQ ID NO: 160723 - protein, 61 aa, Triticum aestivum
  Clone ID: PAT_TA_55141.pep
GAPGSLEQICIILHSGAKHDDLDLSCTRSKFASSCKNELEVLNCPWLNFLHDETVKGYYKL

SEQ ID NO: 160724 - protein, 77 aa, Triticum aestivum
  Clone ID: PAT_TA_55142.pep
SWTHRGAPKPVLQQQRLRSPYRRIIRCTTPFFIDSPPPFTCRHARPSQNILGHRPNCHLYTTRRSCSKTAMDTMATH

SEQ ID NO: 160725 - protein, 55 aa, Triticum aestivum
  Clone ID: PAT_TA_55143.pep
GWGDKKNNTPGGLMGSRACLTTYGRPKPDHLGREICFGGKAKSGTKGKFTNDPFT

SEQ ID NO: 160726 - protein, 127 aa, Triticum aestivum
  Clone ID: PAT_TA_55144.pep
KGHQGRGDGMRDAMKALLYGARVDAVFAGHVHAYERFAGVSADKRDQCGPVYVTMGDGGTREGLAEKYIEPQPKTSVFREASFGHGRLQVVNVTHALWTWHRNDDDEPVVADQTWITSLAPNPACKK

SEQ ID NO: 160727 - protein, 43 aa, Triticum aestivum
  Clone ID: PAT_TA_55145.pep
TFPASLFYIQVYSCSLIMQFFCLWLPSNSCQMFKYFPYERCNL

SEQ ID NO: 160728 - protein, 51 aa, Triticum aestivum
  Clone ID: PAT_TA_55146.pep
KKEPFLLFFSDKIMHHAPGKSLNEPMTHGLLTGFTPPCGHLERIKTREVFA

SEQ ID NO: 160729 - protein, 62 aa, Triticum aestivum
  unsure (1)..(62): unsure at all Xaa locations
  Clone ID: PAT_TA_55147.pep
KKKRGGGDHKNGTPHYGGGNKKGEQGGGTXYGKTQTRGGGAKNKLKPARGGGKKEKKGGGIS

SEQ ID NO: 160730 - protein, 147 aa, Triticum aestivum
  Clone ID: PAT_TA_55148.pep
GFPWVKTVFSNFFPFPAIPFFLDKPVPDPPVFLFKKKSPRFPFVTRAPQVLGFFSPNSFFWGLGPLFNFLKSGGPPPGLVVFVKMGAPGLFWYRAVFLFLKVFSPFSQKKAWGFFGRFFLLKKQPRKLFFFFAPFLVLGPKKFFLAP

SEQ ID NO: 160731 - protein, 91 aa, Triticum aestivum
  Clone ID: PAT_TA_55149.pep
GPQKASLPCFLGAHNQKNGSGKRGFLRAGGLSFLFVSPVFNPRVYLKFSWVRGFCSSPLPRHGFCFASPPGSPMEDDPLWTKEREIKVWVS

SEQ ID NO: 160732 - protein, 115 aa, Triticum aestivum
  unsure (1)..(115): unsure at all Xaa locations
  Clone ID: PAT_TA_55150.pep
KHGDVNQNVTIRHYHQIVKTEPVTLRYAKELKVLEEYEYXAHSSLVHSFYVPVVKFHFEPSPMQXLVTELPKSFSHFITNVCAIIGGVFTVAGILDSILHNTLRLVKKVELGKDI

SEQ ID NO: 160733 - protein, 103 aa, Triticum aestivum
  unsure (1)..(103): unsure at all Xaa locations
  Clone ID: PAT_TA_55151.pep
PTRPPTRPPTRPKGRGGSTGYDNAVALPAGGRGDEEELAKENVKNASSSTGNITLSVTKSKPETGEVIGVFESVQPSDTXDLGAKAPKDVKIQGVWYAQLESN

SEQ ID NO: 160734 - protein, 48 aa, Triticum aestivum
  Clone ID: PAT_TA_55152.pep
DKLTNLDENGFIPREGFGPYHDKGPPFSVTQTKSQRHLGMQNELRRGP

SEQ ID NO: 160735 - protein, 81 aa, Triticum aestivum
  Clone ID: PAT_TA_55153.pep
SRSGAGDKFSPAGGSPMAPKKCFLAAPVLKFEWGPPTNPPVDLTELDGFLKTMKKPLAALFHPTSNSIILLKSKLLAPVPK

SEQ ID NO: 160736 - protein, 132 aa, Triticum aestivum
  Clone ID: PAT_TA_55154.pep
YSLTNATSNAQTSPAMASSVPATRGSSWQHMLMNTAPHGGMMGRKSYDVTLHEQQAIMMRALGGVVGAQNFGEPAKGLQLPSSAVPAGSVPPQQGKLGSYDAGEFPYGNYDLASPAMSGRPAAANNLGPRFY

SEQ ID NO: 160737 - protein, 158 aa, Triticum aestivum
  unsure (1)..(158): unsure at all Xaa locations
  Clone ID: PAT_TA_55155.pep
FSINNDENREIXPISSQDACDFIDFVEHXXGKVLVQFFEGKXSRNPTVVLAYLILKKNCTLLEAWTMLKKVHRRAHPNDGFAKVLLVLEKXLHGRPPMESQHKRPXMKVCPICGKNAGLSSSSLKLHLQKVHRKISSGSVDSPITLEIQKAIKALKTG

SEQ ID NO: 160738 - protein, 49 aa, Triticum aestivum
  unsure (1)..(49): unsure at all Xaa locations
  Clone ID: PAT_TA_55156.pep
TFKIXSLKKKAPLIPCLKHLPLFPCEFNLIPKVNLAPLIVLIDSIVPVC

SEQ ID NO: 160739 - protein, 84 aa, Triticum aestivum
  Clone ID: PAT_TA_55157.pep
PIAPCILIGTGRPSAPFPGFSPGLGPLNGKGSPSPHRQGGCLSLKNLAGLFKGISMGNPPPIPGKGGVSVFFPINPKVNCNNIH

SEQ ID NO: 160740 - protein, 75 aa, Triticum aestivum
  Clone ID: PAT_TA_55158.pep
DANGRKVAKKGGYQFVAKYGANVDGFSPIYTPEEWFEFGDRYAGGTTGLFYWAVTLAGFLGGGVLLVSNTRAFPG

SEQ ID NO: 160741 - protein, 75 aa, Triticum aestivum
  Clone ID: PAT_TA_55159.pep
KGYKGVKHCSLHDKTIGRGRTSATKWRSGQGGDFPSSTNPILVRKPALQTPGRGLMVTGSQGNLFFGVGTQSGGF

SEQ ID NO: 160742 - protein, 116 aa, Triticum aestivum
  Clone ID: PAT_TA_55160.pep
FIRSGQLFPRSTLIGGDAANHLEVIVNSGGNSLAGCVTDTKRQTDSQNKFHRWDSDRKSCFHSDSSAPFSREFSSRRHARRVGSLPSFAKRGAVHTPRPRSRGRPAWRNPAETGTF

SEQ ID NO: 160743 - protein, 109 aa, Triticum aestivum
  Clone ID: PAT_TA_55161.pep
PKGKNVSRWLALLVMGPNDNSLPRNIVPDIQGQDFFLLWNPPHYFFRPKQDWYHGQKFFQKNFFAPLKITAGYFFCHPNWDPGVSYEQTFFFIQQLFSNLGYLTFHSPG

SEQ ID NO: 160744 - protein, 32 aa, Triticum aestivum; identical to SEQ ID NO: 159903
  Clone ID: PAT_TA_55162.pep

SEQ ID NO: 160745 - protein, 123 aa, Triticum aestivum
  Clone ID: PAT_TA_55163.pep
GGLITQGSPPQKKTLASLLISDGPEKLEQPTGADVYIWVDPFKLGLLDGEHPKQYTRGNKNRWGVLQFKKIKKIFGPGACFFWQKLINRFFLEGDSDQGKSPKEFSLGQLCPNMIKQIGGVRA

SEQ ID NO: 160746 - protein, 82 aa, Triticum aestivum
  Clone ID: PAT_TA_55164.pep
SVFPVAPFFLLGALCPTVFGLFQTVFSSGGAKFPLFLSPFFSTFRGDGCVSKLNFFGAICFWRSPHWFKRGFFFFLASPCPF

SEQ ID NO: 160747 - protein, 74 aa, Triticum aestivum
  Clone ID: PAT_TA_55165.pep
KADPPPRFFFFFSPRGFFSPPPFLPGFFFKPSWVSPYFLGGPGPAKPVGLFKKVPPKKKIGSFGQGPGFGPPVP

SEQ ID NO: 160748 - protein, 68 aa, Triticum aestivum
  Clone ID: PAT_TA_55166.pep
FKYFQAYSLQNQAQVSTIPQVKLLSDSTTTRCDRLVITSRARIKLWGVKLEVYKYPLKKVCSTITHNA

SEQ ID NO: 160749 - protein, 154 aa, Triticum aestivum
  unsure (1)..(154): unsure at all Xaa locations
  Clone ID: PAT_TA_55167.pep
ARWAPPGGXKPRRETPLGKVFPPGKGPPKVGPKAPNAPKKYFFFFFQKGPPRGGPPPVYFFFPRGKKKNPPFFFFKKKRGRPPNKLLVMGCGSPPPTKKKNYFSPPPRYFFFFFFFWFGGGRPPPPQKGRGGGGGGCPSPLFFFFFLILMGWGG

SEQ ID NO: 160750 - protein, 195 aa, Triticum aestivum
  unsure (1)..(195): unsure at all Xaa locations
  Clone ID: PAT_TA_55168.pep
PTRPELAMQGLDPLTTAGLFAEARCVGEKKVNGEDCFILKLSADPQTLKLRSEGPAEIIRHVLFGYFSQRTGLIVHIEDSHLTRIQPHSGGDAVYWETTISSCLEDYRAVEGIMIAHAGRSAVTLFRFGEAAMSHTKTRMEEAWSIEEVAFNVPGLSVDCFIPPADIRSGSVGEACELPXHXDRAKSTGVHPARV

SEQ ID NO: 160751 - protein, 62 aa, Triticum aestivum
  Clone ID: PAT_TA_55169.pep
PGTPQKDQATTFICTIKGVLTKNRRIDPEPFFKKREQVEGNTKGNTPEGNFWELKVFGLWDL

SEQ ID NO: 160752 - protein, 71 aa, Triticum aestivum
  Clone ID: PAT_TA_55170.pep
ASQCVVKLLKALLIRRRAIYLIIYLWRESASSPLTSLRAPYPASVLLLLQVETSFDGKNGRKVYTVFSPPK

SEQ ID NO: 160753 - protein, 98 aa, Triticum aestivum
  Clone ID: PAT_TA_55171.pep
RQGAGGVGAGEGAAGQEGGQGAAEAGGPGGVAPHRHVPLHVGPQRLAARGLVPLIIVTSVRACTWFTCRVVKSNPFKSVQACVHKADVKSTVKKLSIW

SEQ ID NO: 160754 - protein, 57 aa, Triticum aestivum
  unsure (1)..(57): unsure at all Xaa locations
  Clone ID: PAT_TA_55172.pep
KXKVLNEFAAANQHFPCKRLANGSKRVQLSQFPQEQLPEAKXWIGFKRSECIVHLDS

SEQ ID NO: 160755 - protein, 78 aa, Triticum aestivum
  unsure (1)..(78): unsure at all Xaa locations
  Clone ID: PAT_TA_55173.pep
TLAVHTLSXSNPCCSLCHCQVVSNVSVVSEVATPSAIRSCDRDAHGQAQGWELRAATSSLNRIDATPTCTSVQLLRYQ

SEQ ID NO: 160756 - protein, 78 aa, Triticum aestivum
  Clone ID: PAT_TA_55174.pep
GKKQTDQAFHSFAPKQPTKAREIEQLQYIIQPKTNFSLGKNWTQGLEAHFMQTRLDNATQTPTPWHGFAPTILQTRSK

SEQ ID NO: 160757 - protein, 74 aa, Triticum aestivum
  unsure (1)..(74): unsure at all Xaa locations
  Clone ID: PAT_TA_55175.pep
GPYFSLAPPFVLIAQWVLGPLCKLYEKGGRPPIICPLLNPSLLPGPCLSPKKKKKKKKKKKKKKKKKKKKKKXK

SEQ ID NO: 160758 - protein, 91 aa, Triticum aestivum
  unsure (1)..(91): unsure at all Xaa locations
  Clone ID: PAT_TA_55176.pep
GASMLEQIIMVSRQELGETHNIIALLKHQIYFFVVGILLDFYLRRHTIFFLLLHTILLPLGLFSLXCWSFSYSVLPLGVLIKRNCLSPKVL

SEQ ID NO: 160759 - protein, 135 aa, Triticum aestivum
  unsure (1)..(135): unsure at all Xaa locations
  Clone ID: PAT_TA_55177.pep
MIAALECVQXGWAVRVLVGVPQKEGVFHPMNFVKKRAXKGTXGNYKPHTDHRKVVEMYMRKERKLEKFIRHRVPFFQINMAFDLMLKGEGLRWVMRIRSKSPLSRHVSCRLKIWSWKSCRLTRNQSCLSVTFWNH

SEQ ID NO: 160760 - protein, 64 aa, Triticum aestivum
  unsure (1)..(64): unsure at all Xaa locations
  Clone ID: PAT_TA_55178.pep
PKSLSKRNVESAXKDSFYQGPRTLQFFVGKSMHINGGVVFAYYKEGAADPTFLYFAQGLKKVKC

SEQ ID NO: 160761 - protein, 150 aa, Triticum aestivum
  unsure (1)..(150): unsure at all Xaa locations
  Clone ID: PAT_TA_55179.pep
HHQIGCSSLGGFAECILQNTKSRSCTSLHLSMASDMRKCAGGNFQPVPTQPYDATAGSRQICPCXVLLLTRFFPKQLERPSATTPRHSHEGKLTELETQPLRRDSPALAALAESXPPLSPSKEQPIQTNFGCIMGTSGCPSKGEKPLPAI

SEQ ID NO: 160762 - protein, 154 aa, Triticum aestivum
  unsure (1)..(154): unsure at all Xaa locations
  Clone ID: PAT_TA_55180.pep
XXAYDPSHAPPYRKALXXPLXAGAXXFFFYLFIYFFFIFFYFFFFFIFFIFFFFFFFFFFFFFFKKRKNSRENPPPGKKIKRRVDPPPYWDYRGGTLVPEAFLGLIGPPAGPKPFPETKGGPPPPRRGGGGPPPPRGPQRGPPFLFSGKPQPEI

SEQ ID NO: 160763 - protein, 89 aa, Triticum aestivum
  Clone ID: PAT_TA_55181.pep
APPGEAPGVPKRGCRPTLPNSGTSPSVGGLQDIITFGFSDVSPPHFVQLASYLILRATGGGPRGPPGIGAPPFVRAPFMYIYTREISPC

SEQ ID NO: 160764 - protein, 81 aa, Triticum aestivum
  Clone ID: PAT_TA_55182.pep
QVTHAYGRMHTWGKNIFAPTGGAQGTDMGTNTQGPSTEITHASNFILLFNNLVLDGHSINGDIKLHPSASLHARGKGFILN

SEQ ID NO: 160765 - protein, 73 aa, Triticum aestivum
  Clone ID: PAT_TA_55183.pep
DKGFFGFSSFLFFLCREGNRGASSYNIKYFHGMTKEAIHSGAFLFLPEGPQYHKYRGVHRKPGGPQFVKNAII

SEQ ID NO: 160766 - protein, 84 aa, Triticum aestivum
  unsure (1)..(84): unsure at all Xaa locations
  Clone ID: PAT_TA_55184.pep
MQGFLIGICLAMYPIHSKDQPLGIWDPRATVVCITXGVVIAYFADHQLPQFVTRNKKLKQVGEPAVPTLKDGLGGYLAHPNFFG

SEQ ID NO: 160767 - protein, 86 aa, Triticum aestivum
  unsure (1)..(86): unsure at all Xaa locations
  Clone ID: PAT_TA_55185.pep
QSLPDHALLKPEGPKAVYPCCTHAVLNPPAIERLLGGILEEVIVTNSILLPKDKCFXSLTVLSMANLVAETIWHVPRARSVSSIFQ

SEQ ID NO: 160768 - protein, 58 aa, Triticum aestivum
  Clone ID: PAT_TA_55186.pep
KNVESATKVSSYQRPRPLKSLVGESIHDDAGVVFAYFKEGAVDPTFLYFAHGLKKVKC

SEQ ID NO: 160769 - protein, 116 aa, Triticum aestivum
  Clone ID: PAT_TA_55187.pep
VHCGVAAINDFASSYMCQSLPFGGVKDSGFGRFAGVEGLRACCLVKAVVEDRWWPYVKTMIPKPIQYPVSENGFAFQQLLVETLYGISVWDRLQSLVNLLKMISEQKSPITRRKSR

SEQ ID NO: 160770 - protein, 113 aa, Triticum aestivum
  unsure (1)..(113): unsure at all Xaa locations
  Clone ID: PAT_TA_55188.pep
AAEGEASDENSGRPRSWTSQSIEVFEQVAEIAKQCLEMASERRPSMREVAEELGGLRRAXLAQHPWGQKSSEETEALLAVGSPPPASNCSEIEFSNAYVSLDDFAYLGVQSPR

SEQ ID NO: 160771 - protein, 59 aa, Triticum aestivum
  Clone ID: PAT_TA_55189.pep
KKGRRDIGFALTFRQGSFPNFTTKQLGQNFRDWNSKHPGQMSEVLNSKPNLHKVQSPLN

SEQ ID NO: 160772 - protein, 117 aa, Triticum aestivum
  Clone ID: PAT_TA_55190.pep
FFFFFRKGNIFGRFFLQRAHGPKRFFGGAQKIWARKGGVSQDPPPLFFLNFVFKTRAKLNLLREKGFFFGPGGGKTFSGPPVFFFSNGGLVGSSGEKNPLRVEKKNPLCWEKKIFLF

SEQ ID NO: 160773 - protein, 79 aa, Triticum aestivum
  Clone ID: PAT_TA_55191.pep
CGDPAVTSVRSKASVASVVACIMPFFLGVSLLCPSMDCFWHKQHYCPSCGKMVAEFKKNDPCIVIDPTNWTEPSFPVPA

SEQ ID NO: 160774 - protein, 159 aa, Triticum aestivum
  unsure (1)..(159): unsure at all Xaa locations
  Clone ID: PAT_TA_55192.pep
FGGVHTPPGPVVGKLKGDXTIPLGFVYLLPHYFFXKNGPPGIFFPQAWVPLPGVIPVPSGGFHFWHIPPLPQIFGGVFFFQFGGGPLGPPWGNPPGPPPNRVALKPFVQPLNKGPVFPPQGNXIFPPPSKWSPYPPPPFXVWKPPQFEFHPVDPFFFLD

SEQ ID NO: 160775 - protein, 68 aa, Triticum aestivum
  Clone ID: PAT_TA_55193.pep
GLSASSDLTTCPRSSGSALFPSTPRAAGSSASPKQSPPASPYIKSPSSFVNSANALGFPFPLFFLICS

SEQ ID NO: 160776 - protein, 73 aa, Triticum aestivum
  Clone ID: PAT_TA_55194.pep
KILVRLGLERGRGQPHPIEEVVRQLRKNHPSLLRQLADLEEHICLYFAAVNRARLFLVHYLDAQSDPNAEVPL

SEQ ID NO: 160777 - protein, 55 aa, Triticum aestivum
  Clone ID: PAT_TA_55195.pep
KNIRELLTGTEKNWVHYNGRLKKQTGKPKGVNRFLQANNKKLQHLLGSNLLKSIT

SEQ ID NO: 160778 - protein, 146 aa, Triticum aestivum
  unsure (1)..(146): unsure at all Xaa locations
  Clone ID: PAT_TA_55196.pep
WPFVLVGQYAPSELLHFKLLGLYPSWVSWTFPIKLXFSVSMALYALVIFNHLFAKELAPHKPLAKFLCIKGIVFFSFWQGCALDVLAGVGVIQSHHFWLDVEHIQEAIQNVLIILEMVIFSVLQQYAYHVAPYSGADKAKFEKKNE

SEQ ID NO: 160779 - protein, 73 aa, Triticum aestivum
  Clone ID: PAT_TA_55197.pep
KGLKLYLFGEICRTLFSSGKTPWGAGLHGPAFLSGKSFFRALFLSVLAHILVDLSPLCISWLKKFYIFLYFWE

SEQ ID NO: 160780 - protein, 68 aa, Triticum aestivum
  Clone ID: PAT_TA_55198.pep
KKMSQTNMPVFFISVKHKTPDQLAGRGRSYNQTTRGQNVMPSAIRSLTGSTRVSARILALNPLVESRF

SEQ ID NO: 160781 - protein, 83 aa, Triticum aestivum
  Clone ID: PAT_TA_55199.pep
MLRIQVHYYIYKHDQEVALLFHLHRSTSELVFLHTFYFTTSSQTLTRPIYLQNCTSHQNNTWHQVSTVPKSCNSHKFQIPGFS

SEQ ID NO: 160782 - protein, 54 aa, Triticum aestivum
  Clone ID: PAT_TA_55200.pep
WLPLPPFSFSRFLSLAILDFCALPPPMVVDSLDEDEETNAFLLRRKFGGEGEKP

SEQ ID NO: 160783 - protein, 207 aa, Triticum aestivum
  Clone ID: PAT_TA_55201.pep
REHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNFKDDPAKEAANFTFQVIIMNHPGQ

SEQ ID NO: 160784 - protein, 202 aa, Triticum aestivum
  Clone ID: PAT_TA_55202.pep
MDACRKEYFEIPWVNVRAKLDPTVVERTVIPHADYLTDAKVVTAKAVGVDDSVVLTSIGRTVGYDFLVIATGRTCTRPQSRPERLEMFHRDKDRIAAASSVLIIGGGPIGVELAAEIIMDSPDKRVTLVHGGPRLLMVMSPRASAKALEWLRSKNVTVLLDQTIDVDLAGTGDGHDGQRDFTTSAGETVSADCHFVCTGRPV

SEQ ID NO: 160785 - protein, 138 aa, Triticum aestivum
  Clone ID: PAT_TA_55203.pep
MAPKAEKKPVAEKAEKTTAGKKTKAEKRPPASKEGGEKKGKKKNKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 160786 - protein, 149 aa, Triticum aestivum
  Clone ID: PAT_TA_55204.pep
AFPPQFVYCCNKLALPRSKVNVNGGPLPMGPPLGPTGARGFSPLFKKKKPRGRDSKFGGVPICIGPGMGPAPVFKRGNPVEELSNGGPTQWPNFLSKDFPKKRGETKPNCSPPQPPKKTPPPKNIFSRQKKVLKNVILWGPKRDVFPVT

SEQ ID NO: 160787 - protein, 135 aa, Triticum aestivum
  unsure (1)..(135): unsure at all Xaa locations
  Clone ID: PAT_TA_55205.pep
IMNPXGASISLTYIASERXNXXXYGGGMSSAKAALESDTRVLAFEAGRKGKIRVNTISAGPLGSRAAKAIGFIEKMIEYSYVNAPLQKELLAEEVGNAAAFLVSPLASAITGSTVYVDNGLNTMALAVDSPTLST

SEQ ID NO: 160788 - protein, 126 aa, Triticum aestivum
  Clone ID: PAT_TA_55206.pep
GEYIDAKGRLVVDEHLRVGRLKNVFAIGDITDVPEAKQGYLAQRHAMVVSRNLRLLLRSAGPEHKLHRYKASKAAITVTLGRRDAVSELPFMSLVGHIPGVVKPRDLYVSRTRRMMGIKGSRNGES

SEQ ID NO: 160789 - protein, 110 aa, Triticum aestivum
  unsure (1)..(110): unsure at all Xaa locations
  Clone ID: PAT_TA_55207.pep
PPGKVKQLQTQMGFKKSEKKGAFLPRGGLFPFPVDRTPSKPLGKGFFLDPGPLLVIGPEKKLNVRGAAILSMQPSQEFFXNPLGEVGTPVKKFFPRAPGVAPQILPMTVQ

SEQ ID NO: 160790 - protein, 124 aa, Triticum aestivum
  Clone ID: PAT_TA_55208.pep
GTKGGPRGPRGPLYPGTGGPQLFPGGPRTNGKKPPGPGFLQRGPPPPDKKSNGALDIFGRGETSPARGTLPLGTTKLPGAPPINPGEKRGRPPLGILAGGKKKKGPPSATMSQNGRGPAGPQTP

SEQ ID NO: 160791 - protein, 150 aa, Triticum aestivum
  Clone ID: PAT_TA_55209.pep
GGRLSGSPPPKPPGVPPQKGPRPPERPGVIFRGPKEIFWAVQREHGWAFDPAQKLFFDPVVPPGGVGGLPSLGTFPLFFFKKKKRPPFFFPPSANGFSSFLPPPLGGSNFFPGKQTPPLNLGFFPGPKIILSLFFPPGTKGFGPPLNFFS

SEQ ID NO: 160792 - protein, 96 aa, Triticum aestivum
  Clone ID: PAT_TA_55210.pep
GKSPPTRWEKKTNGGYKPPPGEPSGPPLNKKKISEKTTPGCLLGPTLPPPKKTTGPHNPWWFAPHFLRTAPKKGGKVYLKKTPPPQGALSGKRFSH

SEQ ID NO: 160793 - protein, 71 aa, Triticum aestivum
  Clone ID: PAT_TA_55211.pep
WGPQDFSNCPPRWVYLGPPGGRWVFRGGPPPPQTGVFSRNRVPSTPPPTEGTPPPPPHFLGQKPPPPFLFF

SEQ ID NO: 160794 - protein, 119 aa, Triticum aestivum
  unsure (1)..(119): unsure at all Xaa locations
  Clone ID: PAT_TA_55212.pep
GKKTKAKKRPPASKEGGEKKGKKKPKKSVETSKIYIFKVLKQVHPDIGISSKAMSIMNSFINDIFEKLAGESAKLGRFNKKPPITSREIQTSVRLVLPGELAKHPVFXGTKAVPKFPPS

SEQ ID NO: 160795 - protein, 60 aa, Triticum aestivum
  unsure (1)..(60): unsure at all Xaa locations
  Clone ID: PAT_TA_55213.pep
TSRVRTRXEKKKKRKKKKKKKKKKKKKKKKKKKKKKKKKKKKKKKKKKKKKKKKKKGGPF

SEQ ID NO: 160796 - protein, 169 aa, Triticum aestivum
  unsure (1)..(169): unsure at all Xaa locations
  Clone ID: PAT_TA_55214.pep
PAHLPRSHRAMTKQKPPQSSPPARRRRAEHGRNRPDPAXPTAAAAPQKSPEQGGRAATPPQLAGQATRSAADRPKLQPKPPRHLAGEDAAGGLQDAHQRSRAFLHRPRQPPPADPRSDRDRTGPTTTTSRTATVHPPPRPDAATHAEDRLRRKQGRCPGAEHRTAATRT

SEQ ID NO: 160797 - protein, 186 aa, Triticum aestivum
  Clone ID: PAT_TA_55215.pep
SGFYMAWNIGANDVANAMGTSVGSGALTLRQAVLTAAVLEFSGAFLMGTHVTSTMQKGILVTSVFQGNDSLLFAGLLSSLAAAGTWLQVASSYGWPVSTTHCIVGAMVGFGLVYGGVNAVFWSSLARVSSSWLISPLMGAAVSFLVYKCIRRFVYSAPNPGQAAAASAPIAVFTGVTAISFAAFPL

SEQ ID NO: 160798 - protein, 45 aa, Triticum aestivum
  Clone ID: PAT_TA_55216.pep
SANKLNNIQEMTLNLTETQASVSERASRTEPSKTINPSLLDSNLT

SEQ ID NO: 160799 - protein, 158 aa, Triticum aestivum
  Clone ID: PAT_TA_55217.pep
SAMGRYPDKALSVLSSVSLRIERWWREEKHHEPLELEDVSSSFADKISEEICISAAKMANKLEVDAVFVYTKGGHMASLLSRCRPDCPIFAFTNSTSMRRRLNLQWGLIPFRLTFSDDMESNLNRTFSLLKARGMIKPGDLVIALSDMLQSIQVMNVP

SEQ ID NO: 160800 - protein, 141 aa, Triticum aestivum
  unsure (1)..(141): unsure at all Xaa locations
  Clone ID: PAT_TA_55218.pep
RFEDDLXAEALGKRRIINAKKSNMSRGVPRKPSVPPSRLARRQEYSESEREESEYETEGEDIEHSPTGGREELDEEDEYEEDPEPMSDEGIQEPKRKRESAVGGSQRRREVDSDEDSPPRKQPATVHRRKGVVFESDDEDE

SEQ ID NO: 160801 - protein, 162 aa, Triticum aestivum
  Clone ID: PAT_TA_55219.pep
RRRKVSPTARVFARFLLFEGYSTNGGAPNKVGSPREPHPPQVVPRKHPMQGPSPAGAPVFQGPSPEGFYFITAPGGGGHGGFWFFKDYKGSCVFLNGPRRGLIFSPGGFCSFSVFYPLCPFAFLFSLKIHPSKAFFQGGALFPFSCGAPPGCVPQKNPHFFL

SEQ ID NO: 160802 - protein, 140 aa, Triticum aestivum
  unsure (1)..(140): unsure at all Xaa locations
  Clone ID: PAT_TA_55220.pep
LICTTTLWLLRPLLSSARQPNLPPPRPCSETLGALPLCQRMPLTQVHKRGAISRSIDIGRFSEYGELNQALAHMFGMEGRLEDRQSMGWKCIXQDYEGDFLFVGDDPWEEFVIIVKSIWILSPQEVLQPMFPGGDLTSRL

SEQ ID NO: 160803 - protein, 103 aa, Triticum aestivum
  Clone ID: PAT_TA_55221.pep
PAHFFFPGGGTPGNGKKPEGFPIFLVPKKRGQNLGGKIFENKKNQGVKNRLKFLIKKTGGERGGPPKKKKGENPGGFFWGGGGEKTPPGKKKKNRGAPESPQL

SEQ ID NO: 160804 - protein, 118 aa, Triticum aestivum
  Clone ID: PAT_TA_55222.pep
GEELFSVCSPLILGQSIFFYGDGGVAIPPPKQFHADVQDRLHCPPLSVVGLPGDLTHPSKPASLPITLGFGLQPFFSCFLLPPVMMRCCSPFCLFLSRVFLFPFHKGFVFLKNFFSFP

SEQ ID NO: 160805 - protein, 94 aa, Triticum aestivum
  Clone ID: PAT_TA_55223.pep
DEATASHDTIEDATAATQDTLDRSGSGYPGHCVRGRSYPRLRGRRCRVYPRGGGGRSYPGHRGGGGGGYPGHGGGGGGTGCQWSCCGHGYHGCR

SEQ ID NO: 160806 - protein, 155 aa, Triticum aestivum
  unsure (1)..(155): unsure at all Xaa locations
  Clone ID: PAT_TA_55224.pep
PKRQAQSAERGDPWPVSRKWFSLLHKDRRVACSPPKSLGTVMRSFGQDPLDAXELHDMIKEVNADGQDQLGFAXVLNLMARKKNVTGSQEELTEELRVLHKDQSRVIYARELRQVMTNLGEKSCEEELVEMVPEDDGDGDGQINYDKLIKAIMAQ

SEQ ID NO: 160807 - protein, 78 aa, Triticum aestivum
  Clone ID: PAT_TA_55225.pep
RITRSVPCFEEHQERWAVYHVPARFSPKQSNNIKVLAGYTISKILEMVSNSDGSSSSYLCFRGSSKFTTSLIRGWVFN

SEQ ID NO: 160808 - protein, 119 aa, Triticum aestivum
  unsure (1)..(119): unsure at all Xaa locations
  Clone ID: PAT_TA_55226.pep
MSRCGSNCGCGSGCXCGNGCRGCKMYPEMDEGCXTHAFQTLIMGSEPPTKAPQSLEAACDNRWCKCGPNCTCNPCTCKRSMRPQSNHIKEIAWIDLMNERVVLMHESKACVIVLNCHPK

SEQ ID NO: 160809 - protein, 178 aa, Triticum aestivum
  unsure (1)..(178): unsure at all Xaa locations
  Clone ID: PAT_TA_55227.pep
MAKAAAAGTREEMVYMAKLAEQAERYEEMVEFMEKAAAAIDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPXDEQ

SEQ ID NO: 160810 - protein, 184 aa, Triticum aestivum
  unsure (1)..(184): unsure at all Xaa locations
  Clone ID: PAT_TA_55228.pep
LIQSSPPPISPGNLRSKQSQGSLVLLLKMQIFVKTLTGKTITLEVESSDTIDNVKAKIQDKEGIPPDQQRLIFAGKQLEDGRTLADYNIQKESTLHLVLKLRGGMQIFVKTLTGKTITLEVESSDTIDIVKAKIQDKEGIPPDQQRXLIFAGKQLEDGRTLADYNIQKGCTLHLVLKLRGGMQI

SEQ ID NO: 160811 - protein, 120 aa, Triticum aestivum
  Clone ID: PAT_TA_55229.pep
SSTGGSRLLLAPPGVLLRGVQPLVVVVVVSCLGSLQVGGSRLPLAPVSWARAPVHRAPLPPHRQPVPSGQAGGCSRVGAPVLLLLVSPLHRAFASVAPGLLPAPCSGDPPPTQGQAVRMG

SEQ ID NO: 160812 - protein, 85 aa, Triticum aestivum
  unsure (1)..(85): unsure at all Xaa locations
  Clone ID: PAT_TA_55230.pep
EEXXKTEXSXXSGQKKNPGKXXRXXXXXXQGGGGGNXKSKRXXHNRXKPAKXXXTAXDRKQHKKDXXXEXAKKRRRTTKKPGRRA

SEQ ID NO: 160813 - protein, 103 aa, Triticum aestivum
  Clone ID: PAT_TA_55231.pep
ALGHLIVGEWDSPHRLNFPTVPEPQGVVRRRTGNRPCSSTSTFCVLDKGLICFFSLADITSCYFLPREEVFPSSSYNIWSQRRACISKSSSGTTSSSRSFGPN

SEQ ID NO: 160814 - protein, 167 aa, Triticum aestivum
  Clone ID: PAT_TA_55232.pep
GGQTHHPGPKKKKRGWVNKQTKGGARPPQTRGGQKLFFLEKEKSLKPKINGWLPKFMQKPFLPGCMPPQKNLNHLNKTGKIHPRGPPPLKKEFSGKLNGPRHFGDRAPPGAQTFVNLAHLKNKNGGPWGHPPSLFPPLNPPCPPGFVYLKNLKDHLDNPQGETKDLW

SEQ ID NO: 160815 - protein, 197 aa, Triticum aestivum
  unsure (1)..(197): unsure at all Xaa locations
  Clone ID: PAT_TA_55233.pep
MALMLSPAATFLPVATGKPTATAGAMRSLLFTTTSGTASGHRSSRKVVAMADILGDFGARDPFPEEIASNFGEKTLGNVDTLHRILIPTLSVLSLSRVPLEAHPAPLSEEDARRLLFKVVGWRLLFPGKGDSDVLKLECVWKVRDQACGDELIARIGKALDGAGHAXXALLXEPPXQVRAQLCTPSVGGLSANDFII

SEQ ID NO: 160816 - protein, 64 aa, Triticum aestivum
  unsure (1)..(64): unsure at all Xaa locations
  Clone ID: PAT_TA_55234.pep
VGSNEQGIAQGCISGISSFASILAPLIFTPLTAWFLSETTPVXFKGFSIMVAGFCTLTAFGHQH

SEQ ID NO: 160817 - protein, 35 aa, Triticum aestivum
  Clone ID: PAT_TA_55235.pep
PTGPGWCCQFSKPAVNKDFGPLFRPVMTKKKWALC

SEQ ID NO: 160818 - protein, 38 aa, Triticum aestivum
  Clone ID: PAT_TA_55236.pep
PHSPETLKCNLVMCFSFDSGRSDTVATTVTMHSLFFFI

SEQ ID NO: 160819 - protein, 95 aa, Triticum aestivum
  Clone ID: PAT_TA_55237.pep
PPTMKDFIPIKLSRVWAGYPFGIITKKLPAQKSSSMVAKKLGEKILWFQELFEEAHHFTSREPPKGTPWQKNFGGFTHFNPGKNFTLFMVGCPWV

SEQ ID NO: 160820 - protein, 68 aa, Triticum aestivum
  Clone ID: PAT_TA_55238.pep
YGSSASAVSLLVRLGHVSAPAFSHVVSPPIWCQVFSFQDLYKNVLRLIWYSTPCYQDRLMNLAPCRPC

SEQ ID NO: 160821 - protein, 81 aa, Triticum aestivum
  Clone ID: PAT_TA_55239.pep
IKDSMYLLIQMENRSSTHGLILHIERYCMPVHIPIEMLAKPHLSGGQSILSQRRIMGLHTCLCETMALLCDFLQDWHHPRH

SEQ ID NO: 160822 - protein, 150 aa, Triticum aestivum
  unsure (1)..(150): unsure at all Xaa locations
  Clone ID: PAT_TA_55240.pep
MARKMLKDGEAPLVADDGGTYDYDLFVIGAGSGGVRGSRTAAGFGAKVAICELPFHPISSEWLGGHGGTCVIRGCVPKKILVYGASFRGEFDDAKQFGWEINGDINYHWKKVLENKTQEIVRLNGGCKRILGGSGVTMIEGAGXIVDAHT

SEQ ID NO: 160823 - protein, 52 aa, Triticum aestivum
  Clone ID: PAT_TA_55241.pep
LLCCSLRYDLLYLVYSSHLALEDLYAIQFTRCKVFCFLRMFMPMLQPAKYVS

SEQ ID NO: 160824 - protein, 122 aa, Triticum aestivum
  Clone ID: PAT_TA_55242.pep
MAAAAPAAAGTGGQALGRSSFSRAASSKTASSSSSPTASGVKLGPNGAAFVSSGIPDLDRILGGGFLLGSVVMVMEDSDAPHHLLLLRAFMAQGVVHKQPLLFAAPMREPRSFLGALPASGA

SEQ ID NO: 160825 - protein, 71 aa, Triticum aestivum
  Clone ID: PAT_TA_55243.pep
RSPYPAEPIPPPMGVRRPERACRSPSPVEPRPALSTTARAASRAQPASGRASTTSPTRVGCPPTYSGFYPG

SEQ ID NO: 160826 - protein, 142 aa, Triticum aestivum
  unsure (1)..(142): unsure at all Xaa locations
  Clone ID: PAT_TA_55244.pep
MTTTAAAMNVAVTQLCGRGRRRRSAALRHDHRWARLLRLAVATRAERLVWDQLLACSSCGGGGGARYRRLGPSHGPDVLTPLAMDDDAGAHAHADADDDAADVXDVVGLKVSLLGDRQIGKTSLMVXYVGDGEEPNGGLEMT

SEQ ID NO: 160827 - protein, 47 aa, Triticum aestivum
  unsure (1)..(47): unsure at all Xaa locations
  Clone ID: PAT_TA_55245.pep
IRTVFVYFRVNLDGKFFPLYYKKXNDLLTRDLAGNFEGIIHHRSVVS

SEQ ID NO: 160828 - protein, 84 aa, Triticum aestivum
  Clone ID: PAT_TA_55246.pep
KFNIAQYINSRFVAFQVFNKIRSNPGWIRPHNIIRPRSNKRSPPRDQKLTPPVSKKKKKKKKKKKKKKKKGRPHASADAWADAW

SEQ ID NO: 160829 - protein, 260 aa, Triticum aestivum
  unsure (1)..(260): unsure at all Xaa locations
  Clone ID: PAT_TA_55247.pep
LKGMSALTLSALIPYLQPPQCIGSFCPQPALHQYLIYFVGLYMIALGAGGIKPCVSSFGADQFDDTDPVERTKKGAFFNWFYFSINIGSLISGTVLIWVQEKYGYGIGFAIPTFFIALAIGSFFLGSEVYRFQIPGGSPLTRACQVVVAAIYKRNVDLPVDSSLLYECRGKRSAIEGSRKLEHSSEFSFLDKSAVVLRSECGGFHNPWRLCTVTQIEELKILXRMFPIXQRAFVFFTVCAQXSSMFIEQGMALNNQGGSF

SEQ ID NO: 160830 - protein, 52 aa, Triticum aestivum
  Clone ID: PAT_TA_55248.pep
ASNNRYAYPTFDLTPNGPPNHKRLQRCMGSPGSAGRSDGNHMESVVRVASQL

SEQ ID NO: 160831 - protein, 112 aa, Triticum aestivum
  Clone ID: PAT_TA_55249.pep
GFGIGVVCQIANSYCHILLRNLRSPTGSGGYQIPRGFLFNIVTCANYTTEIYQWLGFNIATQTVAGYVFLAVAAAIMTNWALGKHSRLRKLFDGKDGRPKYPRRWVILPPFL

SEQ ID NO: 160832 - protein, 97 aa, Triticum aestivum
  Clone ID: PAT_TA_55250.pep
TEEFLSAVLVNKQCERSDQAARGKHTRYRKAKLNITGGRSEFQDQLQHHHCRHGGARGPSHRSVAPETPGIRRQSLLCSLSECWKHLTRTTHIEGYG

SEQ ID NO: 160833 - protein, 46 aa, Triticum aestivum
  Clone ID: PAT_TA_55251.pep
FWPPPPPRGAPVPPPPLWGLQPFPRAFLPPPPRHCMSAPSPVGALI

SEQ ID NO: 160834 - protein, 101 aa, Triticum aestivum
  Clone ID: PAT_TA_55252.pep
GGKGAPPIFFLLALGPNRAWANKKTEKPWDLIFHRGKHEPPKKTWGKPLLEKKKNIAQVGAKLPLLGKRLGGENPKPQTGDIFFLQNPFAKTGLPFCGRFF

SEQ ID NO: 160835 - protein, 128 aa, Triticum aestivum
  unsure (1)..(128): unsure at all Xaa locations
  Clone ID: PAT_TA_55253.pep
ANYIPSLPXPGNKVSLKFVLRAYNPSGRATLEYANVAVRLTDESSSSSSAEAPTARIAEFDLPKPIDVTHQTLSEVLVPLWLVPEEDLPMRYVRALYEGRGVAGAEMELRGILSTHVAMSTTSVLTTY

SEQ ID NO: 160836 - protein, 109 aa, Triticum aestivum
  Clone ID: PAT_TA_55254.pep
FFFFFFFFFFFFFFFFFFFFFFFFFFFFFFFFFFFFWVPRGKAGALLVVKNKREPGGQKRVKPKKKGGPVGLKPTQRAGPNEKTGKKKEGGPPTGRPRENQGGQRRENY

SEQ ID NO: 160837 - protein, 35 aa, Triticum aestivum
  Clone ID: PAT_TA_55255.pep
IRDAVNVCHDPGMWAQKRYIIALSMIIKKKKRGAA

SEQ ID NO: 160838 - protein, 59 aa, Triticum aestivum
  unsure (1)..(59): unsure at all Xaa locations
  Clone ID: PAT_TA_55256.pep
CNYAYKNVVQNIALGDIYCFTPYPVVXENKLFQAGVKQVMILCRIFVKKKADGIRLYVQ

SEQ ID NO: 160839 - protein, 104 aa, Triticum aestivum
  Clone ID: PAT_TA_55257.pep
QGKTPRGDRVFVPLKPGTTARRVNRQAGGRASCYLMAVSGQASGPGSGSRPPVFFAGGIFVSCVCVKVYYQCPICVCAIKWGGVGMGTQPPFAVSQSVRGVSSK

SEQ ID NO: 160840 - protein, 49 aa, Triticum aestivum
  Clone ID: PAT_TA_55258.pep
SANHVNGLYSVFLYLSDNYGFCLSCTPYISMVLMPGFCSLKKEVRKLNN

SEQ ID NO: 160841 - protein, 85 aa, Triticum aestivum
  unsure (1)..(85): unsure at all Xaa locations
  Clone ID: PAT_TA_55259.pep
LSFYAPGWCEKVRYFFFTANGKVPVVFRVPIXGINGEVFWEPLGTASFSDAGLEAPVGVPKKAAFFKACPRLGFGLYLSHKNKAF

SEQ ID NO: 160842 - protein, 51 aa, Triticum aestivum
  Clone ID: PAT_TA_55260.pep
DPYLIICASSLDLLGRGPLQCREAHEYRDTLNEPHDPWKLAQKEYKNAFPR

SEQ ID NO: 160843 - protein, 84 aa, Triticum aestivum
  Clone ID: PAT_TA_55261.pep
KFNIAQYINSRSVASQVSNKIRSNPGSIRPHNIIRHRSDKRSPPRDQELNHQDSKKKKKKKKKKKKKKKKGGPHASADAWADAW

SEQ ID NO: 160844 - protein, 144 aa, Triticum aestivum
  Clone ID: PAT_TA_55262.pep
PPPFSSPSRPPPPPGGSPPGPPPRGLSPPAKTPGFPPGSAGGGSNPLPGRGAIPFPSNFAPAAGGSPRGSPGGAAPPFDELMVPGLWPYRVPPGPGFPCFFFPGGPGPPIVFFVPPPFPSINRAPFFFSFLFSGALPFSPPSLF

SEQ ID NO: 160845 - protein, 92 aa, Triticum aestivum
  Clone ID: PAT_TA_55263.pep
KWVPCLEFSKVGFVFREHNSSPGYYDGRYWTMWKLPMFGCPDPTQVLNEVEEVKKEYPHAYVRVIGFDNMRQVQWVSFIAFRPPGCEEFGKA

SEQ ID NO: 160846 - protein, 135 aa, Triticum aestivum
  Clone ID: PAT_TA_55264.pep
SWGPGVELRPPLFLWVFPPFPTPFLAKWGPRKPMVFARVFFFPPGFFPLGGQLFSLGRGFSFSFFSRKWSGGFPVFPSVFFPGYGRLGFLLKLIFGLDCNFFFLERAPLLSFRGFAVVFFSFESGFELCPITFGN

SEQ ID NO: 160847 - protein, 158 aa, Triticum aestivum
  unsure (1)..(158): unsure at all Xaa locations
  Clone ID: PAT_TA_55265.pep
VHQKVPVSMSIFWQGPRDLLIGVGEVFTSIGQGEFFFNQFPDSIKSLWLAFALVTVLLGSYFRLFKLTLGWYFSTRGEQMGWISYNLNXGPLGRFFWVIGGPSSLNFFAFVYFGQQDKGKKGFVLLCFPLCLVLCKKLCGYFFYEQANNGQGSMDSFL

SEQ ID NO: 160848 - protein, 114 aa, Triticum aestivum
  Clone ID: PAT_TA_55266.pep
GKKGPPQFFGGDQGYKKNFPQQKGETGPTSPPLPFPRGEFSLAPEGFPFGGGTPSFPTKTNRGGGLNQATTGNFGGFGEKFKHPAKKQGNPSGGGLPPTMGEGTPRAKKGGEKI

SEQ ID NO: 160849 - protein, 41 aa, Triticum aestivum
  Clone ID: PAT_TA_55267.pep
LYRQSHSNHYPYGSIMLYVNTKRALKLLRSYEPMILYVLRA

SEQ ID NO: 160850 - protein, 103 aa, Triticum aestivum
  unsure (1)..(103): unsure at all Xaa locations
  Clone ID: PAT_TA_55268.pep
SGMTSTMXSLKINECQHPFSLSNIANILDISXKLESRHVVPPKKFVEALKLMEHRYGAKDFVTSQDTRLLVPGTYYLTLVDSMYRRFYAVKGDAAATPVTNGH

SEQ ID NO: 160851 - protein, 77 aa, Triticum aestivum
  Clone ID: PAT_TA_55269.pep
RCSPRRSLSLAVGEAFYVQMYPYLKFLAGSVGPTSPARAPKVKREYLAFLEPKTVFPDKACNVFGGEFCEAPSQPPK

SEQ ID NO: 160852 - protein, 51 aa, Triticum aestivum
  Clone ID: PAT_TA_55270.pep
ITLLLSGLPPRPKVPRSKPCCFHLYMALLWGLEGCPPYISSGLRKTWVLKG

SEQ ID NO: 160853 - protein, 112 aa, Triticum aestivum
  Clone ID: PAT_TA_55271.pep
ALRSPGCNKLRGSPCALRCRVAGAAMSPRGGAAQWSSWASPCVLRSGCRGAMSFVGCIKLPVRVSDGKLVPGELRGACVEPELFERITGGWSKSGNSREIKPPNQANLGWQR

SEQ ID NO: 160854 - protein, 80 aa, Triticum aestivum
  Clone ID: PAT_TA_55272.pep
GGELDYLSMICSTGAGHQGDGIQLLTLAKTKAFGGGRPKGPTHGNAKKPYNHAGKKLRNNEAAGSNLKYSVRGPVGGPVG

SEQ ID NO: 160855 - protein, 81 aa, Triticum aestivum
  Clone ID: PAT_TA_55273.pep
FRRVQKRGGLWPKGNENQLIAKGIQGVGVKKNKGLWPGKAKKTPHLQGAFFLKKAQLGVHGFGGSLKEKNILPCQKSFYPP

SEQ ID NO: 160856 - protein, 82 aa, Triticum aestivum
  unsure (1)..(82): unsure at all Xaa locations
  Clone ID: PAT_TA_55274.pep
MAVPGIGTQIVQCFRHNREYMNWSGDKRMAGVFKDNTKSSCSQWFCISVKVSRPLGNGGVVRPKFTCNLAAKTMGXKVRIFM

SEQ ID NO: 160857 - protein, 76 aa, Triticum aestivum
  Clone ID: PAT_TA_55275.pep
DKLGGAFAPNPSSGPLKPRECLPLILILRSRVGYALGSGQVQSILIQRHSRCGVGLSKPKTHQAGLLSFVSIFLRV

SEQ ID NO: 160858 - protein, 125 aa, Triticum aestivum
  Clone ID: PAT_TA_55276.pep
AGDVISKLDDFALSNAQEFHELILDKAESALRHGEGMHFTVSVLRPGSGFQFCATISAEVINTSEQNMSNQNKSKENRWPVPKTKWLYPDDVRDADMMPLVRKCRRPGYIYEAPLTTDVSRYTRL

SEQ ID NO: 160859 - protein, 100 aa, Triticum aestivum
  Clone ID: PAT_TA_55277.pep
MSRGGSAGGGQSSLGYLFGDGEPAKPAAAPAAKPAPAEKPALAAADVTKQIPAGIPGSRANNYYRADGQNTGNFLTDRPSTKVHAAPGGGSSLGYLFGGK

SEQ ID NO: 160860 - protein, 101 aa, Triticum aestivum
  Clone ID: PAT_TA_55278.pep
PPTGEGKKVAVRVRAADIPLALQRRAIWIAREVVLFTPRLESKRLALALKKEFDPTYGPAWPCIVGPSFGSYVPPSLGGFLYFSVDKGDIFFFRTAVEPLS

SEQ ID NO: 160861 - protein, 46 aa, Triticum aestivum
  Clone ID: PAT_TA_55279.pep
MSSSRSLRVFEERLHQSLGPDEAWTGILQRSHILIIASSSVLAVHT

SEQ ID NO: 160862 - protein, 62 aa, Triticum aestivum
  Clone ID: PAT_TA_55280.pep
EQFQKQMPGGEAGGASIGFAQDDDDEVPKLVPGKPFEEAAEEKKEPEAKKEADPEEKKKLLW

SEQ ID NO: 160863 - protein, 127 aa, Triticum aestivum
  Clone ID: PAT_TA_55281.pep
PKKFGEAFPKEPAKDWKGLRVPVKLPVQIPQAKVSVVPSPAALVIKGFKEPQRAPKKVKNFKPKGNFTLEEVFEFPKFIKVPSMAKEMAGPVKEILGPWVRVGCPVAGKDPKVFQPEFAAGGVEIPP

SEQ ID NO: 160864 - protein, 83 aa, Triticum aestivum
  Clone ID: PAT_TA_55282.pep
FDFSGTYLAVAGSDIRVYQVANVKTEWNLIKTLPDLSGTGKVPSAKFGTDAKYIAVGFMDRNLRIFGLPGDDQMDDDAKPSAE

SEQ ID NO: 160865 - protein, 55 aa, Triticum aestivum
  unsure (1)..(55): unsure at all Xaa locations
  Clone ID: PAT_TA_55283.pep
MQDFGKTPVPDLEWRIHDFSSLLXTGAKAATFAPFSCFGENWQLQVISMHKKTGF

SEQ ID NO: 160866 - protein, 66 aa, Triticum aestivum
  Clone ID: PAT_TA_55284.pep
PASAWTAPSFGMSPSLFSTHGEPPAPSIKIPPPSFPVWDYSRSDSLWGIGPPQFEYKKMFPLPGAS

SEQ ID NO: 160867 - protein, 100 aa, Triticum aestivum
  Clone ID: PAT_TA_55285.pep
SSRPARFFSLKRGREPVSHYCKLALPLGPPAFAPLPFGPLGFWNFYRRPVFSRGTVMALFFPPFYTLSHEENRFPFGSRYGISGGLPGPGSKYNRKTQGS

SEQ ID NO: 160868 - protein, 93 aa, Triticum aestivum
  Clone ID: PAT_TA_55286.pep
KTPMGGAGSGGFPPTRRAVFYSSGSSTYPKTRGRRRIRYALPCFCVGWNFELVEPFFGKVFMFIFPPVFLIWARPPCEGCLKNPPKELSVFVP

SEQ ID NO: 160869 - protein, 54 aa, Triticum aestivum
  Clone ID: PAT_TA_55287.pep
DSLWGIGPPKVKYKKMFPVPGASYFFSYPTNLLLANYYFPTNLKSLRACVQGIS

SEQ ID NO: 160870 - protein, 80 aa, Triticum aestivum
  Clone ID: PAT_TA_55288.pep
APPHQGFQGRQCKRRGPGLLEGVLRPSPILVPPFVGALPKGVDSPRSRPSPMVRRLAPPKGWVVPPPSVMPNESKGKFLD

SEQ ID NO: 160871 - protein, 89 aa, Triticum aestivum
  unsure (1)..(89): unsure at all Xaa locations
  Clone ID: PAT_TA_55289.pep
KGAVDGFPINESGPSPKAPQVFQFILWGPKVLEILAGEHFPPGNGYGQKFPHLKNDPPKEKQVLFQVPVGKSGGPPAGRSEIYREKPRX

SEQ ID NO: 160872 - protein, 83 aa, Triticum aestivum
  Clone ID: PAT_TA_55290.pep
RIKVSGGKAGNLGDSVPFGPDKKKVPAPSDGAFSKRFLKFLTKKFLKKPNGGGWPRVISSPKEARVFELRYFNISEKEGEEED

SEQ ID NO: 160873 - protein, 60 aa, Triticum aestivum
  Clone ID: PAT_TA_55291.pep
HGYSLVASRACLSGYIFVSMEGYRLVNHIFVWTSSCARVGTSFLAWVVGKILCGQSLTCG

SEQ ID NO: 160874 - protein, 55 aa, Triticum aestivum
  Clone ID: PAT_TA_55292.pep
APLPLPCGVRGPSLSKTGPSVFFAVSSGPVRKMLGAPCSGVIKPQGPLGPVFFSH

SEQ ID NO: 160875 - protein, 41 aa, Triticum aestivum
  Clone ID: PAT_TA_55293.pep
KHSIFLLLLMLVNHRISFLVSKNVSHYGAEGVVIFPAVFIL

SEQ ID NO: 160876 - protein, 89 aa, Triticum aestivum
  Clone ID: PAT_TA_55294.pep
CWCGSEPAPSGVYHKVSRGPGAERGTPWGQGGAPRGRGHTPPPPGAPPPGGAPTGGPIRFGGAGPGKGENHRPRGRGTGENSRGGGWGP

SEQ ID NO: 160877 - protein, 51 aa, Triticum aestivum
  Clone ID: PAT_TA_55295.pep
KNFPKRVFVPHPVKKGNVYPVGPIGLGFLVFGGGGASLFQIIRTPSNPGFF

SEQ ID NO: 160878 - protein, 97 aa, Triticum aestivum
  Clone ID: PAT_TA_55296.pep
KRGALGPPLRRGVLKTNLFLKKSPPSSKKMTFWAPPPSDSKGGEVISFFNAGRGVKGSLFWEKPEGEPFFRGGGKIFPPNPMDLYDWCPPFCWEAVQ

SEQ ID NO: 160879 - protein, 67 aa, Triticum aestivum
  Clone ID: PAT_TA_55297.pep
SQQVFFKKTCCLIYNSRRSKKYLPRWVFLVPISSQWTPTGTLPYPRVVWGGAPPPGGSNLSEAKNKN

SEQ ID NO: 160880 - protein, 102 aa, Triticum aestivum
  unsure (1)..(102): unsure at all Xaa locations
  Clone ID: PAT_TA_55298.pep
KNRGFPPVGFLKGALREASKGGGFFGGNGVGFFNVSLEGVLFXKKVTKAFFVSKIFYPPKTPFLAEWGEGFFXLNAAKAPLPEVGRFFYFSKAQKAPPSGSK

SEQ ID NO: 160881 - protein, 63 aa, Triticum aestivum
  Clone ID: PAT_TA_55299.pep
GNKKRVQRDPGAGLTLNMKPTVFYRRPQNYRERTRWPLFFKRGPLHPVKKSNGALDIFWTGET

SEQ ID NO: 160882 - protein, 66 aa, Triticum aestivum
  Clone ID: PAT_TA_55300.pep
CPECQLKNEPMNCIVFCNISLYMVLVAFCFCNYKFTFMGIIESFLFPQGAVAVPFDSKDKELITKG

SEQ ID NO: 160883 - protein, 161 aa, Triticum aestivum
  Clone ID: PAT_TA_55301.pep
SGGSPRHRTLWELAGLALGAPPLLYFFITGPGSGGSINPPRTVGPAFIRNGARSILGFLVGPVAGTLARGGGVNLFRFSPKALGGVPQSPPFLRGLGRVDPVPVWFPFPSHGVFFLPGFGIVVLGAPYPRGVGGGPPSPPRGFGPPGPPGVCFFVEKFCFW

SEQ ID NO: 160884 - protein, 80 aa, Triticum aestivum
  Clone ID: PAT_TA_55302.pep
LTMRLAPSMGGDVFPPLPPCPQEWALHSSSKGFGGRALVFPFSAPPCNMALVGRVVPLNKSSFMFAVWSPKNFCRSPRRI

SEQ ID NO: 160885 - protein, 142 aa, Triticum aestivum
  Clone ID: PAT_TA_55303.pep
GKKKGSGPGVQKLDRAGKRTAPRDGGAPPPTSQRAKTTPRGARGGELGTAPPPFWPQIKAPWGGSWRGPPSPTKGRPPDGPRGAAGPTCNPPPPPCPRFWGPPAPAPHGGFFAPPKGGPPGPSGGPPGTPTGGPGGLWDCPP

SEQ ID NO: 160886 - protein, 97 aa, Triticum aestivum
  Clone ID: PAT_TA_55304.pep
PPGPPGPRGPRGPEAPGGLLGCFPPTGGATGPRGRLPGVGPPPGPPQEGHVFGPLGPPINGKNKWPGARPCLGRICNCPPTKIWASSGLYICGRMGP

SEQ ID NO: 160887 - protein, 115 aa, Triticum aestivum
  Clone ID: PAT_TA_55305.pep
EFFPFLKLRMTPPSPSRPFRFPLGPVGSVLMIIPPPILIVGVMGRASFKVRVVSILAVLVGFALHPALVYMEKKRWLRFSVKKDLPVFLDPSAGPPKNKTPPLLVFFFLQSVIKG

SEQ ID NO: 160888 - protein, 108 aa, Triticum aestivum
  Clone ID: PAT_TA_55306.pep
AGYHFPPGTALALVSPRFYLAPFKEKWVALRGRAGISGGAPGVGPGVGSGTFPKKLKFLKTGAPSSNGGGGPSQALGVPPAPFGGGQGFPFKLGVRPGPIFLGGFSPP

SEQ ID NO: 160889 - protein, 98 aa, Triticum aestivum
  Clone ID: PAT_TA_55307.pep
TQKLKEILGFLLGANEGEKNFLGKGGGPEKEKKAGDHISGKKLFGEGGGISKKVGGQHMDSYFFLKQKKNISFPFLKASPGGLCWGGKKSFSTRGGEN

SEQ ID NO: 160890 - protein, 85 aa, Triticum aestivum
  Clone ID: PAT_TA_55308.pep
LVFPPNQVFPYPLTPGEIPAKVGLPFLGPGPWFFPSPFFSFLKGFFKGLFWFSPPLSPKGLSFSPGGFLVLVKRGFWANPPLPFF

SEQ ID NO: 160891 - protein, 105 aa, Triticum aestivum
  unsure (1)..(105): unsure at all Xaa locations
  Clone ID: PAT_TA_55309.pep
TNFANTGPPPRGETNPPRFPFGPREPGGVPGPPFPPSQKKKQGGEWASPTEEGKVERKRGPGKTKQVPXREGAGKPNPGGGGGGGSPKTRGGGGGGAXPPKRGGG

SEQ ID NO: 160892 - protein, 120 aa, Triticum aestivum
  Clone ID: PAT_TA_55310.pep
PPAPGNLSSIQYGFNWDRSEVAPPEEFIGWLRLFYKFMAPLVSKDPPPAYVNYLALDLGVNNWTPPPGGLSPQAVFFSRFFWGEAFFGKNFARLVFFKTVVVSGNVFNNGQSIPPFNLKV

SEQ ID NO: 160893 - protein, 110 aa, Triticum aestivum
  Clone ID: PAT_TA_55311.pep
GDPSRKSHDRRRHAVRKPWIPLCRPPPPPPPPPPPPPPPPPPPPPFTKSPPALDKFFINQFFFFCKEFFLRLNKGANGVFLPSPPEKKTLPPTPRGASFFKPGFSFVLRL

SEQ ID NO: 160894 - protein, 109 aa, Triticum aestivum
  unsure (1)..(109): unsure at all Xaa locations
  Clone ID: PAT_TA_55312.pep
KQKKKPWEKKGPQKIRGEKKKSKKKPGPPGGGARGDQKKGGPRPPPKGPPPKKAGPSPWVNRGGPKVTPKPPGERGPAQRKXNEGEKGPTPNQGKSWGANPKGAGGNPL

SEQ ID NO: 160895 - protein, 107 aa, Triticum aestivum
  Clone ID: PAT_TA_55313.pep
KGPLIFLTFGGPKKLLRVQFYRQGGKRGQKKGGPNGGAKNTPKPRGSRFKRTPSPPKTRVGAGKQKALSKNKTPKKQGSPHFFINRGKKSTGGGWFLRGPQKKVRGH

SEQ ID NO: 160896 - protein, 119 aa, Triticum aestivum
  unsure (1)..(119): unsure at all Xaa locations
  Clone ID: PAT_TA_55314.pep
FLQGGFGLFFSILPRDDVEGLFREFXGNVFARPGSFSPPPVELKEGPLDQFSHEMEPFLGKQGLPVCLNKGVVELVPDPVVCEKGKPLFPKAAPPLGVFGTKMGTFRLSLVSPWLSDAF

SEQ ID NO: 160897 - protein, 89 aa, Triticum aestivum
  unsure (1)..(89): unsure at all Xaa locations
  Clone ID: PAT_TA_55315.pep
GPAALEDMAKQIASASGPXDNRGYLFSMEKALSHISHEDDSILVLSDKVRKVLSRSTKKKVPGSDIPLKLHTPVVPIFAFPEGPVAVSP

SEQ ID NO: 160898 - protein, 122 aa, Triticum aestivum
  Clone ID: PAT_TA_55316.pep
PISKQTVHPTGFPFSPPEHCHAIPRKESTFLPWLSTPTKVKGGFIYPANFSFCPFASGKGPSCDACASASGGIGHILPGSVVFHVALDQMAGCLSRDEGQLASQDRTSHHRGEQPSIRSRGF

SEQ ID NO: 160899 - protein, 154 aa, Triticum aestivum
  unsure (1)..(154): unsure at all Xaa locations
  Clone ID: PAT_TA_55317.pep
MAAFSFAAVSVPSFAAXPMSSSNNRMVVRASLGKKAASAAVAMAPSPIFLGGSAMAQDVLLGANGGXVLVFEPNDFRVKAGETLPFKNNPGAPXNVVFYEDPVPSGVGVSKISPEEFLNAPGETFSVPLPGAGPFGFFFEPPPGAGMVGKVPLH

SEQ ID NO: 160900 - protein, 87 aa, Triticum aestivum
  Clone ID: PAT_TA_55318.pep
IHQLFETTDPLLFGQFNDMINVPFSNKPFVAGLVAYFLDNTMHLHQSAVRKDRGYPWWDKFRSFKKDARSEEFYSLPFNLNKFFPSV

SEQ ID NO: 160901 - protein, 83 aa, Triticum aestivum
  Clone ID: PAT_TA_55319.pep
SHQVRSRPQNDVGSFPKKKKNGDWATYPSGGRALSLCKGRGSLFFRRAKGGRMKSKKCCFLAKKKKKWRWGDVDVKWFTSLVC

SEQ ID NO: 160902 - protein, 92 aa, Triticum aestivum
  unsure (1)..(92): unsure at all Xaa locations
  Clone ID: PAT_TA_55320.pep
RALFFKTVKKKKIGSTKKEYYFLSINPPKQIFKFSSPKKLQQXFPKEPPKWDLKDGRVFFQKGKKSHPSKKIPGGRVINQTLGYPRELKRNG

SEQ ID NO: 160903 - protein, 154 aa, Triticum aestivum
  unsure (1)..(154): unsure at all Xaa locations
  Clone ID: PAT_TA_55321.pep
PRPKKKFKGKRAPPPGSRKKRGEKPPIEKKSRPPGPNNFWGAPKSGKNPGPGATQNPKNPPGPRNRRAPPGPKNPPGGIITGQEPHSRGQKPPGPPKGPGGGGEAGSFXPGGPPGAGTRPPGKKNRKLGGVNPQRGPGELGAGALGQHLPKQVF

SEQ ID NO: 160904 - protein, 107 aa, Triticum aestivum
  unsure (1)..(107): unsure at all Xaa locations
  Clone ID: PAT_TA_55322.pep
RADPVRVVPGGPRPGAPERELXXRRAGAAEDGGNAGRAPRALQVPGAVRPVLRRAPGPRPAASRALQARHLHPRQPPHRLRQDTVSDRPADEPMVRRVHAVWREVMA

SEQ ID NO: 160905 - protein, 75 aa, Triticum aestivum
  Clone ID: PAT_TA_55323.pep
CSCANGLIFDQVVPASGEVPCQWQGLALHAVFATAFRVTSRFFLANMDLRKIHISEGIPHPPGALGSIRVQFVQE

SEQ ID NO: 160906 - protein, 100 aa, Triticum aestivum
  Clone ID: PAT_TA_55324.pep
PRVRASFPVPPRPFVGKREKPRFKKENPFFQPGERFPTWGPPPQDRFLGRFSDALAPPKVSPELRVFWVDFLSQFSKFFGIKVATRFPVKPSLLWMAPFV

SEQ ID NO: 160907 - protein, 143 aa, Triticum aestivum
  unsure (1)..(143): unsure at all Xaa locations
  Clone ID: PAT_TA_55325.pep
KKPPPCLLKGVFSPRKGFPSPPGPHKGGPLFWFSQFKKLFFGGVGPLGVPFSLPGGVFPGQGGLSPLXFRPGGPPPKLNPFFFFKLFFFFFPPFTPGPGSFFTGGGGLFFAPAPTKSFLPLFFRPLWLFFFFWGRNPLGGFLG

SEQ ID NO: 160908 - protein, 120 aa, Triticum aestivum
  unsure (1)..(120): unsure at all Xaa locations
  Clone ID: PAT_TA_55326.pep
SQIVFIDDNVSGLQLQKDGVWYNVPIVPNTLLVNVGDVMEIMSNGFFKSPIHRVVTNVEKERLSLVMFYTMNPEKEIEPLSELVDEKRPRRYRKTTTNXYIAKLFETFARGTLAIDTVKI

SEQ ID NO: 160909 - protein, 149 aa, Triticum aestivum
  Clone ID: PAT_TA_55327.pep
KNPPAEPFSQPRKGSGPTTRTPPPGGPIPLIITTIFICIALSGLSPFLQNLNSGAGPGSGRRGKSKKKQLGNPPRQPLTVKKTGQGPGPVFCPPFFFRARLGTKGGRKKGPKNQARFFRFRAPLTGVGSVLKPELPSNTNFPGGGATVW

SEQ ID NO: 160910 - protein, 96 aa, Triticum aestivum
  unsure (1)..(96): unsure at all Xaa locations
  Clone ID: PAT_TA_55328.pep
RQLPVVAVIHPRXPNVVYFFLDRHLFSVDVPDRRVVQCELYELVEELSSKSIAPRFVHAWRLPPAFRSTADAVAEKLNAGGNQEIIDAAAVSTCQT

SEQ ID NO: 160911 - protein, 30 aa, Triticum aestivum
  Clone ID: PAT_TA_55329.pep
HASAIFNNSPQDFHFMDGPIIFLTMNLACI

SEQ ID NO: 160912 - protein, 61 aa, Triticum aestivum
  Clone ID: PAT_TA_55330.pep
STPGPSPHIKVWQSYASLSRTSPSNLSSRTCVLFHFFFFFSYCICLFLAQLFPHAIQSFFI

SEQ ID NO: 160913 - protein, 105 aa, Triticum aestivum
  Clone ID: PAT_TA_55331.pep
TTEAELNYPSLIVNLLAQPITVNRTVTNVGKPNSVYTAVVDMPRDVSVTVQPPMLRFAEAKEKQSFTVTVRWAGQPSVAGAEGNLKWVSDDHIVRSPIVVPPKAA

SEQ ID NO: 160914 - protein, 151 aa, Triticum aestivum
  unsure (1)..(151): unsure at all Xaa locations
  Clone ID: PAT_TA_55332.pep
IRQSGLQKIMIKCGGSASPQNAGQQKAQXDSKQESEERPQMMLFQILSFEARQMLSRIALVKPDKARGVEDVLLRGXHKLGGISEKVSEERLISLVEQIDSRPSXKPNVTIQRRLHRPCRRCLVGKLYVRKNGCTGIWWFIHQPSEPVRTI

SEQ ID NO: 160915 - protein, 136 aa, Triticum aestivum
  unsure (1)..(136): unsure at all Xaa locations
  Clone ID: PAT_TA_55333.pep
GARAVDGVGXVAWDNNVARFAQDWXAQRAGDCRLQHXGGPFGENIFWGSGQSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 160916 - protein, 53 aa, Triticum aestivum
  Clone ID: PAT_TA_55334.pep
ELLQKYPAPETQLPRIQLTDPVARYSGIKRGQVVKIPRQSEVAGEYVTSRYVM

SEQ ID NO: 160917 - protein, 159 aa, Triticum aestivum
  Clone ID: PAT_TA_55335.pep
TDGEGWAIHLYFDMTTPPLMWLSCVNVGRKGTNKILEEEEWLVILVVFLDGRNQPKYCAWNTMDTLVKVVHLVIVHSGCCYNDFSVEHLAVLVDILVNLSLCDRGSDIYSLRSELLVAAELSAGRNQLRQCSSRSMPSRYPATVFCRRGCSMMPVFASD

SEQ ID NO: 160918 - protein, 91 aa, Triticum aestivum
  Clone ID: PAT_TA_55336.pep
PPKKKKGGPPKQPHRKKGEPPSPGKGGENPMAGEKSLEAGGEWEKWPLGPFAPPGPGGLAPETGPFFLVAGGPQRPPFALGQKNPPEPGGH

SEQ ID NO: 160919 - protein, 63 aa, Triticum aestivum
  unsure (1)..(63): unsure at all Xaa locations
  Clone ID: PAT_TA_55337.pep
FEDGFVSLLPDNGNPKNALKLPTDETPLGQIKDGFFXRKDLVVFFLSPLGEEQINALKDLGPK

SEQ ID NO: 160920 - protein, 44 aa, Triticum aestivum
  Clone ID: PAT_TA_55338.pep
SGHRMGLKFRRHTPHRSKNQHFTKNSKKKSATPLENCHRKADPG

SEQ ID NO: 160921 - protein, 76 aa, Triticum aestivum
  Clone ID: PAT_TA_55339.pep
KGSLSYRTPCSVCSLRLIEYNCMPCIMQAVISNTRPKFYSTRQSSTIRVEANLRLQMHAKSMCIFSPYAPRVRGRV

SEQ ID NO: 160922 - protein, 115 aa, Triticum aestivum
  Clone ID: PAT_TA_55340.pep
PCLARGQGVSPSFPLCRGRPFPRGSKEVKDGVLSLSLPFPPPLPRPQRGLAPFTGSFSPPPFPLVAFNFSPPHDTPFFYFPSLMPIPQNTNDPLFGVGQTPLCSPFSVFFFQTPM

SEQ ID NO: 160923 - protein, 153 aa, Triticum aestivum
  unsure (1)..(153): unsure at all Xaa locations
  Clone ID: PAT_TA_55341.pep
GLRVLLEYIREWNTKPXFCHVAQFVLFRVLRSLPPTDILEIKGISELLEGLIPYSQRHFSRVDRLVRSTFLLDYTLTRMSVVDPDVDAGTTKDVTNDSSMDNVEIAPTEPALETLEKPGKKRKSSKTSQSSKKSSKKVKASSNGDSKAVSVEV

SEQ ID NO: 160924 - protein, 159 aa, Triticum aestivum
  unsure (1)..(159): unsure at all Xaa locations
  Clone ID: PAT_TA_55342.pep
MGKPTKTNGSPGPPNSYPPXGGAPQKKKPNPVNGPKPSNFPPKKKNNPGGGQPKKKADGLALKPPPPXGLTSGIPQGGEGGGVLRPPGAPVNAQAKLEHAGEPGPQGGGAPQAKPRGEQGGLKKKKHKGPDKLGVFGGGGPLAKPPQEGVPRGEPQGLF

SEQ ID NO: 160925 - protein, 138 aa, Triticum aestivum
  Clone ID: PAT_TA_55343.pep
KKPRGLYYSFPNPGKKSRLGNPPPKNMKRERDQATKKKNGPSPKSFRAPKGEGKKFERALKNLTLAPQQKDPGGAALKGQKVFPPSQEQKEPLLTNLGGGKPKKSPAFKQNPWQTWGAPPPPRGRGDYPGQRAPKQRA

SEQ ID NO: 160926 - protein, 105 aa, Triticum aestivum
  Clone ID: PAT_TA_55344.pep
PRAKLKMPRTGGAKIYLHYKPQQFPFWGRDRGNIFRTEGTRGELTTKKKPFKNRPGRVFPAREGLKKISFQLGKTERLPKHMKKKFRVCLPFVRKRGRGFFRTRG

SEQ ID NO: 160927 - protein, 74 aa, Triticum aestivum
  Clone ID: PAT_TA_55345.pep
KCAQVAPLWKFGEPPFNHLKCGISALVKVEVHQGLSCLYSSDEFLFMMLQSDQDRQLCSILALFKLQCDIIHLR

SEQ ID NO: 160928 - protein, 60 aa, Triticum aestivum
  Clone ID: PAT_TA_55346.pep
GPGGFLYIFFFFFFFFSPNSLLIGADAAYHLELIVYSERNSRAGCFTGPNFWGEGAVFFS

SEQ ID NO: 160929 - protein, 65 aa, Triticum aestivum
  Clone ID: PAT_TA_55347.pep
SLQYNNVAVCLHRRKPTPLLPEDPAFPRTQPIHPLPKESAGSIKQVKTRYTAFPHSGDGFASSSI

SEQ ID NO: 160930 - protein, 59 aa, Triticum aestivum
  unsure (1)..(59): unsure at all Xaa locations
  Clone ID: PAT_TA_55348.pep
RFFQVVSNPVDIKLKDDLXRAKKIRNPRGLGHYWGGGGRGQPPKTTGRKGKTVGVSKKR

SEQ ID NO: 160931 - protein, 28 aa, Triticum aestivum
  Clone ID: PAT_TA_55349.pep
ASKLISENLQPGTTLTRFQQLNHNNSST

SEQ ID NO: 160932 - protein, 78 aa, Triticum aestivum
  Clone ID: PAT_TA_55350.pep
VFFFFFFFFFFFFFFFFFFFFFFFFFFFFFFFFWGTMPLHGGFFFRSNKTKTGGGPSQVRKGTKSGAKKKGLHIKGKV

SEQ ID NO: 160933 - protein, 163 aa, Triticum aestivum
  unsure (1)..(163): unsure at all Xaa locations
  Clone ID: PAT_TA_55351.pep
MAAAALANGDVRAGGGGAVPRPTNPMVTPLLTDLYQFSMAYAYWKAGKHLDRAVFDLYFRKSPFAGEFTVFGGLEECIRFIANFKFKEEEINFLRTALPTCEDGFFEYLSSIDCSDVEVYAIPEGSAVFPKVPLMIIEGPXAXVQLLETPFLSLGNYASVGTT

SEQ ID NO: 160934 - protein, 158 aa, Triticum aestivum
  Clone ID: PAT_TA_55352.pep
KPATKGVAGGGDPQTKKSSSGKGPPKHKNGGQKGAPGLKPNGKNPRTGPKRNGKKKKDRGERPPKRERVKGAGKRKGPPGLKGRKKGGTNTHSGPPKNWKPPKRGPFRKKAKWGKAEVFQSQKGGKTQGFTQNKRGKKKAKKLKIRATKKKPPKSTPP

SEQ ID NO: 160935 - protein, 122 aa, Triticum aestivum
  Clone ID: PAT_TA_55353.pep
TCPRLILLAQFFPPPPVISSSQSRQASSSWTPGRCSPPFPSSIAARAAESRSRPRSSAQGFPTEAGSRPCSSRPTTGWPHLGHSTSPRWPAARRGGSGSRRGGGGRKGWRHQEARVRGRGFG

SEQ ID NO: 160936 - protein, 200 aa, Triticum aestivum
  unsure (1)..(200): unsure at all Xaa locations
  Clone ID: PAT_TA_55354.pep
SEQLLQGMLGVVGGTSLLESDLFKTGLAEVLVETKYGRVRLWKADKTGKFGRDIVFCQRHRADPDGGYTLPHKINRRAIALAFAQIGVKTVVAFYSVGSLKLTFPPGTVVVPDDYVNFWGQDNLHDEHSSHIVPGYNADLRRALIEILTEANIKATTTAVYVQTGGPRFETPAECXVLGGFGDIFGMTAPLRATMLKGAG

SEQ ID NO: 160937 - protein, 167 aa, Triticum aestivum
  Clone ID: PAT_TA_55355.pep
MKKSPPVSTPNSPSEAMPILRVALRDTLGEAVSAVGAVAGLASLSNHAREEMAVRDYIELLGYSVDELGWSLDAMAEPLDGVDPEMKTAHGAAPGSVRSGAHAEDDLHAWLAGQPGHGKNDTTASKRSSSAPGAGAAARVARRAGGGGGGRALRGGPGRAAGRAKLV

SEQ ID NO: 160938 - protein, 67 aa, Triticum aestivum
  Clone ID: PAT_TA_55356.pep
PAQVVAAVGFKGRRLEIPKDLNPQVAVLIESCWANEPWRRPSFANIMETLRPLINKVPVPQLIRSDS

SEQ ID NO: 160939 - protein, 72 aa, Triticum aestivum
  Clone ID: PAT_TA_55357.pep
STGEGRENPFFSDSSKGGGKKGARAGLGGKSWGGVKPTNGQGGQDKCPDYTHRGIIHGLFGNFFCKKHGGGQ

SEQ ID NO: 160940 - protein, 63 aa, Triticum aestivum
  Clone ID: PAT_TA_55358.pep
AADLLAFVLHVGGMGLWIGIIFGILVQVLLFVAITLCTDWHKEATKAKNRVFTSFLPTDLLEK

SEQ ID NO: 160941 - protein, 89 aa, Triticum aestivum
  unsure (1)..(89): unsure at all Xaa locations
  Clone ID: PAT_TA_55359.pep
PPPXPPPAPPPPPPPPPPPPPPPSPPPXLXAPAIXSKFPPPPVAAGPLQPPVPQPRPGHPCNVMQPCVAPRMTRTEMNKTSPPMAESCI

SEQ ID NO: 160942 - protein, 96 aa, Triticum aestivum
  Clone ID: PAT_TA_55360.pep
TLPKSYRYLFPVCSISDGFTEKVPPCTPWKFCDYTIAGKKVCSINSSSLSTELRANPKLLDITHLRANAFLEVAGVIVLHKATECLGGDLWQWIVL

SEQ ID NO: 160943 - protein, 90 aa, Triticum aestivum
  Clone ID: PAT_TA_55361.pep
TPQADQGHSIGSVMLVPLMGGDKHQVAGTRDLQTTAHTRGRHHAVLNRTIPPKYADQIEGSIAHPIPAKEQAKRREAQWAADQIGFTFLR

SEQ ID NO: 160944 - protein, 57 aa, Triticum aestivum
  Clone ID: PAT_TA_55362.pep
QFLRVLHRHPGEPHKPKQAFPPPFTQEAPAHIANGWSAKLNRSSAGEHKWGLFIATK

SEQ ID NO: 160945 - protein, 95 aa, Triticum aestivum
  Clone ID: PAT_TA_55363.pep
QLQKFPKHGLINPKGVHGHDFKVEPHTIYHLNPPTHRQAKFGDTSSQTKPWQDPITIGARQTTPSQKVDIVVWYLSNHHMGELIERQTGTCDLDG

SEQ ID NO: 160946 - protein, 171 aa, Triticum aestivum
  unsure (1)..(171): unsure at all Xaa locations
  Clone ID: PAT_TA_55364.pep
SKISSSDSSEGNTTRRVVGTYGYMSPEYASXGVFSIKSDVFSFGVIIFEILSGKRNSGSQQYGDFINLLGYAWQLWEEGRGIDLLDTSLVPKDQSPKIMRYINIALLCVQENAADRPTMTDVTAMLCTDDMNIDEPKQPAYFNIRVGNEEESTATESCSINDMTISVAIPR

SEQ ID NO: 160947 - protein, 103 aa, Triticum aestivum
  unsure (1)..(103): unsure at all Xaa locations
  Clone ID: PAT_TA_55365.pep
PGRGNVFKGELKKRLPKFFKVKAPPCFFLFKFPPPFGGGKSSGFVFFFATLESPKKFXPKSPLFRNGFFSKVGKSPNPFKERKTRPQKILGFKKTKPGNSKKK

SEQ ID NO: 160948 - protein, 82 aa, Triticum aestivum
  Clone ID: PAT_TA_55366.pep
GGKNLGLYHETNPGTYPGEPKKKSPLGGQGTKGAGHKQATQILGGQTQNLNFKRGLAHFIWGGFTGFPFYYFAKGGKTGPKL

SEQ ID NO: 160949 - protein, 96 aa, Triticum aestivum
  Clone ID: PAT_TA_55367.pep
ARKQIRGACRPKAPGGFFSSGRWGQPPLAYPRKLGNKTCEGAPKFTENHWPCPQGSGGKQEFSALPKLGDLKQGEQGSGAPNYRLPPGFASNSRTG

SEQ ID NO: 160950 - protein, 121 aa, Triticum aestivum
  Clone ID: PAT_TA_55368.pep
SNKFCQEYEMRRMKQDEGLNVIGEGLATLKNMSSDMNEELDRQVPLMDEMDAKVDRANADLKNTNVRLKQTIFQCAQKVSEVQQCAHVPVGGGLALAPLLIMSCCDRLQHVPRVIRFVSSV

SEQ ID NO: 160951 - protein, 129 aa, Triticum aestivum
  Clone ID: PAT_TA_55369.pep
TAFRQRLYTQSGNGMADNTLDVSYAAQLRQGCPRSGGDDNLFPLDIVTSTKFDNFYFKNILAGRGLLSSDEVLLTKSAETAALVKAYANDVHLFFQHFAQSMVNMGNISPLTGSQGEIRKNCRRLNNFH

SEQ ID NO: 160952 - protein, 135 aa, Triticum aestivum
  Clone ID: PAT_TA_55370.pep
ARPLDGVGPVAWDTNVARFAQDWAAQRAGDCRLQHSGGPFGENIFWGSGQSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 160953 - protein, 81 aa, Triticum aestivum
  Clone ID: PAT_TA_55371.pep
WKKLQVLVWMFSIPFSHFIYVQDSRCMMENCVSCSSCLYVVLVQKLSILPLERTRWLHCFSNVTSLCILGVLLLLLCMQMN

SEQ ID NO: 160954 - protein, 116 aa, Triticum aestivum
  unsure (1)..(116): unsure at all Xaa locations
  Clone ID: PAT_TA_55372.pep
MKELKFSIAAXYNILNDMMDNSLVAGLRHVKTACCGSGKLNAEVMCSHPGTTACPAAEHDDYMFWDMLHPTHATIERGVVALFYGNGPKYGEPVNFGTLVTGQNVSPAIKMVVDDQ

SEQ ID NO: 160955 - protein, 77 aa, Triticum aestivum
  unsure (1)..(77): unsure at all Xaa locations
  Clone ID: PAT_TA_55373.pep
PAICQFQWVKWLLGSPLVQIYLGLPVLKQKVGYVPPKNLFXRVIQVAQKGANYGGVMVWERFEAKGPNYSSYPIQWV

SEQ ID NO: 160956 - protein, 161 aa, Triticum aestivum
  Clone ID: PAT_TA_55374.pep
SRRSASSSCRSSTSLIAARRPRSAPSSVTTFALRWTFSPSQRRLGQSSSRSSRASISRPPRRRSFLMSRQFCYCLILSYTSHHVSLSLSLSSSFPFFRAFFSFLRFCFSVWFHLSFAVTRHHHHPSTRSYRLLCPKAAMTVDISTSLSPLLFGVQCHQFLR

SEQ ID NO: 160957 - protein, 65 aa, Triticum aestivum
  Clone ID: PAT_TA_55375.pep
ARHWIDTTLTTLVKKERALGMNEINNTAVLDCLKGNHTGEQFHQEFWFSRDRGGSFRTLHGLVGR

SEQ ID NO: 160958 - protein, 67 aa, Triticum aestivum
  unsure (1)..(67): unsure at all Xaa locations
  Clone ID: PAT_TA_55376.pep
KTPLQKIKKNFFLKKIFPIFFFLKKKNPPNPPFLPPPPIKKKNKXSKKKYQKFPPKKPHTKKKKPPP

SEQ ID NO: 160959 - protein, 90 aa, Triticum aestivum
  Clone ID: PAT_TA_55377.pep
ALPDRTMEIADPTIWLHGEPKDDITTSRIQECLLSVFRLGISCSKTQPRERTLIRNAAAEMHAIRDAYLPFAGKHIGEHGTKGEPRLHSS

SEQ ID NO: 160960 - protein, 55 aa, Triticum aestivum
  Clone ID: PAT_TA_55378.pep
VSSSLFLLGRASRRTIGPEAPFSIRPSQPLSIYPTTGSGTLIALDSESNKLAVKH

SEQ ID NO: 160961 - protein, 114 aa, Triticum aestivum
  Clone ID: PAT_TA_55379.pep
GSLKLTVGTGYTVANGILTFYTPLTDTPWPTPTLTDPVPTNCDTISKRYTQGSDIKFVNNMAFHRKKTIASSVICTSQKCYLATAAILKVVVLAEALEENHGLWLKALMFLDHT

SEQ ID NO: 160962 - protein, 97 aa, Triticum aestivum
  Clone ID: PAT_TA_55380.pep
PLSFMGGRASLAQCFRLFPVKNLLAQVVFSPAPASFDSIGSGLALIGFLFKFLGAFLHISGAGLEFSVFCGACCFGLVPRFVTPKKVWGPFGPPPCF

SEQ ID NO: 160963 - protein, 133 aa, Triticum aestivum
  Clone ID: PAT_TA_55381.pep
FGVFCCTLSKMIMCTLVTIILQLATLPLAVYNFAADNLYSLSFFLAFLSVIIQVLKIGRTVNPYIHLYVPFLHTPIATVRRWWLRLRDTEDEIRIGLTRSVVQKKKTYIYYVSVHVQRTSFPMIINSCARKSS

SEQ ID NO: 160964 - protein, 35 aa, Triticum aestivum
  Clone ID: PAT_TA_55382.pep
FTKQHITTQIEERARLGLIHDPDPLTLAKRNRGGW

SEQ ID NO: 160965 - protein, 83 aa, Triticum aestivum
  unsure (1)..(83): unsure at all Xaa locations
  Clone ID: PAT_TA_55383.pep
GCFNASPGPSEWHGWVPPLSDSPGDXCWGRRLKXFLWGPRQNFPGQGGGFFFPSQGHAFNPGQRGWARFHPLGPKKKKAPLFV

SEQ ID NO: 160966 - protein, 149 aa, Triticum aestivum
  Clone ID: PAT_TA_55384.pep
GGNSFSNDDRGATTITLTTPGVHFFIWDVPGPCASGIKFPVPVPVAGGSPTGGPIPPGAPGGSLLPAMRGLVPPPPGALFVLAPFLLKPVFVGEFGQGETPPVLFVCPVNKFPVFFATFFGAPLFPMYVTCSLVFGPAFLSPWSVVFMP

SEQ ID NO: 160967 - protein, 127 aa, Triticum aestivum
  unsure (1)..(127): unsure at all Xaa locations
  Clone ID: PAT_TA_55385.pep
KGKKAGSPVEEXDYLPYFFLGLFALLWQFFGANVGDPFLFGNSAPGLAKPKFGLYWVKDGKWVGAFFKGGFPDKNPPFPKLWRAQFPSPSPHEFKAPGLLFSTKFFPSPPPEVSPLAINFANTSMHK

SEQ ID NO: 160968 - protein, 128 aa, Triticum aestivum
  Clone ID: PAT_TA_55386.pep
LKYRLCILLFYLVLKLIEEERCLFETIYIYYTFLSRICDSLLSCFFVYVPGYDETGSQQEARWRVFLCNCHNCSFDRDLPGLHDEVIILFIRIPCPYRRELDLLVMFGNLKRSFEIKGLQVLLYVLSI

SEQ ID NO: 160969 - protein, 88 aa, Triticum aestivum
  unsure (1)..(88): unsure at all Xaa locations
  Clone ID: PAT_TA_55387.pep
GPALGKGRPAAKTEIEKLKLFELTCREGIVXVAKIIYGVPDEAKDKSFXLELSWVCEESNRQPEKVPSDFLEQAKATAQAALEKMDAD

SEQ ID NO: 160970 - protein, 55 aa, Triticum aestivum
  Clone ID: PAT_TA_55388.pep
KNRDGFKSHPKQEKLFEFNLGLEQFTKKGVHFVGKHDLAPTFKKTQRGTCGDFWA

SEQ ID NO: 160971 - protein, 74 aa, Triticum aestivum
  Clone ID: PAT_TA_55389.pep
RPEQSQLCFIIIISTMSGEPAKTYKAGAGKTQPPGRRRETITGRMDRLFSYTTYVHQTRKQETTGQGKQRMKKN

SEQ ID NO: 160972 - protein, 117 aa, Triticum aestivum
  Clone ID: PAT_TA_55390.pep
VRPGWEAQRAGDFRFQHSVGPFAENIFWGSGQSWTPADAVKLWVDEKQNYHLDSNTCDAGKVCGHYTQVVWRKSTRIGCARVVCTGNRGVFITCNYNPPGNFNGERPFAFLTLDAEA

SEQ ID NO: 160973 - protein, 167 aa, Triticum aestivum
  Clone ID: PAT_TA_55391.pep
LQQTPMFLLTLVFSRHLSPPRCIPRKLGFSQIECRLYVYRSLFRPASPGDEPRLFVAMGAYRRFHKLVMLSLLCYPWVDLALLWPPYLHPVGFTYVPPACGWAVLGALATLVPARPRACPLTMCEGQRCLDVDDAQLEHQRLRPHACACKGGSRLWFGLASEAAVCA

SEQ ID NO: 160974 - protein, 89 aa, Triticum aestivum; identical to SEQ ID NO: 130083
  Clone ID: PAT_TA_55392.pep

SEQ ID NO: 160975 - protein, 82 aa, Triticum aestivum
  unsure (1)..(82): unsure at all Xaa locations
  Clone ID: PAT_TA_55393.pep
PPRAXXRVSYSVRCPRRGGPGHGVVHLAVRVLGDVRVAXRPDPXPPAQPGWCRVAMGIPVSGPSAAAVVGTPSPWAWSQTSR

SEQ ID NO: 160976 - protein, 90 aa, Triticum aestivum
  Clone ID: PAT_TA_55394.pep
FFFLSSSRTKMGRRQHRDPPHITGKTTHMLGDSSAVPYQKIADKLHYDQTFVFSTRRCPLSLTESTRVLSWFFYPFAREKNPYDSFGDQK

SEQ ID NO: 160977 - protein, 60 aa, Triticum aestivum
  Clone ID: PAT_TA_55395.pep
SYHTRVGHRASMLRVGRMFTCAALGTCTVAGSVSHWPIPPHHQVYPHGGFDCPSSSKLYI

SEQ ID NO: 160978 - protein, 154 aa, Triticum aestivum
  Clone ID: PAT_TA_55396.pep
WERRNRGKGGRGKKEKGGGKEKQKEGRKKKEKKKKKKGKGRKGRKEKKKKKNKPEPKKKKREKKNKKKKKKKKNKPKKEKSRKREKNEKKKEKKGSRKGKKKVGGRKKSKKAKKGNLETGKKGNRRKKGKKNPGQEPPENHEHQGHPQKKLKGM

SEQ ID NO: 160979 - protein, 75 aa, Triticum aestivum
  Clone ID: PAT_TA_55397.pep
KGCPPWETGAFMGKKEKLRGPSEKFSRAKKPGIFSCRIGSLLVFYQKGLLLREFTVYTIFAKNLLGGEIYLFAGK

SEQ ID NO: 160980 - protein, 87 aa, Triticum aestivum
  unsure (1)..(87): unsure at all Xaa locations
  Clone ID: PAT_TA_55398.pep
XSWGAGXWPXGFLXXCXGLPPPGLXSLSXPSXSAPPSSXXXXXRAALVXXAGPXPFXGAFSPLVAXRGVPARAVXXXGVWCVRXRGS

SEQ ID NO: 160981 - protein, 139 aa, Triticum aestivum
  unsure (1)..(139): unsure at all Xaa locations
  Clone ID: PAT_TA_55399.pep
TQPAGGRSQPGRPNEATPKPTTRAAGRAPRPPPPPPPPTRRPPRPPPPEQEEDDEGAREXXTXQXGQXGNQXGXEXXKQXXXEHGXGKDGXXEDPATQGGDRKXXXXXQAXXQHXXPRXXAXXXEPRGXKGXQNREGKN

SEQ ID NO: 160982 - protein, 157 aa, Triticum aestivum
  unsure (1)..(157): unsure at all Xaa locations
  Clone ID: PAT_TA_55400.pep
LAEMEQDAPPVPHQAQDDGAVDGWARDDTEPSPTASRRSAPRRRSSSLPPPPCSRSSAPSTTTRWGGALGRPRRLFPRPHPLRPPRMKAAWIGDXYFGLGSSQGAFVAPLSQLSGISSSHGSRFDQVPSGAVLIATAIAGGRSLRCDLCLLAKSARV

SEQ ID NO: 160983 - protein, 174 aa, Triticum aestivum
  unsure (1)..(174): unsure at all Xaa locations
  Clone ID: PAT_TA_55401.pep
VFXXCXALXXSLXXLXPXXXXALSXXGGPXXXXXWLXXSXGACSAVXXXXGVXXASRXXGPRCXSXAWXGXCCCCCCWXWXXARXSSXLXRXGFSGPSPXXXASGFSSRPXRXPLXSXXVXARPPGLPPPLALPLLAXALAPLXXXXLCPXLXXAXXARCSXLLXAXLXRXRGS

SEQ ID NO: 160984 - protein, 123 aa, Triticum aestivum
  unsure (1)..(123): unsure at all Xaa locations
  Clone ID: PAT_TA_55402.pep
PHPAPQESKANPRARGRPPAGAAATSGPPREXXAGAAXAGGAXRAGEXAXXRPRRRDRAXRXQGPRGTPXRXXAXDAPXAERXDEEARXRXRPXGXHDGGPRAXPXXHXTRKEHGERAXTGGG

SEQ ID NO: 160985 - protein, 94 aa, Triticum aestivum
  Clone ID: PAT_TA_55403.pep
GFTNKTRPSIQKIYKVLALNFRIPRSDVSALFQLSNMQSLWYAALSPPPATLSRPTASLETGAYPYPDSISASPSSLLRMHLCVLVLLEPAVSP

SEQ ID NO: 160986 - protein, 139 aa, Triticum aestivum
  unsure (1)..(139): unsure at all Xaa locations
  Clone ID: PAT_TA_55404.pep
PTPPTPQERSQQPTQRRRATRGPHRKAEXKTXTGKTXTXEGEXXDTXDXXKGGSQDKEGXPPDQQRXNXAGKQXEDGRTXXDXNXQKETTXHXDXRKXGGXQNDEKTQTGKTNTRKEESXDTKGDGGGKNQDKEGEAPG

SEQ ID NO: 160987 - protein, 110 aa, Triticum aestivum
  Clone ID: PAT_TA_55405.pep
FSNKAPPWIFLGGGETLGNSQFFFPILFLELAPGNQNPKKIPLLVIRPDRGAPVYLKFSPPGNDGPRANREKTALHHFFLIKGGMDLTFWVNLFHPRRKRAPFNDPPGGP

SEQ ID NO: 160988 - protein, 46 aa, Triticum aestivum
  Clone ID: PAT_TA_55406.pep
WELTRLPHNKCLNLWESARSTSLCPPGRTSQPPSLSCAGRVGGRVG

SEQ ID NO: 160989 - protein, 79 aa, Triticum aestivum
  Clone ID: PAT_TA_55407.pep
FSTSISHTGLMIQIHDGRLSPHVRGHFHVRLMLGLLLPRINMQVMLVPIVFLQGGDLHLLLMPIMLLLIGFSVRMLPQR

SEQ ID NO: 160990 - protein, 74 aa, Triticum aestivum
  Clone ID: PAT_TA_55408.pep
RCTSGQSSKPPGFFTIPLCLARSICRTYSLFISALSYHHWGAEHSMNFLCFADAQQPGQGPPVQSPYTALCSYV

SEQ ID NO: 160991 - protein, 114 aa, Triticum aestivum
  unsure (1)..(114): unsure at all Xaa locations
  Clone ID: PAT_TA_55409.pep
KXEKRPRQPRFAFIXKSEVXHLKNGYRWRKYGQKAVKNSPYPRSYXRCXTQKCVVKKRVERSFQDPAVVITTYEGKHTHPIPSALRGSTHLLAAQAAHLHHQHHGHLGMLPQMG

SEQ ID NO: 160992 - protein, 78 aa, Triticum aestivum
  unsure (1)..(78): unsure at all Xaa locations
  Clone ID: PAT_TA_55410.pep
PSPGPRPGPKGFPXSPAPNPKPVDRPEPPPGGXKTTKPPQNPTPGKSPPFWKYPKKKTGGTQSPPPPPPRPNFPLGTP

SEQ ID NO: 160993 - protein, 77 aa, Triticum aestivum
  Clone ID: PAT_TA_55411.pep
PPFTGGTATTVARKRPGAGPTGSPFYDRPGGPGRPFDRFSRTGPPPVWVSAPRGPPGYPLVQTAAGEPLRNEKVTPR

SEQ ID NO: 160994 - protein, 72 aa, Triticum aestivum
  Clone ID: PAT_TA_55412.pep
PKSKRRHHVERNSATFFGRFHLPENTALGQDRTAMDDDGVQLTVTVPRVGAAVAVAMPEPAVAVEVVEASPC

SEQ ID NO: 160995 - protein, 112 aa, Triticum aestivum
  Clone ID: PAT_TA_55413.pep
WGNAPFPCPFQRSSRGSLNPGKRGKLRGKRLSPRGGLAGFQSWRPRAPACSACLVPSAWLCGRLGARSSGCPRAPSSISVAPFARLPALSLACDPLIPYRSAPGSVHAHWRC

SEQ ID NO: 160996 - protein, 84 aa, Triticum aestivum
  Clone ID: PAT_TA_55414.pep
RSTQFFHTFVVFPCYFHLGWRKITWGAPRGLLAKRITGASPARPFLKQLPDPQWEGHPASLCGPPVSLCGKPFSTLPSRRRPLG

SEQ ID NO: 160997 - protein, 114 aa, Triticum aestivum
  unsure (1)..(114): unsure at all Xaa locations
  Clone ID: PAT_TA_55415.pep
SKFPSAISESGFIPVKGRVKDGIPPLTKVGAFKVDVSMEGSLILCRQVDHPGIIGSVGSVLGEENVNVSFFSVGRIAPPKTAVMAIGVYXEPTKAPLTKIGEIPPIEEFVFLKL

SEQ ID NO: 160998 - protein, 158 aa, Triticum aestivum
  Clone ID: PAT_TA_55416.pep
FKQAEKLPYLSAVITESNRVHLSIQYQLPRNVPSEGAQVGDYFLPPGTTCGTSSRAVNCSREIFGPDAEEFRPERWIAQGPDDEARIRKEKSLLMTFGMGSRSCIGKNLAIVELHLYIAQFFRHFDAEVAKSAKPWGIKSQWLTFHHDFVITITRRKH

SEQ ID NO: 160999 - protein, 90 aa, Triticum aestivum
  Clone ID: PAT_TA_55417.pep
VPPGLSKARVGQCVDPKFGVVSPPKVFPKMVQGVPLWVQNEAIFGPKMSLVVKILAPLLNTGTSNRLAGWPPFPVECFPPDCFGTIAKIW

SEQ ID NO: 161000 - protein, 132 aa, Triticum aestivum
  Clone ID: PAT_TA_55418.pep
LLPWGPLSHPCPGGRFHQWQTAAGVGAGSSQVFTAWIKITVVIDGGLAWVPVDGRAPPACGGSTKMAAPPMEKKGPAGSCPGEKLGALVDRANGGHPSFFNRFGQGHGSSPMKKNMMGSPSLLGPIMFVPGF

SEQ ID NO: 161001 - protein, 171 aa, Triticum aestivum
  unsure (1)..(171): unsure at all Xaa locations
  Clone ID: PAT_TA_55419.pep
MADXEXRXXXGGLAWATDDQXLQNAFSKYGDVIECKIITDRETGRSRGFGFVTFASDEAMRQAIEAMNGQDLDGRNITVNEAQSRRSGGGGGGFGGGGGGGGYGGQRREGGGGGGYGGGGXGYGGGRSGGGGGYGSREGGGGYGSGGGGGGYGGSRGGSGGRNWGEMGGPL

SEQ ID NO: 161002 - protein, 185 aa, Triticum aestivum
  unsure (1)..(185): unsure at all Xaa locations
  Clone ID: PAT_TA_55420.pep
PAPXPAPAPPRGPGRRARPPAPPPPPRPPPAPRAAXXPPPPXPPPPPPPPRPAXSPLPPPPPPPRPLSPPXPSPXPPASAPAPLXCFLPPPPAXLPRCLPRPSPASCPSSLXAXXAXPXXXSXRPFXCVAALPRXXAVSSXXXLPPPXXXCXSARLPXFFXXCPFAGGPSSRCALWAWWALLSRF

SEQ ID NO: 161003 - protein, 199 aa, Triticum aestivum
  unsure (1)..(199): unsure at all Xaa locations
  Clone ID: PAT_TA_55421.pep
MEGPSVEVPPYFLCPISLEIMRDPVTLATGITYDRSSIERWLSDGHATCPVTQQKLAEADREATPNHTLRRLTQAWCALHAVERFPTPRPPLDAGRVAEIVEEGHGAGLQKELAALREIKAIVDESDRNRRCVEATPGAVEFLVSVVRNHATVSKSAQDLLELSLDSXTSTSSPEEDALSVICSLKPSKKSLNRILEKN

SEQ ID NO: 161004 - protein, 173 aa, Triticum aestivum
  unsure (1)..(173): unsure at all Xaa locations
  Clone ID: PAT_TA_55422.pep
APHPTPREARHSTEEAERAGTAEDKKPAGDGGGAHXNXKGKGQXGXEGXXRXKRXTQGRKXXNAXXDRQXXXHNTKANXDEGRRHXXEQTXXEXEKEEGDENDAXQDQTGGSKPRPKKEQAGKQTERRRGPPGEPGGRGGRERTGEAAGGHNPRGRAGERTGGGRGGGGAGGG

SEQ ID NO: 161005 - protein, 51 aa, Triticum aestivum
  unsure (1)..(51): unsure at all Xaa locations
  Clone ID: PAT_TA_55423.pep
FSXISPXPLRPPARCSSLGSSLXRVAGWIRGATNGLGLAGTRFRFPGGGXG

SEQ ID NO: 161006 - protein, 115 aa, Triticum aestivum
  unsure (1)..(115): unsure at all Xaa locations
  Clone ID: PAT_TA_55424.pep
SPFPPPPPLFFPPLPPPGALPPXFCSSXPXLCPXLFCXPPAPXSFALXLSXFXXXASXXWXGXRSPPXXXFFLLXXWXALLXCXAXXXPSLLGVXGXAXLAXFXVLVPLXXXCPF

SEQ ID NO: 161007 - protein, 97 aa, Triticum aestivum
  Clone ID: PAT_TA_55425.pep
PLYPEQKMNTLRMVGEMGVPPKMFGWKRGLVKPPKVEGKVRLVMDSKDGMELRARAPAHKKGAAPAWSDGGFLRAAISRFLADVDSRQPQTSGDRLK

SEQ ID NO: 161008 - protein, 85 aa, Triticum aestivum
  Clone ID: PAT_TA_55426.pep
VYSRSLIIAFCFHAYPQVSYMILARVSPVTHSVGNCVKRVVVIVTSVLFFKTPVSPINSIGTAIALAGVFLYSQLKRLQPKPKAA

SEQ ID NO: 161009 - protein, 122 aa, Triticum aestivum
  Clone ID: PAT_TA_55427.pep
GRKNCQPPGKGKEGFFEGGGGPVPKISRQKFSLGKLPPPFVFWRWGPGKQPARLLPSEKTISPRGVAGAPPKKKPFGEKLSPLKKKHFFFRPRAPLLKPPNPLPPGTKSNSGNGGTKTQVLP

SEQ ID NO: 161010 - protein, 83 aa, Triticum aestivum
  Clone ID: PAT_TA_55428.pep
RQGRSYKMFFTEFRSHSLFVVRWCEFRNEQRIKVCQCLRVRPGAVRCRGHRVQGAGIARRDPVQYPAEGGRVHPVQRHRARLA

SEQ ID NO: 161011 - protein, 45 aa, Triticum aestivum
  Clone ID: PAT_TA_55429.pep
LYQCMFYRAEHECPATQYDKSQLPAYSSTRCKTRCTSYTRFSSHK

SEQ ID NO: 161012 - protein, 135 aa, Triticum aestivum
  Clone ID: PAT_TA_55430.pep
LLVFVLAPAPLEPQGVVLPPRVLGATFPFVGPAWPWAGAFANPAPPGMKEKVLVLVGFAFPRVRGARPLLSVAGTGALALVSFCLGSRPSLAYCKCFFLSLSFGDPGPGSCSGFPVRVWPMGAFFLYWLGPWPWA

SEQ ID NO: 161013 - protein, 68 aa, Triticum aestivum
  Clone ID: PAT_TA_55431.pep
HAVVTHSLTPSVLQEMLAVGVVAKLLLVLQVDAGERARAKAKELLKMHARVWKDSPCLQVHLKAYYPC

SEQ ID NO: 161014 - protein, 87 aa, Triticum aestivum
  unsure (1)..(87): unsure at all Xaa locations
  Clone ID: PAT_TA_55432.pep
DPQGPLSMGFPIXNRGIPLPANPFRTPMDFAKLFPFVKGIFIFPLFFQIPAFLDVKANVPPLVAGVGPQPKVLXGYRLLFAPLAGQT

SEQ ID NO: 161015 - protein, 158 aa, Triticum aestivum
  Clone ID: PAT_TA_55433.pep
FILLPTSTGGASMINLKKHAPKGMGKVDIWSRACRCPRVKHADEKDVSRDPTSEEEEPWTRPPPLSSSTAHPLKPMHKPPHAKAARWCPHVRSPRSEPGNPAATEAEGCQQGLKRWCMSWVSRRWCCASSHQGRGRQMASARGQQAPSCITVHMTRCS

SEQ ID NO: 161016 - protein, 112 aa, Triticum aestivum
  unsure (1)..(112): unsure at all Xaa locations
  Clone ID: PAT_TA_55434.pep
XXPPAPPPPRXRXSPHHTTQPHSHLTYTPGPPPPTTHPHHTGGTTQSQYHRIKILNHEKGMPKPTSGWLLRAVRVCSRELLGASSRSNVFNAVAEGCFVHQGTTTARLFATL

SEQ ID NO: 161017 - protein, 147 aa, Triticum aestivum
  unsure (1)..(147): unsure at all Xaa locations
  Clone ID: PAT_TA_55435.pep
RPPPAPRPRPPPPPPAPPPPGPPAXPPAPAPALPLPPPPASAAPPPSAVPALWPXLPGGXAPXPPLRLGRRSXXGSWSGPXWWPRAPPFGPPCPPSGSXACPPAAVXPLGLLAPLAVPSVCPCRARAGRGGGGWAGGGEPLCAALRV

SEQ ID NO: 161018 - protein, 138 aa, Triticum aestivum
  unsure (1)..(138): unsure at all Xaa locations
  Clone ID: PAT_TA_55436.pep
MASQLVESHRAGAEVIKGGEVCKKKSVELLEELGLPKGLFPMGDIEEIGXRPARGFVWMLQKKKSEHTFKKIEQTVSYDTEVTAFVXKGKIKKVTGVKIEDVSLVEVYVDESSADKVTVKTDTGLSDTHDAAAFALGE

SEQ ID NO: 161019 - protein, 120 aa, Triticum aestivum
  unsure (1)..(120): unsure at all Xaa locations
  Clone ID: PAT_TA_55437.pep
VSLGXXXXXRXLLWXXXAXLSXXAPALLXCXAAXXPSXWVSPXRCPGXXXXWXPXXFPXVXRXPPPPPXRLXPXXXXPXRPXPXXCXSPGXPXLXXXXVRXALXGPLSPXXPPFWPLLLV

SEQ ID NO: 161020 - protein, 130 aa, Triticum aestivum
  unsure (1)..(130): unsure at all Xaa locations
  Clone ID: PAT_TA_55438.pep
FPPFCRXPXGLALFRLPLCPCLPFSGVAXFSFXPXVXGPXRXXFGXAXFXCXAXSXLXGLAPLLXFSPRVSLXXXFXXLPPXAXXXXSXXXXSFXXXXPXXCXXLAPXLLAXXPCCSASARXXCXRXSSG

SEQ ID NO: 161021 - protein, 118 aa, Triticum aestivum
  unsure (1)..(118): unsure at all Xaa locations
  Clone ID: PAT_TA_55439.pep
RAAPRVRPVSPSGCPSACPCCVXSPAGFPCVVXLXLFCVRRCXPAACLXGXXSPVVACLXXAPPPPPXLSLPRSXLPLSALWCXSXPCRPACLXXSCCFXXCFXSPPRXSXVPPPPPP

SEQ ID NO: 161022 - protein, 58 aa, Triticum aestivum
  Clone ID: PAT_TA_55440.pep
KLCVYMRHAVCVHSRSYKLFKISCASTTDKISFHHCSSGASPDAWADAWADAGRTLGR

SEQ ID NO: 161023 - protein, 199 aa, Triticum aestivum
  unsure (1)..(199): unsure at all Xaa locations
  Clone ID: PAT_TA_55441.pep
RSHRSPRSPADERPRAPSPAMRPSPPSAPARRAXPRLREPHAPAAPARGASTSHARPSPRSSGCRHPPSPRNGRGHQAPPRAXAPDPRDLEPSPPAHLLRASSARPEAPAPPCAASPAXAPPRACAAALAPVEATGPRLPAPDEGGRKAPPPPSRAGFARRLPLAAARGEGRSMGSWRRRLGFAPEPPAGATRELNLCR

SEQ ID NO: 161024 - protein, 52 aa, Triticum aestivum
  Clone ID: PAT_TA_55442.pep
ASNLERSYFVGDTPLITQELKGRPQNSFPKDESKICILFKKDGESTWPDAGS

SEQ ID NO: 161025 - protein, 79 aa, Triticum aestivum
  Clone ID: PAT_TA_55443.pep
SYRLVRLVVAVIQNVVTTVDNSGIYRQVVMIEVLEVESLYGIVIGKSYGKLHRYGPSGHTVCPYPSSCSTDSSLRTRGA

SEQ ID NO: 161026 - protein, 83 aa, Triticum aestivum
  Clone ID: PAT_TA_55444.pep
KQGPHGMTALCGGEHYKGGNWGHNHLYHPDLRKTLDARYFLAFSTFPYPFNSWFQIQPGLVALGLPSAGSFKQLQKEWAEHIP

SEQ ID NO: 161027 - protein, 192 aa, Triticum aestivum
  unsure (1)..(192): unsure at all Xaa locations
  Clone ID: PAT_TA_55445.pep
MGSLRAPPQLAGGTSLGRGYGACLASSGVPKSKVLGVSCAMKSYRLSDLSDAEVSGLKARPRIDFTSIFSTVNPIVEDVRARGDAAVKDYTEKFDKVTLDNAVVRVSDLPDAELDPAVKEAFDVAYDNIYAFHVSQKSPEKTVENMKGVKCKRITRCIGSVGLYVPGGTAVLPXTALMLAVPAQIAGCKTVV

SEQ ID NO: 161028 - protein, 80 aa, Triticum aestivum
  unsure (1)..(80): unsure at all Xaa locations
  Clone ID: PAT_TA_55446.pep
QGPLQGGEGXTXKTGKQXHAKXHXXAXDXXKGKKXEXXXXXXHNGDXPXXDRQXXQRGGGXXXGXXSPXTEXGNTKXDXK

SEQ ID NO: 161029 - protein, 70 aa, Triticum aestivum
  Clone ID: PAT_TA_55447.pep
ATNQANTYIWTYKMCTSQACGTYTLTSKLTRVLRPPYNHPQLCRGGPALADVIRRTGRRLPKLQNLDITN

SEQ ID NO: 161030 - protein, 140 aa, Triticum aestivum
  unsure (1)..(140): unsure at all Xaa locations
  Clone ID: PAT_TA_55448.pep
KGGXTGEAXAQEPRGDGXEXXQRXPTXEXXXQXXXXXXDXXRXXXXXEKAXGXKXRRGREXXQXKXTXAXXGXXEEDKTXXXEXTXNXXXTEXNKGKAXXQGXXGTDXXXKSXEAGERGAKEPGGKXXGGAGARAGRGTG

SEQ ID NO: 161031 - protein, 166 aa, Triticum aestivum
  unsure (1)..(166): unsure at all Xaa locations
  Clone ID: PAT_TA_55449.pep
PRPTTTAAARPAAAAGAGAGAGEEDAAXERAXSAAXKSAPXXPXXAPKTXTXDGAGGGATGRXPXPAXXDRXPXXEEXXXAGARXXXXAGPPRXPAPRRXXXPDNRXAGAGXXAAXAEXRGGTXRHXDPGNNRXAAXEEPAPXAPXGXEXXDPGQGPGAKXKGXRE

SEQ ID NO: 161032 - protein, 110 aa, Triticum aestivum
  Clone ID: PAT_TA_55450.pep
HASVLIDKLYNMGVIPTNKSLVKCEKLSVSAFARRRLATIMVKLKFAEHLKEAVTYIEQGHVRVGPETVTDPAFLVTRNMEDFITWVDSSKIKKKIMEYNGALDDYDAMI

SEQ ID NO: 161033 - protein, 83 aa, Triticum aestivum
  unsure (1)..(83): unsure at all Xaa locations
  Clone ID: PAT_TA_55451.pep
PPPPPPPPPPPTAPPPXPPAXRPPPPPPPXPPNRQWPIPPSPPSQPPRTPPAYSHPPPPRPCSAPHSNSHDPVSSPARLLQKN

SEQ ID NO: 161034 - protein, 113 aa, Triticum aestivum
  Clone ID: PAT_TA_55452.pep
RKIACYVYEWSEKTIANLLSYSHFCSLVVHLQILVVMPFPSLPSKLVALAPLFEAAARCSSRWRQVRPYPPWHRRGPPCEERRLLGTIATLIQPDRRGLVGSQAGVSSDASMF

SEQ ID NO: 161035 - protein, 77 aa, Triticum aestivum
  Clone ID: PAT_TA_55453.pep
QGSGLAVLGAGSALLGALSKPLDAAHSRYLSPAFAVARLTILDREVHSSSQRQPLSPDASSRALPPHRAHISQTPGK

SEQ ID NO: 161036 - protein, 117 aa, Triticum aestivum
  unsure (1)..(117): unsure at all Xaa locations
  Clone ID: PAT_TA_55454.pep
GTVASCAADDVVQRIQKPLSSPDPVAVTLSELHTDDGLKALEAHLXGKIYMSGYGITKDDMXVFVEVPMKPISDIPNAGSWYQTVSGIVLEGSVAVVRGSLLSGSARAATASSRDED

SEQ ID NO: 161037 - protein, 92 aa, Triticum aestivum
  Clone ID: PAT_TA_55455.pep
LSTDTRALQIILMPIGYNSRSLTFDMMQHSQSSRACLCRLIIQATAVLRAYCPDAFSRLAAVSCSLDARLFSNRTALSDMRALAWSLSLIIR

SEQ ID NO: 161038 - protein, 262 aa, Triticum aestivum
  unsure (1)..(262): unsure at all Xaa locations
  Clone ID: PAT_TA_55456.pep
AADESDVEDIAEDEDDGEVIIEDDATDKKTKGGRDLDDVEDLGRMIRKDDGSTVQKAPLAVDFTNYGSSTKKAVPQGPKKMVAEESPTYKALTKQGYAIVGSHSGVKTCRWTKSALRGRGSCYKWSFYGIASHQCMETTPSLSCSNKCVFCWRHGTNPVGTTWRWVVDPPDLIFDGVKTNHYKKIKMLRGMPGVRAERFAEAMQIRHCALSLVGEPIFYPYINEFLGMLHAERIXSFLVCNAQHPDQLADLKAVTQLYVSID

SEQ ID NO: 161039 - protein, 34 aa, Triticum aestivum
  Clone ID: PAT_TA_55457.pep
VIIDARCYLPGDKRVRHLVEEEDARRMMHKRCWR

SEQ ID NO: 161040 - protein, 55 aa, Triticum aestivum
  Clone ID: PAT_TA_55458.pep
GQPSMVRSRGLRRRCKSRCLRGPCSEVGYQSALESTTISYPQLRREERVPPGNSG

SEQ ID NO: 161041 - protein, 245 aa, Triticum aestivum
  Clone ID: PAT_TA_55459.pep
IQNNKHHQPAPALYSIPWLIGTLRSVGELKMELAISAVAGELVSRFVSFLANRYLHSSCRAQWEEKQLKKLQLLLLRAHTVVEEADGRYITNSRMLAQLSMLADAMYRGYWALGASRYISLEESMEEGVVPNPSPHKRFCMVHGSARKNKATSLVDVQGALESLEDVVAGMTEFVVLLGGCDRMLRRPYDAYLYNDNIMFGRHAEKQKLLNFMLRHNSPGGGAPAVLPIIGASESRKRDSVAHVC

SEQ ID NO: 161042 - protein, 183 aa, Triticum aestivum
  Clone ID: PAT_TA_55460.pep
TESTSPRGEVDAVMHVAAATAPAVAAAPAKKKASAAGRWPWADKAIRPSQYWPFVAMLLLVSLVVFGRMFAICCTSIWWYLVPILNGEDGGPRSMGKTGRHLGKKASDKKIGEKITWASLPPSHGKKGSSGDHEMISPRGSHGKKSSSGDHEVISPRSHGKKSSSSGDHDVISPRSHAHGKKG

SEQ ID NO: 161043 - protein, 131 aa, Triticum aestivum
  Clone ID: PAT_TA_55461.pep
MLSRLRRVVERNLSMFGEHPRFLVQRYHQIDLRDFVLHPAASPLRVVPSYTSGSSRTEVTTERESLPRVRLGDLVMDPGVRPQGDFNVVAWESRLPPYTSFVHFVPNGDGAPGVVEQSTPLSGRKRAAVPL

SEQ ID NO: 161044 - protein, 210 aa, Triticum aestivum
  Clone ID: PAT_TA_55462.pep
MGMVVETEEWVLTPLAYPLLSAASLAAVLLLPHFSRPHAAVVTPSSPSPFDVGTTPFLRFRRAFLLLFCLASVAEGIHSVFGEDEFVRCGFGREQMAARLAAATAAVLFLGGASGVVSDKLGPQNACIFYWMLQLAVGALKSFSGLRCAWVNNFILALASSMFSFCFETWIVLEHEKQGQNQDSLFDTFWLMTFFESISLCWKSRNHLIA

SEQ ID NO: 161045 - protein, 49 aa, Triticum aestivum
  Clone ID: PAT_TA_55463.pep
ITSEAKSAMVRAIDSSRADPVPRNDDGCIKPSALGESDLNDQSLENDTN

SEQ ID NO: 161046 - protein, 25 aa, Triticum aestivum
  Clone ID: PAT_TA_55464.pep
RVRDLLESADSTSLTPLADRRSGHD

SEQ ID NO: 161047 - protein, 253 aa, Triticum aestivum
  unsure (1)..(253): unsure at all Xaa locations
  Clone ID: PAT_TA_55465.pep
DAWAAIATKGPTGGAGGSGSGRPAVANKPSFLTGGAGAGGHLSGKRGTEDLDFFIGDEAIAASGGPGYGLHYPIRHGQIENWDHMERFWSNSIFKYLRVEPEDHYFLLTEPPLNPPENRENTAEIFFESFNCAGMYIAVQAVLALAASWTSSKVQDRSLTGTVIDSGDGVTHVIPVAEGYVIGSSIKSIPIAGRDITYFVQSLLRDRGEPDSSLKTAQEIKEEYCYVCPDIVKEFSKYDQDRTRFANTXVSHP

SEQ ID NO: 161048 - protein, 113 aa, Triticum aestivum
  unsure (1)..(113): unsure at all Xaa locations
  Clone ID: PAT_TA_55466.pep
LSPNPTLSFKTPLWFXITPQSPNPLTPDVISGRXSPSGPDQAAGRVPGYGLIPNIINVGLKCGPGQNALFSPRIGFSKRFFDLFGFSYGDNLDFYNQSPFAYSIGFFIRKTFQ

SEQ ID NO: 161049 - protein, 121 aa, Triticum aestivum
  unsure (1)..(121): unsure at all Xaa locations
  Clone ID: PAT_TA_55467.pep
PTRAPTRAVEKAHDEQHYCNLPCKPFYEVGSWSYIVYGPAVIMVWEGKSVGASGRKIIGSTNRLTCXPGSIHGDCAVEIAGNHLPGAHSLEREALDMPTMNLLGAEGRPRHARTAPLKDAP

SEQ ID NO: 161050 - protein, 97 aa, Triticum aestivum
  Clone ID: PAT_TA_55468.pep
LVPAMADTNSGRYTAWTADDPIFRRGDSSPMSRMTARGWRHGRRSWSCMRQSHMLQPGVVDVCLDSPFALSCMNGGYHLPMLQPVGPSDEYDDLLLL

SEQ ID NO: 161051 - protein, 168 aa, Triticum aestivum; identical to SEQ ID NO: 124110
  Clone ID: PAT_TA_55469.pep

SEQ ID NO: 161052 - protein, 74 aa, Triticum aestivum
  Clone ID: PAT_TA_55470.pep
NARAQEPQLKGSEIGQGYNTQHHKQSFNAHRNGINKPMRSEPGLSPRGWILKFLRNLMFSTKHNVRLLRTEVVK

SEQ ID NO: 161053 - protein, 48 aa, Triticum aestivum
  Clone ID: PAT_TA_55471.pep
HYSRPAGMARLSARRRPPPLDLLPTLARSKSRGPTELTACIRAGYVLC

SEQ ID NO: 161054 - protein, 118 aa, Triticum aestivum
  unsure (1)..(118): unsure at all Xaa locations
  Clone ID: PAT_TA_55472.pep
EGIRSVSIHGSSVAPQQQPETAPLMITQGSKTEMAFSSTVKDYAVLRGNADGPCFLSSSDALYLDKDMPELGCCEQLPPRKIYFXLPDRMLGRSLSSADIPAMAVQASEALAMRVQSI

SEQ ID NO: 161055 - protein, 148 aa, Triticum aestivum
  Clone ID: PAT_TA_55473.pep
NKSFLSVIHSIVLQQAEERQLKKKSDNIESKFHAQLEKHSENAMQSSDQGSHTRSYSVSKDDPKLDVFRKRVEEEKARYINSLRTSRAMTLNHLQTSLPNVFHALTGFSGVCVQAFEGISRCSEAAAAAASHPGAVSPAVSSCDDHPL

SEQ ID NO: 161056 - protein, 44 aa, Triticum aestivum
  Clone ID: PAT_TA_55474.pep
NSTPGVPAREFRVQPHPSRVPSANKSIYAHTRLMDHTDKLTSHH

SEQ ID NO: 161057 - protein, 47 aa, Triticum aestivum
  Clone ID: PAT_TA_55475.pep
LLVAECLGVPLLSTRSLAQSGAVWMKSTPASARIEKLALARGVYLPI

SEQ ID NO: 161058 - protein, 78 aa, Triticum aestivum
  Clone ID: PAT_TA_55476.pep
SLTFDMIQQVELGHSYQLSYSSSAVLRLFPDLSLPAAYHARLMLGSLAMQCLSDESLASSLSVEYQIESLPLAIRLIQ

SEQ ID NO: 161059 - protein, 86 aa, Triticum aestivum
  unsure (1)..(86): unsure at all Xaa locations
  Clone ID: PAT_TA_55477.pep
MCNVDESGLDMGPRACPEGWYPFXDDGQLAWFSFGVRVVVGIGLGVCVVVGIGVGLLISSCQESSRNIKRWFFYHCSSKGTRSYGQ

SEQ ID NO: 161060 - protein, 196 aa, Triticum aestivum
  Clone ID: PAT_TA_55478.pep
MGGVTIADEVQVGFGRLGSWFWGFQQQAVVPDIVAVAKSIGGGFPLGAVITSRTIADQYRSQGYFFSSTGGSPLSSVVGLTVLDIIQEEQLQENARVIGACLKTRLQALGKRHPLIGTVHGDGLYLGLEFVRDRTSLEPATKETRAICNRLLELGVIMQPTGDHQNVLKIKPPLCITQQSVDYFVNMLDYVLLKGF

SEQ ID NO: 161061 - protein, 218 aa, Triticum aestivum
  unsure (1)..(218): unsure at all Xaa locations
  Clone ID: PAT_TA_55479.pep
PTRPPTRPLGFIMKHCKGTPKFNFYSYMIRALEVDFKKVVGISWYLWAMLMIFLLLNVEGWYVYIWITLVPFIMLLMVGSKMEHIITELAYEVAQKHTAIRGDLVVSPSDNFFWFHRPKLVLLLIHIVLFQNAFEIAFFFWLLVTYGFKSCIMGKPAYVITRVVISVICQVLCGYSTLPLYAVVSHMXNSFKKTIFDENVTEGLVNWAEKLGEAQEPQ

SEQ ID NO: 161062 - protein, 200 aa, Triticum aestivum
  unsure (1)..(200): unsure at all Xaa locations
  Clone ID: PAT_TA_55480.pep
RSTATTTRSRAVARGAASCAPARARRRGTRGVXTPAASRACAPGTTRCGRTRTSRSLQRRPGRRGGARRAPPSPAAAXASVSNGGDRDFRPAAGVAVAVVPLTAXRGGRAAGGAGRAGARARARRAGRRGRPGXSRGPRRATWRRPRRRSAGGTAPRRAAGARAAAWPPASAAAATTGIRDDRRTRQLPAAAATEQKTNG

SEQ ID NO: 161063 - protein, 76 aa, Triticum aestivum
  Clone ID: PAT_TA_55481.pep
MAKGGVEEALLLASRDEGLGLGVRDEVKKQLWLAGPFMGGALLRNLIQMISGMCEGHLGELALAGACMGRYCATGA

SEQ ID NO: 161064 - protein, 257 aa, Triticum aestivum
  Clone ID: PAT_TA_55482.pep
PTRPPTRPEQSSEASNRAYHRTVRICAAQSASSAHKIVASKMVAKEAIPLLTPHKMGQFELSHRVVLAPLTRCRSYANVPQPHAAAYYSQRATRGGLLIAEATGVSATAQGYPETPGIWTQQQVDAWKPIVDAVHRKGALFFCQIWHVGRVSTNDFQPDGQAPISSTDKQITPDAESGMVYSKPRQLQTDEIPLIVDDFRRAARNAIEAGFDGVEIHGAHGYLLEQFMKDSSNNRTDEYGGSLENRCRFAVEVIDAI

SEQ ID NO: 161065 - protein, 234 aa, Triticum aestivum
  unsure (1)..(234): unsure at all Xaa locations
  Clone ID: PAT_TA_55483.pep
PTRPPTRPPTRPLASYRRALLSQWNLDDECCARIQKRFSVFLLYGGVEASPPSLASQTEGSFVPKNNLEEAILLLMILLKKWYLGKTHWDPSVMEHLTFALSLCGQTSVLAKHFEEVLPGIYPRTERWYSLALCYSAASDDEAALNLLKKSLNKNESPNDINALLLAAKICSSDYYLASEGVEYAKRAIGDDELLDGHLRSVGLHLLXSCLANESKIASSDHQRSLLQAEALKS

SEQ ID NO: 161066 - protein, 74 aa, Triticum aestivum
  Clone ID: PAT_TA_55484.pep
SLIAKTRAIRTHRREDHHQILEKRVIYLLERRANACDPTISRCDVPASKINDRIDTSAAGNIFADEFHGDLVND

SEQ ID NO: 161067 - protein, 88 aa, Triticum aestivum
  Clone ID: PAT_TA_55485.pep
QSFLPSSMESQCTLNQLDLALSQATNAAQYAFQDGTATASTNLQQQRNFWEDDLQSVFHVDNRQSQDNGVSAESFHGDLQTGQMKMEF

SEQ ID NO: 161068 - protein, 231 aa, Triticum aestivum
  unsure (1)..(231): unsure at all Xaa locations
  Clone ID: PAT_TA_55486.pep
VLGPPHYSXDVIHHPNADELAREMLKTVAXXLPKVRGQYDFSQRFLLARRTFYLGADEIRSLRRRIDDLASAEAGGDAPKPKPVSTFVALAALSWTAFVRSKGLAAGDDMYLAFLADLRSRLDPCVSEAYLGNCVRACLASCADAADLLGQAGILRAARAVQAAVAEMEAAPLSGTDKGWMQKLMRLPFQRLTNVAASPRFRAYEAADFGFGKPARVELVSMNHDGEMVLV

SEQ ID NO: 161069 - protein, 96 aa, Triticum aestivum
  Clone ID: PAT_TA_55487.pep
VGAGGGAGKGHAARPGARGGPHHHLPHFLRRPRPRQPRPLVRVATAANRGSCSAPVNGNQLSTDVRRWRMIVDRSDACTVVVALAGTIVLAVGDYR

SEQ ID NO: 161070 - protein, 82 aa, Triticum aestivum
  Clone ID: PAT_TA_55488.pep
WEILTGEEPYANMHYGAIIGGIVNNTLRPPVPANCGPECRRLMEQCWSPDPSQRPAFTEITARLRSMSAAANQQAKAAAAAK

SEQ ID NO: 161071 - protein, 41 aa, Triticum aestivum
  Clone ID: PAT_TA_55489.pep
GQLDIVGCKRHQFLAFIKSRYVLFNNKLWRRVVLNVLVEFT

SEQ ID NO: 161072 - protein, 33 aa, Triticum aestivum
  Clone ID: PAT_TA_55490.pep
QVISWLSPKLGCLIIKERVEAPLDRTMTTHHPG

SEQ ID NO: 161073 - protein, 67 aa, Triticum aestivum
  Clone ID: PAT_TA_55491.pep
GTVLSLQVPVRFFWVLPTPPVSLVAAPYHLCCIRPKTGVNFPGRCLLRVHAPGPSLSQLLSVFVCFV

SEQ ID NO: 161074 - protein, 41 aa, Triticum aestivum
  unsure (1)..(41): unsure at all Xaa locations
  Clone ID: PAT_TA_55492.pep
DKKAPAGLVCNVPQAMAYPTAPEVKYMSMFTDXDVTACTVM

SEQ ID NO: 161075 - protein, 54 aa, Triticum aestivum
  Clone ID: PAT_TA_55493.pep
FFFFFFFFFIFFFFFFFFFFFFFFFYKKKKLPKTRRGYLCSKTLGLYIAGDPGH

SEQ ID NO: 161076 - protein, 55 aa, Triticum aestivum
  Clone ID: PAT_TA_55494.pep
IRQIKYVLYVKKIMPFSYSAKALSGITLSHIKQTKYIFSLIYGQSCILECVSEGV

SEQ ID NO: 161077 - protein, 184 aa, Triticum aestivum
  Clone ID: PAT_TA_55495.pep
LQQEAAEEEARRKAEEEEAAAKKKKAEEESRAASLDLDEVMAVSPVGLGRRSRQLFDEVWRKFSRLGQMSSASATEALAEAEQAVLSRGGPMCEFTVPGAQDTTVLVVGATSRIGRIVVRKLMLRGYNVKALVRRDDADVIDMLPRSVDIAVGDVGDPLAVQSAVSGCSKIIYCATGRSTVTGD

SEQ ID NO: 161078 - protein, 92 aa, Triticum aestivum
  unsure (1)..(92): unsure at all Xaa locations
  Clone ID: PAT_TA_55496.pep
ILERSDLNVVTKPIINFTYGLALLPYLHIQCPASLQQLAHTNHAWRVPVPVPGLLRAWRCGTXCGGGGGGPGFQAAGLVKDGGEVXRTYLHP

SEQ ID NO: 161079 - protein, 51 aa, Triticum aestivum
  Clone ID: PAT_TA_55497.pep
NFPWDPCIVPWCFHYWANCQELCERKGPLSKNSVVPMPVVTPPPLQKISMV

SEQ ID NO: 161080 - protein, 78 aa, Triticum aestivum
  Clone ID: PAT_TA_55498.pep
SMGNPPPIPGKWGVSVFFPNNTKVNCNKYILPSPLERICFPPSPKKYKTLWVPPSGLTPLYKGGFRYPFYRLLSKKWG

SEQ ID NO: 161081 - protein, 103 aa, Triticum aestivum
  Clone ID: PAT_TA_55499.pep
RRKDFIFHQNIYFCLNRETFITRYLLLFWQRREENHTIPTHRRGNFKIPTSILRIIGIFLCGRVLHSGEKQTKRPPKVLNPFQMRITVNIGGPNKLPSGERCN

SEQ ID NO: 161082 - protein, 111 aa, Triticum aestivum
  Clone ID: PAT_TA_55500.pep
SGVPPGSPPFLAPGPNGKQRKPFPLICLGGGRKMGRPPENGFVPPHAKRAKVMPLFLWGPHLDKIPPFFPPPFFPGPFGGADRPAFPPVLAGPSRLPGSFFPPFFFNCPPF

SEQ ID NO: 161083 - protein, 129 aa, Triticum aestivum
  Clone ID: PAT_TA_55501.pep
LQVVSHRACVGRVAAPSRPNERIKEGPATTQLPPSMPIQSSQFKEEGTFPDRDHGWGRNPSQIFSKAHPKGELCSRTLPKIKGGPPPPGTPAAPVRLETSWTRAGRIGLGASPDPGPAGRKWFYTGSRF

SEQ ID NO: 161084 - protein, 146 aa, Triticum aestivum
  Clone ID: PAT_TA_55502.pep
GSPTRTYFGYGPKNTPERGTSLVSITTSSPISHWGGRMGEHLGTKNPKNPHVFASKGGSTATQRANKTREAFLGREKKLWTMAMYWPTGAALKTPSILKIICRGGSIWGSNLVPRLQEFFTVPRTKGPPGLSRSKKAPPVSEKYVK

SEQ ID NO: 161085 - protein, 159 aa, Triticum aestivum
  Clone ID: PAT_TA_55503.pep
MEPVGAPQDKPAPAARGYWRWRKDDFFPEPSFASWGAYRGALAATPARLRDRLLAGRSTDAAELGAMRRRSENEMRRCLTWWDLTWLGFGCHLGAGIFVLTGQEARDHAGPAVVLSYVVAGLSAMLSVLIYAEFAVEIPVAGGSFAYLRVELGDVAAFV

SEQ ID NO: 161086 - protein, 89 aa, Triticum aestivum
  Clone ID: PAT_TA_55504.pep
QWPALLSSSSPSSWSPSPWRHSPTPRARRPRPRRRPKRRRRPPARPPTRPRPTPLPPSPPLRMHRSPAAAPPTDDPSARTPSGDDEPEL

SEQ ID NO: 161087 - protein, 84 aa, Triticum aestivum
  unsure (1)..(84): unsure at all Xaa locations
  Clone ID: PAT_TA_55505.pep
FSFFRENLVVEYKNQELPFKPLFHPPCFQPWVDXNQLRPIFRPQLRTDGQGFQNPKEPEPKEEENPKGTAQSGKGWENHGPFKF

SEQ ID NO: 161088 - protein, 61 aa, Triticum aestivum
  Clone ID: PAT_TA_55506.pep
SLVHTGLHSQPRWLRKVSTFTHCSCRVNCTGILLILSEIFLKMQGRIIEFSQNESLHVSLK

SEQ ID NO: 161089 - protein, 55 aa, Triticum aestivum
  Clone ID: PAT_TA_55507.pep
RSYCFLLDQEILPLEIRRIVLNWCMKLCVLLADIYICLHSSCSSTMKLEKTQKLF

SEQ ID NO: 161090 - protein, 73 aa, Triticum aestivum
  unsure (1)..(73): unsure at all Xaa locations
  Clone ID: PAT_TA_55508.pep
PAPGSSSDDXKEAVPAVGLEDHNKPVWRKPVIMGDKCRPLQFSGHIALDSDGNQLPPPPPGVKKPPPHVPPEN

SEQ ID NO: 161091 - protein, 70 aa, Triticum aestivum
  Clone ID: PAT_TA_55509.pep
MSAPVSNSGHLAYSGNISIGSGSSTTSTRSFAFPVLQKDWISSPVRMAKGERRCTRRRRGWRKGLLCCKF

SEQ ID NO: 161092 - protein, 79 aa, Triticum aestivum
  Clone ID: PAT_TA_55510.pep
NTPDKIYPGGFYYKTLAGFLHGGPRKKLNFNYTKPHFWSGELKPMDRNPCFAKFLAPGLNRINLLNLVTNKKTLFWVLP

SEQ ID NO: 161093 - protein, 68 aa, Triticum aestivum
  Clone ID: PAT_TA_55511.pep
MHQQTAFTVYSHLKQQLNTSTPAILSKQGVQNTGYDCNTTLQSHFYLNIGCLYLGLNVPLPFPQQPKQ

SEQ ID NO: 161094 - protein, 87 aa, Triticum aestivum
  Clone ID: PAT_TA_55512.pep
LSSWLLQDTPNVRDDSQPFLSRERQQKDAMELTMLKAFQMTRFGKHRASIYTQHDRFGKANYAEGIFQMQSSGYCHVPGAIAMVAFD

SEQ ID NO: 161095 - protein, 45 aa, Triticum aestivum
  Clone ID: PAT_TA_55513.pep
GFTARSPHHLCVNVNNLLYLNSDSLPSKVCCTLVLYMVNILTFTI

SEQ ID NO: 161096 - protein, 35 aa, Triticum aestivum
  unsure (1)..(35): unsure at all Xaa locations
  Clone ID: PAT_TA_55514.pep
NKSSFVKIGGYLRHIRXSHLASNXEYXLVTAVVRD

SEQ ID NO: 161097 - protein, 67 aa, Triticum aestivum
  Clone ID: PAT_TA_55515.pep
RGGVLIPQGFPAPQRGAVFPGSPRSVFQWFQAQRVQTPPLVKEGKLANLLAWRGEENSLQEGPVLCE

SEQ ID NO: 161098 - protein, 92 aa, Triticum aestivum
  Clone ID: PAT_TA_55516.pep
RQGRLLQVGRRQLRVFGGALRSGGSVSDVRAIQEVQAGGQGRRPQGRRTRAEHRASAKLVLNVFRVKTYNMAFIYASGVRGTCMCMLQNYCM

SEQ ID NO: 161099 - protein, 156 aa, Triticum aestivum
  unsure (1)..(156): unsure at all Xaa locations
  Clone ID: PAT_TA_55517.pep
QTAATPAVGVTTVDVQTAVTPAVXVTTVDVQTAARELQEQQDGMMYLDVRTEEEMGKGHIRGSLNVPYFFVTPQGVREKNPRFVEQVGSLFTTDQYILVGCQSGKRSELACVDLLAAGFMNVKNVGGGYAAWLHNGLPVTVEVPTPPPTPESAAAI

SEQ ID NO: 161100 - protein, 68 aa, Triticum aestivum
  Clone ID: PAT_TA_55518.pep
CMAHVPRRQPQGRAVALVARLCLALVMVVCRCDGEGPRIVAYAFWRALCNVQLSSSRCLCCLCTCGMR

SEQ ID NO: 161101 - protein, 230 aa, Triticum aestivum
  unsure (1)..(230): unsure at all Xaa locations
  Clone ID: PAT_TA_55519.pep
TMYSSNGWNSXSWAWDANADEVEVVVHNPGVTEDPACGPLIDSVAIKTLXPPRRTNKNLVKNGDFEEGPYIISGTKWGVLIPSRMVDEHSPLPGWMVESLKAVKYIDSDHFAVPRGRRTVELLAGRESAIAQVIRTVPGKQYALSFSVGDASNTCRGSLMVEAYAGRESTKVPYESAGQGGAAKRAVLPFRATSSRTRVVFFSSFYNTRTDDMSSLCGPVIDDVAVVSVR

SEQ ID NO: 161102 - protein, 76 aa, Triticum aestivum
  Clone ID: PAT_TA_55520.pep
QGIPKPAIRCFAWRGGVKRISGFIFKETPGVFKIFLEKVIRDPVPYPEHAPPKTVPPMDVVYGLKPQGGTLFGFGG

SEQ ID NO: 161103 - protein, 107 aa, Triticum aestivum
  Clone ID: PAT_TA_55521.pep
NTMPDHRQANNNPTGTMARGLAVAMLLLVAIAAVAPLSYAGSEVALTDGVATTTTTGESFSTGLPLYREIGKPAKDAANAAGDSVVSGGLASGLPLYQETGSGEKKA

SEQ ID NO: 161104 - protein, 124 aa, Triticum aestivum
  unsure (1)..(124): unsure at all Xaa locations
  Clone ID: PAT_TA_55522.pep
GPGRAYEWGGTKKSGRSSKGALISLAAGAPXPREVGPPPKTGWAPSLEALMVLKEHHPSPKKEGKNPPKKPPRISKKELGLSLLLLPAPAPSLLTKQGKPFYFLLFQGIPFLLGGLAPKGERVE

SEQ ID NO: 161105 - protein, 163 aa, Triticum aestivum
  unsure (1)..(163): unsure at all Xaa locations
  Clone ID: PAT_TA_55523.pep
RRHNNLHLXCPEIVRLGDINVDAYTLVMEQLRNAKALLEPVAVVRDGMGLSDREMAGDSTVSSIAHKQHFGPANQVQRVSQCSDSFGAPSKKRPAGRPTTSRDKALYEQPAKRSRFCSIRRGQGHKSTTCPQRSDLPKAPRKSPRCFRWSLTGHRRNTCTNTP

SEQ ID NO: 161106 - protein, 63 aa, Triticum aestivum
  unsure (1)..(63): unsure at all Xaa locations
  Clone ID: PAT_TA_55524.pep
PKAFAELKVKEIKNGPLPMFSMFGFFVQAIVPGKGPLXNLGGHIADPVNNNAWAFAPNFAPGK

SEQ ID NO: 161107 - protein, 106 aa, Triticum aestivum
  unsure (1)..(106): unsure at all Xaa locations
  Clone ID: PAT_TA_55525.pep
TQLSALLGLLFEXVKEAAFAQLKVWQSGAIAVIFFLSPSITLQAMLILMATALVISFGLFLLLTLVARSHQASEHEANPISVCRRCRRHHMVSDQQHLQPHWCIDL

SEQ ID NO: 161108 - protein, 56 aa, Triticum aestivum
  Clone ID: PAT_TA_55526.pep
FFFFFFFFFFFFFFFFFFFFFFFFFFFFFPKQENGKKPRGSPSPKLQSPPSKTKDP

SEQ ID NO: 161109 - protein, 105 aa, Triticum aestivum
  Clone ID: PAT_TA_55527.pep
LFEPPLLSWGGILKLFPRPMLNSTGKSPARQARVGSGCPWGVKLKGHREPGGFTRPPRSQSPPGRGKGRPPPFGPPPKVPEAPPGCCGCSPARDPRPSPVGTGQP

SEQ ID NO: 161110 - protein, 124 aa, Triticum aestivum
  Clone ID: PAT_TA_55528.pep
ACWLASPSWPPRPCCWWCAAPAASCRFAVGRVWPEKQLYSPRLMGRGVVDAVQAREPPALLAPPVPRRLPGALRLLPLDPSPIEAEFAAPSAWCPRCRPSLASRSGFAPLCASAAFAWAGRRVS

SEQ ID NO: 161111 - protein, 33 aa, Triticum aestivum
  Clone ID: PAT_TA_55529.pep
RPRCRKAGKSSLCPPGDGELSLGGRGHPEMRGL

SEQ ID NO: 161112 - protein, 138 aa, Triticum aestivum
  unsure (1)..(138): unsure at all Xaa locations
  Clone ID: PAT_TA_55530.pep
QRPVIVFTVGRTGPGELIAGLLHRGQYVGPNLPDEVYLSVYAPTGATDGNVSISFTGQVLESKEGALXVINQSFPXLGLTEGDLSEMSWVESTAXFSGLNTGGDLGNRGRQPKQYSKSKCDYLQAPISRDDMGXIFPD

SEQ ID NO: 161113 - protein, 115 aa, Triticum aestivum
  unsure (1)..(115): unsure at all Xaa locations
  Clone ID: PAT_TA_55531.pep
MGGGGGGGANPAEGVALALLAVAVVGAAEGDSLAGLAAXSTSAAPEVNELGPWAKGLLNGMPDGAAWPRAMEPVFKYPLXLAEDRTLRTDGFRHLTMCGGGWNITKLHYWASVSF

SEQ ID NO: 161114 - protein, 185 aa, Triticum aestivum
  unsure (1)..(185): unsure at all Xaa locations
  Clone ID: PAT_TA_55532.pep
PRVRAAWIKAGXADIERGRTRYLGIPGLAPAYSILRLWASALVADGLPRRATAWHGGLLIEIADPVYPGGSFDPLGLDEDPEALVELKXKEIKSGRLAXMFSMVGFLGQAIVTGXGPIKNLAXHLAEPVNDTSWAFATILIARDESAVSSTYMPTTCWLMDAAACVPHTISAYDRAEIENNGLID

SEQ ID NO: 161115 - protein, 168 aa, Triticum aestivum
  Clone ID: PAT_TA_55533.pep
PRVRERNGSSTVAIAKYIEDKHKAHLPANFRKFMLTQIKKLVAAGKLTKVKASYKLTKAPAAPKKPKTKAPAKKKPAAKKKAPAKKPAAKSPAKKKPAAKPKAKAPAKTTKAAAKPKAAAKAKAPAKTTKAGAKPKPAGKTKAPAKPGGRPAKAGKTSRKDAAGEKAP

SEQ ID NO: 161116 - protein, 136 aa, Triticum aestivum
  Clone ID: PAT_TA_55534.pep
FTGAKTTKKLSGPLGGLFSKGIKGRGPAPRGGETIWELPTKPSFDPLIKTPQKGKGEKKRKKKGWPNIHFLERHRNHPKGSYTNFGGAHYHLISGGTWPPYLGGFFFHFIRFFTTKGFGPHYFWWGYHYFRSPRCD

SEQ ID NO: 161117 - protein, 131 aa, Triticum aestivum
  Clone ID: PAT_TA_55535.pep
TRPRTRGKTGKFGALFASIPLPIFAGMYCVFFAYVAGACGLSFLQFCNLNSFRTKFILGFSFFIGISVPQYFNEYASVSGHGPVHTGARWLNDMINVPFSNKPLVAALVAYLLGNTMHLHHSAVRKDRGYH

SEQ ID NO: 161118 - protein, 67 aa, Triticum aestivum
  unsure (1)..(67): unsure at all Xaa locations
  Clone ID: PAT_TA_55536.pep
RAISISSLPRQXSTILLTSSVHLLPSARSNFPVLVIKSGPALLTATSPSLHLFSSSARSQHHLEGGT

SEQ ID NO: 161119 - protein, 85 aa, Triticum aestivum
  unsure (1)..(85): unsure at all Xaa locations
  Clone ID: PAT_TA_55537.pep
HASALRRRRSVLPATPMAIGICAFSLLXNITGNPEVRVNKMGRAAGVLENHEEGRRYAEHGLRAYVQDKTPEIMPGINKFFTSPK

SEQ ID NO: 161120 - protein, 173 aa, Triticum aestivum
  Clone ID: PAT_TA_55538.pep
RVRPRVRPAGANGWVAWALNPTGEGMAGAQALVALKGSGSAAPTVRTYNITGYVPLGKASTPIAFPATDLAADSGSGGKIRLYGKLQLHSGMKAVNHIWQVGTSVTAGAPDKHAFAAGNLASKSKLVLSGKADSAASPSPAPAPMAGGPSGSAGSDGGASATTVPSAGKSPSG

SEQ ID NO: 161121 - protein, 195 aa, Triticum aestivum
  Clone ID: PAT_TA_55539.pep
HASAGPFLLPLVLLALAKGQRVNAVFPLAQLGPALLLLLQASALAFRNEADGDIRYAVLEASTVSGVLHASLYLDAVVLPYYTGLEALRWSRFSGECASCLCRMEPLVVGGTAMRYRGLSKTALAIIFALCSRMVCRIYGEERLSAWTRSALEGVGWVFVAADAVYLVGWVAAEGGAVGVAAYSLVAGLVFLCVL

SEQ ID NO: 161122 - protein, 59 aa, Triticum aestivum
  Clone ID: PAT_TA_55540.pep
EVSFNPPDFKGMGKDHKPLLLRKIGVCPRTPRCRMSVMTCPAACSLVLKPRTRGRTRGS

SEQ ID NO: 161123 - protein, 128 aa, Triticum aestivum
  unsure (1)..(128): unsure at all Xaa locations
  Clone ID: PAT_TA_55541.pep
PRVRPRVRQFPTLPHLRPLSQREAPPETAMQAAASYRGAAGHRRAGHPSRRPPGPSLLLPGSGAGGGRFSDAAGXLRGGSLRRRXARGGGXGARRGARXGXAWRLARALGLILXGDHEMVHARLLETA

SEQ ID NO: 161124 - protein, 98 aa, Triticum aestivum
  Clone ID: PAT_TA_55542.pep
PRVRASAGDYYGDAAALYPTRRHLLGMHVGYATDDGHATLRMFTKGAKVDHDLHLWLLSTGQCIPAGQPEERGSLQSALEQMLTKMQHTTLRSAYRRC

SEQ ID NO: 161125 - protein, 155 aa, Triticum aestivum
  Clone ID: PAT_TA_55543.pep
MASDRLSHGGLRHMLTIAHIGLLSFGEQYVVADLRVLPVEEGHDAVTPLEAQFCIFRSDSPGGWPVIRHEKDQDRDLLWWSTDTVVPCDNFLCYVDYLRGILLGTVLNEDPHLLYIHLPVKVPIGDPTDPELGTRGCPHLLRSVCVTQGNVLMFV

SEQ ID NO: 161126 - protein, 186 aa, Triticum aestivum
  Clone ID: PAT_TA_55544.pep
RVRPRVRARELRAANSRLQQENSHLSRRLELTRLPPVPKSHNSMEVKTSEQVDGLKQENEKLSKEVEQLRTDRFADVEELVYLKWINACLRHELKNKGTPGPGAQTTAQDLSNTLSPKSEQTAKQLIMEYANVGADEKNLSSIEFGSEYASSRASSSGEPDDTSTDMSSITTPRNPKKKKRKKFFL

SEQ ID NO: 161127 - protein, 190 aa, Triticum aestivum
  unsure (1)..(190): unsure at all Xaa locations
  Clone ID: PAT_TA_55545.pep
FFQEKRQYSWERPGXKCEWQNDXNMGGEWFHTFGKWHGDADDKGIQTSEXYRLYTVSGDDPELNNKDKTLVLHFTVNHEHKLDCGGGYAKLLGCDADQKKFPGDTXSYSIMSGPDICRDSTKKDHTILTKGWENHLIKKDVPWETDPLTHEYTLIIRPDAIYSVLIDNVXKQTVSVYEDWDILPPRESRT

SEQ ID NO: 161128 - protein, 57 aa, Triticum aestivum
  Clone ID: PAT_TA_55546.pep
QRNQSLGTGHVHHQCIACASSSVVTHLTARRINTLPKILKKNQSLACSTATDKRTRG

SEQ ID NO: 161129 - protein, 187 aa, Triticum aestivum
  Clone ID: PAT_TA_55547.pep
MAPKADKKPAAENKVEKAAEKTPAGKKPKAEKRLPAGKTASKEAGGEAKTRGRKKGSKAKKGVETYKIYIFKGLKQVHPDIGISSKGMSIMNSFINDIFEKLAGESAKLARDNKKPTITSREIQTSVRLVLPGELAKHAVSEGTKAVTKFTSSTDGVQLVSASASVLLTLLIYLSASSGSSSSTCAG

SEQ ID NO: 161130 - protein, 71 aa, Triticum aestivum
  Clone ID: PAT_TA_55548.pep
NFDHTVGIPCSCSDLEALENYAGTPFLPSDSDLLLDSPDHDDIGNHDDIGNFACAVIYLGYELRINHHIYT

SEQ ID NO: 161131 - protein, 122 aa, Triticum aestivum
  Clone ID: PAT_TA_55549.pep
PSVRPRVRPRVRGRKVDLASCDNYHKLSTAVEELFRGFLEAQKDLSCDESGVRGAEEKIFSGLLDGTGEYALVYEDDEGDRMLVGDIPWSVFVSTAKRLRVMRRSELPQRMIGANSTKVADC

SEQ ID NO: 161132 - protein, 218 aa, Triticum aestivum
  unsure (1)..(218): unsure at all Xaa locations
  Clone ID: PAT_TA_55550.pep
MEPCTKQFLPMPPQDPNSPSSSTSSSSSSSTSPSHPYHRAQPPHPHNLPPSPRPVPRTIETTPFPTTFVQADTTSFKQIVQMLTGSEQSSKSAAAATTNGSAGNQAASGSGPCRPKKPSFKLYERRSSLKNLKMIAPLAMGAPPSPRNASAAPEILSPSVLDFPSLKLSSPVTPLTGDPFFPSPASSSGDAAERAGIADXGFFLHPSPRGAEPXRVLP

SEQ ID NO: 161133 - protein, 218 aa, Triticum aestivum
  unsure (1)..(218): unsure at all Xaa locations
  Clone ID: PAT_TA_55551.pep
TRPPTRPRTRGSAPKSAKKDSSSDDDSSDESSDDEPKKEVTTATKSQXKKPNTPASNKGQATGSKTLWMGNLSFNIEYDQVKQFFAQIGEVVDVRLATHEDGHPKGFGHVEFATAEDAQKALDSLNGGDLMGRPVRLDMAAERGASAPRTRDGGSFGKPSGGPSLSVFVKGFDSSQQEDAIRSSLKXHFSKCGEXTRVSVPMDYENGASKGIAYMDXT

SEQ ID NO: 161134 - protein, 67 aa, Triticum aestivum
  Clone ID: PAT_TA_55552.pep
PNERINSLTRTGKTSWIQEGLPPGPSTVIILESSCAISPQLTHYLITCFPYWQLELGISVQASSVIS

SEQ ID NO: 161135 - protein, 138 aa, Triticum aestivum
  Clone ID: PAT_TA_55553.pep
HASAEVKRLWALQMTNCKRHINKDYTTMLAMLVRLDDFEEAEVLLKEWESSENAFDFHVPNVLLTGYRQKDMLDKAEALLDDFLKKGKMPPSSSWAIVAIGYAEKGDAVKAYELTKNALCVYASRSGSVPGPAMIGMI

SEQ ID NO: 161136 - protein, 120 aa, Triticum aestivum
  Clone ID: PAT_TA_55554.pep
SNKKYWQRPYSTNWYCHSRIIVKVHTSYMGGCCPAKQRWYKQTKWHKAPVHTTRNQSHQQQPNFDQAALQAPFTFSPSSARSNFTEALGSRPSSQNQVRGRHHRHGCSKTTVIMLCGKLR

SEQ ID NO: 161137 - protein, 87 aa, Triticum aestivum
  Clone ID: PAT_TA_55555.pep
QEEGKPGIYVTCVLAASRFILVEMRFYEGLPWQEKLITDGSRSVFDESSAAAVCLQYDIYCICPFLMMGTVGVCNVNKFWPAPSGAC

SEQ ID NO: 161138 - protein, 199 aa, Triticum aestivum
  Clone ID: PAT_TA_55556.pep
MDFSKYLTEIETADAVLSHNGGVLIVVTGSLTMVDDFCQRFTQSFFLAPQDGGGYFVLNDIFRLITQRNLENGRTQKDGPVAQSVADPAPAVVVERSTTDLVADVDVQNPTVNGTTVQSNPTANGAVENKVEPPVKVTKEVPKKTSVAVPPSPPAQKDNPPPAQKDIPKKTPVAASPPPPSSAQKDVTKKTYASIVKVM

SEQ ID NO: 161139 - protein, 60 aa, Triticum aestivum
  unsure (1)..(60): unsure at all Xaa locations
  Clone ID: PAT_TA_55557.pep
KVPXISAHYPMHTNQSSPYLFHVSRPHSCRTENMLNRKPRPKGMALGAALAALSQQQRGW

SEQ ID NO: 161140 - protein, 82 aa, Triticum aestivum
  Clone ID: PAT_TA_55558.pep
APSSCSGSSRRLFIRRLPTCGRYLTIAVFSAVQATGVMILTISTVAPGLRPAACGDATVQDPDCVPANGTHFGVLYLGAVHD

SEQ ID NO: 161141 - protein, 111 aa, Triticum aestivum
  unsure (1)..(111): unsure at all Xaa locations
  Clone ID: PAT_TA_55559.pep
QERPTQLCLTLVPTADPAGNWDYKARHVTCRSCRTRLGCKGEAWMMLSSAEHEPPSGARAELKVTGRREGDRPAPRARRSHSKKAKGGNTGKRSTXEVAGEIMLWLKNERA

SEQ ID NO: 161142 - protein, 87 aa, Triticum aestivum
  unsure (1)..(87): unsure at all Xaa locations
  Clone ID: PAT_TA_55560.pep
FPPLRCRRFLGARVRPSAWRLFSVFPAPVRWRPPAVGRPRVPRAXCGGRXRCPRRCSWPGPRRPPLCCVAPSRPRAGFPFSPARPRG

SEQ ID NO: 161143 - protein, 147 aa, Triticum aestivum
  unsure (1)..(147): unsure at all Xaa locations
  Clone ID: PAT_TA_55561.pep
PSRKPLPAGGGGRRRXXEXHQKRXGRRXDHEERKRKKEARAGKKNXKEARKGRXAKGKRXAGRGXAEKAQXKKTXKXXDEXXXRQKGXXXXEEGAXXXXGREXEPTQXAKXXSXTXKQKRKEKXGKGEGXXPKXRPGXEEEKGKXXR

SEQ ID NO: 161144 - protein, 135 aa, Triticum aestivum
  unsure (1)..(135): unsure at all Xaa locations
  Clone ID: PAT_TA_55562.pep
GPGNSRVRPNAVPVYSCKPRLGIGLAVASFFRFVLVATVAXMLLVATXDAGIFCGQVTSAFSPFIFFSRGNGANPXLAFCNGVKSLAGATPSTAYKQAACKCIKNAAGGLNACKGAGIPFKCGGSGPYSINAYGD

SEQ ID NO: 161145 - protein, 111 aa, Triticum aestivum
  unsure (1)..(111): unsure at all Xaa locations
  Clone ID: PAT_TA_55563.pep
HAAAHAPEPEXGEXGGSXGXKTPAHSXRKKAGGXEREKEDPNTGKDXTRXKEKAKKAAXXQNNRGGAXEEQQKAANXEKKGPAANGNNTANRQTNNGGEAGPNRGGRHHNH

SEQ ID NO: 161146 - protein, 75 aa, Triticum aestivum
  Clone ID: PAT_TA_55564.pep
IRWPYRKTIRLEGRGSKLGFFKRAAPFFFFFFFFFFFFFFFFFFFFFFFFFFFFFFFFLGFFFFFFSPRVRGRWV

SEQ ID NO: 161147 - protein, 26 aa, Triticum aestivum
  Clone ID: PAT_TA_55565.pep
RVMSLPVSTSIPVQDDRYLKLACCQS

SEQ ID NO: 161148 - protein, 108 aa, Triticum aestivum
  Clone ID: PAT_TA_55566.pep
PDTARVTSPPGRQDMAKTMEVLLAAMMLALEVAAPAAAHAEREAAYLTARMLGITSCSKPLECQMPHPPVGRRGLVPLLHRPLHRPYIGSLKTRETLFYCGLSVPDCR

SEQ ID NO: 161149 - protein, 113 aa, Triticum aestivum
  Clone ID: PAT_TA_55567.pep
KRRFTHGEEDEATYLESKTSEALSTMMVSSRPTMSPLHPLTITPPATAFVICISESPSSQSTPSIYIPWSAFSAPAVNSSRSGVPVAAGFSCYRHGISALTASWQTSSSPASA

SEQ ID NO: 161150 - protein, 66 aa, Triticum aestivum
  Clone ID: PAT_TA_55568.pep
VLADKPGHREKRRVQLRWGADGATDKGETTMWRTYWRGEKPSFFLTAMLHHNQVLRIEYCKAAEET

SEQ ID NO: 161151 - protein, 136 aa, Triticum aestivum
  unsure (1)..(136): unsure at all Xaa locations
  Clone ID: PAT_TA_55569.pep
STQRPSADVVGDTGGGMGEWVRRPREHTALDDILPCVDTAAASEALGRSKEVNYRLVDVLNGVMSXXANLYFPPQAPLSPPLYYNQSGPPVPPLCNPYTPDLRDRACAPGEVAGPDAARQSWGGLVCRTADAGGSG

SEQ ID NO: 161152 - protein, 85 aa, Triticum aestivum
  Clone ID: PAT_TA_55570.pep
YACVPRSRSTPRPPTRPPTRPLKSNTVKFEPRLPEWKEEAMRELSVGVENKIVLHFSEVFWSSVEFLVVCPSSTYGCGCLTPCCH

SEQ ID NO: 161153 - protein, 94 aa, Triticum aestivum
  unsure (1)..(94): unsure at all Xaa locations
  Clone ID: PAT_TA_55571.pep
CMCKXEXXWGXMXVXXXFLFRXXXXXGLKKRXPPAPREXXAGTYTDPTFQHTQHKCQIRGRLWHVLVEKAGRRASAAPASFLDGAGPTTRPCLS

SEQ ID NO: 161154 - protein, 100 aa, Triticum aestivum
  unsure (1)..(100): unsure at all Xaa locations
  Clone ID: PAT_TA_55572.pep
ASRSWCSPPKCRLSPQRPNLCHRSQRCCRRRHHPYRXRPPPEPPPPSLSPPPPPSSERGRGRREYNERGEDQILTHWPTDSRRSDNGHAVNSRQRAPAAR

SEQ ID NO: 161155 - protein, 50 aa, Triticum aestivum
  unsure (1)..(50): unsure at all Xaa locations
  Clone ID: PAT_TA_55573.pep
KLAPSRSRGAVQIASTSMASATSRFMLAAGIPSGTNGGXSSRXSFXPSNL

SEQ ID NO: 161156 - protein, 69 aa, Triticum aestivum
  Clone ID: PAT_TA_55574.pep
NTVVFQYYSFCNTLLSNTALLVRETARNYRSSAALHRSDFLDPSPRRNFKMSARPPRLRSWKHSADGVG

SEQ ID NO: 161157 - protein, 116 aa, Triticum aestivum
  Clone ID: PAT_TA_55575.pep
STTSPASPRSSPARPPYDYVDLDLLTDPHIPTEDMTYIPNYHTPHLHYKHKDINLTHAITLLFANKPVTFFLPTNPDKIPSCQAVAYYHFYPTSLTPDNDTAITHLQGAPTNAAIS

SEQ ID NO: 161158 - protein, 65 aa, Triticum aestivum
  Clone ID: PAT_TA_55576.pep
PARPSVRATLLRALRCRGGLPRRHRDQDRLLQPIANYKLDRQWVSIMCSEEVAPSSIVYYRICSV

SEQ ID NO: 161159 - protein, 233 aa, Triticum aestivum
  unsure (1)..(233): unsure at all Xaa locations
  Clone ID: PAT_TA_55577.pep
TQRPEVXQELXEGVTGGAEXNKGKINFATIDAKAFGAHAGNLNLKTDKFPSFAIQEVVKNQKFPLXEEKDXXHDNIAKFVEQFDAGKIEPTIKSEPIPETQEGPVTVVVAKSYNDIVLDDTKDVLVEFYAPWCGHCKALAPKYDDLASQYAASEFKDKVVIAKVDATLNDVPDEIQGFPTIKLYPAGAKDAPVTYQGSRTVEDLANFVKENGKYKAEISIKDEGTEEAAPAPS

SEQ ID NO: 161160 - protein, 71 aa, Triticum aestivum
  Clone ID: PAT_TA_55578.pep
FWGPQKKNFKLQGRGSKIGSFKTGPPFPLFFFFFFFFFFFFFFFFFFFFFFFFFFFFFFFFFFFYTVINIK

SEQ ID NO: 161161 - protein, 94 aa, Triticum aestivum
  unsure (1)..(94): unsure at all Xaa locations
  Clone ID: PAT_TA_55579.pep
HNPXXFNXPNXFLNTKNDYNDGTFSHIIYNAVDMNLRDYLERLNKIRNHRGLHHYCDLLVRCHHTKTHPMRPNTVGVSKNNNSLHNDPPYLFYY

SEQ ID NO: 161162 - protein, 49 aa, Triticum aestivum
  Clone ID: PAT_TA_55580.pep
KGARLFFFFFFFFFFFFFFFFFFFFFFFFFPPLFPLGRGRTSGRRRGRR

SEQ ID NO: 161163 - protein, 92 aa, Triticum aestivum
  unsure (1)..(92): unsure at all Xaa locations
  Clone ID: PAT_TA_55581.pep
MARTKQTARKSTGGKAPRKQLATNSSRKSAPTXSGVXXPHLYXPXTXXLHKIHXYQKNXKLLIHKLPYQHXXQKITXNFKTNLXFQSHTKLT

SEQ ID NO: 161164 - protein, 76 aa, Triticum aestivum
  Clone ID: PAT_TA_55582.pep
PTRPKNKKKKKKKGRGGKKKKKKKKKKKKKKKKKKKKKKKKKKKKKKKKKGPPFLKKPNLTTPPIQGGGFLIFFPK

SEQ ID NO: 161165 - protein, 117 aa, Triticum aestivum
  unsure (1)..(117): unsure at all Xaa locations
  Clone ID: PAT_TA_55583.pep
MAMVASTSIAYHKPRLSVVCMKKDRDRELGGGKXHIFSFKVVKITPPPRCLGVRCFPTNIHCGESVTIEGXAYTVSAVTHRYQLRKGRYQPSEKRLDVLSTGRYILNLYLDSLLDKS

SEQ ID NO: 161166 - protein, 208 aa, Triticum aestivum
  unsure (1)..(208): unsure at all Xaa locations
  Clone ID: PAT_TA_55584.pep
LDELVEEILLRLPPEDPACLLRASVVCKGWSGIVSHPGFRRRLRGRGGVPPVLGFLHNWKDDFIPRFISTTASSFSLAAPDRRAWGALDCRHGRALFFPQGFGGLELLLWEPMTGAQQRIPVPAGFKGDYPTAAVLCAADGCDHRDCLEGPFRVVFLFVVVVDEETSIYXSETGAWGELTSVQCTLDFSIEFTESYSVLVDRSVLYFT

SEQ ID NO: 161167 - protein, 71 aa, Triticum aestivum
  Clone ID: PAT_TA_55585.pep
KKKKKKKKKKKKKKKKKKKKKKKGGNGKKKQKIKKHKKKKGGGGQKGFVKLKKMKRNLTTGGKGKTLKKPN

SEQ ID NO: 161168 - protein, 65 aa, Triticum aestivum
  unsure (1)..(65): unsure at all Xaa locations
  Clone ID: PAT_TA_55586.pep
WWQXRGVGAGXNNVRAKLKPLTSANWSSKACKVELCKSTRTEPGSPIYSNKIASDFGWGGPFXLF

SEQ ID NO: 161169 - protein, 53 aa, Triticum aestivum
  unsure (1)..(53): unsure at all Xaa locations
  Clone ID: PAT_TA_55587.pep
KTPPPWIPRWXCSYYFDASINPLFLTTDLVGLYLTTISIQSPTLIHWAARQST

SEQ ID NO: 161170 - protein, 77 aa, Triticum aestivum
  Clone ID: PAT_TA_55588.pep
KKKKKKKKKKKKKKKKKKKKKKKKKKKKKKKKKKKKKKKKKKKKKKKKKKKKRGGRFLGAQFFPPGPAPGWFFFWGP

SEQ ID NO: 161171 - protein, 91 aa, Triticum aestivum
  unsure (1)..(91): unsure at all Xaa locations
  Clone ID: PAT_TA_55589.pep
PLLSPSPLSLRLLLSVCSAPPPSFLLFFSVSRLRPLVRSGSVPXCCAVLPRCRRPCPVGRLGPPCPWFFPSPRPPSGPXRPSGRXAWVXPG

SEQ ID NO: 161172 - protein, 52 aa, Triticum aestivum
  Clone ID: PAT_TA_55590.pep
PPHPSCQRAGNHFAITEPGSGTSETIPPSPNDTPPDARMTSIPNAGRPLRSS

SEQ ID NO: 161173 - protein, 72 aa, Triticum aestivum
  unsure (1)..(72): unsure at all Xaa locations
  Clone ID: PAT_TA_55591.pep
TQRPDGSXALCSASCGGGRGTPNPSSDLRRTLPPSPRTLNIPRNPTNQLHKQQTRITPPIQLPTIEDNDPTN

SEQ ID NO: 161174 - protein, 111 aa, Triticum aestivum
  unsure (1)..(111): unsure at all Xaa locations
  Clone ID: PAT_TA_55592.pep
YSSNNRWISCPAWVRSXSTPSTSSEMRSXGXGXTXDPSKKKSVAPLLVVAXXDEVTGSGRDGLXAGEHMIKPKLADTKLLWRCXKEGARGPAGAPPAHGRTRGKEIPGRWV

SEQ ID NO: 161175 - protein, 126 aa, Triticum aestivum
  unsure (1)..(126): unsure at all Xaa locations
  Clone ID: PAT_TA_55593.pep
VRGVSRPWPRAPARRRPQRRPAAGGLRPAPGPRRPPPRRARLPPLPPRRPQRRLPPPLPPPAPLHLPAPPRLPPPPPRRAPREQRPSPAXPLPPPPPRAGSPSAATSPSPSSPAAAGRAPTXPEPR

SEQ ID NO: 161176 - protein, 77 aa, Triticum aestivum
  unsure (1)..(77): unsure at all Xaa locations
  Clone ID: PAT_TA_55594.pep
MRVLVLGLSTGAGIFYSVLGAAMVGQRIXRRHYHMLANRMLAEEYXLRYMVTPDRAEWSTTPLPAAHVQQLISLILL

SEQ ID NO: 161177 - protein, 80 aa, Triticum aestivum
  Clone ID: PAT_TA_55595.pep
LCPGSYDCKTGCYPAGGSKRVTYSKYSSCVLVHMTARLAAIQQVEVRGRASSSFVLCVISCVLLCLMKNLVFMKCHIPQV

SEQ ID NO: 161178 - protein, 158 aa, Triticum aestivum
  unsure (1)..(158): unsure at all Xaa locations
  Clone ID: PAT_TA_55596.pep
QYLLVLQGWSYVGDRLLSAVVPYEETGWYDGQMWVKPAEVLARDRLLGSYKVKPVINLLKQTLVGTGALLVGAVALFAFAAPVEEFVHSFNGAPTAASSKPMMRREDLLKLPAEVRQDDDLAAAAAEAANGXRPVYCRDRYYRALXGGQYCTSDDLLN

SEQ ID NO: 161179 - protein, 229 aa, Triticum aestivum
  Clone ID: PAT_TA_55597.pep
KRKHEHDEVPHTSPALPSAQVQQPQLQPTVSNNRCFLHYLPDLRQAKEIAYNSCQLKPKVEVSDYFDSPSAKLIGKFFSEAGPEPGVLHSSSLREMVVFPQGPGAVMPTYEAVLQEQLRETENRAKELKQEWQTSGCTVIVDSWKSKCDKSFVSVLVQCSKGTQFLRSIDVSEITEDFDELESMLSCVVEDVGAHNIVQIVMNDVSPHMQMAREYVLNKYDSFFLRAMC

SEQ ID NO: 161180 - protein, 110 aa, Triticum aestivum
  Clone ID: PAT_TA_55598.pep
GYKVSALTGCRAMVKLQCVGSQVPEAVLRDCCQQLADINNEWCRCGDLSSMLRSVYQELGVREGKEVLPGCRKEVMKLTAASVPEVCKVPIPNPSGDRAGVCYWAAYPDV

SEQ ID NO: 161181 - protein, 215 aa, Triticum aestivum
  unsure (1)..(215): unsure at all Xaa locations
  Clone ID: PAT_TA_55599.pep
QLPPFSQQQPPLSQQQQPVLPEQPPFSYQQQPILPQQPPFSXQQQQQPVLPQQQIPFVHXSILQQLNPCKVFLQQQCSPVAMPQSLARSQMLQQXSSCHVMQQQCCQQLPQIPQQSRYEAIRAIIYSIILQEQQQVXQGSIQSQQQQPQQLGXQCVSQPQQQSQQQLGQQPQQQQLAXXTFLQPHQIAQLXRVMXTSIALRTLQTMVPWSWWPVV

SEQ ID NO: 161182 - protein, 209 aa, Triticum aestivum
  Clone ID: PAT_TA_55600.pep
KDILCSILSRLPIKEAVRTSILLEHWKHLWRCHSNLEFSLRSMFPGPRTNGPNDVRPWKDVFIERVDAVLQQHSGAGVDNIQFQAPCDDEHGDRIEGWVRFATASKTKQLILDFSATHHIEQHPYKIDLRLLDDSKSSHLQSIKLCSVSLKVPADFKGFRNLKWIFLADTNITDGDLHHFGVHCSGIFGSSLESLGCDAEGYIYHLFQA

SEQ ID NO: 161183 - protein, 172 aa, Triticum aestivum
  unsure (1)..(172): unsure at all Xaa locations
  Clone ID: PAT_TA_55601.pep
GQPGYYPTSLRQPGQWQQPGQGQQPGQGQQGQQPGQGQQSGQGQQGYYPTSLQQPGQGQQLGQGQPGYYPTSQQSEQGQQPGQGKQPGQGQQGYYPTSPQQSGQGQQLGQGQPGYYPTSPQQSGXGQQSGPGQQGYYPTSPXQSGHGHHPXHGHLGCFPPSRSQSGHGSAPG

SEQ ID NO: 161184 - protein, 119 aa, Triticum aestivum
  Clone ID: PAT_TA_55602.pep
PELAWRVAAPPSASHVVPNAAGRTLCMGSQRHAVDIRSEQRREDPVRWKQHWPWFSKGMYWARTAVKDISPAAARGPARRHRRPCRWLRRPLLSERTTVAGAAAGESTCAAGSARRPSR

SEQ ID NO: 161185 - protein, 32 aa, Triticum aestivum
  Clone ID: PAT_TA_55603.pep
EQYSFQGLWGCNCTVLVLVAPNKVNIFPFCSC

SEQ ID NO: 161186 - protein, 98 aa, Triticum aestivum
  Clone ID: PAT_TA_55604.pep
WVSLFHVRWLMVTMEPSYTRFITLHDGACIWALIAESLWRIVLRIRPIIRCWITSIWVLVVLLISIVRVCVSVGCWVVVVLVVAVHGHLLSLRRHRNK

SEQ ID NO: 161187 - protein, 261 aa, Triticum aestivum
  unsure (1)..(261): unsure at all Xaa locations
  Clone ID: PAT_TA_55605.pep
PGQGQSGYFPTSRQQSGQGQQPGQGQQSGQGQQGQQPGQGQQAYYPTSSQQSRQRQQAGQWQRPGQGQPGYYPTSPQQPGQEQQSGQAQQSGQWQLVYYPTSPQQPGQLQQPAQGQQPAQGQQSAQEQQPGQAQQSGQWQLVYYPTSPQQPGQLQQPAQGQQGYYPTSPQQSGQGQQGYYPTSPQQSGQGQQGYYPTSPQQSGQGQQPGQGQQPRQGQQGYYPISPQQSGQGQQPEQGAQGYYPTXSQQSGQGQXPGHEQQ

SEQ ID NO: 161188 - protein, 154 aa, Triticum aestivum
  Clone ID: PAT_TA_55606.pep
AIWCACKKVPCDNCRCYGSRQTPLVRELSWLGSPVSRTVHRSCEKYVGVPPTRCSFCSTTKRKTAQFVIDPAVLLSSSFQRPSYLAISVSKSMPRQITNCNLSPPEGQNHTGIYDSDPLEARLPSCTLLIVLSWRTAYWMMTRETWSLSKQPGS

SEQ ID NO: 161189 - protein, 148 aa, Triticum aestivum
  Clone ID: PAT_TA_55607.pep
LSFYFRRCPDDTYDRLWWPSNGTSRWLNLSTTSEIKRYLTDTAEVPIRVLQTAVTSLTTSIPLNLSWAVPSAWPAMAPPGYYLNLYYTDFQNQSRREFDIYYNGFLWETNNRPVSPTYLFADYTAATALFTDASGFYNVSIIATNTSV

SEQ ID NO: 161190 - protein, 245 aa, Triticum aestivum
  unsure (1)..(245): unsure at all Xaa locations
  Clone ID: PAT_TA_55608.pep
NNSFPPQQPYPQLQPFPSQQPYMQLQPFPQPQLPYPQPQLPYPQPQLPYPQPQPFRPQQSYPQPQPQYSQPQQPISQQQQQQQQQQQQQQILQQILQQQLIPCRDVVLQQHSIAHGSSQVLQQSTYQLVQQLCCQQLWQIPEQSRCQAIHNVVHAIILHQQQQQQQQQQPLSQVCFQQSQQQYPSGQGSFQPSQQNPQAQXSVQPQQLPQFEEIRNLALETLPXMXHVYIPXYCTIAPVGILGTN

SEQ ID NO: 161191 - protein, 219 aa, Triticum aestivum
  Clone ID: PAT_TA_55609.pep
PGELQQRQTVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLQR

SEQ ID NO: 161192 - protein, 133 aa, Triticum aestivum
  unsure (1)..(133): unsure at all Xaa locations
  Clone ID: PAT_TA_55610.pep
VELYLCAGGHTGIIXLATVLTATPSTNALGAKXILALTKRTQEHVPEIDKTKAGKASASLPMVYAVACFEYTCLKLLXGDPDIVERLYGPLTVTELPFFACIVTLVTDGTLEVLLLDQLTAAPEGYASVTLMM

SEQ ID NO: 161193 - protein, 81 aa, Triticum aestivum
  unsure (1)..(81): unsure at all Xaa locations
  Clone ID: PAT_TA_55611.pep
CIHLDDPAPNRWGMATEGTELCSDIWSCSXMXICCTRRNCVXTRMSGRNHALYFAITVSMLPEIINSMLLTTWLRFNEINL

SEQ ID NO: 161194 - protein, 207 aa, Triticum aestivum
  unsure (1)..(207): unsure at all Xaa locations
  Clone ID: PAT_TA_55612.pep
PGQLQQPAQGQQGQQPGQGQQGQQPGQGQQPGQGQQGQQPGQXVQQPGQGQQGQXLGQGXQQGYYPTSLQQSGQGQPGYYPTSLQQLGQGQSGYYPTSPQQPGQGQQPGQLQQPAQGQQPEQGQQGQQPGQGQQGQQPGQGQXPGQGQPGYYPTSPQQSGQGQPGYYPTSSQXPTQSHQPGQGQQGQYVGQGQHGYCWKYALEAIIN

SEQ ID NO: 161195 - protein, 99 aa, Triticum aestivum
  Clone ID: PAT_TA_55613.pep
RHVLNYTLIRISSSSKAYHCSFTSLQFRKRWAPSSNNQGPLNHLYANNISQYSDRHDHRHLRHPLPSSCWFSPARLPSPPQPPPRRCMTATDHRQLHGR

SEQ ID NO: 161196 - protein, 220 aa, Triticum aestivum
  Clone ID: PAT_TA_55614.pep
YLSNAEVQISSWRIPIWEKSKICFYVMDHPATESGEAVGIHGGEIEIEKLALHEVELRRELLPVFKQFHYPEQNRNHASRQIQNALSGIDSTQYSSAKDSDAYGPKPVPHISGFYTDMRKTENMNVLAGQLFSGPTPAVDLLPKEKCNSIGSPEARNLTVNHKVDNGSIGYLSTPIGTNVSTIMPQSREGVDCVPSHIRPLSNYSLLDGPLDNGSPSPCQ

SEQ ID NO: 161197 - protein, 53 aa, Triticum aestivum
  Clone ID: PAT_TA_55615.pep
WEEGEAAPAKRFKAADHAPAHANKKVYASIFTSSNKSDFRETYSCRSLPLGRN

SEQ ID NO: 161198 - protein, 191 aa, Triticum aestivum
  Clone ID: PAT_TA_55616.pep
YPQTQPFPPQQPYPQPQPQYPQPQQPISQQQAQQQQILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGSFQSSQQNPQAQGSVQPQQLPQFQEIRNLALQTLPAMCNVYIPPYCSTTIAPFGIFGTN

SEQ ID NO: 161199 - protein, 102 aa, Triticum aestivum
  unsure (1)..(102): unsure at all Xaa locations
  Clone ID: PAT_TA_55617.pep
QPGQXQPRHEPTGPHETGQGQQPGQRQQPPQRQQPQQRQAAPTKRPKPNGRTNRGAAREANGTRGEEEQEARRERGGRAERARHPRAPNRPSRGGTDRARPR

SEQ ID NO: 161200 - protein, 200 aa, Triticum aestivum
  unsure (1)..(200): unsure at all Xaa locations
  Clone ID: PAT_TA_55618.pep
MEWQIFPETTLQLTVSDRLRASGVVHGLVYWRGWMYDQIVVLDTATFQFSLIDLPTPLKPELGESTYKLGETKDGKLCIVDIKDNTIVSWFLDNGSVIERWISYKNFPLRPIVRELTGCSMEEEDYCNVNVDLVAVIDGFVYICIFYLKDTEXGESYLSICLETSDMCELYNGAYRHNEAAHPYVMAWPPSLVQAGRNQN

SEQ ID NO: 161201 - protein, 210 aa, Triticum aestivum
  unsure (1)..(210): unsure at all Xaa locations
  Clone ID: PAT_TA_55619.pep
VFVVLFGANVSLRGSVSQQQQPVLPQQPPFSQQQQPILPQQPPFSQQQQQPVLPQQQIPFVHPSILQQLNPCKVFLQQQCSPVAMPQSLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRTLPTMXRVNVP

SEQ ID NO: 161202 - protein, 256 aa, Triticum aestivum
  unsure (1)..(256): unsure at all Xaa locations
  Clone ID: PAT_TA_55620.pep
GYYPTFLPHXDKASSPALWQQRXHGQPLYYPTVXLLHPGQGQRRDSTHILLRISQQLGPEPGQMQQPVQRHQGQDLTQGHARADSQRKMHQGHLSAQGQQGQKLLQGRHGQLSAQGHXPAQGHRGQQPGQGQQGQRPAQGQQPGQGQPWYYPTSSHESGQGQQPGQWQQPGQWQQPVQGQPGYYLTSPLQLGQGQQGYYPTSLQQPGQGQQPGQWQQSGSGQHGYYPTXXRHLSGQGARPGQWLQPGQGQQGYYLT

SEQ ID NO: 161203 - protein, 67 aa, Triticum aestivum
  Clone ID: PAT_TA_55621.pep
YKTDLHIEEVATHLPSWILMPAPNGRCVVAVVIMLPQLLLLALSQTPGATCTTGTKCSSSYASASLP

SEQ ID NO: 161204 - protein, 90 aa, Triticum aestivum
  Clone ID: PAT_TA_55622.pep
THRAKLTLESVPNATIHANHTNTHTSQGTRSAEQAALPSLPERSHEALSRGDEETSIPHACNSCNPHDMRSLSSKLQSPRGRLQNVRTRG

SEQ ID NO: 161205 - protein, 214 aa, Triticum aestivum
  Clone ID: PAT_TA_55623.pep
PGITSKNLPEIAHHSNFSSHLQSYKLDHAKAGSGFLSISFLPTVQPLTSSEVSSVVNGSAVTLAAQGLESDSVRDKALEIVSVHEKGLKVDSTLDTLREPGSTQLEAVPAKGEESSLKNDAQSSLGPLCYQIPNMNDVAPASSSLFSEHQTVHQTSEHCRNGALSPNGCTTPTKGTMSVQLSVDSILKIAADSFPVTPSILRRRNEKDRHLLVI

SEQ ID NO: 161206 - protein, 230 aa, Triticum aestivum
  unsure (1)..(230): unsure at all Xaa locations
  Clone ID: PAT_TA_55624.pep
QQPYPQPQPFPSQQPYLQLQPFSQPQLPYSQPQPFRPQQPYPQPQPQYSQPQQPISQQQQQQQQQQQQQQQQQQEQQILQQILQQQLIPCMDVVLQQHNIARGRSQVLQQSTYQLLQELCCQHLWQIPEKLQCQAIHNVVHAIILHQQQKQQQQLSSQVSFQQPQQQYPLGQGSFRPSQQNPQAQGSVQPQQLPQFEEIRNLALQTLPGMXHVYIPSYCTIAPFGIFGTN

SEQ ID NO: 161207 - protein, 109 aa, Triticum aestivum
  Clone ID: PAT_TA_55625.pep
ALLTLFFKKKKKKKKKKKKKKKKKKKKKKKKKKRGDSYKGSKLTKPGHAKKKNIKWGALIKIPWLWFYTVGTGKSLRGPNLFALGGCFFRGGGKTQGPPTIALWKSCPF

SEQ ID NO: 161208 - protein, 242 aa, Triticum aestivum
  Clone ID: PAT_TA_55626.pep
PGQQQQFPPQQPYLQLQPFSQPQLPYSQPRPFRPQQPYPQPQPQYSQPQQPISHQQQQQQQQKQQQQQQQQQQQQQQQHHQQQQQRQQQQILQQILQQQLIPCMDVVLQQHNIAHGSSQVLQQSTYQLLQELCCQHLWQIPEQSQCQAIHNVVHAIILHQQQKQQQQPSSQISFQQPQQQYPSGQGSFRPSQQNPQAQGSVQPQQLPQFEEIRNLVLQTLPARCNVYIPPYCTIAPFGIFWY

SEQ ID NO: 161209 - protein, 218 aa, Triticum aestivum
  Clone ID: PAT_TA_55627.pep
MKTFLILALLAIVATTATIAVRVPVPQLQPQNPSQQQPQEQVPLVQQQQFPGQQQPFPPQQPYPQPQPFPSQQPYLQLQPFPQPQLPYPQPHLPYPQPQPFRPQQPYPQPQPQYSQPQQPISQQQQQQQQQQQQQILQQILQQQLIPCRDVVLQQHSIAHGSSQVLQQSTYQLVQQLCCSSWADPDSAVPAITCVCLFAHTHTHTHTHVTRLSQLHIS

SEQ ID NO: 161210 - protein, 229 aa, Triticum aestivum
  Clone ID: PAT_TA_55628.pep
PQQPYPQPQPFPSQQPYLQLQPFLQPQLPYSQPQPFRPQQPYPQPQPQYSQPQQPISQQQQQQQQQQQQQQQQQQQIIQQILQQQLIPCMDVVLQQHNIVHGKSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 161211 - protein, 145 aa, Triticum aestivum
  unsure (1)..(145): unsure at all Xaa locations
  Clone ID: PAT_TA_55629.pep
WNTFLVFALIRALWATSAIAQXMETSCISGLERPSHEHPLPPQQLIFTTIHQFSQPLLHPLPLQPSFXSQQQPPFSQQQPPLSQHPRFSQPQQPALPHLSPFSQHHHLVLPPLLRPNNLRXWRMRIVLPFVLLQLCPCDSVPCLH

SEQ ID NO: 161212 - protein, 73 aa, Triticum aestivum
  Clone ID: PAT_TA_55630.pep
LQPLPCRPRRPPVPSLYAVVPHHLADEGDKLRRGGRRIEPHPSCFFVRYPSCIICNSFVSTLCNPFVGNLFVP

SEQ ID NO: 161213 - protein, 269 aa, Triticum aestivum
  Clone ID: PAT_TA_55631.pep
HYLASQQQPAQGQQGHYPASQQQPGQGQQGHYPASQQQPGQGQQGHYPASQQEPGQGQQGQIPASQQQPGQGQQGHYPASLQQPGQQGHYPTSLQQLGQGQQIGQPGQKQQPGQGQQTGQGQQPEQEQQPGQGQQGYYPTSLQQPGQGQQQGQGQQGYYPTSLQQPGQGQQGHYPASLQQPGQGQPGQRQQPGQGQHPEQGQQPGQGQQGYYPTSPQQPGQGQQLGQGQQGDYPTSPQQPGQGHNPDQGHQGHCPMSPAATQDKRHQLG

SEQ ID NO: 161214 - protein, 118 aa, Triticum aestivum
  Clone ID: PAT_TA_55632.pep
TVPCPHFLNSSHATCSILPVAMQPCLPGHDAIGLDVMHGPIELPPYLLRSSPYDPLQSSRSCFFPTQLLHRRRSAKGAAAGSQAHLPHCYRSASMWSVHDPRETQSSNINEKGKVPTF

SEQ ID NO: 161215 - protein, 87 aa, Triticum aestivum
  Clone ID: PAT_TA_55633.pep
AILQRDTLPDRPRHLLPWPGSSNPGRLSIRIRFGGSIPCPWNGGGFLHQHHAARWHQQQPEHLQKTILDHSYFLFTPKVDLFICCDT

SEQ ID NO: 161216 - protein, 238 aa, Triticum aestivum
  unsure (1)..(238): unsure at all Xaa locations
  Clone ID: PAT_TA_55634.pep
RPSGKVKQPGTRHNKGYYTNLLRNSAGQGQQLGQGQPGYYPTSPQQSGQGQQSGQGQQGYYPTSPQQSGQGQQPGQGQSVYFPTSRQQSGQGQQPGQGQQSGQGQQGQQPGQGQQAYYPTSSQQPGQLQQPAQGQQGYYPTSPQQSGQGQQGYYPTSPXQSGQGQQGYYPTSPQQSGQGQQPGQGQQSRQGQQGYYPISPQQSGQGQQPGLGQQGYYPTSPQQSGHGQQPGHEQQPGQ

SEQ ID NO: 161217 - protein, 91 aa, Triticum aestivum
  Clone ID: PAT_TA_55635.pep
VHAIILHQQQKQQQQLSSQVSFQQPQQQYPLGQGSFRPSQQNPQAQGSVQPQQLPQFEEIRNLALQTLPAMCNVYIPPYCTIAPFGIFGTN

SEQ ID NO: 161218 - protein, 241 aa, Triticum aestivum
  unsure (1)..(241): unsure at all Xaa locations
  Clone ID: PAT_TA_55636.pep
MAKRLVLFVAVVVALVALTVAEGEASEQLQCERELKACQQVMDQQLRDISPECHPVVVSPVAGQYEQQIVVPPKGGSFYPGETTPPQQLQQRIFWGXIPALLKRYYPSVTSPQQVSYYPGQASPQQGQQPGQGQPGYYPTSLQQLGQGQSGYYPTSPQQPGQGQQPGQLQQPAQGQQPEQGQQGQQPGQGQQSGQEQQGYDNPYHVNTEQQTASPKVAKVQQPATQLPIMSDGKGGDRIVG

SEQ ID NO: 161219 - protein, 60 aa, Triticum aestivum
  Clone ID: PAT_TA_55637.pep
YCLGTLDLEIVAESACVCFEEHGGMYIGQVQPWPISHHVFVFSGLLSFGYLSNLICCRYF

SEQ ID NO: 161220 - protein, 68 aa, Triticum aestivum
  Clone ID: PAT_TA_55638.pep
GAPKKKIKNFANTGGRKLGSPKKARPLFFFFFFFFFFFFFFFFFFFFFFFFFFFFFFFFFFFFFFFFF

SEQ ID NO: 161221 - protein, 54 aa, Triticum aestivum
  Clone ID: PAT_TA_55639.pep
SSVPTLLYACIRRSSCSMLTPTCMRLDGSFQGSDWYNPVAAHLHRLDWHTPVVS

SEQ ID NO: 161222 - protein, 192 aa, Triticum aestivum
  Clone ID: PAT_TA_55640.pep
KKKKKKKKKKKKKKKKKKKKKKKKKKKKGKKKKKKKKIKKQKHEKEKKKNLKKTWGAVFWGALFPRPGLWKPLGFPFGTPNFNSFAFPLLPYWGGGPGRSPFFLVGQPFCFLGRAFLGGVPPRWPVCRKLAAFLLDLAPPFGPVLWGGGWGGPPLGPFPCGRSYGGSFGVSAFVFCGAAAFSPLILERGLLL

SEQ ID NO: 161223 - protein, 38 aa, Triticum aestivum
  Clone ID: PAT_TA_55641.pep
ASKTGADSPGGKTFLTNVRCAETRGVPEAGPGVQLLLF

SEQ ID NO: 161224 - protein, 174 aa, Triticum aestivum
  Clone ID: PAT_TA_55642.pep
GENRGRGPETQRKKAKKQESRALARGGGGPGEKAKHEGGKGPEPGGDKRPKRANHQRERATGRAAKANPQPGKRGNAARQRKWGRGGEFPRAPRGKPQAPGRQKKGGREKAVTRRQTTGQASGEAIEAPGAPLSRFHHLIFFVFINFFIFLFFFFFFFFFFFFFFFFFFFFFFF

SEQ ID NO: 161225 - protein, 92 aa, Triticum aestivum
  unsure (1)..(92): unsure at all Xaa locations
  Clone ID: PAT_TA_55643.pep
FFVCKQHSRGGACAPTRHLPRGGGAATPIKKGDPRGSQKXXKEPVQTQIATKGLNRERTGVAHTRTLAWNRQSTRPMLHHRIAKTSPPRVRE

SEQ ID NO: 161226 - protein, 24 aa, Triticum aestivum
  Clone ID: PAT_TA_55644.pep
NISQKQRRNPHKLTVSLLSRRPPS

SEQ ID NO: 161227 - protein, 159 aa, Triticum aestivum
  Clone ID: PAT_TA_55645.pep
NKKKRGGRFLGVPIFTSPSWRGFTFFLVPLILIYRPFVFHRGAGETLAFPHFIRFATLPLFAGWLFSEGARPVGLSKNLPILIGIWPPPFPGPLTAGVLVFPPWVPFPFAGPFGPFLLGFFLFFLPTFAGFPLNFLNGGLLLGFRFMVFRPLSPKNLFG

SEQ ID NO: 161228 - protein, 95 aa, Triticum aestivum
  Clone ID: PAT_TA_55646.pep
EKKKKKKKKKKKKKKKKKKKKKKKKKKKKKKKKKKKKKKKKKKKKKRGRALLGEPNFPSPVLPKVLTFFLGPPKLNSPGRGFKTVGPGKPRGSPN

SEQ ID NO: 161229 - protein, 52 aa, Triticum aestivum
  Clone ID: PAT_TA_55647.pep
MRCSRGVLTRFVSHSWPLHFMWLFSGACARVPYWCVSLRPFKCVSARATLPL

SEQ ID NO: 161230 - protein, 75 aa, Triticum aestivum
  Clone ID: PAT_TA_55648.pep
QYRITSEPKAYNCNNLRSLTSELTNMNSLGLTVSYLTHIPGVPLTLMYPATKPERPAAFMNPARLFYRPVTHSTA

SEQ ID NO: 161231 - protein, 60 aa, Triticum aestivum
  unsure (1)..(60): unsure at all Xaa locations
  Clone ID: PAT_TA_55649.pep
MFAWEKKICQXQYALTLTPRNSWTHTIEAPKYVCTTFRLARRQSYRRPANIDLSLPHPHR

SEQ ID NO: 161232 - protein, 58 aa, Triticum aestivum
  Clone ID: PAT_TA_55650.pep
FAIATGGGVLSLTVLVFGQAPPPGRAPGRKTFFFLSIYTLGACGGGRRSYLISCALSS

SEQ ID NO: 161233 - protein, 71 aa, Triticum aestivum
  Clone ID: PAT_TA_55651.pep
FKKKKKKKKKKKKKKKKKKKKKKKKKKKKKKKKKKKKKKKKKKKKKKEKKKKKKKKREKKRKKGGGGRIVA

SEQ ID NO: 161234 - protein, 83 aa, Triticum aestivum
  Clone ID: PAT_TA_55652.pep
MWVRGAKAREKGPRSPLFPVLYVVRPTGLVILGFTYTTEPITLHFCVHVVLGSFILYRPFFFFFFFFFFFFFFFFFFFFFISD

SEQ ID NO: 161235 - protein, 123 aa, Triticum aestivum
  unsure (1)..(123): unsure at all Xaa locations
  Clone ID: PAT_TA_55653.pep
FQYTGPKFTTLALGKQRRDRNKPGGTKFIFLQVDSYLTGWHNTEXAPPRSPLXQMGRPLGQWNKPCSGALNAQGEGYTRKGTSSLSIALLPFLFGHFPXFFPTSSKFPAQSINPRHRLRVPLT

SEQ ID NO: 161236 - protein, 177 aa, Triticum aestivum
  Clone ID: PAT_TA_55654.pep
KKKKKKKKKKKKKKKKKKKKKKKKKERKAKKKKKKKRKRQRKRNKQGRGPHVEWAGANPCREPGGGGPFSSPFPKPSGPGEGERHRAGPPPPRGRARTEWRIGTRPPPPIGARPGEGRTRCGSPAVATPLGPGPSPPFPPLPAGGGGVPPRAAPRGRPAGGPIEGWPAPPPRRPGGG

SEQ ID NO: 161237 - protein, 174 aa, Triticum aestivum
  Clone ID: PAT_TA_55655.pep
YLKKKKKKKKKEKKKKKKKKKKKKKKKKKKKKKKKKKKKKKKEKEKKKKKKREKKKKKQKKRKRGGGGAFWGRFGAPPQGGQGGKFFFCARRPLVCGGGGLNPFAGGGPGQERKNGTPRGGGPFRAGGVVVRGQNRSPPKGGYLLLVRPPLGFLAKSGGGGGGPSGGGAFWGGP

SEQ ID NO: 161238 - protein, 127 aa, Triticum aestivum
  unsure (1)..(127): unsure at all Xaa locations
  Clone ID: PAT_TA_55656.pep
GGGGGWGCSTGEEHLWLAGPLIAGALLHNLMXLICVMYVGHLRELALAGGLIGRSFATVTGFSLLIGMASALHTLSCLAYXARLYHLLGVYKQRPMVILTLVSIPVGVGWFYTGFMLLLVGLDADFG

SEQ ID NO: 161239 - protein, 65 aa, Triticum aestivum
  Clone ID: PAT_TA_55657.pep
CMNTNTYGNSSNATTFFLSGGGGWEGETAPRITHCGVTFSSLHAVTLIDEGGWTRSLVWVASRGG

SEQ ID NO: 161240 - protein, 28 aa, Triticum aestivum
  Clone ID: PAT_TA_55658.pep
GKSTIFIDWLIYSTFQISKYLDVTDGSP

SEQ ID NO: 161241 - protein, 57 aa, Triticum aestivum
  Clone ID: PAT_TA_55659.pep
QLHRAEFPPPPHPRRVTAGTEQLRPWLPGRRGHTRGPSGTRSRGRRAYPPLPVRRAK

SEQ ID NO: 161242 - protein, 63 aa, Triticum aestivum
  Clone ID: PAT_TA_55660.pep
APRALGFTLSASGLCGVGNCYRFPPCPRYDLWPPPLPAVPPLAIGGPRPAPGPGSRVPARPPR

SEQ ID NO: 161243 - protein, 97 aa, Triticum aestivum
  Clone ID: PAT_TA_55661.pep
PTPGCSVDNGHCGMCVMQRDGMCWWTPGHLVEKQLKRMYCSVTRERIRMPISFVDRKWVSTFQGVNLYCNMEVSAECFVYLALLVSENVMNRCILFQ

SEQ ID NO: 161244 - protein, 33 aa, Triticum aestivum
  unsure (1)..(33): unsure at all Xaa locations
  Clone ID: PAT_TA_55662.pep
GSXLXEARQVPSAITTFPSTAQIVPGAPGCRSR

SEQ ID NO: 161245 - protein, 99 aa, Triticum aestivum
  unsure (1)..(99): unsure at all Xaa locations
  Clone ID: PAT_TA_55663.pep
MDLELAHGAGAPRKRGESWAAVLLLAYQSLGVAYGDVATSPLYVFKSAFAGDDITHTAGNEEIYGVLSFVFWTLTLISXLKYVCIVLRANDGGEGXTFA

SEQ ID NO: 161246 - protein, 161 aa, Triticum aestivum
  unsure (1)..(161): unsure at all Xaa locations
  Clone ID: PAT_TA_55664.pep
RKPSRPTATTSPTPAASPPPPEIPPLPLPPGARPEGTPXNFAPPPHPVRSPDRPRLAGCRSPRHCPLNLSPSVRNTEXSPVTRSNPPHGTAARATPIRPGHALPIPPRRLSRAARVAPSAGAPPPPPACPFIPTPTARSQFTPPSVRPPVRHAQPATFLFP

SEQ ID NO: 161247 - protein, 111 aa, Triticum aestivum
  Clone ID: PAT_TA_55665.pep
LAEVVGAVREAKEAVPARFAGWMRGVEQYDVPPLDYSTVTLSDWSRLGFDEVDYGFGAPGYVFPLNDHVNFVAALNYVRPPAPRRGGIRVVLHCVEEPHAAAFAVELAKFA

SEQ ID NO: 161248 - protein, 58 aa, Triticum aestivum
  Clone ID: PAT_TA_55666.pep
FLLRPGRGGGGGLISRGRLCLRVCGLVLCSAGPAAWGVPGWVGLAVLVFSLTSKGGGG

SEQ ID NO: 161249 - protein, 120 aa, Triticum aestivum
  Clone ID: PAT_TA_55667.pep
MDGEHSALKKMRLEDAEDSAISQVPATASSMHQQLFWSQWQLLDSILPTGGFAHSYGLEAAMQSRIVNNQEDLRLFLIQVVDNIGSLLLPFVFCASRSPDAAAWVKLDQLLDATLTNEVG

SEQ ID NO: 161250 - protein, 182 aa, Triticum aestivum
  unsure (1)..(182): unsure at all Xaa locations
  Clone ID: PAT_TA_55668.pep
MAVQEEALHILFFPFLASGHLIPTADMAFLFAGRGVRCTILTTPVNAAIIRSAVDRANDAFTGTGCPAIDIAVVPFPDVGLPPGVENGTALTSQDDRDKLFHAAQLLREPFDRFLADHRTDAVVSDSFFHWSVDAAAERGVPRIAFLGSSMFARACSDSMLRHNPLENAPDDPDALVXLPGL

SEQ ID NO: 161251 - protein, 93 aa, Triticum aestivum
  unsure (1)..(93): unsure at all Xaa locations
  Clone ID: PAT_TA_55669.pep
HVVIXKXQFQQDAAKPNALDEGELLALLRDEQAEEDRMIQTDISDEDLLKVMDRSDLTGARAAADAAPHFPLKGPGWEVVVAAGGGMLSALTS

SEQ ID NO: 161252 - protein, 161 aa, Triticum aestivum
  Clone ID: PAT_TA_55670.pep
SRNSVACIRQTWTRLPDPVCFQHEWRVSTGEDIGMLFSRDMLRSSDRPHVQPVEELLTFGHVPTPDGSEWRPVEHLRFDCHGIRSRVTFGRATFFSVETLNINCCRSCGGSSCLWIDGLRYLHGLKEVCVTGEYSSSFAQDLRRQLDKHANHPELKMLHSS

SEQ ID NO: 161253 - protein, 136 aa, Triticum aestivum
  Clone ID: PAT_TA_55671.pep
SDDSEGIVCTRGLLLNETEDAQLQGLLPLSDGFIGFAFVHRLTRTDIRLGMMKIPKKVAAATPFEEQGVVGISVDGRRFKKISYKTADDGRIVFGRKKWEDFAASRGLKVNTAVLIGFKSSERDDVHVLVILKKLG

SEQ ID NO: 161254 - protein, 54 aa, Triticum aestivum
  Clone ID: PAT_TA_55672.pep
LMCCRNSFEPEGFKPQNLVSINMTCEFRKSVLAERSTDYPLARIMQNNSDLGRK

SEQ ID NO: 161255 - protein, 62 aa, Triticum aestivum
  Clone ID: PAT_TA_55673.pep
TAIGITRPFLGGSYQIVIYPTTFVQKGGCGGFGKGNFSELFKSIEDYEKSLEAKQSAAVQGS

SEQ ID NO: 161256 - protein, 115 aa, Triticum aestivum
  unsure (1)..(115): unsure at all Xaa locations
  Clone ID: PAT_TA_55674.pep
GKLVHLLQVIPLNDLRNIFGLGKREAQAITSDIESRAYRNKLIKSFSTDLVVAPNKASFLQNLCQELXFDPELASKMHKDTKLTLVFCIASLILQHSSMLAQNLILLLLARCVPY

SEQ ID NO: 161257 - protein, 128 aa, Triticum aestivum
  Clone ID: PAT_TA_55675.pep
GFVTHCGWNSVLEAVSAGVPMVTWPRYADQFHNEKLVVELLKVGVSIGAKDYASGMEAHEVIAGEVIAESIQRLMESDAIQKKAKDLGEKARRAVEKGGSSYDDVGRLMDVLTARRSSVKVGEDNQAS

SEQ ID NO: 161258 - protein, 111 aa, Triticum aestivum
  unsure (1)..(111): unsure at all Xaa locations
  Clone ID: PAT_TA_55676.pep
FQNQLSASKSSGSSQGVYVXSEMNPYVGHPNPMQEEQELFRKGLLSEAALPLEAEVLKNPDNAEGSRLLGVTHAENDDDQQWEQKQIQIPEGGMERIRYGRVHYRWRKKNP

SEQ ID NO: 161259 - protein, 65 aa, Triticum aestivum
  Clone ID: PAT_TA_55677.pep
VLGQPQMMFLPFIELPYCYVVQLFVNIHTRQLTVITSNFLLIYTLDSGTHELYLSEDMFHIYSCL

SEQ ID NO: 161260 - protein, 146 aa, Triticum aestivum
  unsure (1)..(146): unsure at all Xaa locations
  Clone ID: PAT_TA_55678.pep
VFVFGLPREAMEDDVAAALTEAGEVEEVRLVRDPVELQLNKGFAFVRFAEVWQARWAANDLRTAMIKGKACGICKNNDNETLHLRNICFDWSKDDLAEKLKTFELENLEDINLIEHPDRKGRNRGYAFLDFSSHVDAXCWILKLQK

SEQ ID NO: 161261 - protein, 166 aa, Triticum aestivum
  unsure (1)..(166): unsure at all Xaa locations
  Clone ID: PAT_TA_55679.pep
MAPGGLLGTAAVAVMVSLAVHVALHCPIQPLPSPPSPARHPPNNLLQGLEKLGEGRLSGPEDVYIDAAAGGTLYTATRDGWLERMQPNGSWEHWRFVGGTDLLGIAPSADGSLLVCDAHKGLLKVEEGRVTILASTVEGSTIRFADAVIGAXDGTVYFSDGSTRFG

SEQ ID NO: 161262 - protein, 138 aa, Triticum aestivum
  Clone ID: PAT_TA_55680.pep
VPSKQELEKKHDAEDSKSLVKFAVFVKKDSAEYGINIVQQILWVNGTRYVLQEIYGIGDRNTADRNVNEDDSGKECVVCLTEPRDTTVLPCRHMCLCRECAQTLRFQTNKCPMCRQPVESLLEIKVDIMPRHHEGGDQ

SEQ ID NO: 161263 - protein, 55 aa, Triticum aestivum
  Clone ID: PAT_TA_55681.pep
DAAGSRCTFSLIPQAQPDSTRACRTGDLHVECSSAFAGQTVSITRRGGGVHLVIN

SEQ ID NO: 161264 - protein, 176 aa, Triticum aestivum
  Clone ID: PAT_TA_55682.pep
TTVSPAVHQRRACFSSLYSYPLVRQRSIQKHGTQRQRSSSPILAQADAGGVPLQFEATPPSLSCRSNPAPPPSAASSWSPATAAPDVCCCSPPFPSSFAVAPDAESRSRPHSSARGPQAEAGSRPCSSRPARQGSPSRVKPELAVETGSPAKRLVTAACARAMGKRGGGREDAVEE

SEQ ID NO: 161265 - protein, 88 aa, Triticum aestivum
  Clone ID: PAT_TA_55683.pep
FSPLFILFYTGSLIALLELNHPHHGGGGGTHEPRPTHSTSLPTRNHECKFISSSGRDHLLAPLAPAQPCNRSNRYRRGSERRARTNHS

SEQ ID NO: 161266 - protein, 103 aa, Triticum aestivum
  Clone ID: PAT_TA_55684.pep
LDVSAAATYKVKLVTPEGDEHEFEAPDDAYILDSAETAGVELPYSCRAGACSTCAGKIEAGAVDQSDGSFLDDAQQEEGYVLTCVAYPKSDCVIHTHKEGDLY

SEQ ID NO: 161267 - protein, 91 aa, Triticum aestivum
  Clone ID: PAT_TA_55685.pep
GKWWPRLLKKKGRPPVFLKVDWDKWQDEDDEDAGFGDFGDMDFSKLDMGGGDDDDDDEIEEEDEENVVDSANKADVDAETEPGSKGGVALL

SEQ ID NO: 161268 - protein, 88 aa, Triticum aestivum
  Clone ID: PAT_TA_55686.pep
SDQVDQLLISRWKRATTHHRGPSFITPFLQKQEEKPCKSNCLKYESRTQEVKPTDGAEAESSGKIGEAESAVAGEDDRLLAIRALPLR

SEQ ID NO: 161269 - protein, 96 aa, Triticum aestivum
  unsure (1)..(96): unsure at all Xaa locations
  Clone ID: PAT_TA_55687.pep
HPSIAKKYGVKPDAETLDMLNTIAXQKEVAVVSKVLFGDPREKLCQAIHDMPISSLVIGSRGLGKLKRVLLGSVSDYVVNNAACPVTVVKPASTHA

SEQ ID NO: 161270 - protein, 163 aa, Triticum aestivum
  Clone ID: PAT_TA_55688.pep
ANGVALSRDESFLVVCETAGFRCTRLWLKGDKAGQKETFVDNLPGSPDNIHLAPDGSFWIALLQLRSPWMDLITRWTLAKRVVASIPALHEPIKATAKGAMVAQVSEDGEIIRVLDDSQGKVIHFITSVTEFDGHLFLGSLSTNFLGKLSLAKVPRVQAAVSS

SEQ ID NO: 161271 - protein, 134 aa, Triticum aestivum
  unsure (1)..(134): unsure at all Xaa locations
  Clone ID: PAT_TA_55689.pep
SVRDNTFFESCGVADLITTCXGGRNRRVAEAFARNGGKRSFDELEAEMLHGQKLQGVSTAREVYEVLTYHGWQELFPLLSTVHEICIGQLPPTSIVEYRLAEDAIKNNLGFVKFFEDQAFHYLPIPGKARPRKL

SEQ ID NO: 161272 - protein, 94 aa, Triticum aestivum
  Clone ID: PAT_TA_55690.pep
IFFFFFFFFFFFFFFFFFFFLNRIARDNRGTYNARKTFTSLEGGGGNTGKTKTKFWGFWVHFLQTQHSTRRDTRRSHQQWEKGTMPQLYENLKP

SEQ ID NO: 161273 - protein, 73 aa, Triticum aestivum
  Clone ID: PAT_TA_55691.pep
EHVLKVRKEKLGTANPDVEDEKKRLAELLKEAGRSRNRKQKSLENLFGSGGAARGAKKDGAGGRRWTNFGFRS

SEQ ID NO: 161274 - protein, 132 aa, Triticum aestivum
  unsure (1)..(132): unsure at all Xaa locations
  Clone ID: PAT_TA_55692.pep
HFPIPSPPPPAXPSRSSSAAAPPCSGSVAASSPSSSRLPPPLPSPTSAASPPPPRPPTPRTLASRWRTTSSPPAASPDPRPSRPPPSSPTSNPLPSPTLSSPSSPASASPAPTSPPSSPRTPSSSVPAWRKP

SEQ ID NO: 161275 - protein, 78 aa, Triticum aestivum
  Clone ID: PAT_TA_55693.pep
KKAPPKPKHARIITYPGIKTVCTRSNKPHLKSRKQRVDCRHTGHPVYGEGHDGAHDTGSKASVAYEKVDLTSELATTR

SEQ ID NO: 161276 - protein, 175 aa, Triticum aestivum
  Clone ID: PAT_TA_55694.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFDKRAST

SEQ ID NO: 161277 - protein, 136 aa, Triticum aestivum
  unsure (1)..(136): unsure at all Xaa locations
  Clone ID: PAT_TA_55695.pep
MAGGRNKRISKGRKGSRQKAGAPVTKNQWYDSNAPMLTTRRHAGKTVGSRXTQGARTASWGVKHRGQVISLAGLENDQDQAYRKIRLRAEDVQGMNGLTNFWGMDFTTDKLRSLVRKWQTLIEAHVDVKTTDKYML

SEQ ID NO: 161278 - protein, 80 aa, Triticum aestivum
  unsure (1)..(80): unsure at all Xaa locations
  Clone ID: PAT_TA_55696.pep
HDVHKAAGHCSDKALKVILCLQFLEVXAFYGVYLNLIVYLQDVLHGDSASNVTDVNSXAGVSYLMPLLLVAVADSYWLKT

SEQ ID NO: 161279 - protein, 141 aa, Triticum aestivum
  unsure (1)..(141): unsure at all Xaa locations
  Clone ID: PAT_TA_55697.pep
MSSPRRPEMPPAARNNDNGYVETDPTGRYGRFDELLGKGAMKSVYRGFDEVRGVEVAWNQANLADVLRTPDALQRMYSEVHLLSTLRHDAIIAFHASWVSVSSPSPRGGCAGGAPRRTFNFITELFSSGTLRAYXXRYPRV

SEQ ID NO: 161280 - protein, 110 aa, Triticum aestivum
  unsure (1)..(110): unsure at all Xaa locations
  Clone ID: PAT_TA_55698.pep
PRSPARIRLVSRNPLRRSFSSSEPAPGVAGDEGGYVDREVEEDRDERYGFEMEVLKLPGKNNRLLLRARVRVXSPLQAVWSTLTDYEGLAGFIPRLYECRLLHQDKVFAR

SEQ ID NO: 161281 - protein, 123 aa, Triticum aestivum
  Clone ID: PAT_TA_55699.pep
AGDTKLRECTGICIESSCPGVTSFLTSINLIPLTWRASKITKNLKIKVRLLNDETVTGWIADPEIYVDFFIVNVAGVNATHVSLDRDMQFEPYRKVAAVCRNFNSGLLMDTKRSRSCLSKCST

SEQ ID NO: 161282 - protein, 75 aa, Triticum aestivum
  unsure (1)..(75): unsure at all Xaa locations
  Clone ID: PAT_TA_55700.pep
LRQIQKQDKPVTKYVKNMKRSTIDXXKVPSLSCLYDTNNLLKNYGLTKCXSMVDEDDPTLXKANGTEIEWYPVKK

SEQ ID NO: 161283 - protein, 135 aa, Triticum aestivum
  Clone ID: PAT_TA_55701.pep
KIPNPSAHPPTTAPPDYPVLPSQICRARPSPAALGPRCLGRRGGPRPCSATTATTASPPPSAAPTASSPGLGTPISTPPSAPSSCKPPSSSPLSPSPSLPLSWLYFSLFLSLPCLCLWDWIAAARAGVFSLLLLL

SEQ ID NO: 161284 - protein, 99 aa, Triticum aestivum
  Clone ID: PAT_TA_55702.pep
DTKVGIQKIVNSVKPNHISTKNHSQVDKTFQLALFVPLFFSADKDSCKHGTLQKGYYCTGEVIPRHTQRAAVAARCQGIKNTQTFSVHFTNRTNGKDEL

SEQ ID NO: 161285 - protein, 136 aa, Triticum aestivum
  Clone ID: PAT_TA_55703.pep
LSSYSKSSSSCFLSSKALTSLCTFLISLSAIFELVATFLVPSDHSRDSRIRRSLFVSLDLILDQTEHTISRCYVLQRRQEIIILLREKKKERAQHITCQCYCHEHRYGEHLQLHQSSGTADLAALDMSDRLLNDPL

SEQ ID NO: 161286 - protein, 108 aa, Triticum aestivum
  unsure (1)..(108): unsure at all Xaa locations
  Clone ID: PAT_TA_55704.pep
MALFRGLIRTLEAVIQKWEQDANTLGELRWQEMQSAYDLSLRSQVPELIQDHRXRLRETNAIXGKAQRDNMTEDQFLLAIRGMTGLLLQTCLLELVEGRSARGLYIRV

SEQ ID NO: 161287 - protein, 153 aa, Triticum aestivum
  Clone ID: PAT_TA_55705.pep
MFRHALKAVAFLSNEKIAAKVEQLKKMFRWSDAEVRIALSTLPSVLMRSNHMLESKSEFLISKVGFEPAYIAHHPALLTYSLEGRIIPRYYVVKFLKENGLLDHNRSYYSAVIVMEKVFVDKYISPHKEVAPSLAEDYDAACRGEVPTRFKFT

SEQ ID NO: 161288 - protein, 98 aa, Triticum aestivum
  Clone ID: PAT_TA_55706.pep
MTPPHHALFKAPQLKPFGPSLLLHGCGYMLKCSVSLAAWGLSLKRPISLCHCTLMSCPDGSDSLVCPPYCSETFTLLHSQKLTLATRELCLPLSPPTG

SEQ ID NO: 161289 - protein, 94 aa, Triticum aestivum
  unsure (1)..(94): unsure at all Xaa locations
  Clone ID: PAT_TA_55707.pep
SQSRCIVHASSVFPLRHVNVVKVKILSAPQFGLSELMXARGDNKKYVGVTLDGPADGFKVIPGPKRFAGAQYRISVARKALRSQTIIYVPLGVV

SEQ ID NO: 161290 - protein, 97 aa, Triticum aestivum
  Clone ID: PAT_TA_55708.pep
RMSLQHIPQNVGLESSSKKKFNRSAAALDAHVQELEYKLEKERRVAELMREELVDVKKKSEETEAARAAEYQLLLQRVEATDARFAHLMNLFEGKIV

SEQ ID NO: 161291 - protein, 174 aa, Triticum aestivum
  Clone ID: PAT_TA_55709.pep
TVLAAAYVTFYNRAVAPSVAFTPIQLMGLGHATAAGAVTVSACTEACRLRMAGGQEAAQMGIAWLLPQYAVMAVSYASLSVGQMQLFYDQSPETMRGASTALYFLSISLGNVINSQLVTLVASVTSAGGRTGWFPPEMDDGRLDYYFVLVVAITLLSFAVFVALAKNYTSKRVR

SEQ ID NO: 161292 - protein, 91 aa, Triticum aestivum
  Clone ID: PAT_TA_55710.pep
HTEFAYMENHSRDDVTTKKLDRWSLSMRYRQPACRHALTKICLERGPLFSDLGKPNTKLQDSAQVEDPSIGYPGMSTQLGAIPHNLNPATC

SEQ ID NO: 161293 - protein, 95 aa, Triticum aestivum
  Clone ID: PAT_TA_55711.pep
TCKITKAGIGGPLIDTDGNFVGMNFYDEEETPFLPRDLICRLLLNVNKEWASADDTIMEGDKNRWLLPGGTHRNTDGNRWPLPKPRLVGVRDVCL

SEQ ID NO: 161294 - protein, 107 aa, Triticum aestivum
  Clone ID: PAT_TA_55712.pep
MIEYKTSIESLRKDSKYTLDKVVIGESDLQRGRTDLRSTGKQIQSVIRSIYKAESAAAGLMDQLRIIPTRQSLELRAEVASMASDLKNRRHVLEERVIRISEYGVRV

SEQ ID NO: 161295 - protein, 99 aa, Triticum aestivum
  unsure (1)..(99): unsure at all Xaa locations
  Clone ID: PAT_TA_55713.pep
CSRSYQDLSKALEKMFRSFSIGXCGAPGMNAMNESKLMDLINGSEYVPAYQDKAGEWMLVXGNVQWGMLVQSRERLWIIKGSEVIGLAPRAMEKCNSRS

SEQ ID NO: 161296 - protein, 95 aa, Triticum aestivum
  Clone ID: PAT_TA_55714.pep
CLLCFQSDTSYIKEARFFPWTMYSPSAKWTLFHRWPGSVALLLRQTLLCEALCSSFCLRAGWIDKHAFGTVTGRLRRCLSDLWFLCIAHGLHGVG

SEQ ID NO: 161297 - protein, 76 aa, Triticum aestivum
  Clone ID: PAT_TA_55715.pep
HPPANLFYFFRNSSFSAEHSLNIHIKPHTSASMHAPRKGYLLNLPTPSPAWGHAIGEGHTNPHLARPPGNLAHVYR

SEQ ID NO: 161298 - protein, 92 aa, Triticum aestivum
  unsure (1)..(92): unsure at all Xaa locations
  Clone ID: PAT_TA_55716.pep
GNVINPWPTVDAHSGMWISLLGLNEARYTSVLSGVSRSIAIGFQIIWXRALGLPLERPESVTMQWLDSLCNKVTACSYTGSSSYNTSCLSCS

SEQ ID NO: 161299 - protein, 206 aa, Triticum aestivum
  unsure (1)..(206): unsure at all Xaa locations
  Clone ID: PAT_TA_55717.pep
XSAXECLQEYPLLNKXMVLGGLHIPSDGLALAARATQILIESTRIAGVSYREHTLVTGIEQADGHVTGVTTNNGSIPADIVVSCAGFWGVEIGKMIDLKVPLLPLGHQYVKTTAVPSLVGREVNKNINAMNAELPILRHQDQDLYYREHGEQFGIGYYGHRPMPVDAGSLGVTPKEVDDKNMPSRLDFTPXDFEPAWQATKELLPA

SEQ ID NO: 161300 - protein, 140 aa, Triticum aestivum
  unsure (1)..(140): unsure at all Xaa locations
  Clone ID: PAT_TA_55718.pep
FFFDPDTTTXLQAYLKELQPRTNHLTGLPDMDDRLISAGELMNXPTRMTDPSGDTLQGWIQQRVVYVKSXDTRHVLTVXLEGAYAPTSPPEKLIHESGSTGSTTTTIHLHPHFKIYDIHSRCEQLYADTQLLHANLQDKL

SEQ ID NO: 161301 - protein, 46 aa, Triticum aestivum
  unsure (1)..(46): unsure at all Xaa locations
  Clone ID: PAT_TA_55719.pep
RXLXRHPASLVANSVTCSTYHHIRCTYNIPDHIRYTGXXRTLGRPG

SEQ ID NO: 161302 - protein, 72 aa, Triticum aestivum
  Clone ID: PAT_TA_55720.pep
SPRPKQPYTFQLQADLSLGTAPMTRITMSLSFLPIDLMIFDGQVNYSSRLLTLSEGTVHKRLRLRISDLGTN

SEQ ID NO: 161303 - protein, 161 aa, Triticum aestivum
  unsure (1)..(161): unsure at all Xaa locations
  Clone ID: PAT_TA_55721.pep
MKGAKSXGAAKADAKLAVKSRGRRSRPPRGKKGKAGKDPNKGGGGPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 161304 - protein, 122 aa, Triticum aestivum
  unsure (1)..(122): unsure at all Xaa locations
  Clone ID: PAT_TA_55722.pep
RPQPKGTKNSGPAGSPAPKSQRSPPREMTPWHMGPGSPQTLSTERPARQHTSLYREGTSGDARPTRRPPRHRAARNAEAPRGRGRQRSHGVSATHSRVGCSNRGPVGAGTGARAXRXDAGRP

SEQ ID NO: 161305 - protein, 57 aa, Triticum aestivum
  Clone ID: PAT_TA_55723.pep
LVLLPVEISVVNKYAQLAGLSRYLFVSHRVRFLDFDQLPVGSGRIFYGFKTPPFMET

SEQ ID NO: 161306 - protein, 143 aa, Triticum aestivum
  unsure (1)..(143): unsure at all Xaa locations
  Clone ID: PAT_TA_55724.pep
MTSEHNXREAGVTYAIQMDKKADFAGKAALEPLSRKTSARRLRCLTVDDGRSMCLGKEPVFYNGKAAGYVTTAAFGYTVRKPVAYAWLPGNVREGEAVEIEYFGKKIKATVTPDPLYDPQDRRLRSDGPSREPELQKRLKSLL

SEQ ID NO: 161307 - protein, 103 aa, Triticum aestivum
  unsure (1)..(103): unsure at all Xaa locations
  Clone ID: PAT_TA_55725.pep
SDSSTYDTEGRFMPXNFESIFSKYARTAPDKLSFGDIWRMTEGNRLQYDFFGWLVSKGEWILLYVLAKDEEGFVSREAVRRCFDGSLFEFIAQQRREAHEKQH

SEQ ID NO: 161308 - protein, 35 aa, Triticum aestivum
  Clone ID: PAT_TA_55726.pep
VIVRWQRMASYLFIVLSQCLSCTPDILNESRCSHN

SEQ ID NO: 161309 - protein, 55 aa, Triticum aestivum
  Clone ID: PAT_TA_55727.pep
CYRQGEALMLLKDYGGACDAFLDAAKLDPGSPEIESALWKAMNSLKTSCGATQAV

SEQ ID NO: 161310 - protein, 121 aa, Triticum aestivum
  Clone ID: PAT_TA_55728.pep
GIKKFETLSYLPPLSTEALLKQVDYLIRSKWVPCLEFSKVGFIFREHNASHGYYDGRYWTMWKLPMFGCTDATQVINEVEEVKKEYPDAYVRIIGFDNMRQVQCVSFIAFKPPGCEESGKA

SEQ ID NO: 161311 - protein, 42 aa, Triticum aestivum
  Clone ID: PAT_TA_55729.pep
RGREKPGALIWCRDVIRAPKIIIFAPWNRIGPLTCWKPLRVF

SEQ ID NO: 161312 - protein, 54 aa, Triticum aestivum
  Clone ID: PAT_TA_55730.pep
PKPRVGVPTWPRGWLVPPDPLVICWGVTKHSQAPPRPLAPLPHPDYFTGFFTPP

SEQ ID NO: 161313 - protein, 94 aa, Triticum aestivum
  Clone ID: PAT_TA_55731.pep
PPPRRAHNFMPPPAAGTEGAWAGGAPRGAPGLRWTRAPPSSSTGSTTPPRFSPWTHSPLPQEVPPPPGDRGAKGALGWPLPPQVLRPPAQSFPR

SEQ ID NO: 161314 - protein, 97 aa, Triticum aestivum
  unsure (1)..(97): unsure at all Xaa locations
  Clone ID: PAT_TA_55732.pep
TPFCFGGNCPKEAPLSLGGFRKLGEPLPFSKRPPSKLVCYITKELMAPENPPLVLPKGFGYSPKALYXMAKKNGGKFICPRPGEECNSPGLVRGYIS

SEQ ID NO: 161315 - protein, 73 aa, Triticum aestivum
  Clone ID: PAT_TA_55733.pep
KNGPPVQIILGSSPVGFPNDPPWVFPSVSPGPPPQFSKKGVFPPVSPPSLGFLLNHKSFGARLKFGPGALGPL

SEQ ID NO: 161316 - protein, 124 aa, Triticum aestivum
  unsure (1)..(124): unsure at all Xaa locations
  Clone ID: PAT_TA_55734.pep
GSGRSAADPRRLRAMREQLAGTGAIYAPGPGSKGGVLPFLGWAWWYLVLGWNTVVEVALFAGTIGFLKDRHTPFKXVDQGAGSSSRGRLVHGSLPLEDVKFIKNAMDWVSKSSYHFDHANFLES

SEQ ID NO: 161317 - protein, 105 aa, Triticum aestivum
  Clone ID: PAT_TA_55735.pep
VVILTRPSRLIGPLFTLQEIGMIRDDFGFGCPLSCLLGSCCCCIPGSAQFCAGCLAPLVPRFPELSPLDIPAFWFQPGKCCPALPFHDSSNPGNSSSLRLCSICV

SEQ ID NO: 161318 - protein, 200 aa, Triticum aestivum
  unsure (1)..(200): unsure at all Xaa locations
  Clone ID: PAT_TA_55736.pep
SAPSXILLTIIVSVITSMCSYGLPWLASCTQCPEDAVEQCPTVGRSGNYKNFQCPPGYYNGMASLFFNTNDDAIRNLFSTGTATEYHMSSLFIFFVAIYCLGLVTYGIAVPSGLFIPVILAGATYGRIVGTLLGSISSLDPGLFALLGAASFLGGTMRMTVSVCVILLELTNDLQMLPLVMLVLLISKTIADSFNKGVYD

SEQ ID NO: 161319 - protein, 168 aa, Triticum aestivum
  unsure (1)..(168): unsure at all Xaa locations
  Clone ID: PAT_TA_55737.pep
MAPDHGSKVDISFAGRFTASAIAACFAEITTIPLDTAKVRLQLQKKAVAGDLAGPKYRGLLGTAATIAKEEGAAALWKGIVPGLHRQCIYGGLRIGLYEPVKSFYVGENHVGDVPLSKKIAAGFTTGALAIAVANPTDLVKVRLQSEGKLAXPGVPRRYTGXAMDAYA

SEQ ID NO: 161320 - protein, 107 aa, Triticum aestivum
  Clone ID: PAT_TA_55738.pep
WLNKTGIMFTIHFPSIQRAVLTKRGGKLKRKVGRRRATVRSSDCLFHLSLSVIGKRTKCGRVSIRSLAGRLQPLRCCRLAVPLPSISSPLAPVAPSIGQTPSLSRLC

SEQ ID NO: 161321 - protein, 78 aa, Triticum aestivum
  Clone ID: PAT_TA_55739.pep
MSCCGGNCGCGTACKCGNGCGGCNMYPEAEAAGATLLVSGAATHKASSGGMEMAAENGGCGCTQCKCGTSCGCSCCSC

SEQ ID NO: 161322 - protein, 45 aa, Triticum aestivum
  Clone ID: PAT_TA_55740.pep
MSFRSIVRDVRESFGSLSRRGFDVRISGLPGLSGHHHREIFRATG

SEQ ID NO: 161323 - protein, 134 aa, Triticum aestivum
  unsure (1)..(134): unsure at all Xaa locations
  Clone ID: PAT_TA_55741.pep
PSXAEAXGSXPGAGPGAHAENDGAXTAPXGTLQTARAPVAPXAVPAPSPPXXPLRGAAXXAAPSPPRAPGXDGXXTRETEPGTGXRRRLXRGSXARXTLSRXASGPPPXCHGKAARSKSPXXRGWHLAXYECWA

SEQ ID NO: 161324 - protein, 153 aa, Triticum aestivum
  Clone ID: PAT_TA_55742.pep
TPASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 161325 - protein, 80 aa, Triticum aestivum
  unsure (1)..(80): unsure at all Xaa locations
  Clone ID: PAT_TA_55743.pep
GARIVFTAVILDFMCXGGDSTKGNGTGGESIYREKLTDEKTVHKLTKPGILFMANAGPSTDGSHILICTAAXTWLDGAAR

SEQ ID NO: 161326 - protein, 204 aa, Triticum aestivum
  unsure (1)..(204): unsure at all Xaa locations
  Clone ID: PAT_TA_55744.pep
RRRSCPLEERNLLSVAYKXWHAGPARVSAGIIFSMEQKXEGGGTDAHADTMRYYRRSTRPDYAXRCCSGILALXDSXLGPSDGAAGFKVLYXLKMKGDYHRXALAELKIREERKEAGLSTMNAXKLARISDLGDLVTTPPHQAWTCTSTFAVLLLYTSSNSNVRACNLAKQASADAIXQSMNSLIARESYIDSTVIMQVLRDNM

SEQ ID NO: 161327 - protein, 97 aa, Triticum aestivum
  Clone ID: PAT_TA_55745.pep
MYPRGDLYSTDCLSLYLSLDASNELHLESKKVAVMTLSILNQKNGKHLTKTSGLFICDGGWGWPNFLALKKLKKGYVVGSSCIVKADLTIVGLSNDG

SEQ ID NO: 161328 - protein, 75 aa, Triticum aestivum
  Clone ID: PAT_TA_55746.pep
CRPGRAYLFDRVVNVTLGPNEDPHFLTGLHPVTDISCRCCPRLLGWKYAKASPEAPKFKKGKFFLKKTLFFKKGR

SEQ ID NO: 161329 - protein, 156 aa, Triticum aestivum
  Clone ID: PAT_TA_55747.pep
PGPPPVSPPPRGFSGHGPAPVFPPPLRAPLLQSRGQPGGFLPRPPGRFYNFFGAPGEIPLLPFNAGGAWVPSGPLICSPPPFVSLPPLPSCFAALLMGGSLPSPSLPFRLKQTPWPPWSLLDMPRVSGPQLLFLFFGPAFPPFFWVKKERSLFRLK

SEQ ID NO: 161330 - protein, 83 aa, Triticum aestivum
  Clone ID: PAT_TA_55748.pep
LLGWDIIRFGEVFVVGVSDGSWRYGLSQSSSRFKQGQSLGGIGGGSAWSMVGLQGQTVGSYGLCLAKGGPQPHVMCAKSGCPS

SEQ ID NO: 161331 - protein, 98 aa, Triticum aestivum
  Clone ID: PAT_TA_55749.pep
FNWKSTNYCFELEYNYRSGSKWDDVVRWSTAAARDAVWYGLSISRRGSLRKASSTPRRRCSSSLSRGCAWSTSTSPSCHCSAPPCRLGFLFAIEAFRN

SEQ ID NO: 161332 - protein, 214 aa, Triticum aestivum
  unsure (1)..(214): unsure at all Xaa locations
  Clone ID: PAT_TA_55750.pep
RPRGFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGXRRIVKMIPTKPMV

SEQ ID NO: 161333 - protein, 69 aa, Triticum aestivum
  Clone ID: PAT_TA_55751.pep
PLKHHPCSIICYIGSKEPSTYDQHDMVVLSANNIQDEVVSNFLSNEELQPAVTKKVRYSRLIQQKLSYY

SEQ ID NO: 161334 - protein, 62 aa, Triticum aestivum
  unsure (1)..(62): unsure at all Xaa locations
  Clone ID: PAT_TA_55752.pep
SEQGCRGTVRLLCDICKAKKNNVXYESSPKIYCRCPTCNGDRYILSHICTVYRCITYPESTE

SEQ ID NO: 161335 - protein, 83 aa, Triticum aestivum
  Clone ID: PAT_TA_55753.pep
KHQATQANTQRNQDMTSYSKITHTHPTLRHVAKSKQRIQKLATGALNKAINSNAEPHALIDRDCLCSIFTIPGTSLREGGQSD

SEQ ID NO: 161336 - protein, 153 aa, Triticum aestivum
  Clone ID: PAT_TA_55754.pep
VSSLLVRDLYLLTTVVNLLKPCTLKKDTPGLYIQSVRLQWILVLQRFAWWMSDAVWNSPRIRAHGALGASATGLVRDDQETGPGAPRSLQESPDELCTVASTDQNLVLYACLGCGRPLPCSERGRICSGQRRALRTHVRGLSLNRTGGSAPRS

SEQ ID NO: 161337 - protein, 98 aa, Triticum aestivum
  Clone ID: PAT_TA_55755.pep
NRKPQRCAAPEHKTNTPRGTRENHLGQPPPPHPTRPTLSRQRRGGKHSRLTNHTTQGPTATLADPAMETSNPETTHARYKQTRREGNQSPSRTNRTTP

SEQ ID NO: 161338 - protein, 60 aa, Triticum aestivum
  unsure (1)..(60): unsure at all Xaa locations
  Clone ID: PAT_TA_55756.pep
TASPSYVYFSELSKSQQPQGRLPFKIXLAFSGLQHNLPKSRGYYMRVFECKELHVLFYVR

SEQ ID NO: 161339 - protein, 178 aa, Triticum aestivum
  Clone ID: PAT_TA_55757.pep
MWGAPPHLPPDPGGSSEMSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLLGQIKTGFADGKDLILSVMSAMGEEQICAVKEIGGGK

SEQ ID NO: 161340 - protein, 193 aa, Triticum aestivum
  unsure (1)..(193): unsure at all Xaa locations
  Clone ID: PAT_TA_55758.pep
SPSQIKPAARLPSLLMAPKHLPPESLPRRIPTGGFHPITIHVRVNRGGTYLPRLMHQGGVSSLEMAIEAALYWPDGARKRSKSDHAERARNGRRQLLQALVDKHNEDHNLLGDFAYELKDVVECKVFSEKRGWYYHLNFTLTKGADSGIEDLFFVEVKYGRPVKQELSVSCFCMIKPTDNGHCYGCTNMXVSI

SEQ ID NO: 161341 - protein, 125 aa, Triticum aestivum
  Clone ID: PAT_TA_55759.pep
AVPAAAISCPVICHHLSTPQRPAFLTPMRFLVSLGAQPVHFLPIHGHLLLTIHHRAQAIDCRRSMAHEPRTHPRRQRPNGAHKGAHTRSDLDPWPASFERKTAAPQVRRLLSPGRRVTSRVCRVL

SEQ ID NO: 161342 - protein, 64 aa, Triticum aestivum
  Clone ID: PAT_TA_55760.pep
CRLHIVCSVRPLPSPFHFKKIYEHMLINMTQASSALPSSPRSCRSPPASCLAPRPSPASLRPFP

SEQ ID NO: 161343 - protein, 191 aa, Triticum aestivum
  Clone ID: PAT_TA_55761.pep
AQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 161344 - protein, 114 aa, Triticum aestivum
  unsure (1)..(114): unsure at all Xaa locations
  Clone ID: PAT_TA_55762.pep
RADEKITYPAGDEQGLTFTKLYIRLSGKNDMRGLMAGLEDPGMTSVLCKLKLGEIVTTILTIXGAMLRTVECKNISXTGCYVRGQDRITSLRRRFLHDTHGIRCVGDSFLLGPG

SEQ ID NO: 161345 - protein, 68 aa, Triticum aestivum
  unsure (1)..(68): unsure at all Xaa locations
  Clone ID: PAT_TA_55763.pep
TRRPGGRVTAEVDETVYGSGIRRLKMQSTMMSVDASACSLRLDLXVQRRGPEGTGRLKLSPAYCTGDT

SEQ ID NO: 161346 - protein, 96 aa, Triticum aestivum
  Clone ID: PAT_TA_55764.pep
RQLFLRSYHFSRDAEVSPRARTRRVVWAGARRMRRAAAKGLRRLRARIRLCFGWAAPALRRRSSPRRGGVHGFRYGRIPRGKAPPAAASAASVCLW

SEQ ID NO: 161347 - protein, 139 aa, Triticum aestivum
  Clone ID: PAT_TA_55765.pep
CACQQVVISDRGDIGGPSAGVVECDHSEISCRVPKRVRRLGVPSVKLIQGEQEFRKVGEQPQDLLILPDLKVVPGTSCATDSGSTDASHIMKARNHDVHRHAEQADPAGDPSGRFAGSSTFHMLPCCRRCGSFVFLQCQ

SEQ ID NO: 161348 - protein, 93 aa, Triticum aestivum
  Clone ID: PAT_TA_55766.pep
TDDLLGSLSELKEGHMGVAGCAGSGDASKHSPALTTTHSTRVTPSMIHTAGMGLGRDIFLDQCSKRRTISLGQMLSNLYMTISHEVTTIYSPT

SEQ ID NO: 161349 - protein, 96 aa, Triticum aestivum
  unsure (1)..(96): unsure at all Xaa locations
  Clone ID: PAT_TA_55767.pep
GPVLALFVATPLLVFFTPVLVPAAFPPPIFTAGFFSSGAFGPPPVGVLAXMSKSLSPGGSSPPGADPVAPPGAKLDSKAPKVKNWGQHPLAQARTP

SEQ ID NO: 161350 - protein, 79 aa, Triticum aestivum
  Clone ID: PAT_TA_55768.pep
LTDGYRTNTKAEAAKLGLMGPRINNNAGSTHPQAHQLGHSNESAAAKVAHRQPCGCTALLNTYPQTWRTPQRNATCERS

SEQ ID NO: 161351 - protein, 116 aa, Triticum aestivum
  Clone ID: PAT_TA_55769.pep
VKGRDAWARGDLQEFGQLISASGGSSIVNYECGSKEMIQLYEILLKAPGVLGARFSGAGFRGCCLAIVESGRAEEAAAYVGAEYERAQPELVSKIPADRRVLVCEPGDSARVILHA

SEQ ID NO: 161352 - protein, 99 aa, Triticum aestivum
  Clone ID: PAT_TA_55770.pep
EGNPAQFVSVAFYPVATETILICFVSCKQERAKLLGSPTSCAGSSSRLSYTKLLSAALLQKCIRRHRGDFLHLRINAREHSSELFLLGFQIVIIPVAPV

SEQ ID NO: 161353 - protein, 161 aa, Triticum aestivum
  Clone ID: PAT_TA_55771.pep
PTNPEYAQGYKIAFTDCFPFLIASQGSLDALNELLKEPVPINRFRPNILVDGCHPYAEDLWKTMKINKLTFDGVKLCDRCKVPTINQENGIPGGTEPTETMLTFRSGEVIRPSHKNKQKVYFGQNLVCKESVSAKGKGRIVKVGDPVHVLQTYPSSDEVPA

SEQ ID NO: 161354 - protein, 118 aa, Triticum aestivum
  Clone ID: PAT_TA_55772.pep
DNEAMLLEALTVNDEIQKVLSRYEEMKKPVAPAHAEQEPLAIPIAAEAEHEDATAVGSEEALVRKPAGSRAKPDGDDGMLDDLDEMIFGKKGGDSSSSQEDADGAQKQDMKKDDPINL

SEQ ID NO: 161355 - protein, 45 aa, Triticum aestivum
  Clone ID: PAT_TA_55773.pep
AWLGGERGLCLYHVNQYMFIKFLKWNGEGRGRTEQNMLILQKKQP

SEQ ID NO: 161356 - protein, 103 aa, Triticum aestivum
  Clone ID: PAT_TA_55774.pep
APVYLAAVFEYLPSEVLEFAGNGAKDNKKTGFFPGHFLFSVRNDQEFGKLFAGVPFAPGGVFPNINSVLFSKKSPPPPEKGANLPKKKPPPRSPKKKPPPPKG

SEQ ID NO: 161357 - protein, 99 aa, Triticum aestivum
  unsure (1)..(99): unsure at all Xaa locations
  Clone ID: PAT_TA_55775.pep
TQGLIFVVDTNNRSSVVRARDELLSMMNEKXFVSAVLSVYVIKQDLDECHETFSEINDXLGMHLHSASVMWYIQXTCGTAGEGLXEGLDWVSSNSASKS

SEQ ID NO: 161358 - protein, 32 aa, Triticum aestivum
  Clone ID: PAT_TA_55776.pep
SYRRCNFIIKWNSVILSGLSEHKHSSVRSFKK

SEQ ID NO: 161359 - protein, 129 aa, Triticum aestivum
  Clone ID: PAT_TA_55777.pep
TSFRYNVTEYRTDGIIALHLPNGGSCEAIQTTCKLLPVQYFPRSNPWEHYYSPPSTRGGGTLLHFRILAPKPFIFSTDPTPAGDTPGVTVVAPAPTKREATANALNGIVMSLPPLPRRNQTSAPVIWAS

SEQ ID NO: 161360 - protein, 111 aa, Triticum aestivum
  unsure (1)..(111): unsure at all Xaa locations
  Clone ID: PAT_TA_55778.pep
GTGQFPXSXPRPSAXXLASQQTRLSPQLPXTSPPXPXSPPGMXPPPSPSXASXXRPSPPSPPPRPRARGGAAAPPRARRPRRXPAXPXXPGTPRRLRPSPGGPPVGHSPRR

SEQ ID NO: 161361 - protein, 80 aa, Triticum aestivum
  Clone ID: PAT_TA_55779.pep
LFTVCSSLTTCSLFLIYPAFLRHMCYVSSSLVKRVAAYIVSKVSHTLMHPSLRPQATVVSMMQHMTVFCVILCMIRPAKA

SEQ ID NO: 161362 - protein, 95 aa, Triticum aestivum
  Clone ID: PAT_TA_55780.pep
LCCFCARLAAEAHVHSSFKQPRSRSHRMSPQLPDVHAGDLEPARAGMHLVLLFEVLHAVERLFAFSYVMPCYGEDACGQMHVLSSGVHIILAAWM

SEQ ID NO: 161363 - protein, 130 aa, Triticum aestivum
  unsure (1)..(130): unsure at all Xaa locations
  Clone ID: PAT_TA_55781.pep
NLFGTTVVNCSLNWQTICRYYLKDVALEGGQPFHRAHGMTAYEYNSTDPRANCLFNEAMLNHSTIITKKLLEFYRGFDNVETLVDVAGGXVGATAHAITSKYPHIKGVNXFDLPHVISEAPPYPGVQHIA

SEQ ID NO: 161364 - protein, 210 aa, Triticum aestivum
  unsure (1)..(210): unsure at all Xaa locations
  Clone ID: PAT_TA_55782.pep
MNYVALTMLEEGXDSCEAMLQARSWXILDHGGATITPLWGEYFLSVLGAYDWPGNNPLPPELWMMPYFLXMHPGRMWSNCRLAYLPMSYLYWKRLVGATTSNVLDLRKELYNVPYNEINXDKACNGCAKEDLYYPHSPIQNIVWATLKKMGEPDIMHWPESNXEQKLWTYDMKHIKGEDETTHYICIATVNKMLNMICCWXEQPMSEAFK

SEQ ID NO: 161365 - protein, 212 aa, Triticum aestivum
  Clone ID: PAT_TA_55783.pep
LLLATPFLLLPLAVSSIPTSNPDIDLDYLIKNAGLDDAPSDDPEDWLDDGAPASPGDDLDADYDEEDLFGDDDGPEESSHPEVDEAHVLLLTAANFTAVLAARRHVMVEFYAPWCGHCRALAPHYAAAATHLAEQGVDVALAKVDATEDHDLAQAHDVQGYPTLLFFIDGVPRDYSGERTKDAIVAWIGKKLGPAVRNLTAVDEAEKDVTGD

SEQ ID NO: 161366 - protein, 216 aa, Triticum aestivum
  unsure (1)..(216): unsure at all Xaa locations
  Clone ID: PAT_TA_55784.pep
TXTHTXTHXMXXLXXANXXAXXSLXPLPXXDPXMXXKLXEXRXXXXAXXXWXXSXPXXXLXXNXGDXLXSLXXNHXXSRPEPGMDEXWSGWEQGAHYXRLGPGGXXVQGEFXRRRTAXXAXAXKGATXREGDVXLGXEAXLXFVPRHXXPXLQXXRXTPXXXTSXXXHXXRXXVXXKXNXXAAXXKSRKSWXGERGAXTPCXXRXNXXAWXXRAXX

SEQ ID NO: 161367 - protein, 152 aa, Triticum aestivum
  Clone ID: PAT_TA_55785.pep
MATNENLPPNVIRQVVKELKNVDQTPAQGIRESVNDDDFASICADIDGPGGTPDENGVDRVKLGLNRDLPQYSPKGFSVSKILHPNIYSSGESCVNTLKKDWNTAHGLRHVLLVVRCLLIEPLPESALNEQAGKMVLENYADYARDATLYTR

SEQ ID NO: 161368 - protein, 49 aa, Triticum aestivum
  Clone ID: PAT_TA_55786.pep
DYKIIHSSIICYQYPSMVAQLKKQLVIHTRLQLMFIHKPTIPKQNHYVL

SEQ ID NO: 161369 - protein, 137 aa, Triticum aestivum
  Clone ID: PAT_TA_55787.pep
SSFSHGSYHVGLYSGDIPDSVRRIRTPSTLAWQWLPSRPPFSSIKQTLCACIPVSLDSFFSLSATDRQWGTLVKSSRSCVQVAQQHTGPRCSHQQAAEQNRFGIAYRLDISAVFLWGSYLCLDHQVSFLSVHVGVCV

SEQ ID NO: 161370 - protein, 113 aa, Triticum aestivum
  Clone ID: PAT_TA_55788.pep
EDDGRVFLLTVGALGASASAVSVVCARPSAATRPRFTCKMWANLAASNGGKTDIVLVEMQMRSSTSPGAVVAASEPTFLAVPAVYLVPGAGGGGMEMEVALNVRIDKSSPWSD

SEQ ID NO: 161371 - protein, 143 aa, Triticum aestivum
  Clone ID: PAT_TA_55789.pep
GIGRLLTQLKARFPNIRTSIAPYELPVNQKYYQALWRKYSGVIDYVNFQFYGYGANTVVQYYVQFYDEQARNYPGSGGTKLLASFKTGNVTGLLSPDQGISGAKELQRQGKLPGIFIFSADSSKMSPYLFKYETQAQQLVANH

SEQ ID NO: 161372 - protein, 73 aa, Triticum aestivum
  Clone ID: PAT_TA_55790.pep
PAQVRANSPPLTCSLVEVSAFNVVAVDRFVADMLSFVYSRLKCKMRYHSKVYVPLGNGPFKLSKVCRSLYCVQ

SEQ ID NO: 161373 - protein, 68 aa, Triticum aestivum
  Clone ID: PAT_TA_55791.pep
FSFYVGNLILPLIHIFLRKEFTKACLLSKTSSCEALTYTNNSGKVPASYNGMQFTTLVYESARRPAPI

SEQ ID NO: 161374 - protein, 98 aa, Triticum aestivum
  unsure (1)..(98): unsure at all Xaa locations
  Clone ID: PAT_TA_55792.pep
LLIGFASGDVPVIRANIALIKNCTIHGLYWGSYLTHRPAVLIDSLNELLSWLSKGLITVKLSQTYRLAEAHLAFAXLRDRKPVGKVMIVMGSSAKSSL

SEQ ID NO: 161375 - protein, 50 aa, Triticum aestivum
  Clone ID: PAT_TA_55793.pep
DYKIIHSSIICYQYPSMVAQLKKQLVIHTRLQLMFIHKPTIPKQNHYVFG

SEQ ID NO: 161376 - protein, 143 aa, Triticum aestivum
  Clone ID: PAT_TA_55794.pep
MTVTPQITVSDGRLAVRGRTVLSGVPDNIAAAHAAGAGLVDGAFVGATAAEAKSHHVFTFGTLRDCRFMCLFRFKLWWMTQRMGTSGRDVPLETQFILIEVPAAAGNDDDDSDGDSEPVYLVMLPLLEGQFRTVLQGNDQDEL

SEQ ID NO: 161377 - protein, 114 aa, Triticum aestivum
  Clone ID: PAT_TA_55795.pep
CMTGDVLKLVVASRQHEALHVSCLLHNGMTLNSNEAYVLDEKNQGRNVYQTQYKGILQREPALLRDAALGQFSCRCSLNLLHGHTQRVLLHKLLQITGCRQRGSIRRVQHRNGP

SEQ ID NO: 161378 - protein, 109 aa, Triticum aestivum
  unsure (1)..(109): unsure at all Xaa locations
  Clone ID: PAT_TA_55796.pep
MIITNAARGRTRDIYGSTVVTCCHSPNLGLPKSTIASASQDGTVVIWTAPKEGEQWEGRVLNDFRTPVWRLSWSLTGNILAVSGGXPTVTLWXKEPVDGEWEQVTTVEP

SEQ ID NO: 161379 - protein, 58 aa, Triticum aestivum
  unsure (1)..(58): unsure at all Xaa locations
  Clone ID: PAT_TA_55797.pep
GWERXSSPSSACRPPRRVCLCFRPRIEKXLSYRLAYFHPRWFNLSATGNCLNFSAKCC

SEQ ID NO: 161380 - protein, 116 aa, Triticum aestivum
  unsure (1)..(116): unsure at all Xaa locations
  Clone ID: PAT_TA_55798.pep
AFSQYGEXILGAEIINDRETGRSRGFGFVTFGSEESMRQAIEEMNGKELDGRNITVNEAQSRRSGGGGGGGGYGGQRGGGGGYGGGGGGYGGQGGGGYGQGGCGGSGQGGGGYGGH

SEQ ID NO: 161381 - protein, 103 aa, Triticum aestivum
  unsure (1)..(103): unsure at all Xaa locations
  Clone ID: PAT_TA_55799.pep
VVRRFKRPVDVSEKEIDAAGDGDVLVILDLRADQSLIEAGVAREVVNRIQKLRETAQLEPTDLIDVYYESADNSSNTLEEILQSQDQYIRDVLGXSLVPKAVA

SEQ ID NO: 161382 - protein, 78 aa, Triticum aestivum
  Clone ID: PAT_TA_55800.pep
RLVGTLTTTFMQVGQLQHLVQLEPPLGHRRTPECPHALCRYMSQVVTEYLLPPPMEALLVTASFPIFSEPARSPCRTG

SEQ ID NO: 161383 - protein, 73 aa, Triticum aestivum
  unsure (1)..(73): unsure at all Xaa locations
  Clone ID: PAT_TA_55801.pep
SAVVDNCGGIITVSLDQVFSMHHRWEVFRGDSTSSGDLLFSVKTTSLIQLKTEMDVFLXRNTAQQVCDFKIKA

SEQ ID NO: 161384 - protein, 161 aa, Triticum aestivum
  Clone ID: PAT_TA_55802.pep
SKRPFVWVVRPKLIRGFESGELPDGLGEELRGRGMIVSWAPQEEVLAHPAVGAFFTHSGWNSTVEAIAEGVPMICHPLHGDQYGNARYVADVWKVGVEVDGTHRLERASIKAAIERMMDSGEGREIGERMKGLKMAAEDGINERGSSHTHLSDLVALIKSF

SEQ ID NO: 161385 - protein, 156 aa, Triticum aestivum
  unsure (1)..(156): unsure at all Xaa locations
  Clone ID: PAT_TA_55803.pep
LADPRYCGMPYPEKEEVRTLXRQDPNFWKNRPLSEMMIRAATDDVRFLLNIHEKMMEKLSKVSSWRLAVRSELYYDIEAEACVPEVDILSLLDVPPGKMGRVIGRKGSSIMAVKESCNVEIHIGGAKGPPDRVFIIGPVKEVRKAEAILRGRMLEF

SEQ ID NO: 161386 - protein, 161 aa, Triticum aestivum
  unsure (1)..(161): unsure at all Xaa locations
  Clone ID: PAT_TA_55804.pep
AIAALNEADVSYNCSTSGGATERGTLXPFGLLIHATNSGSEQLAVYFYIYKGLDGGLRTQFCHDESGSSRAKELLKRVVGSTVPVLHGEALSARVLVDHSIVESFVMGGRMTVTSRVYPMEAIHAAGRVCVFNNATGSALTVEKLVVHEMASAPIQAYRDA

SEQ ID NO: 161387 - protein, 134 aa, Triticum aestivum
  Clone ID: PAT_TA_55805.pep
ESYVSATAICTTLQRPEASLHFVSGMFATNPPLVRSTKSSLACKPRATMLLDDAQPTSLSLLTLHLCVYYIEHQKAEAGSGVCITFCGSSSAGSQRWKIGLEMSSLLSFYSRHTCLFLFHFLLLSFHSSSIFIT

SEQ ID NO: 161388 - protein, 167 aa, Triticum aestivum
  unsure (1)..(167): unsure at all Xaa locations
  Clone ID: PAT_TA_55806.pep
FILTIASQFQELVGISVMKILFRHSAAEVYMGQPGTTECMSNLKVQQAFRRLWIRLKGIEKQVVAMNVSPXLKNRTGRVKFPHRLVYPGTSPHKGQTKGLXARGIPNSISRLGPPALLACLLAPDTRYWALWVLSRCPPPPDLDNNKVIMRGCSTGPDGHSVCVRRV

SEQ ID NO: 161389 - protein, 84 aa, Triticum aestivum
  Clone ID: PAT_TA_55807.pep
FLKRLVARHAIYCILTQAFWSTYKPNKKAPPRGHHRRLPIQRQAAPPAATCGNPCLQLGFPTDRMHEEENTPLLFTCYPWARTT

SEQ ID NO: 161390 - protein, 206 aa, Triticum aestivum
  Clone ID: PAT_TA_55808.pep
EAGARFAKWRAVLKIGPGAEPSELAVKQNAEGLARYALICQENGLVPIVEPEILTDGPHDIKACAAATERVLAAVYKSLNDHKVLLEGTLLKPNMVTPGSDSPKVGAEVIAEYTVAALRRTVPPAVPGVVFLSGGQSEEQATQNLDAMNKLPVLKPWTLTFSFGRALQQSTIKKWAGKKENVADAQATFLARCKGNSEATLGKYGG

SEQ ID NO: 161391 - protein, 98 aa, Triticum aestivum
  unsure (1)..(98): unsure at all Xaa locations
  Clone ID: PAT_TA_55809.pep
PQHQQQHQPPPPPLGRVSFPPPXAQFPLGRGPFPPFXQNPRARGFFPPPQLPPFGEIRKLALQPLPPVCNFSPPPNWSPPLAPFGFLGANLKKKTLCP

SEQ ID NO: 161392 - protein, 124 aa, Triticum aestivum
  Clone ID: PAT_TA_55810.pep
MSTMDGIINTVSANIPMAPLFGLLKPNGKMVMVGLPEKPIEVPPFALVARNKTLAGSCIGGMRDTQEMLDLAAKHGVTADIEVIGAEYVNTAMERLAKADVRYRLVIDIANTLDKAAAAATTTE

SEQ ID NO: 161393 - protein, 95 aa, Triticum aestivum
  Clone ID: PAT_TA_55811.pep
HGTGGTYGFTDTDLKNDWATGPGNRTTPGVILDSKSLLDAPIDIYRPDQTQLSTYVLYAIPKHTKLTPMHGWHDKRETPRASKEMELEPADTTTS

SEQ ID NO: 161394 - protein, 164 aa, Triticum aestivum
  unsure (1)..(164): unsure at all Xaa locations
  Clone ID: PAT_TA_55812.pep
MKGAKSKGAPPRADXPSWXGEEARGXRRKLGSPRGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSYEDEDD

SEQ ID NO: 161395 - protein, 112 aa, Triticum aestivum
  unsure (1)..(112): unsure at all Xaa locations
  Clone ID: PAT_TA_55813.pep
RAATLGGPGTRPATGLDKLRRAGATQPIAINTDAGDANKQSTAMPTTLTTPVTASSSTPPSGGSVWPSVIHPGSNLATKSLGANLLVRPQPNVXHVYDWLYRHETRTWSNHR

SEQ ID NO: 161396 - protein, 211 aa, Triticum aestivum
  unsure (1)..(211): unsure at all Xaa locations
  Clone ID: PAT_TA_55814.pep
PRGESGGEEVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKIARREERLAXGPRDHAPAPAAAAPAQAAAA

SEQ ID NO: 161397 - protein, 173 aa, Triticum aestivum
  Clone ID: PAT_TA_55815.pep
MALLATTPLLAPLALSPAPISASQSSLLFLRAPAPALLSLRSASPGARLLAAVASKEPELGGGGSGGGDGAGSGGGGGGGSDPQGGGDEGEDEKMGEGLSMSQKLTLAYAALVGAGGVMGYMKSGSQKSLAAGGISALVLFFVHTQLPVRPVFASAIGLGISAALLSVMGSRF

SEQ ID NO: 161398 - protein, 69 aa, Triticum aestivum
  Clone ID: PAT_TA_55816.pep
TVGSLGGLAALTVFVFYLLHQRKRKRAVASDELMRSGSSMTSYSKDLELGGSPHIFTFEELEVATDGFS

SEQ ID NO: 161399 - protein, 87 aa, Triticum aestivum
  Clone ID: PAT_TA_55817.pep
SNCGNRGSVCGCVEYGPFAARTGASSVVGFLVTSCGGYAEFKASSGGFVLTQTHVLCVGTQLVRSSRVVYTTRGGAMFFPHKDPGMI

SEQ ID NO: 161400 - protein, 53 aa, Triticum aestivum
  unsure (1)..(53): unsure at all Xaa locations
  Clone ID: PAT_TA_55818.pep
LIITHEVPDGLRSCRIFCHFGSCKLVQPLSPIETLALSVGFNSXKIXHDQSXY

SEQ ID NO: 161401 - protein, 61 aa, Triticum aestivum
  Clone ID: PAT_TA_55819.pep
MKMAHPPAVKGQVVGWPPVRSYEKNTMGIILCAPKIKYEADSRQTPAPDWLYVNASMDGAS

SEQ ID NO: 161402 - protein, 142 aa, Triticum aestivum
  Clone ID: PAT_TA_55820.pep
MVQDKHQHHTISTHRTGTPATPPLTEGLFTYRHSTDTGGGADRKQADFHRLTQGDNHHTHKAHLGQMPPPSSEPNPSTRRTQRDKDPDHARSHKNKEEVASYGSNLTYAFMLHHHLYMKQDHIEANEASCTEEAPPLTLDHP

SEQ ID NO: 161403 - protein, 165 aa, Triticum aestivum
  unsure (1)..(165): unsure at all Xaa locations
  Clone ID: PAT_TA_55821.pep
MAMATSTFSPHPLSLKPQLGPRPHRLHLAPFPRLRSHRRLAAAGEAPVEAPPKPAEADPSPAASNGSAAAAPAAAAPAAPVAAAKAEAVASPKFQDSRWVNGTWDLSRFGNTGGAVDWDAVIDAEARRRKWLEDSPEANSSXYAVGFDTLIIPWWAWIKRVHVPG

SEQ ID NO: 161404 - protein, 123 aa, Triticum aestivum
  unsure (1)..(123): unsure at all Xaa locations
  Clone ID: PAT_TA_55822.pep
RAGNPGSDQRPGPTKVIDWGYANDTACSQAEDVPEIDWCEPGEAAVMXALLGTKDGFLTERIKSYVFDRNYSTKPTVLFGLFSYLHSGHIPAQRCSLEAKKRLHLTAKSVDALLEELIIRTEL

SEQ ID NO: 161405 - protein, 108 aa, Triticum aestivum
  unsure (1)..(108): unsure at all Xaa locations
  Clone ID: PAT_TA_55823.pep
GGPHQFIXIQTRGGRKKKGKNAKGAYQTECLGFPECVDLVSTSRLTETGALPRVRARAVLTAAHLAGPQVAQHLPRHLQRPLGSRLAALPSGLVVAQAAHGPERAGVT

SEQ ID NO: 161406 - protein, 77 aa, Triticum aestivum
  Clone ID: PAT_TA_55824.pep
NCKSHSIGCTSELHQITSTPELKINRGPTSDSVTKGAAKFGRIYKEAAPPARGDLNSGLDPGRGILSLAWALGNPAD

SEQ ID NO: 161407 - protein, 131 aa, Triticum aestivum
  Clone ID: PAT_TA_55825.pep
SRVLGPTCYGRRPCSRALWIKIGWQVVAAGACLLRESNEIPLGTINFVSEGGAHIHVNEKDRQGYLVRKQEIVFLCFLLEQDGQWRSPQINCNNKNNNNNNNDYNSNDDQEDDGHKGLNMNMCPFVFYEVA

SEQ ID NO: 161408 - protein, 70 aa, Triticum aestivum
  Clone ID: PAT_TA_55826.pep
ANPRGHRPGSRLELVMGYTDSASHKSPSAVGISALVLFLGLKPLAVRSVVCFGPLVSVYGWLSCHIGDLL

SEQ ID NO: 161409 - protein, 122 aa, Triticum aestivum
  Clone ID: PAT_TA_55827.pep
PCKVVEVSTSKTGKHGHAKCHFVAIDIFNGKKLEDIVPSSHTCDVPHVDRQDYQLIHITDDGYVRLLPESGHTKDHLKLPTDDVLLGQIKTGFADGKDLILSVMSPMGEAQICAVKETGGGK

SEQ ID NO: 161410 - protein, 97 aa, Triticum aestivum
  Clone ID: PAT_TA_55828.pep
QGTPGRPLHHVHSISPSTASFARSPFGSRNHNPGNTPRSPAAPFSTASPSRFAGTGHQGHHPSASLPATNFVASSPSPAASGGSSSVFRDHRPPSST

SEQ ID NO: 161411 - protein, 139 aa, Triticum aestivum
  unsure (1)..(139): unsure at all Xaa locations
  Clone ID: PAT_TA_55829.pep
TVYSPLKHXGLMTPGLRGGIMGLGGVGHMGVKVAKHPLEPYLALLKMDGKLVLMGVIAEPLSFVSPMVMLGRKTITGSFIGSMDETEEVLQFCVDKGLTSQIEVVKMDYVNQAFERLERNDVRYRFVVDVGGSNIEDAA

SEQ ID NO: 161412 - protein, 114 aa, Triticum aestivum
  Clone ID: PAT_TA_55830.pep
SCDTLRKEDVQLGEDKWEREEVAEDVVGDLKVSGANDEVERAIILSQGTVAALLVLEFEPFISCNLKPISISFISRSYLYLLNRTRSVFSLDLYATARLFRPQYKYILCGSLEE

SEQ ID NO: 161413 - protein, 129 aa, Triticum aestivum
  unsure (1)..(129): unsure at all Xaa locations
  Clone ID: PAT_TA_55831.pep
IVYGKRKHGGVAQIKFHRGNRSVGEKTAGRRLGGFTCRQLRLWVNEDSASEYFEVIFVEVAQGAVRVDPGVNWLSQPVRQHRGLGGLASAXKRFGGLRGKGPRRLKNRPSVRXRWKSNHARFLMRPPLS

SEQ ID NO: 161414 - protein, 65 aa, Triticum aestivum
  Clone ID: PAT_TA_55832.pep
TKISTNQTNIHNSYFIPQPTPHRQCSTCYQVFYTENQYGFTTPKGTITIQLHCPSLQQIIIKMKN

SEQ ID NO: 161415 - protein, 122 aa, Triticum aestivum
  unsure (1)..(122): unsure at all Xaa locations
  Clone ID: PAT_TA_55833.pep
LVQQLCCQQLCQITEQSXCQAIHXNVVHESIMHQQQQEQQQQQXRQALSQVSFQQPQQQYPSGQGSFQPSQQNPQAQGSVQPQQLPQFEEIRTLALETLPAMCNVYIPPYCTIAPVGFFGAN

SEQ ID NO: 161416 - protein, 130 aa, Triticum aestivum
  Clone ID: PAT_TA_55834.pep
KTSRPGEKGGKYRSAPNLNRYCRRLPRRADPLHPSRRCCLLPAARVAPHPRAAPLPGPPPCRLRQSSPLSLEGASPTRLVGGGAAADRCPPPKASPAPESTASDRGTARRRGYCFRSAAPGPDRRALPCS

SEQ ID NO: 161417 - protein, 195 aa, Triticum aestivum
  Clone ID: PAT_TA_55835.pep
VKKFLKKTTKLFGNGKALHQISSAIKEAQDLATELVGLRKKYELDMRSTSNGATIDPRVLALHKDVGELVGVDCTRDELIKTLICEDGSSKEQLKTISIVGVGGLGKTTLTKAVYEKIKAQFDRVAFVPVGQNPDIKKVFKDLLYELDNEKFSDIHNTTRDENLLIKQISDYLVDKRYSSRSACVLLYTFRKCVK

SEQ ID NO: 161418 - protein, 57 aa, Triticum aestivum
  Clone ID: PAT_TA_55836.pep
RAFYVSLLSDVIWSSSTANDVNRAMALEMKISPLVASLFNYGKSMAVIFNRSSEYTW

SEQ ID NO: 161419 - protein, 84 aa, Triticum aestivum
  Clone ID: PAT_TA_55837.pep
AYLGDTCSSTILSGSIEIIHAQPDLAAHLAASDFAHLQRRTSCIYWLFLSSREVHQAACFSTTLLTETPACRSRFRWDYETGFT

SEQ ID NO: 161420 - protein, 153 aa, Triticum aestivum
  Clone ID: PAT_TA_55838.pep
FGHTSQGSRFCTRPGGSTIVRRRVALHPARSTVGQHRLAVAPGQCVVLSGYEAFPSSYPRRVPVLGRSRVRTIFMMAIGGERVSSRLRVRPLRHPSLVRLTHGPHHPSATSGSWASSVDRCSRLASSLDLCPRIGIPGRVFSGLSLGSRVSTP

SEQ ID NO: 161421 - protein, 74 aa, Triticum aestivum
  Clone ID: PAT_TA_55839.pep
GRVGPFVGLIAAACGQLDQVLQDSCNGHVVAAKHKLGDSSSTPLVHQNGHAQKQANGGVANGTCHANGNGSTHG

SEQ ID NO: 161422 - protein, 199 aa, Triticum aestivum
  Clone ID: PAT_TA_55840.pep
RLTSLQGKLDAQRRIAVKRFSRSAWPDPRQFMEEAKSVGQLRNKRIVNLLGCCCEADERLLVAEYMPNDTLAKHLFHWESQAMVWPMRLRVVLYLAEALDYCISKERALYHDLNAYRVLFDDDCNPRLSCFGLMKNSRDGKSYSTNLAFTPPEYMRTGRITPESVIYSFGTLLLDVLSGKHIPPSHALDLIRDRNLVCS

SEQ ID NO: 161423 - protein, 117 aa, Triticum aestivum
  unsure (1)..(117): unsure at all Xaa locations
  Clone ID: PAT_TA_55841.pep
PPPKPRPQAKRQERNATQPRTNHPPTQAAKGPPRMAVLPAGPPPPXRXVRGSPPKAPPPPQKEWXGXEKTSGGGASSAMGSGPGGASMGWRVRGRGRAVGEERAGAXLPRGELLLFA

SEQ ID NO: 161424 - protein, 185 aa, Triticum aestivum
  unsure (1)..(185): unsure at all Xaa locations
  Clone ID: PAT_TA_55842.pep
VVGLPTPIFSPTNPPIPLAAAAAAGVACPRKKKAVHKTTTTDDKRLQSTXKRVGVNTIPGIEEVNIFKDDVVIQFQNPKVQASIAANTWVVSGTPQTKKLQDLLPTIINQLGPDNLDNLRRLAEQFQKQMPGGEAGGASIGAAQDDDDDVPELVPGETFEEAAEEKKEPEAKKEAEPEEKKESSS

SEQ ID NO: 161425 - protein, 162 aa, Triticum aestivum
  unsure (1)..(162): unsure at all Xaa locations
  Clone ID: PAT_TA_55843.pep
PANTGDRPGHLPSCGGRGRRASTGAQGRGXPRHRQRPRRARAFGGGEGRRRRWCTAYPPCLLAFPSSAAPPRCAAEAVSAAHAPASVVHPPARGTTVRQPPPLPGLAAPSTPHTPPPLPRLAAPSSILPASALRPPARGMAAAVACARQNGRSRRRCRKRNG

SEQ ID NO: 161426 - protein, 113 aa, Triticum aestivum
  unsure (1)..(113): unsure at all Xaa locations
  Clone ID: PAT_TA_55844.pep
MHPPPAAAAASAAECGGAPAPSEHAAYPRLSPEDLAPPPPPPYHAAASYSPPPVSGNPYVSGPAAGSVPPPKNTMDSVKDLLGKMGMRFGGVVRMTENTGGGFWXPLYTGPSI

SEQ ID NO: 161427 - protein, 81 aa, Triticum aestivum
  Clone ID: PAT_TA_55845.pep
SPCTAPRRRKGTGTKGGYPPAGYPPGGYPPPAQGYPAAGYRQHGYPPEYAQQSAAHQDSGTCFMEGCLARLWCWCVLDVCL

SEQ ID NO: 161428 - protein, 141 aa, Triticum aestivum
  Clone ID: PAT_TA_55846.pep
PLAPVICNGDPRYVVTAILFLSSASFIPCGDAPASDAMHIALWPVSAVVAGSVPCVLTYQAPCHSPLKAASPTWSRHRRVDPALDSASRTSRCQVVQVSQAPLSPRWTTPADPFASLFAHTPSSSTFDQQLKITLEVNLNP

SEQ ID NO: 161429 - protein, 61 aa, Triticum aestivum
  unsure (1)..(61): unsure at all Xaa locations
  Clone ID: PAT_TA_55847.pep
GGLXXXKGITPXTPXKGRXXLXKFEXSPXIGLLQXSKPFSXLSLXXMKXQXWAXXTXCXKY

SEQ ID NO: 161430 - protein, 100 aa, Triticum aestivum
  Clone ID: PAT_TA_55848.pep
PGKGGKGLGKGGPKPPRKVSRGNIQGIPKPAIRCLARGGGVKRISGLIYEETRGVLKIFLEKVTRDAVPYKEHAPRKPVPPMEVVYPLKRQGRPLYGFGG

SEQ ID NO: 161431 - protein, 106 aa, Triticum aestivum
  Clone ID: PAT_TA_55849.pep
GELGLVVCKMDAPWWSKRKSIPNGVQTQRNFLEIFSGPEHTCWAKEVSEGGLRGEHNPPGAPGPRHAQVGCPTSMAFHTASLLYKYPNIPETLGESTKINSSRHKF

SEQ ID NO: 161432 - protein, 78 aa, Triticum aestivum
  Clone ID: PAT_TA_55850.pep
MFFFGGNWGWGSPCKWGKGWGGCNMYPEVEPPGPPLLVSAPPPQKASSGGMKMGGENGGWGCPQCKWGPSWGCSCCSC

SEQ ID NO: 161433 - protein, 68 aa, Triticum aestivum
  Clone ID: PAT_TA_55851.pep
AAPVRGLFIVVSQRMGLKKCRPCQEIGCVQASVQCSFFMCGVWPEEPLFCPGCLKMSLDVGTRRLRAC

SEQ ID NO: 161434 - protein, 91 aa, Triticum aestivum
  Clone ID: PAT_TA_55852.pep
KKQVVAALKLVLVVLAAAPGGGPPAFQGSQLAVWALGILSGAKPNGEFFGHLRGQQPCFFQYPKGPPFGQYIRSPPGGDPLQFLGLPVPPC

SEQ ID NO: 161435 - protein, 93 aa, Triticum aestivum
  Clone ID: PAT_TA_55853.pep
QYMAEKRSQRSLRWVLDTFRMYTLGEGRGSIKGHLIGSPTKGSVARLPSFKECPGLHTKGPVFALQLKEPAKPSICGLGYPRRDGDSLWGAQG

SEQ ID NO: 161436 - protein, 71 aa, Triticum aestivum
  Clone ID: PAT_TA_55854.pep
CERPWGIDIYLYHWTCVRDIWRSRFILKHHLGHLALMSTQRSTRLILAMTEQLALYKGPLPHQIALGGSGL

SEQ ID NO: 161437 - protein, 72 aa, Triticum aestivum
  Clone ID: PAT_TA_55855.pep
GFLLTHPRLMMSRGIPKQVTPAGPYIKILIICCHFAQPMGCQQPVLVVKRPQNHVGVFVDVCTGHVLRAPVG

SEQ ID NO: 161438 - protein, 95 aa, Triticum aestivum
  Clone ID: PAT_TA_55856.pep
APLLFGVTRPLRCNTLLSRDGIVTAQVNPVGGPRPLRLCASLNTPPACSSAAHQYASQRQWPRCFLLCLVLRRTLQLYHARLMIIVIQSRTLVAP

SEQ ID NO: 161439 - protein, 130 aa, Triticum aestivum
  Clone ID: PAT_TA_55857.pep
RAALPKNVTLGNHVRNSSQAAALVAAVLQGDAALIGSAMSSDFIVEPTRAPLIPGMAAVKAAALEAGALGCTISGAGPTAVAVIEGEEKGEEIARSMVDAFLSVGKLKATATVAQLDRDGARVISTSSLE

SEQ ID NO: 161440 - protein, 137 aa, Triticum aestivum
  Clone ID: PAT_TA_55858.pep
VFPAKHPTVLWCCGWKSFRVKGLSNVDVPCYLFMVSCVSSDHWFVVPTAQCDKNAQSPGENLFHITGYVFVTVAPHKLQEQEFCGSSSPYFLVYLCLVFCVRCIRCIFTETLCLVWFLIGIFRAAISDSVLSSECYF

SEQ ID NO: 161441 - protein, 101 aa, Triticum aestivum
  Clone ID: PAT_TA_55859.pep
WVEGTIAEIADPSLGRHYPRGEVLKCINIGLLSVQQKPNDRPSMSSIVVMLGSDTVSLEAPYRPAYVLDRSRSYSETTELINEQISLETHSSITELAPRYT

SEQ ID NO: 161442 - protein, 147 aa, Triticum aestivum
  unsure (1)..(147): unsure at all Xaa locations
  Clone ID: PAT_TA_55860.pep
VVDVVALSGGHTIGLCRCTSFRQRLYNQSGNGLADSTLDVSFAAHLRQGCPRSGGDNNLFPXDAVSSTKFDNFYFKNILAGRGLLSSDEVLLTKSPETAALVKAYADDVHLFFQHFAQSMVNMGNISPLTGSKGEIRKNCRRLNNSH

SEQ ID NO: 161443 - protein, 147 aa, Triticum aestivum
  Clone ID: PAT_TA_55861.pep
RPGERRVWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 161444 - protein, 77 aa, Triticum aestivum
  unsure (1)..(77): unsure at all Xaa locations
  Clone ID: PAT_TA_55862.pep
IGRKKGSAARSKKNSAEGPECXVPPHAPEEAKXSSNVHSKLDEGQQGRSVDSHSQQQCSGVSLLACIRSPLGQCARG

SEQ ID NO: 161445 - protein, 114 aa, Triticum aestivum
  Clone ID: PAT_TA_55863.pep
AGLCLSAVRCKDISVGGWYDGMVPNGHRSMFEVRITPGRFMRCWRRLRMEPPQEYVRINVYDGHAVGPVRQISPLQGRWHIRRRVSPYTAVLTLAFRWSAIPVLACLTCIWVSS

SEQ ID NO: 161446 - protein, 50 aa, Triticum aestivum
  Clone ID: PAT_TA_55864.pep
RSPLQHLWRLARCYSILLDLFPLSSRFLTQLRLGPTHLHLFNPFLPNRFC

SEQ ID NO: 161447 - protein, 179 aa, Triticum aestivum
  Clone ID: PAT_TA_55865.pep
AQTMASMTGLSQGVRLPGPAGRRASRFIVRASSAEAEAAGRRAVLGLMASGVVGSAFAQVVHAGTVAAIKVGPPPPLSGGLPGTDNSDEARDFDLPLKNRFYLQPLPPAEAAVRAKESAQDILNLKPLIDKKQWPYVMNDLRLRASYLRYDLKTVISSKTTKEEKKDLKDLTGKLFATL

SEQ ID NO: 161448 - protein, 47 aa, Triticum aestivum
  Clone ID: PAT_TA_55866.pep
NNTCHCDDDIHCISRKITTLATTCINQCPLATTCIKQSPILLGPGLT

SEQ ID NO: 161449 - protein, 66 aa, Triticum aestivum
  Clone ID: PAT_TA_55867.pep
HLLLPASVVVKEEETMTLFDCVEGLISELGSFSLHTHIVGLIQPQHLIYNAIMAVFGWSPYGIRTD

SEQ ID NO: 161450 - protein, 101 aa, Triticum aestivum
  unsure (1)..(101): unsure at all Xaa locations
  Clone ID: PAT_TA_55868.pep
VGSKKXGHRGFGFVTFAEDGVADRVARRSHEILGQEVAVDSAAPVEGGPSRGGYIEPPGPYGAYSPMMSYGQFSGSLGYDYGYGPSGSSSRSRVQPRYRPY

SEQ ID NO: 161451 - protein, 156 aa, Triticum aestivum
  unsure (1)..(156): unsure at all Xaa locations
  Clone ID: PAT_TA_55869.pep
MAAASVSLKSSLFLSSPLSDFGGAAISISAQNRRRSWQPXGARMQVAAAADSKNILIMGGTRFIGLFLSRKLVQEGHQVTLFTRGKAPITQQLPGESDAEYAEFSSKVLHLKGDRKDFDFVKTSLAAKGFNVVYDINGREATEVSPILXALPNLEQ

SEQ ID NO: 161452 - protein, 121 aa, Triticum aestivum
  Clone ID: PAT_TA_55870.pep
IGFLFTAVVTGIFGFLSALSPNYMCLLTLRFIVGMGLGAGHVLGTWFLEFVPAANRGTWVVVFHCTWSFGTILQALIAWVFFLISLPFSAQLSVCCQFTISHICQSTLFISVILGFILLIL

SEQ ID NO: 161453 - protein, 51 aa, Triticum aestivum
  Clone ID: PAT_TA_55871.pep
LSSGINMLICYSMVFVYNHKYVSITVPSIVHVTVAVLPCHPVVDFMVVAEG

SEQ ID NO: 161454 - protein, 125 aa, Triticum aestivum
  Clone ID: PAT_TA_55872.pep
APLPQFTCVSYSSGSMTTRLCLIVRWRGNTCERFPYGYAYYIIPVHTSLRETKLCSALQHCRQLFERTLLQPDTDTSATTWYNGFPGRKCTEAGRARCNDYHLPCSTPSRVHFNIPCMQCSSLAR

SEQ ID NO: 161455 - protein, 68 aa, Triticum aestivum
  Clone ID: PAT_TA_55873.pep
CCQLVLNFVIAKGKEKRWCRRSFSRHDGSLTTMSQGHPHGLVTLFQVCLSLPTQPPCSGCYYFGYSMD

SEQ ID NO: 161456 - protein, 189 aa, Triticum aestivum
  unsure (1)..(189): unsure at all Xaa locations
  Clone ID: PAT_TA_55874.pep
XKQQTLAPFPRLLRPDPSLHPPPRSRWSSSLSLLLLHQDSQHVHPSLGAMVAVGTERGRNAVGSPPAGGSSIGADEATDVIHRLPRCSSASAREEAAGGGMSSTGRIRERGKERIPARRLLGSVQPWSWRCGFPASLLHLHVDLGGTLDVAPPMAVARFGVRGAMXLVLPLLDGAGYVNKTDRGLSPTV

SEQ ID NO: 161457 - protein, 210 aa, Triticum aestivum
  unsure (1)..(210): unsure at all Xaa locations
  Clone ID: PAT_TA_55875.pep
IIENLPIXVGCLGACTYCKTKHARGHLGSYSIDSLXRVKIVVSEGVREIWLSSEDTGAYGNFSIQIVIDLRSVTYHILPFYFASVILYFLGRDIGTNLPNLLNAIVAELPADRSTMLRIGMTNPPFILEHLNEIASVLRHPCVYTFLHVPVQSGSDAVLKAMNREYTVSEFRMVVDTLCELVPGMQIATDIICGFPGETDEDXVETVNLI

SEQ ID NO: 161458 - protein, 157 aa, Triticum aestivum
  Clone ID: PAT_TA_55876.pep
MAAVDLPKKYKAAVYDKPGSISTKIEELDMPEPGPGEVLIKVTHSGVCHSDMGVMMNSWSILPFPTQAGQVGGHEGVGKIVKLGPGAENASVKIGDRVGIKWMASICLNCEACRAGMDGNCFNGKISGYYTPGTFQQYVLSPANYVTPIPDGLDSAA

SEQ ID NO: 161459 - protein, 169 aa, Triticum aestivum
  unsure (1)..(169): unsure at all Xaa locations
  Clone ID: PAT_TA_55877.pep
MAPVKLYGATLSWNVTRCVAALEEAGVEYELVPINFGTGEHKSPDHLARNPFGQVPALQDGDLYVFESRAICKYACRKNKPELLKEGDIKESAMVDVWLEVEAHQYTAALSPILFECLIHPMLGGATDQKVIDDNLVKIKNVLAVYEAHLSXSKYLAGDSLSLADLNHV

SEQ ID NO: 161460 - protein, 84 aa, Triticum aestivum
  Clone ID: PAT_TA_55878.pep
HFRNSSLMNEDKWCRPILFHKDGPNAGEQEPFPVGNNIRPRSGRNRPLHSSDTRGDASLSTSPNQENSSRRANAAEGEDSMFAH

SEQ ID NO: 161461 - protein, 76 aa, Triticum aestivum
  unsure (1)..(76): unsure at all Xaa locations
  Clone ID: PAT_TA_55879.pep
VKIWVHESKHIXVQVIRQEVPVSTNQIVSCTCFIWSAYGSAVYAGYTYGAIGMYKISGFSYCQLGYVLVLEASGVV

SEQ ID NO: 161462 - protein, 96 aa, Triticum aestivum
  Clone ID: PAT_TA_55880.pep
FFFFFFFFFFFFFLIFFGFFFFLNFFNKWVWQTKKKKTRGGMQAKKGPDKRGYPFLLGKNKKEVKRVHEKSRNGKMLFWLQGSAKGRNVSRVQPRS

SEQ ID NO: 161463 - protein, 108 aa, Triticum aestivum
  Clone ID: PAT_TA_55881.pep
PVAVAGAKPELPLVRRWWNSSLRHATVTCSAASTCGPALQRAPPRTPAWGRRWPNAARKEVEGAGEAGEERCRRGRQGVQRMRWPAGSACGDERDGRDRGLIAFCYYE

SEQ ID NO: 161464 - protein, 69 aa, Triticum aestivum
  Clone ID: PAT_TA_55882.pep
AKMTANLRTNLLGGGGLTHIDATQAEPLTVPRPHHATASDKGNHFELLQDNWLEVHVAAALLSSAAVAV

SEQ ID NO: 161465 - protein, 131 aa, Triticum aestivum
  unsure (1)..(131): unsure at all Xaa locations
  Clone ID: PAT_TA_55883.pep
LAALLVDKVGRKLSMGAFAFLCXLSVAPLAAPLEEGLATVLLFSARTCITGSYAVLYIYGPEIYPSSCRNTGVGVATSLGRIGGMIAPLIAVGLLESCHQKEAVFVFDLVLFLAAVACALFPLETKGCQIQ

SEQ ID NO: 161466 - protein, 101 aa, Triticum aestivum
  unsure (1)..(101): unsure at all Xaa locations
  Clone ID: PAT_TA_55884.pep
VLGKALRMMGVDHMHMGPVVGMLLGAIKMVLGFVDLLAHDFICDAXSSWIFFCQVGVSCGDVKPVSTXGIHVWHMTGQRAIFWWDCCITIWCRCPRPALDE

SEQ ID NO: 161467 - protein, 139 aa, Triticum aestivum
  Clone ID: PAT_TA_55885.pep
RMPFHTDPIYGLGSPCGNPLFICKVGTPSGAGLEFADQFPRGDPGPKCSSNPVSGSKKGNAVAPQAPVRELTGGSPVTWLCAPGHNGRCTVGCSRSSSALHPARNGGCPSWPRSRHVCNPWHTGFPGGVVHQDRPGRRL

SEQ ID NO: 161468 - protein, 78 aa, Triticum aestivum
  Clone ID: PAT_TA_55886.pep
MFFCGGNWGLGSACKCGNGFGGFNMYPKVEAAGAPLFVAAPATQKGSSGGMKMAAENGGFGCPQCKWGPSWGCSCCSC

SEQ ID NO: 161469 - protein, 78 aa, Triticum aestivum
  Clone ID: PAT_TA_55887.pep
LDLSSCSALEFQIERVQIIVSSFQNFIWFLLGWCHCQREEFEFFSKDMMKTRPLGDHLREFNHGDGCPKSHWRKAELL

SEQ ID NO: 161470 - protein, 86 aa, Triticum aestivum
  Clone ID: PAT_TA_55888.pep
QSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 161471 - protein, 179 aa, Triticum aestivum
  unsure (1)..(179): unsure at all Xaa locations
  Clone ID: PAT_TA_55889.pep
WVIISGAGGGLGHLAVQLSSKGIGHRVIGIDHSSKKDLVMESGAEHFIPVDGTEDMVAAVQGLTEGLGAHAVVVCTANNAAYGNSLDLLRFGGRVVCVGIPEGDVVPMKCASPGLMVLKSLQIVGSAVGDRREAIETMDFAKRGIIKTHFRTEKMEKLXEFFEEMHKGELKGRVVLDLS

SEQ ID NO: 161472 - protein, 70 aa, Triticum aestivum
  Clone ID: PAT_TA_55890.pep
MQSETVVETSNTEKERSLLVKISELQSRMITLTDELISAKQKHVQLQQELNALYCREEIEDIRDEDNEET

SEQ ID NO: 161473 - protein, 80 aa, Triticum aestivum
  unsure (1)..(80): unsure at all Xaa locations
  Clone ID: PAT_TA_55891.pep
MENGYPYEVIKAGFTILEGKXTVFCILECRQWSXILKXDYLXKSICSRKWPSICKQPSIDTNIQKLYLTLSKPRKTVTPY

SEQ ID NO: 161474 - protein, 80 aa, Triticum aestivum
  Clone ID: PAT_TA_55892.pep
MLNLLSCEIFELTCNASFATLFLKKKKKKKKKKKKKKKKKKKKKKKKKKKKKKKKKKKKKKKKKKKKGRALLKEQNFPGM

SEQ ID NO: 161475 - protein, 73 aa, Triticum aestivum
  unsure (1)..(73): unsure at all Xaa locations
  Clone ID: PAT_TA_55893.pep
KDALHLKYTSDPFHVLGMIKMLYRAGADRLRTAMWGALGNPHGVCTRVVIDQVLLSVSXKPNNAMHATEALCR

SEQ ID NO: 161476 - protein, 99 aa, Triticum aestivum
  Clone ID: PAT_TA_55894.pep
QRLRFDPLGRVAPSTGGRDYLVIAGQMAAPSCFELMFLSRSIQISIQLEPSSRIGLPDCSVARSIGITLHCHHHLEPCTSERRTTVADASMHLLANSLN

SEQ ID NO: 161477 - protein, 141 aa, Triticum aestivum
  Clone ID: PAT_TA_55895.pep
MVKAVAVLTGSEGVKGTIFFTQEGEGPTTVTGSVTGLKEGLHGFHVHALGDTTNGCMSTGPHFNPAGHVHGAPEDEIRHAGDLGNVTAGVDGVASINITDCHIPLTGPNSIVGRAVVVHGDADDLGKGGHELSKSTGNAGA

SEQ ID NO: 161478 - protein, 138 aa, Triticum aestivum
  unsure (1)..(138): unsure at all Xaa locations
  Clone ID: PAT_TA_55896.pep
MDLHKEVTAARLTDDLVVDILSRLTYKSFCRCKCAYKAWSAFSADPDYCKKLPKKVTTGLLYQGHNKSAIPLVSLSQDDGEIDGILSDMPQYEHLEFLDCCNGLVLXKYRSSYTSPGICRFVVCNPATREWRILPDTH

SEQ ID NO: 161479 - protein, 182 aa, Triticum aestivum
  Clone ID: PAT_TA_55897.pep
GQAILPRSCIARFLSHNHRHGERPIPWDYRHDVGPCLPLPSPPRAGVEARALLLLLTYRCHDAHVLTWDAPKLNYFDLGYLLSMLRLDRVDLSNGALLWARSWTELPTGPRLPALPRLRPGGDYDCLQQPARLRLHLATQPHAPYVTLKEQVQPDDLNRHSLYDTREMVADRSMLEWVDTMY

SEQ ID NO: 161480 - protein, 97 aa, Triticum aestivum
  unsure (1)..(97): unsure at all Xaa locations
  Clone ID: PAT_TA_55898.pep
MEAIAGLVAVSHNRNELVVIRREGXPGARTVKQHNRGACQIXIDDLVLRPGGDPFVICNECTLPVCTDCYKYKRREGTQSXPKCKTCYKRLMLCPLV

SEQ ID NO: 161481 - protein, 74 aa, Triticum aestivum
  Clone ID: PAT_TA_55899.pep
SQQQPLVYLVRSRLDSDLAWANTHHMFFDSCYFLVPSFTCSLVPCVTLTPRCLTRVLVCPAKCNIVLLGYLVSS

SEQ ID NO: 161482 - protein, 205 aa, Triticum aestivum
  unsure (1)..(205): unsure at all Xaa locations
  Clone ID: PAT_TA_55900.pep
IDIALXXKFETTKYSCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQNVYKIGGIGTVXPVGRVETGVIKPGMVVTFGPTGLTT

SEQ ID NO: 161483 - protein, 170 aa, Triticum aestivum
  Clone ID: PAT_TA_55901.pep
MAEPSVKGLGKSSPDVVEGNEVDRLSKLPDDVLLNIVERLDIADAARTTILSRRWKQIPAILSKLIIMVGSFHPNHESRKLTSDDIVRANTIVLEATRSILERRAGSPYTIHLLRMQFYLGDESIFIGQTVANTIATQKVASVEFTIMTKVRKKITNNGLLTYGRQFMSF

SEQ ID NO: 161484 - protein, 104 aa, Triticum aestivum
  unsure (1)..(104): unsure at all Xaa locations
  Clone ID: PAT_TA_55902.pep
MTRDALDAIILDLVMGGXPLKVGREKKSLETAPAKTLATXNNEIHSTVKVGLEYPNKLLEQAXDQGTNFNCVPEGDFLNLDNENGVQNGQHVSIIDDRKPLIDR

SEQ ID NO: 161485 - protein, 183 aa, Triticum aestivum
  unsure (1)..(183): unsure at all Xaa locations
  Clone ID: PAT_TA_55903.pep
TLPPPPSLVRPTVHELAAAVEEPPCTYLVAHEQHQVLLAGXEMPEPIPLIHLSRFTTAADDPKAARFRRVLQTWGLFRGPTIESMEFLIDAMISAXRELFRLPFEEKQKCRNLXDSGGKHSEVEGYGNDQVVNQAEGLYWNTPAAICGWSPNMRGISPSGPLYPNLSWMCFLSTHHEPREYTS

SEQ ID NO: 161486 - protein, 152 aa, Triticum aestivum
  unsure (1)..(152): unsure at all Xaa locations
  Clone ID: PAT_TA_55904.pep
ITFFSQAVSECILRGGLKNTPAGIPDVLVAHMNAADCXLMMEVEHXVPVPMGPAIPVFVLARCKVTXKITCIIDNXSFYYFDTNAARALAYEYVRFSPRLPFISHIRGWMSLLFVYKGPPCYPGIWYWISFCYAARSPALDXLWLLDMPDWK

SEQ ID NO: 161487 - protein, 63 aa, Triticum aestivum
  Clone ID: PAT_TA_55905.pep
PQSVCASVAIGQVLLCVWWKATNASYDSQAFLVLKYKLAGVLEIIKNVKWGLNKFSIDPVPKL

SEQ ID NO: 161488 - protein, 58 aa, Triticum aestivum
  Clone ID: PAT_TA_55906.pep
YQFVLLLQYAVPPAMNIGTITQLFGVGESECSVIFVWVYALASVAVTMWSAFFMWTLS

SEQ ID NO: 161489 - protein, 130 aa, Triticum aestivum
  Clone ID: PAT_TA_55907.pep
GVGPVAWDNNVARFAQDWAAQRAGDCRLQHSGGPFGENIFWGSGQSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 161490 - protein, 118 aa, Triticum aestivum
  Clone ID: PAT_TA_55908.pep
SVHSIVIWTLDEYAHVPGTWYVKCHISMADAFGRDDFVYYDNGGDGGDSHWFWNCDYWILALDLERDLVFLSDQKTNKVLSYNISTGELKEIRDHFERFQYHVYVPCYSKLPAQESSV

SEQ ID NO: 161491 - protein, 65 aa, Triticum aestivum
  Clone ID: PAT_TA_55909.pep
RVMTTHLSSDGLHGLQLRLTVGLQATRAVNCRTSRQARKIGGFRFITAEMVGTLQRLAMGDAYTC

SEQ ID NO: 161492 - protein, 71 aa, Triticum aestivum
  unsure (1)..(71): unsure at all Xaa locations
  Clone ID: PAT_TA_55910.pep
AERSHVQWHRVCIYLHRVGSLALKHVKTGXLSYLEANXLKLMVFFDLIVGLDRFIRDIVVRXNGRLMFVVI

SEQ ID NO: 161493 - protein, 161 aa, Triticum aestivum
  Clone ID: PAT_TA_55911.pep
PPRFFFLIMILLPPLRPPLPIHSPRLFHTQPRGLIFAFPPRTPHPHPGSKIPALPQVLGLIPLLPLAHCTSPFLLSMHFFSPSPFSLFLFPPPPFFFSPPFLISTLTPPLFFTNPNIKNKKQKKKKKKKKKKKKKKKKKKKKKKKKKKKKKKKKKKKKKKK

SEQ ID NO: 161494 - protein, 143 aa, Triticum aestivum
  unsure (1)..(143): unsure at all Xaa locations
  Clone ID: PAT_TA_55912.pep
AELGIIPKNFGWVEQWYHVLXAFAAGFMKPRITRVDVLLHXGVKVIMFSGQFDMICARKDAVKWVXKFKWEGLKDFTGLPRNPLLCKGGXGEGEGESGGTQAFLKSCKNLIFSWILGAGHMMPIGNPCPALHMLGAMTQCPAR

SEQ ID NO: 161495 - protein, 45 aa, Triticum aestivum
  Clone ID: PAT_TA_55913.pep
RYSSQFGVLLSLIWSYVAKNICKVFGSCDTSGYGQHVFHLWQCMP

SEQ ID NO: 161496 - protein, 162 aa, Triticum aestivum
  Clone ID: PAT_TA_55914.pep
TLVNLLNISEECDLTWIMFILQGAPTLKELRILVRDHLCEMISGEQRKKFVFSEEKDNGLEWEPAPDFKHHNLAELRMYGRFRAQDNIVRFVRNVMEAAVNLEDIKLFKSPVCENCKHMLQEWTLMEKSSLSHKLNMGMLSSNVQIQFPSLGKFRTWSKYCS

SEQ ID NO: 161497 - protein, 134 aa, Triticum aestivum
  unsure (1)..(134): unsure at all Xaa locations
  Clone ID: PAT_TA_55915.pep
LGPLXGRPGVGFFFFFFFFFFFFFFFFFFFFKRKAFIIITRISGDHASMAKKHSTGAQGGSTYRPPPPPHLFNYSPLTSPPALPSPSFRTNPGSELLTHAPMGALAPQLGRSPICSPRGGRPPLPGSNVPTFRG

SEQ ID NO: 161498 - protein, 83 aa, Triticum aestivum
  Clone ID: PAT_TA_55916.pep
AVHIAWCKFILTLLCSQCVLEHKYGKGALKRPGSFTYGIPHPPTMEASPYVACSHATYLKNNLEAHLTHLAVAHRAERGDSNA

SEQ ID NO: 161499 - protein, 91 aa, Triticum aestivum
  Clone ID: PAT_TA_55917.pep
NVMFRTKERTGILGLEFPIYCRSLIIQETRRWLQNRFFIHSIKHGQLKAYFFHVLAPPSRAGVLNSSGPISGLPPANLHTLTPDRLEHCPY

SEQ ID NO: 161500 - protein, 81 aa, Triticum aestivum
  Clone ID: PAT_TA_55918.pep
GLYLAVRNSSSVVAGHALYLYDSTTMYLSCGATREDFTHDCESIQKVRMHTTSEHDGGNNRIKVCSNSLYHYNLCRRGMKA

SEQ ID NO: 161501 - protein, 89 aa, Triticum aestivum
  Clone ID: PAT_TA_55919.pep
SRNFRSILRDFLIHCSPPPIPLYLWAVLLLFVSHCMYTLRESNNDERCGSCVGHFVVIPCSMSSCFRPMVTGRPGVYDRRLRQPLTGAQ

SEQ ID NO: 161502 - protein, 132 aa, Triticum aestivum
  unsure (1)..(132): unsure at all Xaa locations
  Clone ID: PAT_TA_55920.pep
GLGGGGGGGXXPPPPPPPKKKNPPSFFLGWGXKQPPPPFFFFGGGRKKTTPPPPPPXGKGGKGEKGGRPPPNGPPGDFPPPRLGPGGKKKRGGNRPGFWPRVGRVPRKSAVPGGGRGGRRGAGGDAKAAQRQ

SEQ ID NO: 161503 - protein, 200 aa, Triticum aestivum
  unsure (1)..(200): unsure at all Xaa locations
  Clone ID: PAT_TA_55921.pep
ASFTLAPQSRRAVAWAPSPIVALATSPCASQVAAAREDGSLELWLVSPGSVGWHNQLTIQGGAESRVTSLVWVPNGAGGRLLSSSVDGSVAEWDLFHLQQKTVLDTVGVPVWQMAMEPTDDQLISGNKSSGCAVNGHANHNGSTDSELSYVDDGQSSDDEDDSAKTSSSYRVNEXPRLALACDDGXVRLYNVPESGPLTY

SEQ ID NO: 161504 - protein, 69 aa, Triticum aestivum
  unsure (1)..(69): unsure at all Xaa locations
  Clone ID: PAT_TA_55922.pep
WYLNGHRIMFSSSRDYRXENAAASSELAKIVVLVVAIVCAPDCSYWFMGVWHSTSSIRVSPDSRCVNDG

SEQ ID NO: 161505 - protein, 73 aa, Triticum aestivum
  Clone ID: PAT_TA_55923.pep
RALSRHGAQFLIDEVCHIYNLCCKYRQKQATQTENNHYSFYATLTSQLAIFINILSESNKGALQEDYKDRPSA

SEQ ID NO: 161506 - protein, 173 aa, Triticum aestivum
  unsure (1)..(173): unsure at all Xaa locations
  Clone ID: PAT_TA_55924.pep
MRGAHFWLPPLMASRGTTIXPITPRWYCLCRQQHGAQREFITTQSNAXRLEGFACXVKDADLEAQVPELHLQAEILDLPNLCENHLLIQSKNXYRLMKTDHRLEPLWMNLLEQHGLAPSFIISDMAHWWTGNITWELGVPRLNFSGFCASSSLVRYITYHNNVFENVYRREMN

SEQ ID NO: 161507 - protein, 70 aa, Triticum aestivum
  Clone ID: PAT_TA_55925.pep
DAWAGRSRGFGFVTFASDEAMRQAIEAMNGQDLDGRNITVNEAQSRRSGGCGGGFSCGGGGSGYRGQRSK

SEQ ID NO: 161508 - protein, 206 aa, Triticum aestivum
  Clone ID: PAT_TA_55926.pep
RPVYLDAQAPHPPRVDARSRGYPRQEPLLKKTIFLNDKPFVIATASSRSLHEIDSNSKPINGLQIFSLEVIANLSASKVETGQQMEGGTHNITNVTENATSGWSIVKEELTFSAGSAPFSSCHASTIVEIGKDNFLVAYFGGSKEGAPDVKIWLQRYSDGHWHPPEVADEQDGVPMWNPVLFQLPSHELLLFYKIGQEVQKGSGAM

SEQ ID NO: 161509 - protein, 58 aa, Triticum aestivum
  Clone ID: PAT_TA_55927.pep
ILTCINILFAQAHICTMFMKMWHSSHAFRRHTSYMLHHGNQCHPHCLVAPNLLFLSVG

SEQ ID NO: 161510 - protein, 51 aa, Triticum aestivum
  Clone ID: PAT_TA_55928.pep
AGILCLGYRIYGQNAIPSFMNCNWGRPLENSLGGCMGISAKNGYSEPVGTL

SEQ ID NO: 161511 - protein, 99 aa, Triticum aestivum
  Clone ID: PAT_TA_55929.pep
LSQIYDVDQFRHHVRPSMFLRGYPIIGRVKEVIVAIHLTHSSGPLQCGEHCPSIWPSLLPRYHCHDIFPCSSYARMRMVQSPDLPYVVCPSATAPRIKK

SEQ ID NO: 161512 - protein, 122 aa, Triticum aestivum
  unsure (1)..(122): unsure at all Xaa locations
  Clone ID: PAT_TA_55930.pep
LQTHISEHHIQTFWQFPWLLQKISSTKTCCAFALHKSCKSRPLQMLLVRRFILILMVQPLVASEQTSKPTSPHSCVLSPRRPNWQSAMMMESRDYMXEDIRNRLCHPNTDPTDTMKKRFPLA

SEQ ID NO: 161513 - protein, 176 aa, Triticum aestivum
  Clone ID: PAT_TA_55931.pep
MHKWVYVGYVRAHSHDVRALTMAVPICKEDAVPEEKVVKVRRKDEFSYRKWAHLGVPMLISGGDDTKLFAYSAREFTLYAPHNFCPAPQRPLINLARDCTVNGDSVMLVQSVNCLDVLLVSVKNKLTPSTSSGGDATIRQVVHLKSKGSRKIIASAVSTNGMLFAYSDCVKPCLSH

SEQ ID NO: 161514 - protein, 167 aa, Triticum aestivum
  Clone ID: PAT_TA_55932.pep
AGAGGYGAYAAAAPPSGYPGYGSAAPPPHAAAPYGSAPPPYGAAPPTQGAGGYGSSVQPAYGAAAQQTQGAGGYGSSASAYGAGQGAGYGGTTGVGLDQSGGKTKKKGMGMAGGLAVGAAAGVLGGLALAGGASYVENKIEDRVTERVEEDMYRGGGYDDYGGDDDY

SEQ ID NO: 161515 - protein, 160 aa, Triticum aestivum
  Clone ID: PAT_TA_55933.pep
PRALCGKRGSRGIWWRSLPWDNEKGCCGGYVWLNCQGMSWSMVHTGFWQQVKVTVTVTHKLSEVTENELYFRPNHQCMYVFSLAHIHGFARTGRLGSVGVEKGLDTARLVCGEPGGDSCSPESSCAMASSGLEEVMFIFRSLKDAKCNVQGHHSIHALLS

SEQ ID NO: 161516 - protein, 57 aa, Triticum aestivum
  Clone ID: PAT_TA_55934.pep
LITLMFPYQKPPLPKALIALTARPFSSHPHTIQQTMRKPSPPKHFIFTSSKCYTSTS

SEQ ID NO: 161517 - protein, 92 aa, Triticum aestivum
  unsure (1)..(92): unsure at all Xaa locations
  Clone ID: PAT_TA_55935.pep
DPKVALEIXPXVTPHAFDNQYFINLQKGMGLLTSDQVLYADLRSRPTVDAWAANSSDFEAAFVAAMTNLGRVGVKTDPALGNIRRDCAVLNS

SEQ ID NO: 161518 - protein, 124 aa, Triticum aestivum
  Clone ID: PAT_TA_55936.pep
AGDVTVLPKDAALPVTLKPREYEVFTVVPLKRLPNGASFAPIGLIGMFNSGGAVTEVRCAGGAGVEVKVRGAGTVGAYSSARPKRVAVDSEAVGFSYDDGSGLAMFQVGVPERELYSWTVSIEC

SEQ ID NO: 161519 - protein, 76 aa, Triticum aestivum
  Clone ID: PAT_TA_55937.pep
CNLTTPYTKTKHVKHCEHNLRLEPYPEKGAKPGCTHDMVTTYNKPQHWDTQQFFILRVWYPCSFSTGACSCKTPTA

SEQ ID NO: 161520 - protein, 113 aa, Triticum aestivum
  Clone ID: PAT_TA_55938.pep
REIMKVFLTKHYRNRRFSDTDFFLDFEEIYVIDSKTRSITRAKVVVNVPEGKRRDRRNDLLLIRDGGESFRITDKSQRDDATTIIQREEWTKSRQDVEKHFRKLRDFDYSNWF

SEQ ID NO: 161521 - protein, 125 aa, Triticum aestivum
  Clone ID: PAT_TA_55939.pep
LKFGALLLQKIFITVVLHRSCFCYIVQMKRMLQFCAGEVGLGRDFIRAVHKSLSLSLSLHHPKDKPSSARPPGPTGGRRRRLPVPLPSFLRGSSECVHHGARQSSTDLLAAFTLALVFSHCTEGV

SEQ ID NO: 161522 - protein, 163 aa, Triticum aestivum
  unsure (1)..(163): unsure at all Xaa locations
  Clone ID: PAT_TA_55940.pep
MADVEYRCFVGGLAWATDDQSLQNAFSKYGDVIDSKIITDRETGRSRGFGFVTFASDEAMRQAIEAMNGQDLDGRNITVNEAQSRRSGGGGGGGFGGGGGGYGGQRREGGGGGGYRGGGGGYRGGRSGGGGGYRSRDGGGYXGGGGGGYRGSRGGSGGGNWRE

SEQ ID NO: 161523 - protein, 177 aa, Triticum aestivum
  Clone ID: PAT_TA_55941.pep
VASARASSPTTATSSSVSLLFGFGKMPTSMRCGDDLTRSTNEELITSKADSKPSSNENLRTCNSVGKLIESLPPGSGATDTAGLGSSSGSARDVSDCSGGAPSKTTRGVVWIYLFDGDTIVFLCSGLPIEHNPSCTKVLTSTNLAAAMRDKTKSSSAMKIQVRDAFSNVAPGCLEEC

SEQ ID NO: 161524 - protein, 197 aa, Triticum aestivum
  unsure (1)..(197): unsure at all Xaa locations
  Clone ID: PAT_TA_55942.pep
MASRDLRRLLDGAALVAREAARRSSGPDILRSALLAATDLAGLTRGTPRRPQPVPLPPESHPEGADSSRPSSSSVVYFSHDDASPLEPSLEQQPPPQESLHPAHARDITGTHSTAAAAAVAEPEAVAVARPKDEAVRPEVSPSSTPTPTPSPSXSSLPTPAPALVEKRRRPRERNVPSTPFTRALGFAGLGXAGLAW

SEQ ID NO: 161525 - protein, 153 aa, Triticum aestivum
  unsure (1)..(153): unsure at all Xaa locations
  Clone ID: PAT_TA_55943.pep
GGSIQGADIVLASRRRNSRGQDKPAAKGTEGKXGKDPNKPKRRHPHFFPFMGEFREEFNHNNPNNKPITADSKSDGERWKNLTXSVIRPHYDXPRLNKLKGEYNKAIAAYNKGKSAAAAAPNKXAANDVLGEDDDXSDKSTSEINDYYYYEGS

SEQ ID NO: 161526 - protein, 116 aa, Triticum aestivum
  unsure (1)..(116): unsure at all Xaa locations
  Clone ID: PAT_TA_55944.pep
IHDMYSAHTALTRMKDRQELLAAEYNSIFLNKLITLAMHRNNKKKEIGYCTCFLTQPMTYVXTRDITMGFIVLQPFAEDTALDGGAASRELALLLXHATIDEFLLPLNLNDMSSKL

SEQ ID NO: 161527 - protein, 109 aa, Triticum aestivum
  Clone ID: PAT_TA_55945.pep
YSNAADGEHVRASPAAHRLFLSDWTSCGMSAGSLTALQLAPCHRLWEHQHGPRILCERAKRAAGHLVADPRTTGTRSALREPHTECATPTATCVIATMTTASTTPSMLD

SEQ ID NO: 161528 - protein, 74 aa, Triticum aestivum
  Clone ID: PAT_TA_55946.pep
SVYIVRVENPSIFVGTEGMRLLCSYMYWVALSVSMSWCPFPIGAGSLCQLMRLSRVLMQTTQVYQILFNLRHSC

SEQ ID NO: 161529 - protein, 211 aa, Triticum aestivum
  unsure (1)..(211): unsure at all Xaa locations
  Clone ID: PAT_TA_55947.pep
SCLVSPPHSIHRLAAVARNPLSTQSQSRITFPDGTGPGASSSPHLTPARPSLLRRQKEKMLYDIHCRAQIQALQALFDELGHSNDLMLVNLVSLELVRIACESYALLRPLIKEYVFWACPKLENLSVVACLSLEIQMLEHDVLPQLKVQEAKLEQGALEALLLMKNSAILLLDLRKRFMLALGVLLAEXDLVLARVKKLSIMLKDTADDVL

SEQ ID NO: 161530 - protein, 154 aa, Triticum aestivum
  Clone ID: PAT_TA_55948.pep
LVQIFPLTPGLLRHFSRQPALPEPSAIASSRSQEGSLSLYWIIIDIMSAPALAFFAHRSSISFLLSHAYPNPSRKFHQIFKNYTSLHINMPAIGKKAMPTKFPSPSKSGLPSPALQSTVSEGVETFLLRISFTAVAPPESLKCMATTTMRGGIS

SEQ ID NO: 161531 - protein, 119 aa, Triticum aestivum
  Clone ID: PAT_TA_55949.pep
VTSGLAEGAAVIQGALDRMTSDYCQSALDYLEMQPDLSALVRGAHTFRCPNLGLTSWVRLPIHDADFGWGRPVFMGPGGIAYEGLAFVLPSATKDGSLSIAISLQAEHMEKFRKLILDV

SEQ ID NO: 161532 - protein, 75 aa, Triticum aestivum
  Clone ID: PAT_TA_55950.pep
GMGNLTMRFLNESHKFTRLCGAHVIARTGLIHSIASVTLAFPRRPYGLKEILLCISVLPCCFFPHASFVYGVRIN

SEQ ID NO: 161533 - protein, 69 aa, Triticum aestivum
  Clone ID: PAT_TA_55951.pep
LFTFRPHKLLAPRWYLFVSRRSGVSRVLFPRPGMPHQTVFRPHVNERVVLWGAPPQESSTCRKAFSSGK

SEQ ID NO: 161534 - protein, 101 aa, Triticum aestivum
  Clone ID: PAT_TA_55952.pep
KYGRHFRAGICSLAKGGFAFHEGCLARLDFLRMASSCEPQQGLGIHLGHWRPRQFMFLPRSSTSCASFAVNMVPWSLAPRMAGSAQGFRPALIYCAEQVGL

SEQ ID NO: 161535 - protein, 122 aa, Triticum aestivum
  Clone ID: PAT_TA_55953.pep
RGHGAAVAVVRERRWGQGDQDGVRRGPPRRVRHRRRAAAEPPATEAGCRRRAGCCVQAVRRLSRLAALLHPGMGNDSHGLGEHPGLPCRGFSSRCTEQEQGGQFIRLLSLSALVVNKVVICA

SEQ ID NO: 161536 - protein, 125 aa, Triticum aestivum
  Clone ID: PAT_TA_55954.pep
AWDNNVARFAQDWAAQRAGDCRLQHSGGPFGENIFWGSGQSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 161537 - protein, 51 aa, Triticum aestivum
  Clone ID: PAT_TA_55955.pep
EYYLVASTFGLSKTELFRLAQGAVEFVFADDEVKKSLRAVFELAAAETLTS

SEQ ID NO: 161538 - protein, 87 aa, Triticum aestivum
  Clone ID: PAT_TA_55956.pep
MAMRALYNEIRPIKVRNVPGSLKPRLPWENVKKSPAQAVGRSIEKYIEPSSVDPLFPVCLGGMAFAYLVGLPQERPPLEPLEKPGGP

SEQ ID NO: 161539 - protein, 150 aa, Triticum aestivum
  unsure (1)..(150): unsure at all Xaa locations
  Clone ID: PAT_TA_55957.pep
SCSVYKYSLKHYCQLDSRRHPRYAIAKSNGLLKADKLDNIYVSCREAMVAMCEGSSPVFAVPIAILAPPFLLTAAFPKLSWARHAHCXCHSARTQSSQSLRMVSLLCTFINGVFFGSRIGASHFSHSLLSTIVPSLPTFFNNITSAMVHQ

SEQ ID NO: 161540 - protein, 189 aa, Triticum aestivum
  Clone ID: PAT_TA_55958.pep
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYL

SEQ ID NO: 161541 - protein, 102 aa, Triticum aestivum
  unsure (1)..(102): unsure at all Xaa locations
  Clone ID: PAT_TA_55959.pep
MHQYCLGIRPDPGGVSGMQLLHGHNYATFQTFXVDKMHAHLHHDPXVDPWQPLERSKPEMPIEMILXKAAHSKLESFPXHKNTDLACKDHTDYGDEVLIAYW

SEQ ID NO: 161542 - protein, 100 aa, Triticum aestivum
  Clone ID: PAT_TA_55960.pep
QPIRATKRLSSLVKLAWPRRASAVEPEVLHYEDAGCMVGGHVQREDGDLSRGGAPVLGYGLHLHLELGGDGRGGAALTGARRRHARPDRAISMLLHETSG

SEQ ID NO: 161543 - protein, 73 aa, Triticum aestivum
  Clone ID: PAT_TA_55961.pep
ESQVQADTLATELNEKDASGMLDATLYKHWKDKYGTVGTLITLYYKSKEGHVTEKEVHQAEDDVLEAVYADKA

SEQ ID NO: 161544 - protein, 181 aa, Triticum aestivum
  Clone ID: PAT_TA_55962.pep
MEDTTATLATELDGLLAMARELEERVDGDQGAPGAARELCAELAASVDRAVRLAGSGPRGGNAGGRARVNGQHRGGRKAGAVRAQVRVASMQDLGSLDDGLSWRKYGQKDILGAPYPRAYFRCTHRHSQGCQATKQVQRAAADPLLFDVVYHGAHTCAQATAVLVGTDQQPPASLGQEQQQ

SEQ ID NO: 161545 - protein, 92 aa, Triticum aestivum
  unsure (1)..(92): unsure at all Xaa locations
  Clone ID: PAT_TA_55963.pep
IAVDLRMLGAKKVGSEMLESTMADKLPNDXEEWSPECKRHMLYIDXIYKYVDDGGEARVAPCNKISRFIADTRSSMPKMTTASLDTLLTDKI

SEQ ID NO: 161546 - protein, 127 aa, Triticum aestivum
  unsure (1)..(127): unsure at all Xaa locations
  Clone ID: PAT_TA_55964.pep
RPASGCLFRSDFWLLGREVSSQVRAPFAVFAVQFYHGGTGRVWNVSKWAIGVGINEPVGKXDVLGRKGWYVSGMEYCVSXIQGGVCRXFSRCRKVKNDQLKAVIKARGEVMSTKRAVALRLVMVRYH

SEQ ID NO: 161547 - protein, 179 aa, Triticum aestivum
  unsure (1)..(179): unsure at all Xaa locations
  Clone ID: PAT_TA_55965.pep
MLANLGIFQYILALFALAIGMGGVDDSXAQNTAHDFVICDNRARAECCTGRDGMGQHLVTGLAQDXWAARCAGNCQLDDYVWPLGENMLTGAYYQKLTDALSAKLSVDQKXNYHVDSITXYAGKVCXHYXTQVVWXKSTCILCARMDYTENMXVFIIWHYNLKCNYNRERPVAYITLDD

SEQ ID NO: 161548 - protein, 68 aa, Triticum aestivum
  Clone ID: PAT_TA_55966.pep
GRSPRNTSCALVRFEMMIVLACAAVGTYPDAVLHGQSLNGPPAACRRRSGRRLPNSRCTRQGPGASPP

SEQ ID NO: 161549 - protein, 50 aa, Triticum aestivum
  unsure (1)..(50): unsure at all Xaa locations
  Clone ID: PAT_TA_55967.pep
PANVLRRENDIPSGLSIAAEKKPRNRQSLEQLSKRHPRSCDIXREVKELT

SEQ ID NO: 161550 - protein, 79 aa, Triticum aestivum
  unsure (1)..(79): unsure at all Xaa locations
  Clone ID: PAT_TA_55968.pep
GGVFFFFLWGFFFFFLGKPPEILFRGGFTCLGVHLLFSCWRGLTYIQGSRHRGXLTHGXYMDPSIIDFMPPPRRCLPWP

SEQ ID NO: 161551 - protein, 131 aa, Triticum aestivum
  unsure (1)..(131): unsure at all Xaa locations
  Clone ID: PAT_TA_55969.pep
NGNIFLMHLFMSYKSFSLTTGKTRWVSCGEIYIYPIQXSIPIILFFNILLSKWKHIFVAHFNDPLACPWEPLFPASWEAELLFLQTLMRRRRCPPPAIFRFGGRCRGKTARLSDLRSEEKQXPPHHSPCHH

SEQ ID NO: 161552 - protein, 65 aa, Triticum aestivum
  unsure (1)..(65): unsure at all Xaa locations
  Clone ID: PAT_TA_55970.pep
HKLTVGGGEDLIKXQTQQTNLXLQTYLHSTYNTHTTIHAPYEFHYPTINHPPRECLPHTIGSIYQ

SEQ ID NO: 161553 - protein, 75 aa, Triticum aestivum
  Clone ID: PAT_TA_55971.pep
DEAKMTNLILLLFDPSKLNKYRNQHIWRDYCDILTHYNLVVNYSDLACNYTLITLNPLTISVQLDLHCKSNWNYS

SEQ ID NO: 161554 - protein, 123 aa, Triticum aestivum
  Clone ID: PAT_TA_55972.pep
ERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIVHRKCF

SEQ ID NO: 161555 - protein, 115 aa, Triticum aestivum
  Clone ID: PAT_TA_55973.pep
FFCFFAPSFFLKKSGPRFFFSSAWGSLPGVFPEALRGFSFWNNPALPQFFLADFFFPFGGGPLAPPLGKPPGAPLNEGAFKALGQARNQGVLFAPQGNHIFPPAPQMEPWPPPPF

SEQ ID NO: 161556 - protein, 58 aa, Triticum aestivum
  unsure (1)..(58): unsure at all Xaa locations
  Clone ID: PAT_TA_55974.pep
YGGVAFFTCEGNIQQGHVVHSAGXFLQEASHERGVCITVRSLPQGYCVTHAHKEGTLS

SEQ ID NO: 161557 - protein, 197 aa, Triticum aestivum
  Clone ID: PAT_TA_55975.pep
GVTHSFEFHEATVDAIQLGFRNGSLTSAALVRFYLDQIRRMNPLLHAVIEGNPDALRQAARADAERRRGMATGALHGVPVLLKDNIATCDALNTTAGSLALLGSVVKRDAGVAARLRRAGAVVLGKASLSEWANFRNVHNGWSARGGQTRNPYVLSSDPCGSSSGSGVAAAANMAAVTLGTETDGSILCPSSFNSVV

SEQ ID NO: 161558 - protein, 71 aa, Triticum aestivum
  unsure (1)..(71): unsure at all Xaa locations
  Clone ID: PAT_TA_55976.pep
KRQRGPFPGGLASVPYPTPGGPGMTPGEKQSLVPGAHTXTLQRLGPGPRLEAFSLPPLTXKKQGPLGSLNL

SEQ ID NO: 161559 - protein, 110 aa, Triticum aestivum
  unsure (1)..(110): unsure at all Xaa locations
  Clone ID: PAT_TA_55977.pep
HYRSYGGDVSSQRFLPDTKGRVLWIGGTKIRGDFARGGGVGKTFLQGGRGGFSSDPPGQMGLVWDVSFGVDLEGGHGEMIWGGFXRGFGGIRGFNVGGFVVSRPPPGGVD

SEQ ID NO: 161560 - protein, 99 aa, Triticum aestivum
  unsure (1)..(99): unsure at all Xaa locations
  Clone ID: PAT_TA_55978.pep
QIYALDMRHSSQRNKSALAPPLGATDYIVYAVGSQIQWLCASQLGXVRELQYQIKDLEVICLPIVANRSQGGGGHIPPGMPKRAGAPNSGAPPKMEKVH

SEQ ID NO: 161561 - protein, 75 aa, Triticum aestivum
  Clone ID: PAT_TA_55979.pep
SVHTIAMKASMHRSKYRSPRLPSYSPRSPKEAVASDCVRTSFRSLTLRGYLVYDTCVAPVFWQVYECISCIKCLL

SEQ ID NO: 161562 - protein, 108 aa, Triticum aestivum
  unsure (1)..(108): unsure at all Xaa locations
  Clone ID: PAT_TA_55980.pep
REFILTSQHVSICQQDTKERVTTGAAGTQYPTGHKKCGRGGGGNQPPKSHXTGKGENTTPHTTLLFKSTTRDTGRPPQATGGRTDLKLAPLWDDDLLGTXAPPGAHLL

SEQ ID NO: 161563 - protein, 54 aa, Triticum aestivum
  unsure (1)..(54): unsure at all Xaa locations
  Clone ID: PAT_TA_55981.pep
KDMRLXXXLGDENXVXMXVVXXXNEXXKKXRXLGXXXXDFXVVXEVXKGKGGXX

SEQ ID NO: 161564 - protein, 114 aa, Triticum aestivum
  Clone ID: PAT_TA_55982.pep
IPPKWGSKENGPQTVPQWGDFWDFPHVNYLFSPQLGKKLEGGPPQKSLTSSPPQSKLGDPFFLVRPWGAPAFLTRETSPAKTNWETYFRFRTGEQTLARPAWSYRVRPPPPLGQ

SEQ ID NO: 161565 - protein, 119 aa, Triticum aestivum
  Clone ID: PAT_TA_55983.pep
GVAVRSGDAINGVRFTYVDTSGNLHEEEWGGCEAEKFEQLLLQELEYVLEISGTYGSPPESYVTSLELVTNKGRTIRGGTAGFGGSFNVPLVSARIIGFFGAAGTTYIDSFGIYAGFAA

SEQ ID NO: 161566 - protein, 91 aa, Triticum aestivum
  unsure (1)..(91): unsure at all Xaa locations
  Clone ID: PAT_TA_55984.pep
QNLGPNKLRGAKLVIASVRTGDTLIATITTTGGGGGSIPXXXXNTYIXXGSWLXNNEAANYVRGTTKETSTTLLRLFRQLSFYSAGRGGGC

SEQ ID NO: 161567 - protein, 82 aa, Triticum aestivum
  unsure (1)..(82): unsure at all Xaa locations
  Clone ID: PAT_TA_55985.pep
KRPIGSMADPVLRASSPVPEEDLAALCDVVSLCITRERXKRPCMGEVAGLMKGAVSLSQEQTTPRNTPLWWAELEIMSTAPP

SEQ ID NO: 161568 - protein, 62 aa, Triticum aestivum
  unsure (1)..(62): unsure at all Xaa locations
  Clone ID: PAT_TA_55986.pep
GKGCGGCNMYPXVEAPGAPLLVSAVATHKGSSGGMXMGPENGGCGCTQCKXGTSSGGSCGSC

SEQ ID NO: 161569 - protein, 111 aa, Triticum aestivum
  Clone ID: PAT_TA_55987.pep
SYNKHGVTLHLWTAAYAQHLWVKLNKAFCLESNAYLAAKVSGHSLQVVWGLCNLIAWARVVCIGNRSFFVARNYDPPAKFLGKGPLAFLSLYTKILARASKCVQPCRRTCV

SEQ ID NO: 161570 - protein, 83 aa, Triticum aestivum
  Clone ID: PAT_TA_55988.pep
MPDHKAPRLDYITLGGGLRMCPGSTLGLAVLKLIMAGLLVLFDRSLASGGPELEMHMRMGIRISKNSQLQVVALPHKQVSLQR

SEQ ID NO: 161571 - protein, 91 aa, Triticum aestivum
  unsure (1)..(91): unsure at all Xaa locations
  Clone ID: PAT_TA_55989.pep
WFGGPSSXRESQSPHSPFFPCHLMLCSGCXADIIXXNPPPPTXGXKVMWCDPLNPSYPPLMPHNPIGLWSTGVRFMREGPLSGLFVXPPPP

SEQ ID NO: 161572 - protein, 100 aa, Triticum aestivum
  unsure (1)..(100): unsure at all Xaa locations
  Clone ID: PAT_TA_55990.pep
NILVQGSPPHAEDLWKTMKIHKLTFDGVKLCARCKVPPINXETGIPGRDPTEPMXTFRSGEVTRPPPKNTQKVYFGQNLVRKESVSAKGKGRMVKVGDRV

SEQ ID NO: 161573 - protein, 89 aa, Triticum aestivum
  unsure (1)..(89): unsure at all Xaa locations
  Clone ID: PAT_TA_55991.pep
WNALGGLKWXENPKNKVTAVPADEQPTCGAPXSWWKGSPLSGHFSRRFPAPGRWGKXERQLVWWWCNIRXEGGCXSXPPPPPQNVGLCM

SEQ ID NO: 161574 - protein, 95 aa, Triticum aestivum
  Clone ID: PAT_TA_55992.pep
NVCWKKNGHYNMKCRWCPGFPQVSDMLDANHSFVDDSTIMDNGDANGRLPAVIKFEIQLYKTKDDKYLLDMQRVTGPQLLFLDFCAAFLTNLRVL

SEQ ID NO: 161575 - protein, 139 aa, Triticum aestivum
  Clone ID: PAT_TA_55993.pep
KKKGKKKTTKKNQTKNGGGGGKKPKQRNRKKNRPKTKNHPPPTTPPNKGKPGKETRGENQTPRGQTKPGEKKPPGRQTQNQLEKPDPKTREKPPKPRGGPPPQGPPQNPPPPPGGGPKNPKGRRKKGPPKKGQNLFPWE

SEQ ID NO: 161576 - protein, 166 aa, Triticum aestivum
  unsure (1)..(166): unsure at all Xaa locations
  Clone ID: PAT_TA_55994.pep
MDPGLVGAGSNWLPRAGPDRQKRGERYYYDSGAGNYYYGQGHPMKPXPVRVTHYMLAPHGLLDQMQGLCPNPIRDRYLWRXHSDYYIXLLHSDTPETRKDQIRSIKRLNEXEDCPXFDQLYSLXHTYTLASVCGAEKIKHGLDIYMNXAEGLHHAKKCEAXGLCYV

SEQ ID NO: 161577 - protein, 167 aa, Triticum aestivum
  Clone ID: PAT_TA_55995.pep
MDEFELEDNLEFILQSIQELIEDQGENNPFGEVNQNELLANLVNYDQDNLMPDVSVEDVVNGKDVQGIPWEKMLFPRDQYREMKMKGYKNYQNLSYAREDALQDCKQVERDGPYYDFQYNTRRARLSIVHFQLRNLVWATTKHDVYTVHNQSMTHWSSLNQISTELI

SEQ ID NO: 161578 - protein, 64 aa, Triticum aestivum
  Clone ID: PAT_TA_55996.pep
CFSFSVSIFLQVITLVVRLFVAQLDTGMRFQGSPRRRSWQKYWNDLGIVLCNFHDLPKGHTGFQ

SEQ ID NO: 161579 - protein, 164 aa, Triticum aestivum
  Clone ID: PAT_TA_55997.pep
MGVVSTVLGLFGFGFGFSSGIAIGYYFFIYFQPTNVKDVEVRPLVEYDSNSLDGILPEIPMWVKNPDYDRIDWLNRFLELMWPNLNKAICRMAQDIAKPIIAENCEKYKIDSVEFETLTLGTLPPTFQGMKVYVTDEKELIMEPSLKWAANPNITVVAKAYGLK

SEQ ID NO: 161580 - protein, 174 aa, Triticum aestivum
  unsure (1)..(174): unsure at all Xaa locations
  Clone ID: PAT_TA_55998.pep
GGGAGAAGVRVRRAGAARGGGRQHVTGACRQGDVRAIASALKRRTTCNLLVFGLRGETPLWRALNHGRRTVLLDENQGYVSHLKGRHSALKAYDMSYTSTVRKIADILEAVRADRAXECRTVQNLLFXDCRACMNELRNQLYDVVWDDILKYGQRGYTRVRSQTISRIFTXTLL

SEQ ID NO: 161581 - protein, 112 aa, Triticum aestivum
  Clone ID: PAT_TA_55999.pep
RTSAAVGSAGTASRALSGIVSVPTTVTVPQPICHIAVCTKLLSQVWAALGGPFAQECQPLPPPAPSPELDGQQRVRPLVCSSPASTPRSWFVTPSPSLHAASIVGSGPGGVA

SEQ ID NO: 161582 - protein, 189 aa, Triticum aestivum
  unsure (1)..(189): unsure at all Xaa locations
  Clone ID: PAT_TA_56000.pep
DTXNLTSXLLDGHRKLLALVTSGNANAQNTNVLQPNNGPITGPPEVEAPLDPMKELGRLLAEHKFDEAFTVALQRSDVSIVSWLCSQVDLRGLCTMAPVPLNQGVLLALLQQLAVDIGTETSRKIQWMTDVAMAINPTDQVIAIHVRPIFEQVYAKLAHHRSLPTTSPLDNSNLRLLMHVINSVLLSYK

SEQ ID NO: 161583 - protein, 192 aa, Triticum aestivum
  unsure (1)..(192): unsure at all Xaa locations
  Clone ID: PAT_TA_56001.pep
MGSSGGSSDYFLRQLSSSDGGSAPAPAPRQPEEWECGGGTGRRGSRRWSRKKARARGHRRGGGGGFCGAPEEAAAAGRKRVMVVVDQSSGAKHAMMWALTHVANRGDFLTLLHILPRGGGARGEDAAALANSLGSLCKACKPEVEVEALVIQGPMLATVLSQVKKLXASVLVLSQSKPSPFCCFLRSRGEVL

SEQ ID NO: 161584 - protein, 78 aa, Triticum aestivum
  Clone ID: PAT_TA_56002.pep
TTRPTHSSLPRAPPPRRRRLPPRAPAAAPPPPSRRPRCSATASLPAPPLQRRCLPRRAPTAAPTPPSRTRVAVSPAPS

SEQ ID NO: 161585 - protein, 131 aa, Triticum aestivum
  unsure (1)..(131): unsure at all Xaa locations
  Clone ID: PAT_TA_56003.pep
TGYILLFALGKXHSHAHNHPXEEAVAGLVLVPALSPCATTLPVFLAVGNSSSMMILAIIVLLFSTITVMTSLVALSFYGASQIKFHWVERYDKVLVGSVLCLVGVLTYVFHHHDGDEHSLHAHVHRKLVGP

SEQ ID NO: 161586 - protein, 195 aa, Triticum aestivum
  unsure (1)..(195): unsure at all Xaa locations
  Clone ID: PAT_TA_56004.pep
MFLSPPLRPPIASSTIRPLPPIGPPTSASGMELRLCLHLQLHLHSHARPPSAPTPPPCPAAVLLPVRRLRIGGSCGVARRRSTRRSQSAICAAEPDGAQGWEAVKERSVSVVLLSGGQGKRMGANMPKQYLPLLGVPIALHSLRTFCGMKEVKEVVVVCDPSYKNVFEGFVENLQIPMKFTTPGKERXDSVFNGL

SEQ ID NO: 161587 - protein, 207 aa, Triticum aestivum
  Clone ID: PAT_TA_56005.pep
PFLSSSSCHRSRTREEPGARRAKEEKRRSPSPARAQDSRRRDLGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCAT

SEQ ID NO: 161588 - protein, 147 aa, Triticum aestivum
  Clone ID: PAT_TA_56006.pep
LEHGPKPPTLARRHSSPSPGKPARLPVKVAAMPSLAHLPLRVSDTRAARRRPPWRRQGRCSCRVSVVDGWAAYLAWDGGGCLVCGDDVGILLMCGRVCVLLFLLFCLLLLYAQVVCWIVLFRSSCNEFLVIAVAGRWRHDPEIMSSA

SEQ ID NO: 161589 - protein, 91 aa, Triticum aestivum
  unsure (1)..(91): unsure at all Xaa locations
  Clone ID: PAT_TA_56007.pep
MAAVQYRCFVGGLACATDDQGLQNAFYKXGERESTPRIMTDXDSTGRSRGFCFVTLSSDEAMRQAIEAMNGQNLYRPNITANETHSCPSGR

SEQ ID NO: 161590 - protein, 116 aa, Triticum aestivum
  Clone ID: PAT_TA_56008.pep
MASTAYLETDENLEALISRIEQKSRKIETLLKQSKPVEALKTALEGSPLKTRDKRCKSANWIVVHRAMMAIKDIDGMFNSLDTEYYDILMKYLYRGLSTGDRPTCDQCLKIHEKLT

SEQ ID NO: 161591 - protein, 59 aa, Triticum aestivum
  Clone ID: PAT_TA_56009.pep
GAQEGLQMIGNNVHDTEWICSWKPEILHIHFYQNISKASSNADIGELSFSILVFQNSDM

SEQ ID NO: 161592 - protein, 114 aa, Triticum aestivum
  unsure (1)..(114): unsure at all Xaa locations
  Clone ID: PAT_TA_56010.pep
SKRGGGTVPASAARRQLQQQVRVEVRSVKQQTGEQAGMXSXERXYRERVRDLXKRELELAEREFARARMIWERAREEVERVERMKQIAARGLGSAASAAALEITCHACMQRFHX

SEQ ID NO: 161593 - protein, 71 aa, Triticum aestivum
  Clone ID: PAT_TA_56011.pep
TIMHTPIPLATALPFRERLSILAGSRSVRINWRRAACTLMRLKRLTTSKPAVNHWQHLLDAVSGAEAAHRP

SEQ ID NO: 161594 - protein, 125 aa, Triticum aestivum
  unsure (1)..(125): unsure at all Xaa locations
  Clone ID: PAT_TA_56012.pep
QFPVGRMGXYLKKGXYAQRVGTGAPVYLAAVLEYLAXELXELAGNAAKDHKKSRIIPRHXMLAVRXDEALGKXXAGVTIAHGGVIPKINPVLLPKRPAEKEGKEPKSPKKGPKSXKKPAPPTRMW

SEQ ID NO: 161595 - protein, 159 aa, Triticum aestivum
  unsure (1)..(159): unsure at all Xaa locations
  Clone ID: PAT_TA_56013.pep
GGYTPLWRAIYPXGRTVFLNDNQWYRVPHVXRHSGLEAYYVAYASPVPELRYLIXTASTASAAECRSFQSLLFSAAACAIKGLPKQPYDSLAVMPLHGRAGTGLCRGEFAIFLWSPAGPEERGGEQWWAGATKVDGVPRVPVREEPVPRQQRSLAHSHH

SEQ ID NO: 161596 - protein, 89 aa, Triticum aestivum
  Clone ID: PAT_TA_56014.pep
GSGQSWTAADAVKLWVDEKQNYHFDSNTCDAGKVCGHYTQVVWRKSTRIGCARVVCTGNRGVFITCNYNPPGNFNGERPFAFLTLDAEA

SEQ ID NO: 161597 - protein, 87 aa, Triticum aestivum
  Clone ID: PAT_TA_56015.pep
SPRGTAGTPTGTCWKLQVRGIGSGSIRWVQVQFMIHKGCAIYKPWEQGVASLVPVLVISSQRHQFLCSTPQVACVPLKCVRFRFTSP

SEQ ID NO: 161598 - protein, 85 aa, Triticum aestivum
  unsure (1)..(85): unsure at all Xaa locations
  Clone ID: PAT_TA_56016.pep
GEKFADEKFVHKHPKPGILSMANAGPNTNGSQFFXCPVPCNWLDGKHVVFGEVVEGMHVVKNIEKVGSRSGTCSKQVVIADCGQL

SEQ ID NO: 161599 - protein, 117 aa, Triticum aestivum
  unsure (1)..(117): unsure at all Xaa locations
  Clone ID: PAT_TA_56017.pep
LHLHMHYXSPGAFFSXXVAGAEGPCMCPHDHLKTVFMGGFQCHKSQIEXACSILGNAFVLEHLTXDPRLTEAIWGDKSSQWNIPLERIFPRVCEWAQRPXKRFGKVIPVLDPPLHSE

SEQ ID NO: 161600 - protein, 103 aa, Triticum aestivum
  Clone ID: PAT_TA_56018.pep
KLLEQLAEKLGAAVGATRAAVDAGYVPNELQVGQTGKIVAPEVYIAFGVSGAIQHLAGMRDSKYIVAVNKDADAPIFQVADYGIVGDLFQVLEELLEKIPDKK

SEQ ID NO: 161601 - protein, 160 aa, Triticum aestivum
  Clone ID: PAT_TA_56019.pep
NGTRSNSNGTSNRNAPLSFLQKKVKEEGVTVLGDMGCSYVSTREETQNCITHATMRPKTTTQVQRRTTPVCDLYYTHGRRTTCTCAPHRMGASPETARGQEPRSPSSSRLEKSVCSADCTCRVTKLHNKSTEVMKLVLRLTTSRGKANLTWPATELYHNG

SEQ ID NO: 161602 - protein, 134 aa, Triticum aestivum
  Clone ID: PAT_TA_56020.pep
KWVFEKLKGKPNKSLSDLLREYNLPPGLFPRNIICYEYDQTSSRLVVHLAKPCEVSFKDSSMIRYATRVKATLSRGKLSAIEGMKTKVVVWVKVTTVNLESFRSDKVCFIAGVKKLRQKDAYEVPREAASVEEF

SEQ ID NO: 161603 - protein, 47 aa, Triticum aestivum
  unsure (1)..(47): unsure at all Xaa locations
  Clone ID: PAT_TA_56021.pep
EVAAAKMGATNRGGFLNXCWGGGGAXXXNSXPPYXTSXXQXPRARAP

SEQ ID NO: 161604 - protein, 119 aa, Triticum aestivum
  unsure (1)..(119): unsure at all Xaa locations
  Clone ID: PAT_TA_56022.pep
TSQVIIMNHPGQIGNXYAPVXXCHTSHIAXKFAELVPKIASRSGKELEALPKFLKNGDAGIVKMIPPKPMVVETFAPPPXXGSFXXGXMRXXVXVGXXKGVEKKDXXGXKVXKVAIKKK

SEQ ID NO: 161605 - protein, 148 aa, Triticum aestivum
  Clone ID: PAT_TA_56023.pep
AGIDAPDVDDEEHMSSRSSVGYDDMWPNTILEEEDDWRSSGGSSPTLPGSVDTPISSHFGGMPTPSLFSSTPPRYGALPHRKTQAPEERKKSASLPSPHVARAPLNVRMMGSPHWLGGCIPPPPPPPPNKCRGFSMPSFSYTGAQESQ

SEQ ID NO: 161606 - protein, 75 aa, Triticum aestivum
  unsure (1)..(75): unsure at all Xaa locations
  Clone ID: PAT_TA_56024.pep
KSXRDCHATQKSTDRAFLPPLAXVSSILIAHEPVLIAHALAQGYIFWLGTGRRIRSYYAFXFXDEXXVXPPPPPP

SEQ ID NO: 161607 - protein, 125 aa, Triticum aestivum
  unsure (1)..(125): unsure at all Xaa locations
  Clone ID: PAT_TA_56025.pep
TYINCLLICHHMKGQINTNHWSLGDGALRLAHLHPXHPVLSGGGGGGLEXPHXXHLEALVDPEPGPPVPQRRAGPGVSLPPGAVLEGDPPLVPTHPQERPALLREPLRVGELHRRVQVLLLLGAQ

SEQ ID NO: 161608 - protein, 193 aa, Triticum aestivum
  unsure (1)..(193): unsure at all Xaa locations
  Clone ID: PAT_TA_56026.pep
MSAAAAAADTYSPAAEAGSKRRERREELRRHLAEDADWPRADGRSLHDCRPAFMQTGPTTAASGSAYAEFGKTKVIVSVFGPRESKKAMLYSDTGRLNCSVSYTTFATGIRGQGLENKEYSGMLHKALEGAVMLHTFPKTTVDVFALVLESGGSDLPIIISCASLALADAGIMMYDLVTSVSXVSCLGKERYH

SEQ ID NO: 161609 - protein, 109 aa, Triticum aestivum
  Clone ID: PAT_TA_56027.pep
GSRTQTFQEAPPNRPTGSPHFSHQSQRRGQDAGHRHPPRGTRTPRPSLDASRRLRGAHGPTPRYQPPDGHRMGPDPLTDPAILKKLVPVIKKEPILQEVALCRGGYLAI

SEQ ID NO: 161610 - protein, 123 aa, Triticum aestivum
  Clone ID: PAT_TA_56028.pep
QFLHKLLRLQQCMLFFMPVLLPRSPTRSCLRIGSRIAPPIAKALVFARILFWLSFSLSKSLSRSCPRSCLRLWLRSGHRSRVVTPVVHARALPSSIPVINPVFKPIFLGILPCILSPFLSPIC

SEQ ID NO: 161611 - protein, 183 aa, Triticum aestivum
  unsure (1)..(183): unsure at all Xaa locations
  Clone ID: PAT_TA_56029.pep
MAAVTGYEHADAWEQDWLKVDDTHEVYYEQYGKKEGXPVIFLHGGPGXXTSKANTQFFNPAIYRVILLDQRGAGKSRPHASIKDNTTWHLVADIELLRRHLNIPKWHLVFGGSWGSTLALAYAQTHPSSTGSLVLRGIFAVRAKELNWTNQPGGAPFLFPDAHEEMVNFLPENERADHMNAYH

SEQ ID NO: 161612 - protein, 145 aa, Triticum aestivum
  unsure (1)..(145): unsure at all Xaa locations
  Clone ID: PAT_TA_56030.pep
MVSLVLLIASLASAGLIEGAAVDVSSKVNIVARQQRGGQGGQQGGQQNGKQNGQNGGGQNGGQNAGQTCLNNNLIQSASGLTGQETGTEGIKPXQAPSAVDKANFINFCQGSELTNGMQIKTGSCNGIPMGKIPAQTNMVTAVIT

SEQ ID NO: 161613 - protein, 101 aa, Triticum aestivum
  unsure (1)..(101): unsure at all Xaa locations
  Clone ID: PAT_TA_56031.pep
ASVSHWGTWGRSGAGAGSAGAGGARGGAAPGRTRGARRDSALVCALAMPTRAKTAGESCGHLRAHYASSXQTAHDPSXWQDIRSAKARNTVELCGLTVRHW

SEQ ID NO: 161614 - protein, 216 aa, Triticum aestivum
  unsure (1)..(216): unsure at all Xaa locations
  Clone ID: PAT_TA_56032.pep
DEYTPAXPESGRLFDRDMLIYRERHCPGKDEQTRCLIPAPPKYKNPFRWPESRDVAWFDNIPHKELSIEKAVQNWIRVEGNKFRFPGGGTMFPHGADAYIDEISKLISLSDGRIRTAIDTGCGVASFGAYLLKRNIITVSFAPRDTHEAQVQFALERGVPAILGVMGSIRLPYPSRAFDLAHCSRCLIPWGGHDGLYLAEIDRILRPGGYWIHSGP

SEQ ID NO: 161615 - protein, 205 aa, Triticum aestivum
  Clone ID: PAT_TA_56033.pep
MGGATGMVVLMVTIIPAALLHMVSAGGTPPFSCWPGAPYVRFCDQRVPVEQRAADLVARLTLAEKVSQLGDVAAAVPRLGVPAYKWWSEGLHGLSMWGKGMHFTGAVKQVTSFPQVLLTTASFDEKIWYFIGQAIGVEARALYNIGQAEGLTIWSPNVNIYRDPRWGRGHETPGEDPITVSKYAVAFVRGLQGPSPTTLQTSACC

SEQ ID NO: 161616 - protein, 145 aa, Triticum aestivum
  unsure (1)..(145): unsure at all Xaa locations
  Clone ID: PAT_TA_56034.pep
RSCYRDPGAGALTPWTKLVCTLLPSCRSLPMLEKCAXCAGVNVERFSFYHGTHKYHRETLXTLCQGMHHTCMLXPGCSYTYGPVTLTGLFEGMVKXQTDLGXEQTVSSDCCFKRDRIAIYMSYWKLSYDVKPAHAILWAHGTICL

SEQ ID NO: 161617 - protein, 211 aa, Triticum aestivum
  unsure (1)..(211): unsure at all Xaa locations
  Clone ID: PAT_TA_56035.pep
RPSVPRLHPVIRLLLLLLHPEDQGQTPFTLPAPPLLAASSSELPERLVVLYASQTGNAMDAAERVGREAERGGCPAVDVLSMDCFDPSCLPRERYVVFVVSTMGQGDPPDSMKDFWTYLTRKSLGARWLEGLFYAVFGLGDSTYGKYNYPAKKLDRRLFNLGAERITEKGLXGDDQHSSGYEGALDPWLLILWKSLNQTNPSLLPKISDAI

SEQ ID NO: 161618 - protein, 179 aa, Triticum aestivum
  unsure (1)..(179): unsure at all Xaa locations
  Clone ID: PAT_TA_56036.pep
ILLTAANHPIIIGAAXIMTTRPRGAVSSAVAAATKKNNATPPCCSRHDLLLLAAQHAALVELLLADNTTSGENAEKLLHLVAADDDHHNLPADASLVDHQHHHDDDAYNTNDVMPSSSSINKKEXSYNTTECSTQTTIPAPTTGDDTNDYWIIRPAFYDAGAALLYYNSVAAMRSLIMM

SEQ ID NO: 161619 - protein, 88 aa, Triticum aestivum
  unsure (1)..(88): unsure at all Xaa locations
  Clone ID: PAT_TA_56037.pep
KKTWRHGDAPATRSAAAAASLCTRRXTTSGAAAAGGGGXGASTMLQFYTDNAAGLQKTPNAVLIMNIWLHLPSGAILHVFCKLYRTPN

SEQ ID NO: 161620 - protein, 86 aa, Triticum aestivum
  Clone ID: PAT_TA_56038.pep
RRRVGLVGLRGKLSKEVVESKLCQQGAIVVPEIRSCQRRQTPELRCRTTWRCLIERPGMATVNGQGVAATKPHQRKEVACGGIGVS

SEQ ID NO: 161621 - protein, 213 aa, Triticum aestivum
  unsure (1)..(213): unsure at all Xaa locations
  Clone ID: PAT_TA_56039.pep
RPSDLKHGHGAEHWLKWINXRDTGRQSDSAHGYMHSTRXVHQNLHMWTSNKARQGXTISEGDRTVGXVKVLPTKHLINSXVTCPIITARKQIIVSGGTLSSPLILQRSCIRCTQXKLQKAGVNPXCETLPGAVLNFQDHYTYTSAXRIKTKPHVESFDDYARGDPVVQERVFNQWNINGTVPLATNGIESGDKIRPTEEELKMMDSLPSPEFR

SEQ ID NO: 161622 - protein, 106 aa, Triticum aestivum
  Clone ID: PAT_TA_56040.pep
AHPGRLCLRLRRTEKPDWGGRRKAGRLSRSTHNQSTMHLMPNATRLLRKTFRLLTAPGEFFLSKLRTTTGQQRGAGAELADHGEGYTPEEQAAMLLQYNFMIGDTY

SEQ ID NO: 161623 - protein, 141 aa, Triticum aestivum
  unsure (1)..(141): unsure at all Xaa locations
  Clone ID: PAT_TA_56041.pep
MMAGAQEQGLKLLVPRSGVSIYAIRVQMALAMKGLAXDYLPEDPGCKSDLLLASNPVHKTLPVLIHGGRPVRESLIIMEYLDDAFPGNGASILPADPYRRAVARFWAAYVNDKMFPSCIGILNTAKQQERANKVEETLAAF

SEQ ID NO: 161624 - protein, 100 aa, Triticum aestivum
  unsure (1)..(100): unsure at all Xaa locations
  Clone ID: PAT_TA_56042.pep
GGGGVFKLLEGWGLHGGPDKRRGIIWGGKYTRGEGAASDRXLXGVGVLGGAXVGLXGVPXLXXVXXDGQGXEXRDPGLRDLRGLLPXLRRGHLPQVHLPH

SEQ ID NO: 161625 - protein, 120 aa, Triticum aestivum
  Clone ID: PAT_TA_56043.pep
VARFAQDWAAQRAGDCRLQHSGGPFGENIFWGSGQSWTAADAVKLWVDEKQNYHLDSNTCDAGKVCGHYTQVVWRKSTRIGCARVVCTGNRGVFITCNYNPPGNFNGERPFAFLTLDAEA

SEQ ID NO: 161626 - protein, 63 aa, Triticum aestivum
  Clone ID: PAT_TA_56044.pep
FKRSTILQLHPYIYFLIISPQVNLHPVPLSYHPCDKKSKNYLSSTLRGEGKNNWLDTPRTWVL

SEQ ID NO: 161627 - protein, 119 aa, Triticum aestivum
  Clone ID: PAT_TA_56045.pep
EKYKSEDEEHKKKVDPKTSLENYAHHMRHPIQDEKIASKLPADDKKKIEDAVDPAIQWLDPNHLGEVDEFEDKMKELEGLCPPIIAKMYQGPGAHMPGGMDEDAPAASAGAGPKIEEVD

SEQ ID NO: 161628 - protein, 47 aa, Triticum aestivum
  unsure (1)..(47): unsure at all Xaa locations
  Clone ID: PAT_TA_56046.pep
VILPPPQEKTSPQNPPPXISGPPKAKGPPTPAITLNTSLPQFNHFFY

SEQ ID NO: 161629 - protein, 94 aa, Triticum aestivum
  unsure (1)..(94): unsure at all Xaa locations
  Clone ID: PAT_TA_56047.pep
MEDLINDVGRVTYLQGYLTCISSAVRKGANAHGYFVWSLMXHFEWGFGFTVRFGIYHVDFETQERTPKMSGKWYRDFLTGXRPVAQARTLRADS

SEQ ID NO: 161630 - protein, 73 aa, Triticum aestivum
  unsure (1)..(73): unsure at all Xaa locations
  Clone ID: PAT_TA_56048.pep
KKIEDPXHPRPQWLHPPHLGEVXEFEHKMKELEGXXPPXLPPMSXGAGXHTPGRMXEHARAPRAGVPPTMEEV

SEQ ID NO: 161631 - protein, 126 aa, Triticum aestivum
  Clone ID: PAT_TA_56049.pep
WHRIDDLLPASDDAISRGVNGMKLYMVAPFLTGLKSWIGTHRSQVYQKPDTSARGTVWKAKNPSGVFVPVENPVITRAGSDMQNPVISRAGSGTQHVDNRPGKSFRSFRFDTASILQSMDASFLHT

SEQ ID NO: 161632 - protein, 154 aa, Triticum aestivum
  Clone ID: PAT_TA_56050.pep
FLPENERADHMNAYHDRLMSDDPAVSHPAATAWNKYEINMSTLRLDPADLEKLTDPVYLLPHARMEAHYFKNRAWLEEGQLLRAENIERIRHVPCTIVQGRFDVVCPPVTAWDLHKAWPETKLVWVRDAGHSATEPGTKKALIEACDGYAGLEV

SEQ ID NO: 161633 - protein, 176 aa, Triticum aestivum
  Clone ID: PAT_TA_56051.pep
YTRRWHSMQATFHSYSSVYTVFSPLTPSRQVIYHESWLLDALLNLLAPSPPAWPSPPAFPSPPALPSPPALPSPPAWPSPPTLPVLPGTSPAFALPPPFALPALAPLPVFAPALASLPALSPAFALPALAPAFALPALAPAFALPALAPAFALPALAPAFALPALAPAFVLPALAP

SEQ ID NO: 161634 - protein, 118 aa, Triticum aestivum
  unsure (1)..(118): unsure at all Xaa locations
  Clone ID: PAT_TA_56052.pep
FEVPRKESSTSSDGGEGXEEXDXGMFTLDXAPVFIQVKALSMMXIVALAVEAWGAVVGTVGGVYGGQGVGELVXCGWMVLWFCPFMRGLVSSGKYGIMWSVRVKXGLIGPPPPPLWRR

SEQ ID NO: 161635 - protein, 52 aa, Triticum aestivum
  unsure (1)..(52): unsure at all Xaa locations
  Clone ID: PAT_TA_56053.pep
WEDAHPKCPKGCXGSRVVSTTPEMWRCGDINPTVEGTWGGPCKKYCSVHAGI

SEQ ID NO: 161636 - protein, 95 aa, Triticum aestivum
  unsure (1)..(95): unsure at all Xaa locations
  Clone ID: PAT_TA_56054.pep
LVYGKSGARRTLLGSXSSSIALYXNALLPLTFISQEAXAFPXNXXFSLSPXTQXGTHRXIANLRSHXRSAQLSGPQQRPLKXYLFSWAPHFTRLE

SEQ ID NO: 161637 - protein, 84 aa, Triticum aestivum
  unsure (1)..(84): unsure at all Xaa locations
  Clone ID: PAT_TA_56055.pep
MVANANAPARRSASATASLRKRRTTSGXSPLLLDGDGASSMLQXYSDETHGRNMSPNYVLIMSIGFITVVTGIHVLGKMFRTRN

SEQ ID NO: 161638 - protein, 116 aa, Triticum aestivum
  Clone ID: PAT_TA_56056.pep
RYLKKGRYAQRVGSGAPVYLAAVLEYLAAEVLELAGNAAKDNKKTRVVPRHLLLAIRNDQELGRLLSGVTIAHGGVIPNINPVLLPKKTAEKAEKAGAAPKSPKKTTKSPKKATKA

SEQ ID NO: 161639 - protein, 153 aa, Triticum aestivum
  unsure (1)..(153): unsure at all Xaa locations
  Clone ID: PAT_TA_56057.pep
MSGIQHGSWMIPLKKGKAPEPRWLNSTEQEIQLHVQYXSRISSXVIRWSKPRVEISWHSIGTCSMAPXVGXSIVKQGVIKXRLNVKGVXKGLKVGGLSLCPGNVGXKRCRSALLMGEKFFVLTGKDVGYKGRAPPPPPQSAMVCGRLWACRGC

SEQ ID NO: 161640 - protein, 70 aa, Triticum aestivum
  unsure (1)..(70): unsure at all Xaa locations
  Clone ID: PAT_TA_56058.pep
RRMMIXSGEAVKYKSSLDAFQQILKKEGPKSLFKGDGANILRAIAGXGVLSGYDQLQILFFGKKYGSAGA

SEQ ID NO: 161641 - protein, 60 aa, Triticum aestivum
  Clone ID: PAT_TA_56059.pep
FPQRLMFSSLALHERSVQSMSRCPHYTPISMSQSPYSATPTGSSSICSSRPSCSQSASHA

SEQ ID NO: 161642 - protein, 127 aa, Triticum aestivum
  Clone ID: PAT_TA_56060.pep
FVLSNLHRCLLHLESRRLKWKRNRNKRKKGKKNNRARVNSRLFQLSRPMGSCRTARRLPPLGRWAHASLLGIGDVGRRSDGPVALRAGAAVVAVPEDRHRRVSARRRSDADADADHAADCRHHLAAL

SEQ ID NO: 161643 - protein, 166 aa, Triticum aestivum
  unsure (1)..(166): unsure at all Xaa locations
  Clone ID: PAT_TA_56061.pep
MQPAAAPAMPSILLLLALLAATAVGAGAGRTPTLVFILAGQSNMGGRGGATLNNRWDGVVPRECAPSPRTLRLSPALRWEEAREPLHSGIDVGNVLGVGPGMPFAHALLRAPACPKGAVVGLVPCAQGGTPIANWSRGSDLYDRMLTRARAXXAQTNGKGKNRGHA

SEQ ID NO: 161644 - protein, 89 aa, Triticum aestivum
  Clone ID: PAT_TA_56062.pep
HSPESEHVPAVLSSYHTQEGGNDRHGYPPCGQGEIPYGREPADTRRLPGGAGKDNLHSMDNPAATCELTHLASWVHTTAKPEGLPWLYL

SEQ ID NO: 161645 - protein, 112 aa, Triticum aestivum
  Clone ID: PAT_TA_56063.pep
MKQNFDSAAKSGDHEDYAMYEEETPLHIDIRRFTYAELKLITSDFQSIIGKGGFGIVYHGTLENGDEVAVKVLMETSIAEATDFLPEVQTLSKVYHKNLVTLQGYCQTKKCL

SEQ ID NO: 161646 - protein, 82 aa, Triticum aestivum
  Clone ID: PAT_TA_56064.pep
MALSRRMAASALLLLVLLVATEMGAARTKVAEARDCLSQSFKFKGACLSSSNCAAVCRTEDFPDGECHAQHWDRKCFCKRPC

SEQ ID NO: 161647 - protein, 177 aa, Triticum aestivum
  Clone ID: PAT_TA_56065.pep
PRRPERPTRVCLRPFLHPYGEEEAPPRRGRASELGSAPWPRHNECSFESSRGRRRIAVKPYAGRRTRVAPTRASAAHALAGRAARLLCCRRSPWGSMSGTDPAVRTTRRLNCRPQSVPTDTPDPLAEEAIYEDDDHGSAESQDYIIDDDEDCADSPSDSCTQYHEREPILSPCDQHR

SEQ ID NO: 161648 - protein, 87 aa, Triticum aestivum
  Clone ID: PAT_TA_56066.pep
RGLPLLHPPTTLLSSPLLREVHARPQSPSPVSRTTTSRIHRHGDGHPQRPLRYRPRLLVTPPSPDAVLPTTNPTSASIDDSSLHLPS

SEQ ID NO: 161649 - protein, 80 aa, Triticum aestivum
  unsure (1)..(80): unsure at all Xaa locations
  Clone ID: PAT_TA_56067.pep
MGGNSNASAGDVNNILDSDEAEADEKKIEXGVAELNSRDMTKESAFGTEKIGDGPSGGGAIGEDSYNVLYMVQPTHLLLI

SEQ ID NO: 161650 - protein, 218 aa, Triticum aestivum
  unsure (1)..(218): unsure at all Xaa locations
  Clone ID: PAT_TA_56068.pep
KKEGXNPHSLSRSPPLPLILAATPPMPDADEVEGARKLARGAFAKLSQYEPAASSSPPSAPTAHLPQLLSCCFQLLRRLDHADPGLAARCVSLLRAFIHSIPSRDPDASLAPALEVCLQNFVDISQLRNCTMLNYAIQEVPKDPTMAISFQYELRVQLELMSHHFISSVQDEAEFEHFFSALSWSEKATQRTPELGLAGAIXLVRKTTGFLCLLLHKL

SEQ ID NO: 161651 - protein, 90 aa, Triticum aestivum
  unsure (1)..(90): unsure at all Xaa locations
  Clone ID: PAT_TA_56069.pep
QKGKRYHAFFNSSCTGSSGNCCCFSSTSLAVPQPCALAAPSRDRTATAPQGVATALRPPAPLDAVTASRSPVWSARAGPRRXAPRARLPP

SEQ ID NO: 161652 - protein, 80 aa, Triticum aestivum
  unsure (1)..(80): unsure at all Xaa locations
  Clone ID: PAT_TA_56070.pep
VPXTIRIDDVDEVARSSIWSLIGIKGDKVEKDDGKGCKLARVFDPKDEAKMSSHRGNNSLPFLKGNPAALSRSVNFQERS

SEQ ID NO: 161653 - protein, 78 aa, Triticum aestivum
  unsure (1)..(78): unsure at all Xaa locations
  Clone ID: PAT_TA_56071.pep
EESLSVSWGGMKQNNRLWGVERYRLIAXSRARMGWXGVAISSGLSEPETRASFLTTPTSSLGALRSSCGTECDAETGI

SEQ ID NO: 161654 - protein, 134 aa, Triticum aestivum
  unsure (1)..(134): unsure at all Xaa locations
  Clone ID: PAT_TA_56072.pep
HQLIASQKVAPRQLKLRMFKISLVFEASALLKGLGVRLPSGAKAILCQMMDFSMSQTLYFSSIFHKVFLXSELNRSLACSTSLGESSLATSTACPRALEFMMDLPSLFLIXKTLTGVVASVDALANPLRLDLRS

SEQ ID NO: 161655 - protein, 121 aa, Triticum aestivum
  Clone ID: PAT_TA_56073.pep
PTASQIGKPAVHIASVDLKGKAYELLRQNSSSLLMEDIYKNPGPLQFQGPGADLKPISLCVEDRDYMGRIKQLQEYLEKVKNIVKPGCSQDVLKAALSSMAHVTELLTIMSSPSYSGQATI

SEQ ID NO: 161656 - protein, 89 aa, Triticum aestivum
  Clone ID: PAT_TA_56074.pep
SHDASLVTGFLFFIFERLHQYIDRLPVELVTILKFREPNETSTLNDISSSTFWKSNSSVRKSIQKTPIYFLPVQDKIHLERYPKGSIAF

SEQ ID NO: 161657 - protein, 81 aa, Triticum aestivum
  unsure (1)..(81): unsure at all Xaa locations
  Clone ID: PAT_TA_56075.pep
QNMPXNRLGAMRGLGAKDKTSXIRGGGGGXXXXXPLLTPPPXIQILXXXXXPSXXYXQXTXXXPFTSSYXXKNXXXXXKXF

SEQ ID NO: 161658 - protein, 64 aa, Triticum aestivum
  Clone ID: PAT_TA_56076.pep
GSPCWAIVFVGADTNVHSRAWPGWSCSYWLQLQVSICENTSGLPKSHRRYMLPLTTYVYSHLNC

SEQ ID NO: 161659 - protein, 58 aa, Triticum aestivum
  unsure (1)..(58): unsure at all Xaa locations
  Clone ID: PAT_TA_56077.pep
VGIARGQGKFVDLVRKXQRAVGAPNLRXVDAMGLPVAKDFTHLPTRGKVGLGKMFPDA

SEQ ID NO: 161660 - protein, 105 aa, Triticum aestivum
  Clone ID: PAT_TA_56078.pep
GVSLYTRTLASRIIYMEKGVHLHGDNLCPSASCVRTSERPILGKPLTDALRKKATERGHTCQPHGQSTISRAHYLHPMDLPTPTKMEGSLCFIPHELRVGVLARR

SEQ ID NO: 161661 - protein, 152 aa, Triticum aestivum
  Clone ID: PAT_TA_56079.pep
MGPSPYINFSFASLECPPGGRGTRFYKAYLFIYLFITGQHQLFGGSPKGERTPPVVAGRRPQTCMYNPNGSAHLIGAFFILYGLLLSGPTSIPLGEEGEPTILFAPRRPGNVWVGGAPISTPECLHGAGLPHPAIDPTLAALGAHLFPKLGP

SEQ ID NO: 161662 - protein, 72 aa, Triticum aestivum
  Clone ID: PAT_TA_56080.pep
PFYKKISNPHLNFLKCWTLSNNFFTYWYKKTVFNKIPLFLNPYGERQAQFYAGPWVHPEISNPVLEGFQFFF

SEQ ID NO: 161663 - protein, 132 aa, Triticum aestivum
  unsure (1)..(132): unsure at all Xaa locations
  Clone ID: PAT_TA_56081.pep
ENITGQPPVFMDPQTVHLPNWVRQKIANDSIHDVVDKKLLDLYDAGSLQSVVDLAMNCVGNAAIDRPTMTEVAXRLKVWLPAASGTPRRTYSMDSEIPRQFQLMISGARNEGSSFQSGYTNGMSQMSLFSGR

SEQ ID NO: 161664 - protein, 159 aa, Triticum aestivum
  unsure (1)..(159): unsure at all Xaa locations
  Clone ID: PAT_TA_56082.pep
GFFGGVYTPPGPVVGKLKGDPQIPLGFVILLPDFFFKKLGLPGXFFPQAWVSLPGVFPVASGGFLFWHIPPLPEIFGGVFFFHFGGGPLGPPWGNAPGPPPNRVALKPCVQPRNKGPVFPPEGIXFTRPPCKWSPYPPPPFXVWKAFKFPSHPVDPFFK

SEQ ID NO: 161665 - protein, 122 aa, Triticum aestivum
  Clone ID: PAT_TA_56083.pep
KKDGEVFALPSGKKGFGLFRGEIGEPFFDKKEAAKQAGQAPALEAPKLPVRVHPGLEEFLAAAVSAAANRGFSMEVYGGSKKLTSFFKPMGPLCKKKGQLPFKVQKAKRKAWKKGNFGKKSF

SEQ ID NO: 161666 - protein, 77 aa, Triticum aestivum
  unsure (1)..(77): unsure at all Xaa locations
  Clone ID: PAT_TA_56084.pep
ARGGGGGEPKKLSRDLLTLRGKKHSMLSAKHIHGATQNSLTLCLYILXTRWGGGGHTTHTXVNXGAGGGAESLIRTN

SEQ ID NO: 161667 - protein, 79 aa, Triticum aestivum
  Clone ID: PAT_TA_56085.pep
IPFAPDRAETAVVFRERGGGGPNHAPGVLLNGTKRPLPPRGGPPPCVPPPRWMQSLGPPPPWGAPPPVPVPSPPPPGCP

SEQ ID NO: 161668 - protein, 129 aa, Triticum aestivum
  Clone ID: PAT_TA_56086.pep
MITLPIVAPTSLPSLSRRGSSFAVVCSGGQKIKVDKPLGLGGGLTVDIDANGRKVGKKGVYQFVDKYGANVDGYSPIYTPEEWSESGDRYAGGTTGLLIWAVTLAGLLGGGVLLVYNTSALAGLESIYV

SEQ ID NO: 161669 - protein, 101 aa, Triticum aestivum
  unsure (1)..(101): unsure at all Xaa locations
  Clone ID: PAT_TA_56087.pep
RYAENKTETVIAPVVGSNFDRLGEAYDYYNLYSWEIGFGVRYGKSRLNXRTKCLQEIVCGCXCPTMIRLLRTSDIGWYINEFRADHNHALNEKCVFSSWEG

SEQ ID NO: 161670 - protein, 64 aa, Triticum aestivum
  Clone ID: PAT_TA_56088.pep
GDRSLRMLLGDASPWSIAGAAAAVALLWLAAWILEWAWWTPRRLGRALRAQGLRGTRYRLLHRR

SEQ ID NO: 161671 - protein, 208 aa, Triticum aestivum
  Clone ID: PAT_TA_56089.pep
PGGKEAPILSFLVGSLLAVRALAEPFEKLFSTPEGWKMQGLATNEQIVKLQIALQQGDVAGFEQHVIDISTPSHPSYGAHYGSHEEMKRMIQPSSETVASVSAWLKADGINDAEIDSDWVTFKTTVGVANKMLDTKFAWYVSEEAKPRKVLRTLEYSVPDDAAEHINLIQPTTRIAAIRQNHDVAHEIVGLQFAALANNTVNCDATIT

SEQ ID NO: 161672 - protein, 125 aa, Triticum aestivum
  Clone ID: PAT_TA_56090.pep
PPLGDSCICLLASEPYGQAGYVVRGPAISMGYLRLFAGGAASIPSPQVVSCPEVGGSGQNRIQITILDGLSFLLERSPKSQNGLSWVRNVISVSSGPCCNTTECLIQYKLPSICALLVSKTNTIK

SEQ ID NO: 161673 - protein, 151 aa, Triticum aestivum
  Clone ID: PAT_TA_56091.pep
HTVRLALDLLLAQCSEHSTVGSPAPACSSSPPPRPHEALYRQQKDRRSLCYAKRTLCGALNSLLDSFEVYPPHGGQTVSCMSGPSVRWRAHVIPSSFFSSARCVVMPCPLSRGFSSRFIVTRSVRTGSGSYAPLPSALTHRTSSSLCRQPL

SEQ ID NO: 161674 - protein, 227 aa, Triticum aestivum
  unsure (1)..(227): unsure at all Xaa locations
  Clone ID: PAT_TA_56092.pep
VFHAQQVKYYPSLNEHHVEFITAQPLFFVASAPWAGDHINVSPKAICLAHFACSGPIPSXYLDATGSGCETISHVYENGRVTLMFCSFGPSPQIMRLFCKGRVVEKFDHHYQELRAKMATENGDDIDMIGARAIIVLKIQKVQTSCGFGVPIMGTTAATPIEATGDAVTMVEHDEDTAANDGWKPRETMEKWARKMLEKQELMDYQKRSNHQSLDGLPGMLSARRAL

SEQ ID NO: 161675 - protein, 65 aa, Triticum aestivum
  Clone ID: PAT_TA_56093.pep
YELACIFVMHVGKTGKCFDSAVYHLLRCTLSEWVIVSRLTYCLKAILPKTCRFQTNRINIKRWCV

SEQ ID NO: 161676 - protein, 71 aa, Triticum aestivum
  Clone ID: PAT_TA_56094.pep
FSQRIGLHMTCVNIRDASLLDTWFMLLSVLMHDCYPPVLLGVCDRQVCIWAHDVNTPVIQFSHPLFLAASL

SEQ ID NO: 161677 - protein, 102 aa, Triticum aestivum
  Clone ID: PAT_TA_56095.pep
SIYHSNSSNNMIRHLIGSRRKKVRIGQGELYPPYLKELQSSVLYLQVRKVSIAMRILGRLRLSFTAGGRSSHRSHPAARVGVPRRRTDGTIPRPATGGAPPP

SEQ ID NO: 161678 - protein, 153 aa, Triticum aestivum
  Clone ID: PAT_TA_56096.pep
GFGRTILPSPRVWAPPPRWLGFGNFSPSNDVASFPEPQGSFFVPAPEPPKVAVCQPLPRVFFFFCPGVGGFFPVPIPRVFFVPAQPCVPPLGGPPPFGWRGCLKFYPRFGGRVGPFNPEPEGARGPPVSLFFFWRTQIWGLGLLTPLWVPRVP

SEQ ID NO: 161679 - protein, 91 aa, Triticum aestivum
  unsure (1)..(91): unsure at all Xaa locations
  Clone ID: PAT_TA_56097.pep
EPAQADFEWPEVDSLLXELKNIEQVKDVYKGRFFRSPGLAPTFXVYMASLVGQKYNVLARYGNNVQEVMVETSLDKEGLKEAILMCTNRVS

SEQ ID NO: 161680 - protein, 155 aa, Triticum aestivum
  unsure (1)..(155): unsure at all Xaa locations
  Clone ID: PAT_TA_56098.pep
YQDDAVKAYFHHYGXKFKPYFNRHGRXFPDVATQGYGFRVYDQGKLKGLQGTSASAPAFAGVIGLLNDARLKAKKPTLGFLNPLLYSNSDALNDIVLGGSKGCDGHARFNGPPNGSPVIPYAGWNATAGWDPVTGLGTPNFPKLLKAAVPSRYRA

SEQ ID NO: 161681 - protein, 97 aa, Triticum aestivum
  Clone ID: PAT_TA_56099.pep
TYRRQLCWYMSWYLNGIPPVISGLCKRHIILSNVDLTPKVVGSVQKVILAKRGAMAHYICCWRSNPLKVRHGLLFFFLLWGLLVNIMQVDLAVVLGP

SEQ ID NO: 161682 - protein, 78 aa, Triticum aestivum
  Clone ID: PAT_TA_56100.pep
FYCYSLCRPECMLFSVVVVSSKGVRVLSLCSVMLMSVCDYLSNFVIGVGCALLCVLPLHIVAVLFWIKLKNISFCLNK

SEQ ID NO: 161683 - protein, 72 aa, Triticum aestivum
  Clone ID: PAT_TA_56101.pep
GYDGQRGGDGGYGGGGGGYGGQGGGGYGQGGGGGYGQGGGGYGGQRGGGGYGGGGGGYGGQRGGDSGGQWRN

SEQ ID NO: 161684 - protein, 66 aa, Triticum aestivum
  Clone ID: PAT_TA_56102.pep
GKANQPPNQGKIFQNTTRGDPGPGNHPQKGSQRVGQPDLNHRKKAKNFDSTQPKATNRSNQKAERV

SEQ ID NO: 161685 - protein, 75 aa, Triticum aestivum
  unsure (1)..(75): unsure at all Xaa locations
  Clone ID: PAT_TA_56103.pep
MAMAVPALLSLLVKTYAILSHTYRRNHEEVIFXDITNDAGHHEAEYNKLAFCGVQAAKDGLSYFXVDTSCIRNVA

SEQ ID NO: 161686 - protein, 41 aa, Triticum aestivum
  Clone ID: PAT_TA_56104.pep
FGMEGISQFSCYLNSRCAFLLFSEAVLEVLTNSVSITVAVT

SEQ ID NO: 161687 - protein, 121 aa, Triticum aestivum
  unsure (1)..(121): unsure at all Xaa locations
  Clone ID: PAT_TA_56105.pep
VYSQCILQARGXKIQINLRTYLPLGQVTPCHRLCTLTALRSLLSSEGTLSNVINCQWANGTASKLSVEGPPKHSADTQLWILSRVHGSWGQPEPHCHCKKGRGYLISLVVCHWILEHKLYV

SEQ ID NO: 161688 - protein, 119 aa, Triticum aestivum
  Clone ID: PAT_TA_56106.pep
HQGITQLKFQRNKRSVAEERAGRRLGGLRVLNSYWVNEDSTYKYFEVILVDVAHSAVRNDPRINWLCKPVHKHRELRGLTSAGKKFRGLRGKGHRHHKNRPSRRATWKRNQTVSLRRYR

SEQ ID NO: 161689 - protein, 150 aa, Triticum aestivum
  Clone ID: PAT_TA_56107.pep
AGDKAVLPEDFLAETKGRGIFLSWCPQEEVLGHPATGLFLTHSGWNSTLESICAGVPMVCWPFFAEQTTNCRYACAEWGIGLEIDSDVKREEVARLVLEATDGERGKDMRAKATMWKEKAAAAAEDGGTSTLGIDRLVAFLLGGTDGPQS

SEQ ID NO: 161690 - protein, 175 aa, Triticum aestivum
  unsure (1)..(175): unsure at all Xaa locations
  Clone ID: PAT_TA_56108.pep
GAGTPPGGPNPPPPRPPRENPPRTPPPGAXSPGGPTGGGPPTTPPAGPGGKGPPTGAPPPGKKKAPPGPQTRPPLPAPPCPTPKSRGPLGFPRRNRPRVFPPLRGGAPPLEAPQAGPPRAPASLSFALLAASPVSPGCGDAHAPPPPKLFSPLGLMGPGGAPRPKASWMTRLGPF

SEQ ID NO: 161691 - protein, 62 aa, Triticum aestivum
  Clone ID: PAT_TA_56109.pep
SELIIVKPGMLAGSGMLFPAVPMGPRGTPTPGHSYRTRTACCMTISPTRAVSCDGWRLRPPP

SEQ ID NO: 161692 - protein, 82 aa, Triticum aestivum
  Clone ID: PAT_TA_56110.pep
MCIDAKVLSKCIQLHAWRPVHTIVVRYIRIQLGEINHAFLIHHELDLWTKATWWGEEAADLLHHNAGKLPSARARHWLLPPS

SEQ ID NO: 161693 - protein, 78 aa, Triticum aestivum
  Clone ID: PAT_TA_56111.pep
MPRLCEVGAGSKHQCVSTMIQSQSHHQLCTMITSVSRVYMLSKRVYVLSLTSAACCMCVPRTEQLEVHIYAILIWYDA

SEQ ID NO: 161694 - protein, 156 aa, Triticum aestivum
  unsure (1)..(156): unsure at all Xaa locations
  Clone ID: PAT_TA_56112.pep
CKSGRAGVASSAPPLVRPRAVICTPEPDRPRVLVNEKGTSTSPSPDGTRQRGGLFRDGSNTVEEELRAAPTCHVRCEGVHGKEQRSSSAPDRCPVRSPLLRDEPLFLSLPAAPYPTERRPDPTEEHRCRPAGRPWIRGCENESERTTTPPGLFXGG

SEQ ID NO: 161695 - protein, 78 aa, Triticum aestivum
  Clone ID: PAT_TA_56113.pep
LDHMIYQSNSRATVWLVDYMNRQEWTHHQKSSHQYLLRGIKLKPHIKRNKHVLIACRVTPLSQICKHRDKKVVNRRCI

SEQ ID NO: 161696 - protein, 218 aa, Triticum aestivum
  Clone ID: PAT_TA_56114.pep
NGGEKVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHAPAPAAAAPAPAAAAPKKPSQEVKSD

SEQ ID NO: 161697 - protein, 60 aa, Triticum aestivum
  Clone ID: PAT_TA_56115.pep
TKSATDDNQFLDLIQITNWFADKYTENQMVPSYFEEFVDRVYKIPSWQNQCDLISSLWVL

SEQ ID NO: 161698 - protein, 66 aa, Triticum aestivum
  Clone ID: PAT_TA_56116.pep
MEDWENDDFQPIAPVVKAQPLKSNWEDEDVDEDDVKESWEEEEEVLERFAHCLVHIIPLSPWPTFL

SEQ ID NO: 161699 - protein, 216 aa, Triticum aestivum
  Clone ID: PAT_TA_56117.pep
TFFFLFHLLGRGGFGKVYKGTLEGGNEVAVKRLIKSSGQGIVEFKNEVLLIAKLQHKNLVRLLGCCIHEDEKLLVYEYLANKSLDAFLFDHARKHVLDWLTRFKIIKGIARGLLYLHQDSRLTIIHRDLKASNILLDTEMIPKISDFGMARIFGANQNHANTTRVVGTYGYMSPEYAMGGTFSVKSDTYSFGVLLLEIVSGLKISSAQLKMEFCSL

SEQ ID NO: 161700 - protein, 67 aa, Triticum aestivum
  Clone ID: PAT_TA_56118.pep
HRCLLEPLACLRIKALWQHLLRNFEFDLASPFPGNDVDAQARRINGEVMVNYKRRKLIADPRERVDP

SEQ ID NO: 161701 - protein, 222 aa, Triticum aestivum
  unsure (1)..(222): unsure at all Xaa locations
  Clone ID: PAT_TA_56119.pep
IPPQQPYPQPQPFPSQQPYLQLQPFPQPQPFPPQLPYPQPQSFPPQQPYPQQQPQYLQPQQPISQQQAQQQQQQQQQQQQQQQILQQILQQQLIPCRDVVLQQHNIAHASSQVLQQSTYQLLQQLCCQQLLQIPEQSRCQAIHNVAHAIIMHQQQQQQQEQQQQLQQQQQQQLQQQRQQPSSQVSFQQPQQQYPSSQVSFQPSQLNPQAQGSVQPQQLXPVR

SEQ ID NO: 161702 - protein, 101 aa, Triticum aestivum
  unsure (1)..(101): unsure at all Xaa locations
  Clone ID: PAT_TA_56120.pep
CRQGAHCGCFAASAKQRRASFVKGRHPLSSALTGDDGVANQSRCLNFLSDTSLNPWHRPGRRHHPYRRQCQNPFPWQELRISGGTCSCLLRILNGQGXASS

SEQ ID NO: 161703 - protein, 152 aa, Triticum aestivum
  Clone ID: PAT_TA_56121.pep
ADVGSAILCIYKHWSYIKNLASILWRGIKHKTQIKRISLGSCLLRDPFFSNVRTQGQKRGQLVVPIGYSFKFPLQLLRETAYHGVVLDEDMIQIVIHGLQQLVQVQLRRTELNVVMPRRVLTGTAHRHGRRLAYFIVEPHRLVGMAASIGRR

SEQ ID NO: 161704 - protein, 89 aa, Triticum aestivum
  unsure (1)..(89): unsure at all Xaa locations
  Clone ID: PAT_TA_56122.pep
RFYLMSYLTILYLADTTXRKIFGCTKKISRCSSSMHKTFCRGFFPAEVTASQKKSRGHDWDFLQEIFSLLFSACDLMPTSYLGMTNRQV

SEQ ID NO: 161705 - protein, 55 aa, Triticum aestivum
  Clone ID: PAT_TA_56123.pep
QTGKQGIYIYKNRFLIQNTQGISLARRKTTGGKNVKKLFGKNTGGGKSGPFEKIN

SEQ ID NO: 161706 - protein, 115 aa, Triticum aestivum
  Clone ID: PAT_TA_56124.pep
REYRPPQTLVSALPQRYYTEEAIPLPANHMKSNSSGSSKDAPGRATKSSSPFSIWSCFFFAPGDLWQTSAQKAYDSNSIPILGLHIMFGQKQKVPKLGPKFHLLSFCLLQLLSQP

SEQ ID NO: 161707 - protein, 95 aa, Triticum aestivum
  Clone ID: PAT_TA_56125.pep
LQQVYVKYSALFRITREAYPYEDTSQLLSRVISSYGANRIMWGSDFPYVVPECGYKGAKEAISHVAGKVAISSSDLEWILGKTVSQLFQGAWVTP

SEQ ID NO: 161708 - protein, 105 aa, Triticum aestivum
  unsure (1)..(105): unsure at all Xaa locations
  Clone ID: PAT_TA_56126.pep
LHAIGQAWRLWEDGKATELVDSFIAASCPLHEVVRCIHVGLLCVQDHPNDXPLMSSVMFMLENESAMLPPPKHPVYFALGNPKGEQASENTSSSNAMSITMLKGR

SEQ ID NO: 161709 - protein, 90 aa, Triticum aestivum
  unsure (1)..(90): unsure at all Xaa locations
  Clone ID: PAT_TA_56127.pep
APVLRLKIAPGSPYHADGFILTVQTLCPAFDQNFHILLGIQKWMNAALPSLREHDASHGVLDSFTRTHTQRTGRXKWVGSSGAWQAPSCA

SEQ ID NO: 161710 - protein, 133 aa, Triticum aestivum
  Clone ID: PAT_TA_56128.pep
NTVEDEAVVLGAGAFEMAARKHLIDNVKKTVKGRAQLGVGAFADALLVIPKTLAENSGLDTQDVIVSLENEHDRGLVVGLNHNSGEPVDPEMEGIYDNYSVKRQIVNSGPIIASQLLLVDEVIRAGRNMRKPT

SEQ ID NO: 161711 - protein, 89 aa, Triticum aestivum
  Clone ID: PAT_TA_56129.pep
SLKPSMQVQARLQAHPRTRALHASSAVVACQRIRLHQKRRMLPDTHSLHHLRYEHTHCQQLNSTALLVHRLLGRDTNTPTSAIMALRDC

SEQ ID NO: 161712 - protein, 192 aa, Triticum aestivum
  unsure (1)..(192): unsure at all Xaa locations
  Clone ID: PAT_TA_56130.pep
MSFLPIPLPIVGDIASRLHGQEKPRGEDTTSSAPAPVLGTVASRWRELHGENSWKGLLDPLDPHLRASIISYGEMVQAAYDAFNTERRSPHCGACFYGYEDLLAGVGVPHHGNNYEVTKFIYATSSLPLPSSFLLLPLPSLPDVWSRESNWMGYVAVATDEGAAALGRRDIVVAWRGTVQXMEWVNDLDFAP

SEQ ID NO: 161713 - protein, 173 aa, Triticum aestivum
  unsure (1)..(173): unsure at all Xaa locations
  Clone ID: PAT_TA_56131.pep
MAHELVLDTAIRDXSYIPFCEVMVLICQLYFLDFKXMRSHPSGFPSHDRKNVKEXRTASRHRNLRNGAHLIAANAFKDRKLFTPTGIPDLLHVPKEDAHKAHAAMXSDPNMRVDMMXKNLSMMGSQTLTFAWXVNLFFASSAAVNTHFPVTXRLKRMLQQGIDLISEAVSYVS

SEQ ID NO: 161714 - protein, 169 aa, Triticum aestivum
  Clone ID: PAT_TA_56132.pep
MTACKQSASTGAAATYEADRKSAAKSDGAEERKPSTKCRKGKKAKGKLAVKSNGAEKPKTHDLSDVTRGLAVMSIATEKPLDEQLAQFALFTYQNDFWMDNFKGVYDKPSVDAIKRKATENWKSFSDSDKAPYVAIARVYKILIAEANEFKKTLKLTLAMTEKMMNLKM

SEQ ID NO: 161715 - protein, 72 aa, Triticum aestivum
  Clone ID: PAT_TA_56133.pep
QVDPLFRYARNINIVVDMIILQDSQSMHLELVLSINLISKNLPSLITFTLLSMSSLFSVISPMSKVASQAQS

SEQ ID NO: 161716 - protein, 224 aa, Triticum aestivum
  unsure (1)..(224): unsure at all Xaa locations
  Clone ID: PAT_TA_56134.pep
IALVDNSTADSRRVKADEGVLSVVTDSSNRHIRFRTKSLELTKIRIQGATELCNAGEQPFVGKVDLREQNIVDIEELVELCTRMEEACSGFTRFGFCQILDATDNFSEKMIVGWGGFGKVYKGQLPGGLNVAIKRADEHAAMLEVNSELQLAKLQHANVIRXIGVVHPWERKILVYEFMQNGSLXDRYLCDRTKGPMLNWSKRFKIITGLTEGIVYLHKHSMFW

SEQ ID NO: 161717 - protein, 143 aa, Triticum aestivum
  unsure (1)..(143): unsure at all Xaa locations
  Clone ID: PAT_TA_56135.pep
CCSPSKPPGRTQCTQSQSHSSSRSPITPLPTIKETAVTTHAHKGMNAVLRLKTGLXRYTSNVYNKRPXLSESLTKDHSPKYMVLACTDXSRVCPTLTLVLNSIHAFTVQNIAGMVPAYQKTRXCNVGSDIQSVVDVLKLSALL

SEQ ID NO: 161718 - protein, 73 aa, Triticum aestivum
  Clone ID: PAT_TA_56136.pep
NLEDKNLFCGWMVCIHQIAHSTFPMSTSFVVHLTSTNQTEDVPAPHADNDSSSNRSLPREFQIICLSNICGIF

SEQ ID NO: 161719 - protein, 100 aa, Triticum aestivum
  Clone ID: PAT_TA_56137.pep
LGVVGTMEGLRANNGPDEGSRRVQTPGSLACEEVRCADRGARRQTSTGSSTPRTLRNPGEDSNYRLAAIRVWPCILISCESTDGRTNLIQSAILSKDDLC

SEQ ID NO: 161720 - protein, 126 aa, Triticum aestivum
  unsure (1)..(126): unsure at all Xaa locations
  Clone ID: PAT_TA_56138.pep
AQGGVRRHHGDSTFGAKHLQAAGPWLDYNIXKEITLHLILRSTXGRIQSFANTLTGPNIKLGAEPXDTIDNQKANXQHKERIAAHHLHLIFCRKHLQDSRTYGNYNIYKETNLYLHLRIQGDSASY

SEQ ID NO: 161721 - protein, 85 aa, Triticum aestivum
  unsure (1)..(85): unsure at all Xaa locations
  Clone ID: PAT_TA_56139.pep
MNSRPIVLVFLLLVLIISSQFEWKQQIGEAEASPEATRRRQQPQIVREDAVKEKIILAQEKNIQQLTELIQSLQVQLLHXCRGSN

SEQ ID NO: 161722 - protein, 121 aa, Triticum aestivum
  Clone ID: PAT_TA_56140.pep
MSHSNQVRYTARSITPPADRDSGSKSPPPRRRAASKSPPLPPPPPFPPKGVRTISRSPPPSSTRRSVSRSPPPKRRGRSRSRSRSRSRNRSRSRSRDKDDVRNPGNNLYVTGLSTRTQETD

SEQ ID NO: 161723 - protein, 171 aa, Triticum aestivum
  unsure (1)..(171): unsure at all Xaa locations
  Clone ID: PAT_TA_56141.pep
SLQLHSTAAGARSVLLPCPRLRTENGLDHDELNVCSAPTIQDMVLLHHEVEVEYPDGRPTEKHQATQLEFXKIENSRLTTAMAFTVGVLAAIGALFLLQNKVQRKGVIRPLEPEIYIPGECRSKLTILVLPSSPCSSTPLQRKPGPCCFLSLTPALRSSGLTALLTERGEK

SEQ ID NO: 161724 - protein, 126 aa, Triticum aestivum
  unsure (1)..(126): unsure at all Xaa locations
  Clone ID: PAT_TA_56142.pep
HPRKHRPNADKEPKNEKKTKTRPRATXQDKNEARTKQRQRHXTAQKQKRRQPRPARRNXPHRARRKRTGXRPPPRXAGRARAXPPGARPGAEGRREPPPRALPGFIVPQKREHKESGRGATGNADR

SEQ ID NO: 161725 - protein, 62 aa, Triticum aestivum
  unsure (1)..(62): unsure at all Xaa locations
  Clone ID: PAT_TA_56143.pep
PRVVIAAHKGTGHFTVKXVGMPLILGIHDEAVAHGQVNLVVDMLGLYLVQQGFSGCRAILFF

SEQ ID NO: 161726 - protein, 56 aa, Triticum aestivum
  unsure (1)..(56): unsure at all Xaa locations
  Clone ID: PAT_TA_56144.pep
VFGXGXLIIYIFXGXXPVLRXYMXKLENPFCXRKRLKVFFLPKXQMPEPQKLKVFK

SEQ ID NO: 161727 - protein, 56 aa, Triticum aestivum
  Clone ID: PAT_TA_56145.pep
KEAVKFSLINLKSYPLVKGRLIKGTLNLIGARYNFVHESFQTWNAYSQVVQKWLAS

SEQ ID NO: 161728 - protein, 84 aa, Triticum aestivum
  Clone ID: PAT_TA_56146.pep
PVKKPFKYGPLLSQGQDNVKGVQLFSPSMSRAALGMFFQDAINLGSFYGAHQGSLPVPAGCPDQAAKIFDPPARSYIGNSLYPF

SEQ ID NO: 161729 - protein, 81 aa, Triticum aestivum
  unsure (1)..(81): unsure at all Xaa locations
  Clone ID: PAT_TA_56147.pep
MYAGGTSAYQWPSIVXVVNNQILAHMQSTDVVNKYDKASNTWNIVKPLSCIGNLTAPGVGFLRKGVYIGCNGWFQSSSRLM

SEQ ID NO: 161730 - protein, 157 aa, Triticum aestivum
  Clone ID: PAT_TA_56148.pep
GPAWRHKEVFWLVEAKQPSFLEVPLAFPVFEGQSDGFIGAGDKQGALGRLGFTDLYPAVCGFIISSSCGSLHGRMSLFQLVTFIEVGSLFKPDRLSFLIRCSVRGWNCEPKNFSVSVRVCPGVVWCSFLPCYILIRAARIGGDRNCPANSRRHYGPF

SEQ ID NO: 161731 - protein, 131 aa, Triticum aestivum
  unsure (1)..(131): unsure at all Xaa locations
  Clone ID: PAT_TA_56149.pep
GSQLDPNNYDTKMHELISHGETEEFFTXYDEAHESFDDLGLQDNLLKGIYAYGYHKPSGIQQMGIRTLXKGLDVIQQAHFGTRKTATFXLEYLNSLSMAMAECQALGLAPTRERSQLIEKVMRPLGDYSRV

SEQ ID NO: 161732 - protein, 194 aa, Triticum aestivum
  unsure (1)..(194): unsure at all Xaa locations
  Clone ID: PAT_TA_56150.pep
SNFVLVQLAPPVAVHAGPNQTLAACPADGRQAMDRKRMNDALNRHLRAVTERTYDLPPPAVPSRTRPPSSVPKPRDQVDSDSIKGGHGLWSSKADDTLCINWFCAMTGTEFFDVVDDDYIQNNLNICGLSAQDRYYDHAXLDLILELMLVQRDVCGRDQIELIXRSSLMLYRSIHARNILDTKGLAVMLQKVQN

SEQ ID NO: 161733 - protein, 40 aa, Triticum aestivum
  unsure (1)..(40): unsure at all Xaa locations
  Clone ID: PAT_TA_56151.pep
LESRNKQGTRLYVIIREYXYHSGYVILVTCLLIHIQGVHK

SEQ ID NO: 161734 - protein, 69 aa, Triticum aestivum
  Clone ID: PAT_TA_56152.pep
VTQRAPLCNEAGLEGQTRGTEGMVSWRKIRRCRHARFSSSTCLNTRTLTGSSHYQDMCIINFLMKTRVI

SEQ ID NO: 161735 - protein, 220 aa, Triticum aestivum
  Clone ID: PAT_TA_56153.pep
LALLALPRAVTTKKKQNLTLELEMSTIIMRVDLDCDRCYKKIRKVLCKLQDRENIKMISYDEKSNTVTVSGSFDAEEVADRLCSDAGKVITDVQVARGNQMKPGAKVAPKQHGKEGHGYGDGPGPQAHGHGGKPEKTKHVKFGMDDDGRIDRHGPGPQAHGHGGKPEKTKHVQFGMEDDERIDRRGHHDQSHGHGHGNGHGGKPKVVTTTAMSRNEGPRA

SEQ ID NO: 161736 - protein, 137 aa, Triticum aestivum
  unsure (1)..(137): unsure at all Xaa locations
  Clone ID: PAT_TA_56154.pep
MVHLHAERENLKIARKDHPQTEDDSKXLKSLQSVGQIIREVLRTLDNERFIGNASSGPIYVIGCAXKDDKENSTPGTRAALDMTSLTIMRTLPKEVDPELYNMLHEDPCNVSYSAVRGWSDQIRQLMASIELPLMNP

SEQ ID NO: 161737 - protein, 187 aa, Triticum aestivum
  Clone ID: PAT_TA_56155.pep
MASKLPDATKGLGAGGMDVEDGSGGGGGGKKVAGRWPGFVHFFFVLTVVTCALVYAPRFLSPTVPVDFLGPRQPSSGRLPVRVDGGRGNEGDALVLDNQVNSPCASMGAHGICCDRSDFNTDVCFMAGDVRTDAASLFFLLFPPQAPNGTAKDANATVAEKEEVVRPYTRKWEKHLMANIHEVRFRA

SEQ ID NO: 161738 - protein, 161 aa, Triticum aestivum
  unsure (1)..(161): unsure at all Xaa locations
  Clone ID: PAT_TA_56156.pep
MKGAKSXGAVKADTKLAVKSKGAEKPAAKGKKGKAGKDPNKPKRAPSAFFVFMGEFREEFKQKNPKNKSVAAVGKAAGERWKSLSESEKAPYVAKANKLKGEYNKAIAAYNKGESAAAAAPKKAAAKEVEEDDEEESDKSKSEINDDDDDEGSDEDEDDDE

SEQ ID NO: 161739 - protein, 150 aa, Triticum aestivum
  Clone ID: PAT_TA_56157.pep
GWRKQQPAVDRSWPWEATHARAGTAATNCGSRHARSCGLCLSDYMWDGDGGMPLAHRADLFSPYSDSRPQQPWRKTRPRADPAWPDNDSASSSSSPPTTARDDAAKPSTSHDESTTTTNPTDATTRYTGTSPRDPATSTYLTKHEDLHAQ

SEQ ID NO: 161740 - protein, 194 aa, Triticum aestivum
  unsure (1)..(194): unsure at all Xaa locations
  Clone ID: PAT_TA_56158.pep
MGRQASRLRRRRQPPAGISPTTWPASSAACCSMESAIMQSPSKLPDPSVSTPPRVLGHQGWADLPDKLLHCIDPLWGSLLDLIXFASTCGYWXRAGFSSYPSKSTICTKLPTSLGRPNLCVDAPNLLSMNGRHKLHTWKVIDLANQNSXLRCQIPQETFXRMRSAGSSXGHLICCXRRGNCLAVDAFTGDDVSL

SEQ ID NO: 161741 - protein, 77 aa, Triticum aestivum
  unsure (1)..(77): unsure at all Xaa locations
  Clone ID: PAT_TA_56159.pep
QVSLVIVYDLPGESEDYLVXNVRNGRLDRKGVTINFVTREHNSIMFNIKXFYQVVTEEIPMYCFRRFVLGGAVTTIW

SEQ ID NO: 161742 - protein, 91 aa, Triticum aestivum
  unsure (1)..(91): unsure at all Xaa locations
  Clone ID: PAT_TA_56160.pep
GILPNAGISHPSRADAVATQNSLERXSKNDPTFSGAREPRPLADLAAPMDDGDAAKFTEANKEFGGMTRLDXWKTTLLLRAKNELNKQKNN

SEQ ID NO: 161743 - protein, 36 aa, Triticum aestivum
  Clone ID: PAT_TA_56161.pep
CDCLVCDNKKSQELHNAMVAYFLLSHTRSACLFAIQ

SEQ ID NO: 161744 - protein, 95 aa, Triticum aestivum
  Clone ID: PAT_TA_56162.pep
FSIQTATLLLFQNHKQHNTYKGSDIVPMPASKHEPSKNPNCPGRGKLGDRLAALGDSELGELPAEDKRGLRSGSPGTGWPTSRLCSPTGANHAGA

SEQ ID NO: 161745 - protein, 149 aa, Triticum aestivum
  Clone ID: PAT_TA_56163.pep
IHSVYRSPDASGQAVASTPCSFARSAGWFAVRSTSARTAPRHSPSCRRLASRCRRYKFTSPFSTHQLSSYSSVRFVWEIVLVITLQDPKMCLGMVMSLLEKRNTLTCRVFGWLDLSARRPAFSAGSTCFLSPSFIHGRYCLVSKRRADL

SEQ ID NO: 161746 - protein, 82 aa, Triticum aestivum
  Clone ID: PAT_TA_56164.pep
SRNANVHTHLLSAPAPLSFCGINQSTVVPFCFVLSLRQILLPGCAELVMCTHWRDESRGSGCAELVMCTHWLDESRAGFLVG

SEQ ID NO: 161747 - protein, 41 aa, Triticum aestivum
  Clone ID: PAT_TA_56165.pep
GTCTIHCRYMVYALFSQHAETADQKRGTPNRRVFRRLCSLQ

SEQ ID NO: 161748 - protein, 67 aa, Triticum aestivum
  Clone ID: PAT_TA_56166.pep
PGGWHTWISPCKVQIPILLTYVCFTIVSIDLDFKLVRAYMLLWLVWCWSLLKSASLFRMVHAPFRRP

SEQ ID NO: 161749 - protein, 100 aa, Triticum aestivum
  Clone ID: PAT_TA_56167.pep
RSPFRPTEKQVSCMKNTWHHIFNWFNRTYAYMRLTGDAAFSYKKRSDSKYLPVKRNHLICCRRPYVFFPHIIKLSIHRTQLLIAVHDLWFCICLFYIMII

SEQ ID NO: 161750 - protein, 54 aa, Triticum aestivum
  Clone ID: PAT_TA_56168.pep
YAHYYQPWSAHGFGNTADPAWGPSTDPDLVYKRMWYGQLQAFWVYPSMFYSDGQ

SEQ ID NO: 161751 - protein, 158 aa, Triticum aestivum
  unsure (1)..(158): unsure at all Xaa locations
  Clone ID: PAT_TA_56169.pep
MQTPKLAILLALXNLSQAQNSPQDYLSPHNAARAAVGVGAVSWSTKLQGFAQSYANQRINDCKLQHSGGPYGENIFWGSAGADWKAADAVNAWVGKKKDYDYGSNTCAAGKVCGHYTQVVWRASTSIGCARVVCNNNLGVFITCNYEPRGNIIGQKPY

SEQ ID NO: 161752 - protein, 117 aa, Triticum aestivum
  Clone ID: PAT_TA_56170.pep
RAAHVRSGYLPIRRAHPPTTNTECAVKRVARHAKVDVRQSVAQGPAEPHPAISSGAAHGWKLYRTGVPRALRAALTMKSTTHGQSEHSLLLFRGCLGVHLVLNYGVQGPVGCMTLLI

SEQ ID NO: 161753 - protein, 217 aa, Triticum aestivum
  unsure (1)..(217): unsure at all Xaa locations
  Clone ID: PAT_TA_56171.pep
HADIFEFLDLRKXHGKEENRARDLFFALWVPDLFMQRVQNNEDWSLFCPNEAPGLADCWGEKFEELYKKYEKAGKAKKVIPAQTLWFDILKAQIETGTPYMLYKDSCNRKSNQQNLGTIKSSNLCTEIIEFTSPEETAVCNLASIALPRFVREKGVPIESHPSKLAGSNGPKNRYFDFDKLGEVTSTVTFNLNKIIDMNYYPVETARRSNMRHRPIG

SEQ ID NO: 161754 - protein, 63 aa, Triticum aestivum
  Clone ID: PAT_TA_56172.pep
VNYRTRPHEWRTSSHSACAACLRKEVTGMTHQSIMQISCIRAEVTTIRKSQASHPLLQPGSPP

SEQ ID NO: 161755 - protein, 147 aa, Triticum aestivum
  Clone ID: PAT_TA_56173.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEATKSPKKKTTTKSPKKKVAAKE

SEQ ID NO: 161756 - protein, 205 aa, Triticum aestivum
  unsure (1)..(205): unsure at all Xaa locations
  Clone ID: PAT_TA_56174.pep
XKARQTAGPESTCLEGRSYSSRHQGTQSQSCRDHVMNSSLVTSDGSSNPVLEPTSTSEDSSLFSSSDVGSSGNLSSDNTDSTKNPGSSDQMHPVSTVVMPEEHSRQMSSLNPSSSTQYADQAEVDRLHQLKHQASKGVWDEGCETPSFFYVDQGKYPGSISSSDSSSRSRRSINSSSSCNLTGQRNCRMVGEIDHGPGEGQGHXK

SEQ ID NO: 161757 - protein, 129 aa, Triticum aestivum
  Clone ID: PAT_TA_56175.pep
SEVSARRRSSMATDSTPAIARTRTVSLSASATIRAAEANSSHTVAKDSTARSVSSGGNRQPRTSSRGWASYSGDVAPVELLCVHRRRWPGALSPLCRIVTNAEGQWILTSLSVSLDDPGPSQDHQPIMQ

SEQ ID NO: 161758 - protein, 215 aa, Triticum aestivum
  unsure (1)..(215): unsure at all Xaa locations
  Clone ID: PAT_TA_56176.pep
KNSRNAKFMQYHHDEYYQNNKHHNSSAHIDNIQQSVSFTAAPCETGYGILPVKRKLHAGLGSMSRKDLLGIAISKGRRLKHDQFMISDRKLYAVEMHNSPKETVREAIYSFSDMRDSNTISNIHDERRHEHMNIQPKDTASIRLNDRKRKFKLQGNEIRRVESDNEGCLPADKNLHSSKHKDVHQKAQKVKLNRSYYQSVCQGLEKTTXXRRQTT

SEQ ID NO: 161759 - protein, 59 aa, Triticum aestivum
  Clone ID: PAT_TA_56177.pep
LEFQSKAKLTKYNAGMNKKRMLNAQKNSHLETPNSYRDQSELEMINTIGIGITITSPRG

SEQ ID NO: 161760 - protein, 219 aa, Triticum aestivum
  unsure (1)..(219): unsure at all Xaa locations
  Clone ID: PAT_TA_56178.pep
HGRAVGDIASASFTATAADDTQLLDDFKAALLNQASLDSWTARDGACRFPXAVCRAGRLTYVXSLSLSDVLLNTDFRAVASTLLQLCGVERLSLRRANVSXCSGGRCGSKVELLDLSVNSVLRGSFADVTVLAGSCGGLKTLNLSGDAVCVAKDADGGGQGFCGXLDALDLSRNKITRDDDLRWMVGASLCLSGXLDLAWNKTSGSLSDFTNCYGMQYL

SEQ ID NO: 161761 - protein, 95 aa, Triticum aestivum
  unsure (1)..(95): unsure at all Xaa locations
  Clone ID: PAT_TA_56179.pep
RATSTGSRCNVSHTAASSQLRAWHGFASWSGHPCYHDIRCTVLDRHWYHCXCRLGSWSRMDLEYGRYHVSSPSGLFWKQRNQEWWIGVGGRSAAL

SEQ ID NO: 161762 - protein, 171 aa, Triticum aestivum
  Clone ID: PAT_TA_56180.pep
HRALFSVYTWCNWKQMLLRCAPAICLQRRTYTMYSQPSQLQGGLSQSMALWKHSRSHAVSYQTKMGLVSLSPKSTTSSHLQNGTCFACLEQQSKHGLSARDRILHAKLDMASHHGFSSISWKSRTTRSLAQKIGGTGAGLSLSFTVAGIANAGGPVDNDIDSKSSSSCAHG

SEQ ID NO: 161763 - protein, 135 aa, Triticum aestivum
  unsure (1)..(135): unsure at all Xaa locations
  Clone ID: PAT_TA_56181.pep
XAAEXYKICSILGTPNQHTWAGGLQLAASIHFQFPQSRCISLSEVVPTASEDALNLISWLCSWDPRKRPTAVEVLQHPFFQPCFYVPPSLRFRSTGYATTPPSVGAKGAMDQKNARRYPVGTXTNGRPAVNNSYL

SEQ ID NO: 161764 - protein, 204 aa, Triticum aestivum
  unsure (1)..(204): unsure at all Xaa locations
  Clone ID: PAT_TA_56182.pep
QVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKXGDAGIV

SEQ ID NO: 161765 - protein, 92 aa, Triticum aestivum
  Clone ID: PAT_TA_56183.pep
VRTEGEFAAGHPAGPVNIPYMHSKGSGMAKNSGFLEQVSPIFRREDEIIIGCQSGRRSLMAAAELCSPGFSGVTDIAGGFSAWKENGLPINQ

SEQ ID NO: 161766 - protein, 83 aa, Triticum aestivum
  unsure (1)..(83): unsure at all Xaa locations
  Clone ID: PAT_TA_56184.pep
SXQTPXXYIIILKSKLNPQFSNISGGTTILPSHFLQXKSXXXHQTXIXLMSTTYIXXXKHXHFXIRPXHXYPXSXXPXXFLLL

SEQ ID NO: 161767 - protein, 78 aa, Triticum aestivum
  Clone ID: PAT_TA_56185.pep
ALAVPMEGDVSLVRLAGDGHELLGQPDVRLPLGTLLLGHTQVRWDHPIHFAAEQDAPPFTCLARHEEVERTALSQHVP

SEQ ID NO: 161768 - protein, 130 aa, Triticum aestivum
  unsure (1)..(130): unsure at all Xaa locations
  Clone ID: PAT_TA_56186.pep
NPKAQREYFEPLQKSGGKNRPGSPTPEKKPPNLSPGVKTSLAPGNRSNKKTCKEDGGPTPTMRGNPGPIAPRGPLKGLAGGPNGKGGPGGPPNPGGGGHPQEPPHAQGPLGXPGFCGPQAPTFPGQKPCG

SEQ ID NO: 161769 - protein, 61 aa, Triticum aestivum
  unsure (1)..(61): unsure at all Xaa locations
  Clone ID: PAT_TA_56187.pep
YIHKXLXSIYXPNHXXXIHTXXHXXXLXLIXHTHXTMMDXXTQXKQQLIHHQFSLXXXYTH

SEQ ID NO: 161770 - protein, 61 aa, Triticum aestivum
  Clone ID: PAT_TA_56188.pep
GDEHRRGAIGWNPAGSLRLSVAQVWLPCVASGEDTVRYIILSVWPLIQGSAQGDVSSRTHE

SEQ ID NO: 161771 - protein, 87 aa, Triticum aestivum
  Clone ID: PAT_TA_56189.pep
VFWVFFFFFFFFFFFFFFFFFFFFFFFFFFFFFFFFKNHPPPPIFPKNNKKERREKKGLNFFLAKKAPPPPQKKKKKRGPKKKTPIC

SEQ ID NO: 161772 - protein, 98 aa, Triticum aestivum
  Clone ID: PAT_TA_56190.pep
KKDRKTERKKKKKKRKKTKKTKGGGKKKKKKKKNRKDKGRGKSKNGERKKEEKKENNKKNKKKEKKKKRKKKEKNKRRRSGQHLWQAKVPPKQPKLKM

SEQ ID NO: 161773 - protein, 101 aa, Triticum aestivum
  Clone ID: PAT_TA_56191.pep
VILAIYHLKHYTHIWLRKCSGLGLMTQLLTFGRQKEWRVYLLIFKHSKGLYSILLLDNFTNIYSLKLEAVSRVLCKRRLPFLFLWHLQGLPLLQSWSYKPN

SEQ ID NO: 161774 - protein, 99 aa, Triticum aestivum
  unsure (1)..(99): unsure at all Xaa locations
  Clone ID: PAT_TA_56192.pep
LMGPVKGSRFPGGPLGEIVAPLSPGGSFAPFGLAEAPGAFPELKVKEIKTGPLPMFSMFGFFVQAIVPGKGPLXTLVAPIAAPVNNKAWAFPPPFVPAK

SEQ ID NO: 161775 - protein, 82 aa, Triticum aestivum
  Clone ID: PAT_TA_56193.pep
FDTYVSQIRKPHVWGGEPELLMASHVLQMPITVYMHEEAAGGLIAIAEYGQEYGKEDPIQVLYHGCGHYEALHIPGNAEPRY

SEQ ID NO: 161776 - protein, 84 aa, Triticum aestivum
  Clone ID: PAT_TA_56194.pep
KGLLLPAIKIALRGFPKKAPLFRAMGEPIFKPQWGTRSWGKKLVVPKKRAPLNAFAGFRVLLAKIKRGGAFRQGLAKPKKGVAA

SEQ ID NO: 161777 - protein, 64 aa, Triticum aestivum
  Clone ID: PAT_TA_56195.pep
PCHVRTAVSEPVKKCTDTLAPDHAQVTAAGVVTADHAGTAGPSESHLEVESVERTRSPLLCHRH

SEQ ID NO: 161778 - protein, 95 aa, Triticum aestivum
  Clone ID: PAT_TA_56196.pep
AATDCWQGGGPGTRPRARALALALSSTRAGVSWTRAPPSVLCSRWCATTRRRCCSATATDAAAVHAAQRAMTDRLRQAHGACVSRWPGTCELASD

SEQ ID NO: 161779 - protein, 133 aa, Triticum aestivum
  Clone ID: PAT_TA_56197.pep
TSEFLGLGLLVFGSGAGKEEEDQGKERKMRSSGDGGNAGEGLLAVGSILGGGGDHSRGYEGRVDDIEEEEELKAAEKKDNSRVSDFHLAEINFCFHGTCFQALGACGRLDGWHQQAPAGLGTAVGGYMVGGAH

SEQ ID NO: 161780 - protein, 104 aa, Triticum aestivum
  Clone ID: PAT_TA_56198.pep
RPRYSPGAPHASAVAWASKRPILPRTLAPRCPLLTPIGAARTAAPMAKTRPAHKDPISPTPSRGPTKIMHAWGLCATVDQLVHKTHHMWHKVPTLEASGVLRLK

SEQ ID NO: 161781 - protein, 72 aa, Triticum aestivum
  Clone ID: PAT_TA_56199.pep
SGHGHGVLAASDAVRPCYTGSCAELRPKEVNDTTTVGHDMGGVIMATRSLTTGRTGVLEPHMSYATAKPLFW

SEQ ID NO: 161782 - protein, 105 aa, Triticum aestivum
  Clone ID: PAT_TA_56200.pep
HIVSEGHFETIAVHAAPAVVVEPRGRGTEDWGSEHGGARRWGTRRSPRGGGRTSRPYGALDGRRNSQSKRENPTVATIRRQISAGSLRREVGIPRAGARPGNGGP

SEQ ID NO: 161783 - protein, 163 aa, Triticum aestivum
  unsure (1)..(163): unsure at all Xaa locations
  Clone ID: PAT_TA_56201.pep
MAAHRFHQFQLVGGALSTPGDEQRSICRMKLWSTIEVRAKSKFWYFLRKLMKVKKDNGHILAIYEIFEKNPTSINNYCIWLRYQSRTGCHHMYKEYRDTTLNCGVXHMYTEMASRYLMRAPCIHIIRTATVDLKLCKRDNTNHVHNSKIKXPVMYQNVRPPTR

SEQ ID NO: 161784 - protein, 105 aa, Triticum aestivum
  Clone ID: PAT_TA_56202.pep
TRNQQQLLSYNIKSLQWLTCLSSPNRSHTLEKTTGDQAQGHNGHGVFNVLVRRYRPAKPEMETFRALLIAGSGNASPLSSPCCATRTRILLRTLKLPECPSTASA

SEQ ID NO: 161785 - protein, 118 aa, Triticum aestivum
  Clone ID: PAT_TA_56203.pep
RWSSISVFLAAAASSSASHAQDAQLQCTFHVIERVRSALGGAFLTGGVRNRICWRCSMIYAPTMAARHTNLQRGTHQQDAWIVSRAGYMLACVYFDLNDIIYPAEYHRLTVKNLAVHD

SEQ ID NO: 161786 - protein, 122 aa, Triticum aestivum
  Clone ID: PAT_TA_56204.pep
RWPRRWPLVSSRKLPSWPALGRSSPADISPSPTPWAPPSSTHSATCSCCAAIHASRRTSRTAPSESGSCTAPHSRRPWRRWLCCSRAVAAGSALPLPTSRSRSPSSATVCWPASRPSPPTQD

SEQ ID NO: 161787 - protein, 61 aa, Triticum aestivum
  Clone ID: PAT_TA_56205.pep
STSLSQSDLVCIILTNYEPCRSGRLYQLHVKPPATAYRRIRRPLLTAIVHGPHSHAEPGAV

SEQ ID NO: 161788 - protein, 217 aa, Triticum aestivum
  Clone ID: PAT_TA_56206.pep
GKQKLGGRTKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGGRLLACISSRPGQCGRADGYILEGKELEFYMRKLQKKKARVPQLLKSCCMLL

SEQ ID NO: 161789 - protein, 144 aa, Triticum aestivum
  unsure (1)..(144): unsure at all Xaa locations
  Clone ID: PAT_TA_56207.pep
YTSTYYTPESETTDTXILAAFRVSPQPAVPPEQAGAAVAAQSSTGTWTTVRTDGLTSLDRYKGRCYHIQPVAGEDSQWICYVSYPLDLFEEGSVTNMSTSIVRNVFGFKALRALRLXDPLISLTYYKTVLEHAYLTQLDRDLVT

SEQ ID NO: 161790 - protein, 167 aa, Triticum aestivum
  unsure (1)..(167): unsure at all Xaa locations
  Clone ID: PAT_TA_56208.pep
MPGGRSSGSSHAGHRRYTPDVARAPSAPPFWQDRHVVSRATTAALGLRGGGSCDLTHAPVNADGVICSNIQMHPAXYKTIISSFIIVLNAQGTXGCFRRWAPLLLGCSASGALPVRLVPRCSRTRTPTWTARETPSXKTLIYLSGSATVEAVADDRLCPRGAAKGEV

SEQ ID NO: 161791 - protein, 129 aa, Triticum aestivum
  Clone ID: PAT_TA_56209.pep
MAAGDVWVFKNGVMELEQEAASRKALVYMPANETMRSLEALERLLGSLGWERYYEDRAIVHLHKRGGVDLISIPRDFCRLRSIHMYDVVIKNRDHFKVVRPLLSHFDRVYSSYASRIITSFRATNICIP

SEQ ID NO: 161792 - protein, 95 aa, Triticum aestivum
  unsure (1)..(95): unsure at all Xaa locations
  Clone ID: PAT_TA_56210.pep
ENFAYNMRXTIQDEKIASNLHAEVKKKIEDAVDSAIQWFDANHLGEVAEFEYKMKEVEVLCNPIIPKMYQGADAHMPVGMHXDAPVASGGAGPKI

SEQ ID NO: 161793 - protein, 88 aa, Triticum aestivum
  unsure (1)..(88): unsure at all Xaa locations
  Clone ID: PAT_TA_56211.pep
LIEKDRASGLFFTKEWVSLQGVXPVVSSGIHVRHIAARTVFFWAYCVSLVGVATLGLPWGDAPGAGPLSRGFSRPVCRLCASGPGVAM

SEQ ID NO: 161794 - protein, 90 aa, Triticum aestivum
  Clone ID: PAT_TA_56212.pep
YVLVNEPEGGVGSTPATATGYCAGSFAHTPHMVRPEEMRKGPVKTVARFGVCDLMDDIGADDDQTVVVSLVPRCGGELVTVGGVSISYLK

SEQ ID NO: 161795 - protein, 60 aa, Triticum aestivum
  Clone ID: PAT_TA_56213.pep
VIDALMEMKEYNCLGDRSTVYELWNYRADRKATLTECTEYMADRVQELTVVKRRRSRRMI

SEQ ID NO: 161796 - protein, 53 aa, Triticum aestivum
  Clone ID: PAT_TA_56214.pep
MGVKLDLSNNPVGIGVRSRRYALMSEDGVVKVFNLKEAGAFTSRWSEDMLKAF

SEQ ID NO: 161797 - protein, 77 aa, Triticum aestivum
  Clone ID: PAT_TA_56215.pep
MMCHASFCAPNRLLRTNKISCICLYCGVSIDGRIAAALLSTNQFHFLSESCSCFFLLAVSVLEYRVLPGGSCNQCAI

SEQ ID NO: 161798 - protein, 146 aa, Triticum aestivum
  Clone ID: PAT_TA_56216.pep
GEKDVGLPVLLDTGIAAWYMPDKIFAATYYGLGGRGEVSGGTRHVAVDCAYRDPSYTKGYVTVEFGTAGKVSVPLSSLVSQFHDGTCGSFIAPRGDIVSTMGDPFLRGVYSIFDQENFTVTLGQVKHTDEEDIVAIPKGGFKASSK

SEQ ID NO: 161799 - protein, 102 aa, Triticum aestivum
  Clone ID: PAT_TA_56217.pep
HLNLFCKEPNPAQKGIYPGHQRLHQPQKRPRRIPKKHRGGGPPARPGHTGSNPINNPRGGPPRVQIKPRAPVKTIPDTRGSLDPPVGPSIPGTELASRPKTA

SEQ ID NO: 161800 - protein, 84 aa, Triticum aestivum
  Clone ID: PAT_TA_56218.pep
SLPVLLEGLKPCSQRTNISNGRNSPAAIVVKIIFQMEQYCFDCSDQNRNDDVLTVVSSGESVISILHNNTLLVPFYISSATLFE

SEQ ID NO: 161801 - protein, 84 aa, Triticum aestivum
  Clone ID: PAT_TA_56219.pep
KTTGDQAQGHNGHGVFKVLIRRDKPTKPKMETFRALLIAGSGNPSPLSNSAPRPHKPCGWTPPCSPWTFWLLQRSQENSGSGPP

SEQ ID NO: 161802 - protein, 60 aa, Triticum aestivum
  Clone ID: PAT_TA_56220.pep
TESNTYILDNQTSAKPWGMMNYWDRTMYFWQQQERRLSEAAISLLFLAVFNWGPGNSSGK

SEQ ID NO: 161803 - protein, 87 aa, Triticum aestivum
  Clone ID: PAT_TA_56221.pep
GPNYTFSSPPCTLRFPCSSVSPTPILKSDIPLLQQGSIRLQMIHTLQICEERHNSPAYPNALSAETLSDMNHGELSITADIPHDFIF

SEQ ID NO: 161804 - protein, 73 aa, Triticum aestivum
  Clone ID: PAT_TA_56222.pep
VVGCRSACAAFGSAEYCCTGQFGGPQQCKPTTYSRLFKRACPKAYSYAYDDKTSILTCAAGTSYVVTFCPHRR

SEQ ID NO: 161805 - protein, 63 aa, Triticum aestivum
  Clone ID: PAT_TA_56223.pep
TISATSIIPNLGMWGGSCKEKGPILHQSKLHICSLFINTTNSILAYLDHTNNRLIQHQIKGHY

SEQ ID NO: 161806 - protein, 118 aa, Triticum aestivum
  unsure (1)..(118): unsure at all Xaa locations
  Clone ID: PAT_TA_56224.pep
VFPQSVDIVDLVVDVVEAFRRQQEKTKRAAPVRLYRTCSQDSAYVTCEVAQKPSAAKRWRSAQVHDLSQRRSRDRINHKMRALQELVPRFNKTPKASMLDXRCXYLKSLQLQLQVMWP

SEQ ID NO: 161807 - protein, 163 aa, Triticum aestivum
  Clone ID: PAT_TA_56225.pep
CCIVAPAASQLRRRRVRCVAAPAAAAAASQLRRPCCIAAPAALLYRSSGGDVHLQRSSDELVVPQLEWRRGRCMATAASMLMGVLGASLLGAAWRDKMNGYYMHNRTVIKAAYIWMLWAGLRLASVLIFLWLRPWNGSDGGTADLWFLFSLLVKPSTGFCSVC

SEQ ID NO: 161808 - protein, 128 aa, Triticum aestivum
  Clone ID: PAT_TA_56226.pep
QSQPNHQAVSDKRAPKIHLVYTMSAGTAAHLDTNVTWTFTISTSRSMALYPHSIMPSISHLPPLSLLVLLDREKPLPFPRHWPSGSWISKGSKGSQLRDGANGDNNHGCLFQWNLSSAAARESRGVAG

SEQ ID NO: 161809 - protein, 177 aa, Triticum aestivum
  unsure (1)..(177): unsure at all Xaa locations
  Clone ID: PAT_TA_56227.pep
MAGRDRDPLVVGRVVGDVLDPFVRTTNLRVTFGNRTVSNGCELKPSMVAQQPRVEVGGNEMRTFYTLVMVDPDAPSPSDPNLREYLHWLVTDIPGTTGASFGQEVMCYESPRPXMGIHRFVLVLFQQLGRQTVYAPGWRQNFNTRDFAELYNLGPPVAAVYFNCQREAGSGGRRMYN

SEQ ID NO: 161810 - protein, 206 aa, Triticum aestivum
  Clone ID: PAT_TA_56228.pep
AAWAAAWVAVCWKNTSSHTSTWTGACLLSHPAFLRAAIEEQHQVAKKYKDGPEYNAFLEMDTLHNCIKEALRKNPATPLLVRRVHKRFTVQTKEGQQYDIPQDYIVATPTIVNNYIPYIYTDPQVYDPNRFGPERREDKVGGKFSYTSFGGGRHVCTGEAYAYMQLKVIWSHLLRNFDLELVSPFPNTDWSKFLPDPKGKLLVRYT

SEQ ID NO: 161811 - protein, 112 aa, Triticum aestivum
  Clone ID: PAT_TA_56229.pep
MADVEYRCFVGGLAWATDDQSLQNAFSKSGDVIDSKIITDRETGRSRGFGFVTFASDEAMRQAIDAMNGQDLDGLLITVYEAQSRRSGGGGGGFCGGCGGGFCCQRREGGCC

SEQ ID NO: 161812 - protein, 135 aa, Triticum aestivum
  unsure (1)..(135): unsure at all Xaa locations
  Clone ID: PAT_TA_56230.pep
DTRGWRPHCELRKRALYFASGVRGAEHNPLCLALVLKXRDLLMNQNVQTNTEALPFVTKVLLCLLGATLIRLDKTLMVMGLDSVLLMYGTYYDRIQKTWLKHDVINTLSVHPLGVKDYVLAEVRKLQLALSTIPN

SEQ ID NO: 161813 - protein, 61 aa, Triticum aestivum
  unsure (1)..(61): unsure at all Xaa locations
  Clone ID: PAT_TA_56231.pep
XRGRXAVFYLAGAVFFLLAWCAATPRAGTVRWSFFPRVVPCARGLRCDYHSRRXYMCVDKL

SEQ ID NO: 161814 - protein, 93 aa, Triticum aestivum
  Clone ID: PAT_TA_56232.pep
GLALGIFPYVYFELILSSFLLAPSCSAFMLDSGPCTDQEQKTAYEWFEWRYKQIVVFWLIGWMTTFTFYLAQNNRFPGFPLCFFLANAIGSSL

SEQ ID NO: 161815 - protein, 139 aa, Triticum aestivum
  Clone ID: PAT_TA_56233.pep
EGNSRPHPARPTHPRTHLQRAAAPCPAAARHRPMPRRRAPPPHGPPPRAAAPSRLLLPDPTRPPSPWRGASTSRRPIPPSRAVCPPPPMRPAAPTLPFLASGWETSSRCLNPIPPARLTAVVVLSRHATANKHMGTCCP

SEQ ID NO: 161816 - protein, 181 aa, Triticum aestivum
  Clone ID: PAT_TA_56234.pep
MKRCIVPSILLMLSLEAALLIADRPSVDDEVGTILLPSQGQVADQQAAMAAPRPWKCCDRPRCTRSIPPICTCVDEAFECASTCKACVPSTRNPSLQVCQDQYVGDPGPICRPWECCDSAACTKTDPPTCRCGDEVEQCAPTCKSCEASTSNPSLNVCKDAFTGAIPPTCTPPEALAAGGN

SEQ ID NO: 161817 - protein, 115 aa, Triticum aestivum
  Clone ID: PAT_TA_56235.pep
RPPDGGPNANEWYLFSSRDRYYPNRSRTNRAAATGSWKGTGTHMPLETPRPVDVKMALVLYLTELTQGVLTNWIMFYYRLDDLVLFYDYLPMCNIALKVSTWPHVYLPICCDARL

SEQ ID NO: 161818 - protein, 178 aa, Triticum aestivum
  Clone ID: PAT_TA_56236.pep
TCVASLAATMGGAYAATSGGKVPGRSTTGRSNTARPTCTVDRPVGTRHHGRCPPSRPPTRNTMAVALQLLRSPPTLQLRRRRAAARPLSCSSAAHRRSSPRSCLSAPSRPCRNCGGLCCVRKIDFGAPVTGMGRTLAWSSRHVVAHRALCPSPGRPWTPSIRSTGMQGCNAFKALASS

SEQ ID NO: 161819 - protein, 139 aa, Triticum aestivum
  Clone ID: PAT_TA_56237.pep
QTRGKTGGVRINATESGLGSRQHGTGYASAVRTGALYAPTLVAEPGQPGDLAGQRQEEGGKLSRRRATRPRNFKCRADKHTHTHTHTLRHEHKHSSPMDTEPQPTCVPARSEGQDGRAALRRRYSLTRHSHRCTSSTYY

SEQ ID NO: 161820 - protein, 108 aa, Triticum aestivum
  Clone ID: PAT_TA_56238.pep
PIDKATLVYCDNVSAVYLSANPIHHRRTKHVELDILFVRERVALGEFWVLHIPTRQQLADIMMKGLPSEVFSDFRSSLFVAATDVTTAWGVLARVVMESVFLYCIRLR

SEQ ID NO: 161821 - protein, 89 aa, Triticum aestivum
  Clone ID: PAT_TA_56239.pep
GGKPNWGYVGLGGFLWHYPFIRLGWATLVFGQFFCMAQGFWGNPRVGPVSFLAFVGGDLFMVVFWPGGRVRVFWLPLLGGQFEMKGFFP

SEQ ID NO: 161822 - protein, 79 aa, Triticum aestivum
  Clone ID: PAT_TA_56240.pep
GGSLVLQEMITVFKALHVQCGKLTVYVNRGRSPLSVRKHPKNKDLGLTRLDSRARACSRSDYIAPPSMVSVPAVMSVVV

SEQ ID NO: 161823 - protein, 53 aa, Triticum aestivum
  Clone ID: PAT_TA_56241.pep
IRGLGDSLFEKNLGQFFPLLAGFITCEHGSGKVQVPLSYMFSPWVGPIVLQSC

SEQ ID NO: 161824 - protein, 50 aa, Triticum aestivum
  Clone ID: PAT_TA_56242.pep
KHTIYWIIIHYTRILRWIAPLFTSPTRRCLSQHHWYRIYKVFIGACWGII

SEQ ID NO: 161825 - protein, 142 aa, Triticum aestivum
  Clone ID: PAT_TA_56243.pep
RPGVGPLCLFFRSPQPAPVRWARFKKFWWKWAFYFWWAQKEGLVGGPFFFWAPVGFFVLFPNCPCFFFFFFTCKTDAAPFFLKMAGKGSPASHQPIYFFFLRFFFSSSSFCPKKKKKKKKKKKKKKKKKKKKKKKKKKNKTT

SEQ ID NO: 161826 - protein, 37 aa, Triticum aestivum
  Clone ID: PAT_TA_56244.pep
IESQLKSIAEAFSTCTCAYTLDIYTCKTVLTPQLHAC

SEQ ID NO: 161827 - protein, 130 aa, Triticum aestivum
  unsure (1)..(130): unsure at all Xaa locations
  Clone ID: PAT_TA_56245.pep
DCQVMGYHIPKGTSVIINALAVGKDPTHWGKDAAEFRPHRFEEMSVEYFKQGPQMEFIPFGAGRRQCLAALFASTTXELVLANLLYYFDWAIPGGAGPETLDMGHLFGIVVQNRSSLRLQAVASCHPQEH

SEQ ID NO: 161828 - protein, 87 aa, Triticum aestivum
  Clone ID: PAT_TA_56246.pep
QKSRVAFAKITFKKPHIILLDEPSNHLDLDAVEALIQGLLIFQGGVLMVSHDEHLITGSVDELWAVTDGKVAPFPGTFKEYKKMLTT

SEQ ID NO: 161829 - protein, 104 aa, Triticum aestivum
  unsure (1)..(104): unsure at all Xaa locations
  Clone ID: PAT_TA_56247.pep
HEARNKLDLCNVTILYYLLLLPCGYHAIRRAMVPDLIISGIYVLYFLCFLDVYALDGNDRRTSVLXDMSSTRRPDLLSLSGSSYLYVHVNITPRSMMSQRKMAS

SEQ ID NO: 161830 - protein, 78 aa, Triticum aestivum
  Clone ID: PAT_TA_56248.pep
LDTNQTRRGNKGSSPLKPSYVHMSNMFPLSNEGGGRTELDIHTHANQLRRLHYFATHGNRSTSSFLQSTMVPDLLPWV

SEQ ID NO: 161831 - protein, 78 aa, Triticum aestivum
  Clone ID: PAT_TA_56249.pep
NFTRRMPDHACSPCPIGGQRARAACHMVQRSWLEPSDPNAIQNLTRITPGLYVRLGKLCIRTPIDRSKGIRFVQVNPH

SEQ ID NO: 161832 - protein, 133 aa, Triticum aestivum
  Clone ID: PAT_TA_56250.pep
QTGTKRGPLTMGIVVIPTPRGPPQLRAVPTSTGAPPGVHEGLNLGGGPRNQEGNTAVFKDGGPARPPVGGTSPRPLPKGDKIAWLWRGAPDKDTEGFGGRLLWDTRVGTLIAGLVEGQGPENHLPRTIRALAG

SEQ ID NO: 161833 - protein, 56 aa, Triticum aestivum
  Clone ID: PAT_TA_56251.pep
LVAGSSNLALWGSSLQERFIHYLPFMHCWNCQDIVSPYMIHSSYAHEKRWHTIWIE

SEQ ID NO: 161834 - protein, 59 aa, Triticum aestivum
  Clone ID: PAT_TA_56252.pep
DAFVIGGSEDGFVFFWELVDAPIVATFRAHSSVVTSVSYHPTKTCMLTSSVDGTIRVWT

SEQ ID NO: 161835 - protein, 168 aa, Triticum aestivum; identical to SEQ ID NO: 124110
  Clone ID: PAT_TA_56253.pep

SEQ ID NO: 161836 - protein, 84 aa, Triticum aestivum
  Clone ID: PAT_TA_56254.pep
KLTGSVIPLALSIFILDRIFVPKSVHGYRSQCFATKNVHQLQLYMSSGSLHQFAQRPELDPYHSIRAQAISIVVRLGLGQFTAT

SEQ ID NO: 161837 - protein, 189 aa, Triticum aestivum
  unsure (1)..(189): unsure at all Xaa locations
  Clone ID: PAT_TA_56255.pep
MGDNLMEKVTALSEQLKITGTEVGKKMTAGMSSMSFKMRELFLGQTPADKIVEDATSETLEGPDWAMNLEICDLINAGKVNSVDLVRGVKKRLVLKDARVQFLTLSLLETVTKNCEKVFSEVAAERVLDEMVRLVDDPLTVVNNRNKALMLIEAWGESGEELRYLPVYEETYKSLKXRRVRFPGRDMRA

SEQ ID NO: 161838 - protein, 134 aa, Triticum aestivum
  unsure (1)..(134): unsure at all Xaa locations
  Clone ID: PAT_TA_56256.pep
MVQARSHLRVPGPLNIHDHVMRAMSRXTRYYRSTDSPALTNTLLYDENKILKTTPAPTYLLHSTETGAWESALTNTLSMGEPHHELLTAAQSALLRIDXQLSLCFMTYDAESDWGYCAYLMDLACKLRNDSKNT

SEQ ID NO: 161839 - protein, 118 aa, Triticum aestivum
  Clone ID: PAT_TA_56257.pep
NISSFIISRACHAKVSSASECISSGLWTIVCVCKRAISPALGLPSPCWPVPCHWSLQTLRGRGANVTMAARTVVVRWIGPRGAVQVAAEMESRTVLCRPPPATAPHRRAWSCPESTVV

SEQ ID NO: 161840 - protein, 133 aa, Triticum aestivum
  unsure (1)..(133): unsure at all Xaa locations
  Clone ID: PAT_TA_56258.pep
DAYACLSQRGTRGSVVEKYRSSWGXAGRDTRNCVHNTGTKNLYIIWGKXIKGRINRLPTACTXNIAMGTIXKRKPTLRKMVMPRSIILQMMTWTTSDVALMYXKYTGGMISKSKGDIKXTAITGPTGHDHANL

SEQ ID NO: 161841 - protein, 59 aa, Triticum aestivum
  Clone ID: PAT_TA_56259.pep
AWPRGRITYQDTYPSYAELRGVNRVNHHLRICGSGSAKHVRRNWSQNYHVRNGAIICLK

SEQ ID NO: 161842 - protein, 210 aa, Triticum aestivum
  unsure (1)..(210): unsure at all Xaa locations
  Clone ID: PAT_TA_56260.pep
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMIGDGQSRFTIDGKPIFHFVGTSTFSEYTVIHVGCLAKIDPEAPLDKVCLLSCGISTGLGATLNVAKPKKGMTVAIFGLGAXCLAA

SEQ ID NO: 161843 - protein, 84 aa, Triticum aestivum
  unsure (1)..(84): unsure at all Xaa locations
  Clone ID: PAT_TA_56261.pep
MVGGGRRGGAADEAKLNTGNVFAALETLKKKKKGDKSKGGSSKGGKQGDDPTPQQQKELFWAPAPLNTKSWXADVEDDDDDDYF

SEQ ID NO: 161844 - protein, 63 aa, Triticum aestivum
  Clone ID: PAT_TA_56262.pep
VGTVYRHMCLFREVGVTSARAHSTFWREKSHLVNVTAIRIIHTVDSIASELHTSIGAMPDHVI

SEQ ID NO: 161845 - protein, 67 aa, Triticum aestivum
  Clone ID: PAT_TA_56263.pep
SLHTSMNYLNYERYLLLTSSTIHMFESLELLIKKKNGCSFSTTQLYLRKQSNYVSHIYGSLNSCTGL

SEQ ID NO: 161846 - protein, 189 aa, Triticum aestivum
  Clone ID: PAT_TA_56264.pep
MAAPTPPPAAAPAPAPAAAPGPTPPAQVVGNAFVQQYYNILHQSPELVFRFYQEASRIGRPATTGADMDTVTTMEAINEKIMSMDIARAEIRGVDAQESLCGGVTVLVTGHLTGKDDVCREFAQSFFLAPQEKGYFVLNDILCYVGQGEADQSLPPPQQQPPAPELDAVVAPAAALANGTVALVESVPR

SEQ ID NO: 161847 - protein, 131 aa, Triticum aestivum
  Clone ID: PAT_TA_56265.pep
SAEKLNIILRAAPAWGSWLAGPSLRRSCCFPLPPDLINLAAFSHAAFRKTPGVPHLTGLVRHPLSSAWPHTDGALTVSSSNWLPPLTCLWSPPSSASLLPNQGGPPPYLTSPLAWPLIPLPYGHFLPFLPT

SEQ ID NO: 161848 - protein, 73 aa, Triticum aestivum
  Clone ID: PAT_TA_56266.pep
LSGSRYLAGDSLSLADLSHFPFMGYFMDTEYASLVVERPHVKVWWEELKARPAAKRVTEFMPPNLGLGKKAQE

SEQ ID NO: 161849 - protein, 70 aa, Triticum aestivum
  unsure (1)..(70): unsure at all Xaa locations
  Clone ID: PAT_TA_56267.pep
QANSSKKYILFPHLNFESYXWFLLSPAFSYPRECCXLYXXASWRPSLALPLKLAHMSFRHSLLHRFFLSS

SEQ ID NO: 161850 - protein, 104 aa, Triticum aestivum
  Clone ID: PAT_TA_56268.pep
DRTHKRSLKTPLDVYRAPASASPDLGRPILIVRCRIAVRIFSPAPCLSEPGGSRLGARRAAAFAGRTSYQHWSVSHVLRRNDGPAAPARRIIIVPAARQAMSLS

SEQ ID NO: 161851 - protein, 59 aa, Triticum aestivum
  Clone ID: PAT_TA_56269.pep
LFCPCRVCCLAPPLFLLLLCVIGCTETVFRVLVVLLSFCPCVLCCLLWCFPLFGEVLIF

SEQ ID NO: 161852 - protein, 128 aa, Triticum aestivum
  Clone ID: PAT_TA_56270.pep
FIQSLHMSHKQLVANPHIIGFHSANRWEENPLIEMMQRRQPTSGSLPLPLKGSYVDLHITVLKLTTMVHTESGSPSILAADGDGPTMKHPGVATGHSWSLIGPCSTADAGGDPKISYRGLMAYHMRIY

SEQ ID NO: 161853 - protein, 59 aa, Triticum aestivum
  Clone ID: PAT_TA_56271.pep
PAKVCGPYPQVFWGKSTPLCWGRLVFPGNRGVFFPSKYNPPGNFNGKAPFVFLPLYPET

SEQ ID NO: 161854 - protein, 131 aa, Triticum aestivum
  Clone ID: PAT_TA_56272.pep
TLHARLQGGVLDSDFTIHLSCIRRLLDASSDTIVMPRAVNMDFSYSAICTVRVCHGYIRDQSASPITGCLTRPLRKDLAQVYYYYVPTRREDLRSPRGEISAIHQPVPMRLPDDPNHRLALVHRPDGIVDP

SEQ ID NO: 161855 - protein, 66 aa, Triticum aestivum
  Clone ID: PAT_TA_56273.pep
KYKHKTILNSYTYHTSTFQTYHTLLSHITTIFIQYTYYTLTLSHPTYFLISLKFFLSNTTYPFPLS

SEQ ID NO: 161856 - protein, 159 aa, Triticum aestivum
  unsure (1)..(159): unsure at all Xaa locations
  Clone ID: PAT_TA_56274.pep
MVWVFSVCKHCLKFYWMSPECMVTPSMQVVVDVCAVPRHPILGGAMHNVINRHTXLGKATRLMVAAWGLNTCSXSRNTSETRSLVVSVXPPYNVSSKIVNHVCHRYSLSXLGLGINKVAGSVFSIGHLXVLSKLQCLGCLNGVKMVLKHIGYAVKLDNG

SEQ ID NO: 161857 - protein, 44 aa, Triticum aestivum
  Clone ID: PAT_TA_56275.pep
TNFYLPHYIYLPQLILYKKVEQYTLHYHTIITSQPFISSSSIPQ

SEQ ID NO: 161858 - protein, 47 aa, Triticum aestivum
  Clone ID: PAT_TA_56276.pep
PLRMVHLYHKDQAIVIHARAGRILRNCVMPIQHMSTSKGITDLPRKN

SEQ ID NO: 161859 - protein, 67 aa, Triticum aestivum
  Clone ID: PAT_TA_56277.pep
TNADKQHLSSMGLDLTKGVIRNNLEHGVIEPAMSKVKIIQFATEAAITIVRIDDMIKLDKEESGQEE

SEQ ID NO: 161860 - protein, 101 aa, Triticum aestivum
  unsure (1)..(101): unsure at all Xaa locations
  Clone ID: PAT_TA_56278.pep
PMSFLKSRALKGTLFGNYNPRIDIXDVVXMYIRKNLQLDKFITRRVPLSHINLALCVMFNWEGLRSVIRMDEYIIERWLFIHPYLLWHDNTDSLHLSKPFI

SEQ ID NO: 161861 - protein, 74 aa, Triticum aestivum
  Clone ID: PAT_TA_56279.pep
MACRPSSSCSCSTPSCSKYRSCASTCSCCMRSASPCIAWISCRSAAPCGASCAGCAGPSWSTFRRAVARCPVSL

SEQ ID NO: 161862 - protein, 60 aa, Triticum aestivum
  Clone ID: PAT_TA_56280.pep
TTEEDKEKVRKLAMVALWCIQWNPRNRPSMTKVVNMLTGRLQSLQMPPKPYVSSENELMP

SEQ ID NO: 161863 - protein, 109 aa, Triticum aestivum
  Clone ID: PAT_TA_56281.pep
LSVPAGRFSLGYFTLWAAIAIAWGTVGSAVIILMPLVESWDTISMVCAGMLTNDIVYQRLDDVNLRLRAIMGAMPEAEKRYQQLQRKDEVEMHPAGTHPADDSDHLLEN

SEQ ID NO: 161864 - protein, 87 aa, Triticum aestivum
  Clone ID: PAT_TA_56282.pep
VAYVHPCKTYALLGCFKNKKNKSTLTSCGFKIKFTTFPRYLDTIYLFLDPNWIYIAPNISPNFTYFYIQFFFATVFPFTTFDCTNNL

SEQ ID NO: 161865 - protein, 72 aa, Triticum aestivum
  Clone ID: PAT_TA_56283.pep
GYSGSDLRALCEEAAMMPIRELGPQNILTIKANQLRPLRYEDFRNAMTAIRPSLQKSKWDELEKWNDEFGAS

SEQ ID NO: 161866 - protein, 62 aa, Triticum aestivum
  Clone ID: PAT_TA_56284.pep
RLYDTCVVRTSTDLITQCYQATHDVRHTHRERLLLGGHTLVLSTEAPDTDHERFCDGHARMC

SEQ ID NO: 161867 - protein, 118 aa, Triticum aestivum
  Clone ID: PAT_TA_56285.pep
TGMQLSPDGSYLLTNAMDNELKIWDLRPYAPENRNIKTFTGHQHNFEKTLLKCSWSPDNRKVTAGSADRMVYIWDTTSRRILYKLPGHNGSVNETAFHPTEPIIGSCGSDKQIYPPEL

SEQ ID NO: 161868 - protein, 105 aa, Triticum aestivum
  Clone ID: PAT_TA_56286.pep
PIAGSADLSVSMNAFDRKVVMKGVFLIVFKNGGQVRGLSPIMEPDEQWFQFPDGFSEARTWVDMWAGTLCVIRRRRRPLDLHVHVAPCGESLYTRVSQGPAIVML

SEQ ID NO: 161869 - protein, 83 aa, Triticum aestivum
  Clone ID: PAT_TA_56287.pep
GECRGKTGESPALTILGGKTGYETNYSLLTTAGSERANTGGSQCGRNRAFMSAGFFFPFNGEKYEAHKLVFTATQKRVRQTCK

SEQ ID NO: 161870 - protein, 188 aa, Triticum aestivum
  Clone ID: PAT_TA_56288.pep
MASAAPPAAAPGRPHPTYTNASSLSSPLLSLEMIAGALAQLGGASARSAIAGFIAARFTGLPVSHDALLSAHLRRLVAEGLLCTSGFSYFFSSHHSPTRPPESNSPDSDSDDPSTGRFHFLQSSSSSSSEEEEDEDDAAYTPLPVHVHVPVPVLGEKRGRGRPRKKVVVMLSAHTTTAAATPGEPCPA

SEQ ID NO: 161871 - protein, 106 aa, Triticum aestivum
  Clone ID: PAT_TA_56289.pep
DAPRYFMRGETPTASLSYHFCMQKESGSSLSPHAEVRCSTLPSSSPVRPPPRQAPPRHMTSLRTRADPARHSPCWSQTPPRQAPGGLCILTAGTLVYQYMGTPAHR

SEQ ID NO: 161872 - protein, 131 aa, Triticum aestivum
  Clone ID: PAT_TA_56290.pep
ISSFPAPRRRSVLGTDHCYEKRIHEWRRFVVQRHAQCGAAVQGVGRAQLVGMNQDDESSQVVVVDASRTRWCACCGVMMSHGDRPHQLPAVRGRPCRVSNGWRGASSPYRCCEHSLVLASAGGWRRDHFFV

SEQ ID NO: 161873 - protein, 88 aa, Triticum aestivum
  Clone ID: PAT_TA_56291.pep
RRILMHGASACIRVIQRVTAPQSAIRPRSARVLYQLRRWGSPCPRGRRPPAAYPRDTQVIVLYLVPTTEAMVEGRSISPMRFLTASPW

SEQ ID NO: 161874 - protein, 180 aa, Triticum aestivum
  unsure (1)..(180): unsure at all Xaa locations
  Clone ID: PAT_TA_56292.pep
RDSMHKRRATGGKQKARRKKRKYELGRQPANTKGASNKTVRRVRVRGGNVKWRALRLDTGDSXWGSEAVTRKTRLLDVVYNSSNNELVRTQTLVKNAIVQVDAAPLKQRYLTHYGVEIGRKKKAAAAAKKEPAEGQDAEVAAAATDEAMKSNIAQMKLEKRQQGRXTLDSHIEEQFRGGR

SEQ ID NO: 161875 - protein, 211 aa, Triticum aestivum
  unsure (1)..(211): unsure at all Xaa locations
  Clone ID: PAT_TA_56293.pep
RQGEMDVAEVAXNEYDLENKVVGTVAVGRIGERVLRRLKPFDCKELLYFDYQPLSAEKEKEIGCRRVENLEEMLAQCDVVTINCPLHEKTRGLFNKDLLSKMKKGSWLINTARGAIVVKEDVADALKSGHLRGXGGDVWFPQPAPKDHPLRYAQNPXXGGNAMVPHMSGTSIDAQQRYAAGTKAILDSXYFSGRHDYXXEDLIVXNGDYAT

SEQ ID NO: 161876 - protein, 207 aa, Triticum aestivum
  Clone ID: PAT_TA_56294.pep
SLGLRARDWPAKADPCAAWAGVACRAGRVAVVRLGGLRRTRLGERSAAFAVDALRGLAALEEFNASGFPLPGRIPAWFGRGLPPSLAVLDISSAGVDGELPLYLGMSGNLTTLVLAGNSLSGRIPASVFSSKALRTLDLSNNNLTGELPDVSASAGDGAGALFNASGNSLYGAIGDGLVSLKKRFQVVDVSSNYFGQAATTGFQNGS

SEQ ID NO: 161877 - protein, 130 aa, Triticum aestivum
  unsure (1)..(130): unsure at all Xaa locations
  Clone ID: PAT_TA_56295.pep
SHPGYDHIYIDDRPQPVRLKRKCNLKIEASKETYSNNDDSRTKNLDVGANNPAYIVXVTLGPKARNVAMDSKSPPLNIVNDTVTNARKVDLKDPVENIAALSARQAAAETNDIAGDETTAYDSACSGAYC

SEQ ID NO: 161878 - protein, 97 aa, Triticum aestivum
  Clone ID: PAT_TA_56296.pep
HLKKVTSPAAKRVLCKWASRIITAVSFDANPAHPGPPRKVSTAPIIHVSSCLLAHDQNWFPFYTISSSSWYLVVDTVRRRPHRREHPRTPGHSAETM

SEQ ID NO: 161879 - protein, 212 aa, Triticum aestivum
  Clone ID: PAT_TA_56297.pep
RLRRTSVAPTPRRPPQPPVPRGYSTEAGLHGPGQEEGGGGVQAPQAEAAGRSGEEEGKKADMSEFRAQLGSFGLKIVEVTADGNCFFRAMGDQLEGDEGQHMKYREMVVHYIVEHREEFEPFIEDDVPFDDYCDSMMKDGTWAGNMELQAGSLVTGRNICIHMLNSPRWYINNFSGREASNMVHLSYHHGEHYNSVRLTEDPCQGPAMPVVI

SEQ ID NO: 161880 - protein, 124 aa, Triticum aestivum
  Clone ID: PAT_TA_56298.pep
PIHSKTSTARDDRPSHSYMFLTSNVILRRFAMRSMPSTGITWTAATSRQNPQTRLSLEMRRRFHRQQEARLLLLSHWQSRTLLQLLYRPLTLQRCSLMTAEVASDAMMADADTASMRDCGLLHT

SEQ ID NO: 161881 - protein, 212 aa, Triticum aestivum
  unsure (1)..(212): unsure at all Xaa locations
  Clone ID: PAT_TA_56299.pep
HFYFDVAKYRLYVGGRVSYTXKSCQTVLAAHLLYLVRAIAPIMPHLAEDIWQNLPFEHTLEDGSVAKFAFDLKWPDKNEEWCSVQKDDVDFLSVILELRSEVNKILENARTGKLIGASLDAKVYLHAENPDTVSKLKELASATNDADALHRLFITSQVEILPSLSEETTSGVSYAGKFSDPRTGEIWIGVTRADGMKCERCWVYTKDVGVVR

SEQ ID NO: 161882 - protein, 200 aa, Triticum aestivum
  unsure (1)..(200): unsure at all Xaa locations
  Clone ID: PAT_TA_56300.pep
MAFSADPTAQPYVVEDCRGVLQLLSDGTVVRSAALPFPVDGNVAYNDHGRVEWKDAVYDAGLGLGLRMYKPTTNAGEEGKKLPVLVYFHGGGFCIGSCTWPNFHAGCLRLAAELPAVVISFDYRLAPEHRLPAAHEDAAAALLWMQNQLALDPWLADAADPCKVFVSGESAGGNIAHHLALRFGRAGLDPMRIAXYILLM

SEQ ID NO: 161883 - protein, 45 aa, Triticum aestivum
  Clone ID: PAT_TA_56301.pep
THAMLRSLGLCTVNNLKDEHSLTLIDDSLVYAKDIQGYVLLHSII

SEQ ID NO: 161884 - protein, 214 aa, Triticum aestivum
  unsure (1)..(214): unsure at all Xaa locations
  Clone ID: PAT_TA_56302.pep
GMRRPMHSVLGLVSMMQQESMNPEQRLVMDAIVKTTSVASTLMNDVMQTSTMDREHLSLVRRPFSLHSLIKEAVSVVRCLCGSKGVDFEFQVENSLPERXVGDEKRVFHIVLHMVGTLINQCRAGCLSLYVNSYNEMDERHNNQDWMLLRRAIFSAGYVCVKFEIRIKKSRNSLLDASASQISQEPNASSSEMGLSFNMCKKIVQMMNGNIWSV

SEQ ID NO: 161885 - protein, 61 aa, Triticum aestivum
  Clone ID: PAT_TA_56303.pep
ELENSFFSKPGLVSYTWTSFFSKPGLVSIKGRPAALSLASHALSFSSLPSTQNHLLMASPF

SEQ ID NO: 161886 - protein, 101 aa, Triticum aestivum
  Clone ID: PAT_TA_56304.pep
RNPAQINNKRINASTELIELIEQEEGLFHYMSRGEKQSTLAAYFVCGHTTLDSTTVVRIFSDNQIYNPQATEYRDPVGLLREGRDMDSLGGDRSYWCWGGS

SEQ ID NO: 161887 - protein, 95 aa, Triticum aestivum
  Clone ID: PAT_TA_56305.pep
QASWCSNTDFDNHLPLKRHGNTLTDKNHRVGTWTPRRVKLNLGVHRSRSIWALNYTNYRLSIAPQLANQRKCLLYREDLDMLSAQYNNLLREGNE

SEQ ID NO: 161888 - protein, 110 aa, Triticum aestivum
  unsure (1)..(110): unsure at all Xaa locations
  Clone ID: PAT_TA_56306.pep
IVSRALCXYPLELIAKNAGVNGSVVTKKVLSSVNFKLGCKTATGQSKSLMSAGIIDPTKXVVRCCLKRTASVNKPFLTXCVVVVEIKEPEAEPLTDPMDNYRVGIVITEG

SEQ ID NO: 161889 - protein, 91 aa, Triticum aestivum
  Clone ID: PAT_TA_56307.pep
PGAPTMPQHGGPPGSMPMQVAPPPRPPTLPPPTFGAPGAPMSNNASPPGPPPMYQPNQPPTAGSTSGAPPLAPAAPPQAAFSYAQSNEGNH

SEQ ID NO: 161890 - protein, 84 aa, Triticum aestivum
  Clone ID: PAT_TA_56308.pep
ASTCASSKPLNGVCWTSMSVHMHRAPRSGTGNADLRSLTGAAWTCSFFFCFAFPFWPFPWPPPLFFGGSLDGTAVAKLQEALCF

SEQ ID NO: 161891 - protein, 127 aa, Triticum aestivum
  Clone ID: PAT_TA_56309.pep
QSELDSPATAFLNRETCDRYCRLFLPAGANKDHPLVNPFGSDSPSLETLDVGRVLVVAAEGDLLRDKNVEYAERLKAAQGKGNDDVELVVFAGEEHAFFGVKPTSGATGELVRVIRRFMATETEAAC

SEQ ID NO: 161892 - protein, 63 aa, Triticum aestivum
  Clone ID: PAT_TA_56310.pep
RAFILAQQGHGRLKSTFTMPRRGGSLRLAVHVMTGLGANPIHGNHLDMHALNHGVLLNPVAHP

SEQ ID NO: 161893 - protein, 107 aa, Triticum aestivum
  Clone ID: PAT_TA_56311.pep
SARLISKKFVFCIWTQSPLLSCFIISREVTSPKLPLHKNSQLSAQVTGLSSPTLTWQAGADFKSTVGGIIFVAGALWTGLPLVQEDNLILVYGFFFFCGGWSMASVC

SEQ ID NO: 161894 - protein, 80 aa, Triticum aestivum
  Clone ID: PAT_TA_56312.pep
GLERVWISRRSLVLLGRLELCARHCGGVCHCSAKAQTTHSSGEAWVLDDDCRGRVDDHNVHGPHAMVVAVARLQVKALLL

SEQ ID NO: 161895 - protein, 66 aa, Triticum aestivum
  Clone ID: PAT_TA_56313.pep
RKKTSIHENINPTLLLPSKGARKELDNPQVQGIIVAISKDRSDNYGMSNPEGSKGKINIVSCPICH

SEQ ID NO: 161896 - protein, 87 aa, Triticum aestivum
  Clone ID: PAT_TA_56314.pep
VGLRCVVQEGFWMNRGCWSPTWLLSRLLQSPHSLFRLCGEKCVRTDTIPYWMAKFVQTCRLDGCDQLEGPLYVCPYKSTTKKNRRHP

SEQ ID NO: 161897 - protein, 57 aa, Triticum aestivum
  Clone ID: PAT_TA_56315.pep
HGVNLIVSTYVSRQGYAIHPSALSRLPINHVSPSYVLMISELKLRTIPSIGTSARST

SEQ ID NO: 161898 - protein, 91 aa, Triticum aestivum
  Clone ID: PAT_TA_56316.pep
TPGATTFEHAMVRHENTGRCIETFTYEYEYILNCDRWFGLLRPRIRLMALRPHPTRAIYSVHPTVRGERAHVASFAVVEGLHCEEPQDEHE

SEQ ID NO: 161899 - protein, 60 aa, Triticum aestivum
  Clone ID: PAT_TA_56317.pep
VLLPFPRTCCCFSFLAAPSFFLNCCCFSPLLLLAKFLKPPGEPCVIFKFVPLDAYVIFRF

SEQ ID NO: 161900 - protein, 224 aa, Triticum aestivum
  Clone ID: PAT_TA_56318.pep
HHPSHHHHHQQQHQLVKDERLLFSLNYQQLESVIQFTYRVAFQENWIDVAVNVDNIRCDVIQLVSETLMARQGHGSDEKHFPSRISLQLTPLAQSDILSLSVSRSTDNPVQEVGTDKGIDTTLAAAPASMGISVSAHETVTRTMKPWKFEHSVHGNTASLSWFLHGSGGGGREVFSSEPPKLELFQPRSWFRNRYTSPTRPFTRSGGVIFAGDEYGEGVCWRMG

SEQ ID NO: 161901 - protein, 87 aa, Triticum aestivum
  Clone ID: PAT_TA_56319.pep
VIGLLIKPFNLKALVQITHPSSKPVDNPMVPLAAKERTMPFGPITQRWNPGCFGTAQGCGEKLSRKEGVATIKAPPLELPGHLLSQG

SEQ ID NO: 161902 - protein, 71 aa, Triticum aestivum
  Clone ID: PAT_TA_56320.pep
FSPRGEVDGATQCFFFRFVFIRFACPPFYLRSGNLFLVQLVFLERVSFKFETPPARKNFLGKWLFLDIFLF

SEQ ID NO: 161903 - protein, 113 aa, Triticum aestivum
  Clone ID: PAT_TA_56321.pep
ISLFISFKTKGTGPGPSNRRTVAAAMFLDTMEVANRGTWNEASAPTLTTQAPRKPREKEGVGKYGKGSIYCGPSRTHTFRLNQTPLNWWQKGRKLAHRPERHEAQSHGLGQTP

SEQ ID NO: 161904 - protein, 72 aa, Triticum aestivum
  Clone ID: PAT_TA_56322.pep
CRWGGPCFKQVGRSENLSREILRGAFLGGYSPTTSWSVAGPCNIKAGGGVHALNSLGKKLGDHFLLLAGVQI

SEQ ID NO: 161905 - protein, 153 aa, Triticum aestivum
  unsure (1)..(153): unsure at all Xaa locations
  Clone ID: PAT_TA_56323.pep
ERKEPPQSPMNAYKTAQDFPLVDLAPTPPLRVGLALNFFVFYYEILNSPARACTLAKQAFFGVLSKLASLGGESSKARPFFMRLLGANLPFWPSPPHEDAVFXIKEAPAPKKFGAGQWGELKYPFVPCWGQWKSVLVLGLKLLSPPPLFYYAL

SEQ ID NO: 161906 - protein, 101 aa, Triticum aestivum
  unsure (1)..(101): unsure at all Xaa locations
  Clone ID: PAT_TA_56324.pep
MGSVGPTLKSLVDQVFSVITNGGRNIVGAFWGFGQAPNIILGEFPERVFSPXEGVHQLVLGLFIIRGGNISVVGXVDKELDPALDMSQLRGQPPQPVIPLR

SEQ ID NO: 161907 - protein, 78 aa, Triticum aestivum
  Clone ID: PAT_TA_56325.pep
PPQKIKQHIRKQVGSRVYPPEGWEILIRGSRAQQINRPNNKTRIRHYLLGVHGQLVPIVRGGGGPIASSIGRGRTCPP

SEQ ID NO: 161908 - protein, 82 aa, Triticum aestivum
  Clone ID: PAT_TA_56326.pep
KVLKQVHPDMGISSKAMSIMNSFINDIFKKLAGEAVKLARYNKKPPFPSREIQTSVRLVLPGELAKHPVSEGPKAVPKFPSS

SEQ ID NO: 161909 - protein, 112 aa, Triticum aestivum
  Clone ID: PAT_TA_56327.pep
PEQLRGPKGTRFFPYSQFPPKITPKEGCPFSTTPAMRVPKPLQNVLFCKNWLPRRVISAWRFPGFFLPLEGWAQHKCGDPVFHMDKVWFSPLLHGFSPVFKVFLFGCPFQVE

SEQ ID NO: 161910 - protein, 108 aa, Triticum aestivum
  Clone ID: PAT_TA_56328.pep
LATSTQYRQMRRREQDRITRMETDYEKRKQVAEFNLRRDERLKAAEERTSKKRLKRQKKKQRKNEKRAKPSGGGEEPNSEAVPKQVEESDDDDEGSDYEGDDKFKQRK

SEQ ID NO: 161911 - protein, 171 aa, Triticum aestivum
  Clone ID: PAT_TA_56329.pep
GAKQPTYLVTADDVDSLLAIEVQPLDDRKRKGEIVKVYANEQKKITCDPEMKELIKKILSAGHVSYEVLLPVRFIDMWEPAVLAIKREGYSIKCNGQRGVVITEKFQQATAINIPYGHPTEFSIQSADGAEYNLKPGENSPSRDSIVLILRLFRMKAVEKSKGRKKGIFFK

SEQ ID NO: 161912 - protein, 72 aa, Triticum aestivum
  unsure (1)..(72): unsure at all Xaa locations
  Clone ID: PAT_TA_56330.pep
FSLEKQFEPMEKLFYRLVARTNQLEXRRPKKKFXVQKVMEENVRLRAMVDKKDAQLQAISDQCKFMVFNRPN

SEQ ID NO: 161913 - protein, 152 aa, Triticum aestivum
  unsure (1)..(152): unsure at all Xaa locations
  Clone ID: PAT_TA_56331.pep
LPGSATGGVGVATLPARGLPIQMAPKKGAGSPKNGRDSKGQPLGVKIFGDQLAKPGAIFIRQGGPKVYPGNNVGMGKDPPLFSLIEGLVKFXKYGPPRKKVRVSPYXKTPXNPTRFRARKRKNFRFQGERFKAKPKGTFDPKLVLAPPNPSV

SEQ ID NO: 161914 - protein, 117 aa, Triticum aestivum
  Clone ID: PAT_TA_56332.pep
NRQSMQGWTYFYLYLTAGRWLTLFLVQAARMLSYIPMGVSFTTWLSLTRLLLNGRYLHDVHPERVSLIEVDYSNTCFIMVHSEYCIEIIMCTTCDETFTSPTRCILHHLGLRIAGVT

SEQ ID NO: 161915 - protein, 75 aa, Triticum aestivum
  Clone ID: PAT_TA_56333.pep
SYGAENYSSLPFCAFAARKFYSCWYEIVIPIPMYDSFPMPPRVNQYCQLNCMDSFELSQFGLLLILYIRVYRNAL

SEQ ID NO: 161916 - protein, 66 aa, Triticum aestivum
  Clone ID: PAT_TA_56334.pep
LVPAPKVPGFPQLLFPNAGKILHRHKAVRSAQVLARMIAFFYYKAARPPCLSESDGQGQEKVPLMS

SEQ ID NO: 161917 - protein, 96 aa, Triticum aestivum
  Clone ID: PAT_TA_56335.pep
RVSWALLHYSVASLEFVDQLVGIVQFSQIAKAAKLGVLDFVQSANFYLIKPVKFTCVHQCSTNCKRVTTQGEESPFCITLGLNPHVARATLFYFGL

SEQ ID NO: 161918 - protein, 159 aa, Triticum aestivum
  unsure (1)..(159): unsure at all Xaa locations
  Clone ID: PAT_TA_56336.pep
AYRHQLDKLNILLIDKMAVEMVESHAANLAYFEYKXKEIPXVLHGRSKLEKATIMFEGNNGLXHVFTVVPIILGVKVVNXQAQIPAYEQLQKLAPRPCGMFMHLRHMTCGLTVSSLKKPNSDNGVLQLVHGLNVAPQLQTLHLDMIYSYFKHYKKSVDP

SEQ ID NO: 161919 - protein, 216 aa, Triticum aestivum
  unsure (1)..(216): unsure at all Xaa locations
  Clone ID: PAT_TA_56337.pep
METPPPFQESAHCDVCRCTFSTFRRRHHCRSCGRTLCHEHSSYHMALPQYGIYTDARVCYECFNKSSSRRGGVDNASSAGSVSGAADSFSGLNLDKDDDSLPTKSSAVQSPAAIIECKCGMPLCICEAPKPEPAPVKNISAASSAAQSNPKPKKPSSNQQSAELSLKKASATSSSNSSSFLNLGLMSNDXHDKTPSDYEVTGEGLREAIKGXDIKA

SEQ ID NO: 161920 - protein, 32 aa, Triticum aestivum; identical to SEQ ID NO: 159903
  Clone ID: PAT_TA_56338.pep

SEQ ID NO: 161921 - protein, 86 aa, Triticum aestivum
  Clone ID: PAT_TA_56339.pep
NKLRARKDPQAALFKKGQSTGVLHQDPERKRKTLTGPWLLQKGPQKIDEKSNRVPGNSSLKLDLFSPGTAPLGGGSPPWPPPPNSG

SEQ ID NO: 161922 - protein, 83 aa, Triticum aestivum
  Clone ID: PAT_TA_56340.pep
KVGFIFREPNPSPGYYDGRYWPMWNLPMFGCPPPPQVINKVEEVKKESPPAYVRIIGFANMPQVQWVSFFPFNPPGCKESGKA

SEQ ID NO: 161923 - protein, 167 aa, Triticum aestivum
  Clone ID: PAT_TA_56341.pep
QKNDVAKAVLEELEKVMSDYGYSIEHILMVDIIPDAAVRRAMNDINAAQRLQLASVYKGEAEKIHLVKKAEGEAEAKYLSGVGIAKQRQAITDGLRENILNFSHSVSGTSAKEVMDLIMVTQYFDTIKELGDNSKTTTVFIPHGPGHVKDIGDQIRTGMMEASSSGL

SEQ ID NO: 161924 - protein, 108 aa, Triticum aestivum
  Clone ID: PAT_TA_56342.pep
PPKIPARRVALDLLRNPSREAFQGAVSPMLKPAPNKPLPPDPRLKGKQPGDRVCFWKDTPVLPCSKGPTNRVRGPARGGIQPEVFPPPRDLFPAIDPWLRIGRAPCLR

SEQ ID NO: 161925 - protein, 98 aa, Triticum aestivum
  Clone ID: PAT_TA_56343.pep
VFPVKKLVVGPWAGSAGPPPGEPPPTCPLGRDRAPTLNWPGGVSRPVPFKKLKGPKQPPPLDPLPWETPQGSRPHFVAPRGRPPPQKGLVGNVKSFFS

SEQ ID NO: 161926 - protein, 41 aa, Triticum aestivum
  unsure (1)..(41): unsure at all Xaa locations
  Clone ID: PAT_TA_56344.pep
VLPSXGEELEPHEFHEWIPEVQVPPDGPIRFDDFIPRMVAK

SEQ ID NO: 161927 - protein, 113 aa, Triticum aestivum
  Clone ID: PAT_TA_56345.pep
DGPLFPVLGPSDGKFVPPLKFVPARASDPFGPYGAPFPIRSFGFRGGPPLPFLGRPSDKLNALGAPKLGVWSLYPSWPAKGFAAFRRVGFGGNLCSPHFSCLFLPLNKMGAPP

SEQ ID NO: 161928 - protein, 213 aa, Triticum aestivum
  Clone ID: PAT_TA_56346.pep
QVPTPARLHGCSFHYSTKTSRSTMFCCPVRNRQVPEDTKYIYRHPWNRQERQVPLRIDETGKSEDPKYHDNPEGIRIGQFPLRNVYHNAASPTPSPSPTSVPLLSTKTRVTQASSSTTTCARLPSPKTRVRLPWTVKGLESSSNSLNERERLLSQEQDCQIPPRVSKFNYHCRKLLPDREPLLPFTPPNTIRSENACFKGLTAETITRGRMLA

SEQ ID NO: 161929 - protein, 84 aa, Triticum aestivum
  unsure (1)..(84): unsure at all Xaa locations
  Clone ID: PAT_TA_56347.pep
GPIPPPGAKGSPPGQTTPPPLWTGGPPGGGPPSPRXFPPNKRVPVFPGSPGPFSPGLGPEPGEXPPGPRRPSSPPPWQGEGGFL

SEQ ID NO: 161930 - protein, 129 aa, Triticum aestivum
  Clone ID: PAT_TA_56348.pep
GFKCLMSTPGVWALFPFYVPWEKVYPSEPLAGINASAPQKLVLGGKVCIWGETPNPSDVPQPIWPQTISAPKGFWSHFGAISAPNLETPVLGGVPYFKCLFNPPGFVAAPVPNFFVWGPPIGPGSFFFP

SEQ ID NO: 161931 - protein, 112 aa, Triticum aestivum
  Clone ID: PAT_TA_56349.pep
PSSQSHSTAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 161932 - protein, 80 aa, Triticum aestivum
  Clone ID: PAT_TA_56350.pep
CKGDGQQNFCFPPISWGKISNLGWNPRALEETLLDSIESPRKMGNFPDVEGQAPPLPDIFRHFQAPPELVESANRQWPVK

SEQ ID NO: 161933 - protein, 139 aa, Triticum aestivum
  unsure (1)..(139): unsure at all Xaa locations
  Clone ID: PAT_TA_56351.pep
MRGPHLLTMEMTTDWGFLVWELEKKNICFLIMLFXSATTRRRSSGQPNNLXYNGHSYNXSDSGNRNTLAVHAXPGQDNGGILCTTKCNKHNTSAXLQYTTLMRKEFRKMAKSVKNRSCDNYYRCDLTYPTLARLTSLYR

SEQ ID NO: 161934 - protein, 75 aa, Triticum aestivum
  Clone ID: PAT_TA_56352.pep
AFTPLTSAIAAAPSLYSALVPLLPLLNPPPGYFLARFAWPPTRRPEIEARSVLRRTDRPEASAQHPRQRGPPEEE

SEQ ID NO: 161935 - protein, 100 aa, Triticum aestivum
  Clone ID: PAT_TA_56353.pep
PNPPPPTAHPPPQPRPAPRPPAHPPPPSPAPPPPALQAPPDRLGPAGVGRVSDGPALRRGASRGSYRSASPRGSSRATPRPPCSSAPPRFVRPVRVIALR

SEQ ID NO: 161936 - protein, 121 aa, Triticum aestivum
  Clone ID: PAT_TA_56354.pep
EYGDVSIGKSQVRLFAWHIKDQGDYQLSIWVLENYDSGEWTLKCTVSCSKLFGRDCRKYYESYSMFAIHPECNLIFLTDNKEKTLSYDMDNQEVHIICATGDFLEGLPYTPSFVEWTSDGH

SEQ ID NO: 161937 - protein, 191 aa, Triticum aestivum
  unsure (1)..(191): unsure at all Xaa locations
  Clone ID: PAT_TA_56355.pep
MLCHCTEIWMSLTETSPTQRKTIDNVPQVDTRKGKAVSDLSHQCKQLSQDAKQTMASSWTKPRVGRVKLNPDGSYLENKGXAGIILRDSEGSVILSSCRHVFTCADALEAELLTIKEGISLALQWTYLPVDVESDCSEAISTIKEGVGNKXKHAFIVKEIIDSMEERDSCISHTRQNCNNASHSMATFGSL

SEQ ID NO: 161938 - protein, 192 aa, Triticum aestivum
  unsure (1)..(192): unsure at all Xaa locations
  Clone ID: PAT_TA_56356.pep
KSNIXCTIEESLARYRDVTSAAKKHGIRIRGYVSCVVGCXVEGVVHPSKVAYVAKELYDMGCAEISLGDTIGVGTPGRVVPMLEAVMTVVPADKLAVHFHDTYGQALANILVSLQMGIGVVDSSVSGLGGCPYAKGATGNVATEDVVYMLHGLGIETNVDLGKLMDAGDYICKHLDRPSGSKTATALCRLTA

SEQ ID NO: 161939 - protein, 63 aa, Triticum aestivum
  Clone ID: PAT_TA_56357.pep
KNKYGLMIDTWFVMIHVSKEADERSFTSYAQGMRIGRDTIDRSIAGHLERFSEATLHSCYSSW

SEQ ID NO: 161940 - protein, 98 aa, Triticum aestivum
  unsure (1)..(98): unsure at all Xaa locations
  Clone ID: PAT_TA_56358.pep
PPRPPPXPPPAALAPPPPPAPPPPCPCARPSVVCVVRSCGVFRPCRSVRGGLVRGPPPLCFLSVGRSVVFVGAAPSVLWVLSSVPPFWLPVAAPPPPP

SEQ ID NO: 161941 - protein, 81 aa, Triticum aestivum
  Clone ID: PAT_TA_56359.pep
TFLLRCALPRYTGFRPLRICFSTSRVATFITFYYAGQLVKFRFQGRHLTYAVRFSAPVGGHTCRPDIRSGLSSKQESWYQL

SEQ ID NO: 161942 - protein, 171 aa, Triticum aestivum
  unsure (1)..(171): unsure at all Xaa locations
  Clone ID: PAT_TA_56360.pep
PPPPPPAPXPPPPAAAPPPPPPPPPPPPPPPPPRPAPXPPXPRPXLPXPXPCPWPPPPXPPXSXXPAXXPRPXCXAXALGVXSXXXGCPXGVPRPPXXLVPRXSAFCGPPAXCXXPXXXLXLPSPLLPXXGCPPPPPXXPFCPCVPLPLCSCSGLPPLFPPRGVFLAPPPP

SEQ ID NO: 161943 - protein, 168 aa, Triticum aestivum
  unsure (1)..(168): unsure at all Xaa locations
  Clone ID: PAT_TA_56361.pep
PPRPPPPPXPPPPRPAPPPRAAPPPXPPPPRRPPPPPAPRPRAPAPPSPPPPPXGPPRPXPPPPXPPPPPPPPPPPGSPSPPAPPPAPCPXCSPAPPCRPPAPXSSPSSXFXSPXSXPSPPSAASPAGCPSLCSSGSSALPAPLCPRPPPPRSALLVCCVAPAGPLFP

SEQ ID NO: 161944 - protein, 62 aa, Triticum aestivum
  Clone ID: PAT_TA_56362.pep
AGEATGKNPGGAIRGIAKGRLVQKLGLTPPPGRDKLDTTEKGGRFSLPIPRHSPMVAKPRGF

SEQ ID NO: 161945 - protein, 109 aa, Triticum aestivum
  Clone ID: PAT_TA_56363.pep
RADRRWIRAGRAGSAPASPPPSSPRSSAAPASTSPPTTTTTRKRPTTAPSCSPPPPTSPSSTPPPPPPSPPARRRSRSRGLPSRPCDPLPPPIHRLRTAYSSPRPRPLL

SEQ ID NO: 161946 - protein, 160 aa, Triticum aestivum
  Clone ID: PAT_TA_56364.pep
PREEEGAPRSPRPETMSAVRCAARRLGGSLLQRAQAEERRRLVPSRLMRSRHLTTEAQEIQRKEALYDALSYAELKLKEFNDALVKAGDPTGEKHLSALSAPRTGYERLKMYGLRALGVIELTSKTAVFVVFALSFVTLSSMKTEELTSGETITEVKAAN

SEQ ID NO: 161947 - protein, 137 aa, Triticum aestivum
  Clone ID: PAT_TA_56365.pep
MSSAGSGRGKGKAVSKTVSRSSKAGLQFPVGRIARYLKIGKYAQRVGAGAPVYLSAVLEYLAAEVLELAGNAARDNKKTRIVPRHIQLAVRNDEELSRLLGAVTIAAGGVLPNIHTTLLPKKVGKGKGDIGSASQEF

SEQ ID NO: 161948 - protein, 52 aa, Triticum aestivum
  Clone ID: PAT_TA_56366.pep
YRSSNSMTILVSRLTCAFISAALCFRREMLSSSEACCPTLEPSSLGLRDVER

SEQ ID NO: 161949 - protein, 175 aa, Triticum aestivum; identical to SEQ ID NO: 115797
  Clone ID: PAT_TA_56367.pep

SEQ ID NO: 161950 - protein, 32 aa, Triticum aestivum
  Clone ID: PAT_TA_56368.pep
LHVDFHDPTTAPIGWTIPLGIRNTHASCIIKQ

SEQ ID NO: 161951 - protein, 150 aa, Triticum aestivum
  unsure (1)..(150): unsure at all Xaa locations
  Clone ID: PAT_TA_56369.pep
PIMKLVKIMRGXDTSEKVFSKNKSFSERIGKPVICSQDKKDFIVXRIKKPMINEAFWALYPGVATKEDIDTGMKLGTNQPMGPVQLADFIGLDVCHSVLRVLHNGLGDNKYSPCPLLVQYVDAGRLGKKRGLGVYSYRRNSSSVKPKSSL

SEQ ID NO: 161952 - protein, 35 aa, Triticum aestivum
  unsure (1)..(35): unsure at all Xaa locations
  Clone ID: PAT_TA_56370.pep
LCXLICHCXQXKSLLFQYCKXYTYFNXIYPLLYLF

SEQ ID NO: 161953 - protein, 64 aa, Triticum aestivum
  unsure (1)..(64): unsure at all Xaa locations
  Clone ID: PAT_TA_56371.pep
STKLHWQTTPSNHPPKRVXMGGGITLRVNHAGYTHNCRHIYYINXAGXTXRHYTPXCWGILVEE

SEQ ID NO: 161954 - protein, 61 aa, Triticum aestivum
  unsure (1)..(61): unsure at all Xaa locations
  Clone ID: PAT_TA_56372.pep
CLFFFFFFFFFCFFFFFFFFFFFFFWQGKGXXKFFFPPSKKGEGKKRVLKKRKGGTEKRQG

SEQ ID NO: 161955 - protein, 126 aa, Triticum aestivum
  Clone ID: PAT_TA_56373.pep
KPQDPEGKLPTSMLFGAAGHSKQSSSQLCSPEDLPLGRSLMRVSSMFVDDLRLQPPYTEARYGSVRKAYVVFKDDHAIVEGFQRWMLHNYPVDEVMEIDGADHMALLSTPTELARCLADIAVKYAA

SEQ ID NO: 161956 - protein, 44 aa, Triticum aestivum
  unsure (1)..(44): unsure at all Xaa locations
  Clone ID: PAT_TA_56374.pep
GCCVCLPFVXLLXPXRVWSVLYRACIRMPPPTLCNFDPLTAVTS

SEQ ID NO: 161957 - protein, 136 aa, Triticum aestivum
  Clone ID: PAT_TA_56375.pep
DRVLRPCMGGLFRAVFHLSLLRGLFVSWGKLVSGLILAKIASRNHLRKNLGGQMRGLTPVGPVGVTPPFYLGKPVCPFSLRKPPPPGGICDSFLARGGVFFFLGARGFFFFPLGAGLCWFPLPPPPCFAFLSENPF

SEQ ID NO: 161958 - protein, 67 aa, Triticum aestivum
  unsure (1)..(67): unsure at all Xaa locations
  Clone ID: PAT_TA_56376.pep
NCSSSPRCVCPSPPPPVXVSXFXXSLLYFPFLLXCPRFNGACLCMLIPFMKARRSSLFXKKKKPPTP

SEQ ID NO: 161959 - protein, 56 aa, Triticum aestivum
  Clone ID: PAT_TA_56377.pep
RLNGHSGEKQKTHLPCVCTHNKDSIEVGKKALKCWLLHQNSKNIKIQGTQGCKAND

SEQ ID NO: 161960 - protein, 95 aa, Triticum aestivum
  unsure (1)..(95): unsure at all Xaa locations
  Clone ID: PAT_TA_56378.pep
RPDINKGIIXHKKRAGHNLQRGGVGIFFQGSGTRTRHTKQXQHGPSLLESLKDRPLYKLRXLGIRALHWDPPTNKNCGAEPARVGKGRSXERAGG

SEQ ID NO: 161961 - protein, 95 aa, Triticum aestivum
  unsure (1)..(95): unsure at all Xaa locations
  Clone ID: PAT_TA_56379.pep
GKTGLSHYRTVFQQPTGGGNWGGDFANTCWLGRIMPLPKILRGRVRTTKTGGSQLLLGNFRPNKRVGFPFQKTQQFQVQSFLCSKQXLENHNYRA

SEQ ID NO: 161962 - protein, 110 aa, Triticum aestivum
  unsure (1)..(110): unsure at all Xaa locations
  Clone ID: PAT_TA_56380.pep
GGGFSTDLRTNRHQERPNFVVYVHALLNRTTRMTAMARAMKDPPAAISANEGFLEDEPGPASASAGLWNRSWKKXVMLSTIXIIXFFXLXTKSDKGEAVGSAYXGDAFXN

SEQ ID NO: 161963 - protein, 74 aa, Triticum aestivum
  Clone ID: PAT_TA_56381.pep
CPPPRTPPGVAHPRQAHLPPVVGGPRARRPRGPEDLGVRAADPVELSPVFFSVGEELNKRGTPPCMRSRIYECL

SEQ ID NO: 161964 - protein, 90 aa, Triticum aestivum
  Clone ID: PAT_TA_56382.pep
GLLHPIVDPQHIATAGFQVLPVCHPDDHVVNSVIIAQKSSHMHANGFRNGRGGQCARGTVPVVSPPCRFGEMVADVSQKREEFANAEVAF

SEQ ID NO: 161965 - protein, 51 aa, Triticum aestivum
  Clone ID: PAT_TA_56383.pep
GVFFTENIAHIGMFATCTMHMTELNQPTCGGHGPGLLELRRVGGRARIVDA

SEQ ID NO: 161966 - protein, 81 aa, Triticum aestivum
  Clone ID: PAT_TA_56384.pep
AFNHMTKPKHGSNKSAPFKQVSTQVHSSLLYSGHLRIMQDWAKTRILGMMQYKFRRGTPQQTPRARLPRTDLLSGMLFYGI

SEQ ID NO: 161967 - protein, 48 aa, Triticum aestivum
  Clone ID: PAT_TA_56385.pep
PPTQQATVRLLALQAVNRHRLCTRSCAACAPMYVGDLSVLEYECLLFL

SEQ ID NO: 161968 - protein, 118 aa, Triticum aestivum
  unsure (1)..(118): unsure at all Xaa locations
  Clone ID: PAT_TA_56386.pep
GKTGLLVHNLAFSPLXGCNIIFVIVACITERRRLRSDPLNFSTLNMIFEVISAYGNVGLSTGYSCSRLHQLHPEIICQDMPYSFSRWWSDGGKFLLVLVMLYGRLKVFAVSTGKSWKV

SEQ ID NO: 161969 - protein, 110 aa, Triticum aestivum
  Clone ID: PAT_TA_56387.pep
PPGKTNRLQTQRRSKEKEKKGGYFPLGGFTQFPGDTNPSKAFGKGFFLEPGSLLVNGQEKKFNDSGPAISSMQPSKEYFENRLGEVEAPLRGVLQRAPGLAPQFLSMPVQ

SEQ ID NO: 161970 - protein, 61 aa, Triticum aestivum
  Clone ID: PAT_TA_56388.pep
GSRPRCDGPPEKSRLGATNTVVLVTHTGCYYIEMNRIGPRKRKFTRVGVRLILARKNGNMQ

SEQ ID NO: 161971 - protein, 57 aa, Triticum aestivum
  Clone ID: PAT_TA_56389.pep
PPPLVLSAPQLTGLTLPRVTPPSLCPFIPAVSMHALLYVWSYLVLMFSTMTKKKNPR

SEQ ID NO: 161972 - protein, 85 aa, Triticum aestivum
  Clone ID: PAT_TA_56390.pep
APRGARTPWIMHEYTATDPNPQSQSQSQSQSAGPQNDSFVLYRLFNKQDEEAPAPISEPPSTSSPGNLPLLAVPVRASVVGELAS

SEQ ID NO: 161973 - protein, 38 aa, Triticum aestivum
  Clone ID: PAT_TA_56391.pep
IPASVPLRWFSPPSVGSTRCWPLSIVISNESVNSRYCS

SEQ ID NO: 161974 - protein, 87 aa, Triticum aestivum
  Clone ID: PAT_TA_56392.pep
EQTKSLLTLNNHLIHTTIYCTNHGYAAKLELMSDGTLGGSKNHYQLNFGPLICTHIVMLNAWIGIQSCLTNSIFTPCCRWCVRLRMN

SEQ ID NO: 161975 - protein, 137 aa, Triticum aestivum
  Clone ID: PAT_TA_56393.pep
RNGVLLLVSAAHVAAAAAPARHGNGNGHDHDHDQDTGGSNSTDEDEEDAAMREAKVEKGGYQQDVEDKPIFADSSPELHGAPMYDSERIPAAAKEVKHNDAPGVRVGDIGGPAAAHEVNREDAAGVRRRLRRPGSGA

SEQ ID NO: 161976 - protein, 123 aa, Triticum aestivum
  Clone ID: PAT_TA_56394.pep
DKTIVQWGDTADTPAGPRGRPLGTYGSASFAVNAQYFIARNITFKNTAPVPNAGATGKQAVALRVSADNAAFVGCRFLGAQDTLYDQSGRHYYKDCYIEGSIDFIFGNALSLYEVRARPPLLP

SEQ ID NO: 161977 - protein, 152 aa, Triticum aestivum
  unsure (1)..(152): unsure at all Xaa locations
  Clone ID: PAT_TA_56395.pep
GRVGDGYLPDSGMQVTIAFNHFGVQLVQRMPRCRRGYFHIVNNDYTAWEMYAIGGSASPTINSQXNRYIAPANPNAKEVTKRVDTEEGQWNGWNLRTEGDMMVNGAFFVPSGEGMENIYDKASSGVDPKSSALVDQLTMGAGVLGGPRTTAK

SEQ ID NO: 161978 - protein, 60 aa, Triticum aestivum
  Clone ID: PAT_TA_56396.pep
MENQALARSARAYGRKLAHPRSICREGSFLSNAQSKGGTLTPLADVFKSYLILNWGITRK

SEQ ID NO: 161979 - protein, 133 aa, Triticum aestivum
  unsure (1)..(133): unsure at all Xaa locations
  Clone ID: PAT_TA_56397.pep
QAKSCCVGDDRMAEPSRVIHIRNVGHEISETDLLQVVQPFXAVAKLVMLRTKNQALVQMEDLSASISAIQYYTTIQPSVRGRNVYLQYSSHQELTTDQSSHGRNPDQXFKPLYRFSHARVQYKQLVLCMDGTF

SEQ ID NO: 161980 - protein, 61 aa, Triticum aestivum
  Clone ID: PAT_TA_56398.pep
LWEFGASCVLINTPSVPNYLSWICLDTDVSRLILILDTSVSRQIPRQEFERKGVCRIALLV

SEQ ID NO: 161981 - protein, 73 aa, Triticum aestivum
  Clone ID: PAT_TA_56399.pep
RAPASAQILSWRLTTRSCASSSSLHTSSCPAIRAGIGRTTWGKIRLHAPPTDDLLLYAISACGLATRKLLLQK

SEQ ID NO: 161982 - protein, 93 aa, Triticum aestivum
  Clone ID: PAT_TA_56400.pep
ASSSRILSLGKLGLASFRIGGPNVKTDWVYADNLVLALILASMGLLDDIPGRKGTPVAAGQAYFICDGAPINRFDFIISPLFRSLGYPVPRAT

SEQ ID NO: 161983 - protein, 154 aa, Triticum aestivum
  Clone ID: PAT_TA_56401.pep
KFFQPKNMPSSIVNARGLHVVFYHRACRQPHAKQGNSASDQKIAAASNVIFMFLSIFSKTYPDMSSGKPLEPMKLARTIMSTQSFFLTSPALRNIRALQGMNGFIAYDAATGRSPYGLNSARRSARKSYVFSHAYGVDIVDEAAVACSPVCKVD

SEQ ID NO: 161984 - protein, 89 aa, Triticum aestivum
  Clone ID: PAT_TA_56402.pep
PPPISSPPSALRPRTPRLPDPKISAPPAPLRPQIAAAVGVLAWMYKYLSHGASSPPGADTVDHAGAKLDSKAHEVKNWAQHRLDQARTP

SEQ ID NO: 161985 - protein, 100 aa, Triticum aestivum
  unsure (1)..(100): unsure at all Xaa locations
  Clone ID: PAT_TA_56403.pep
QRHGTLELHCTLSWRVIYSITGCQIVNSCNTIQARFXAVKVYEGCGVSSRRNMFISCCLKYLRSSSSINNKFSVKYYLNLVLWTRKTGDTSRRNMLSLAA

SEQ ID NO: 161986 - protein, 198 aa, Triticum aestivum
  unsure (1)..(198): unsure at all Xaa locations
  Clone ID: PAT_TA_56404.pep
MSTAAQQAVADQKRAVRSDVRRALKALSPDQRTSEDLAIQNNILNSSWFKASKRLCAYISCAQLREVDTSKIIAEVLSSDPEHDGQAKDIYVPRVEDKNRNMRMFKITTMDDLVKNSMNILEPSPLDASGNACENVLSASSPVDLXXLPGQAFDRTGRRYXRGGGYYDTFLMRYQELAKEKXGWSQPLLVALSYSVQI

SEQ ID NO: 161987 - protein, 105 aa, Triticum aestivum
  unsure (1)..(105): unsure at all Xaa locations
  Clone ID: PAT_TA_56405.pep
SNSGIMKFAKKQLTCLGCKAVISGPNQTLCSHCKGREAELYCKTVANVSDLEMLFGKLWTQCQECQGSLHQDVLXTSRDCPIFYRRRKAQKDMAEARVQLDRWDF

SEQ ID NO: 161988 - protein, 62 aa, Triticum aestivum
  Clone ID: PAT_TA_56406.pep
KLPCLLAEVGLLANEPPPPSPAAPSSPPSPSPAPAPPPAPARASSALAPASFLTPPRASGPG

SEQ ID NO: 161989 - protein, 181 aa, Triticum aestivum
  Clone ID: PAT_TA_56407.pep
KYLLSPPLPSLPCSPSPDPLIPSRCTAAGSMRPSLPGARGPSFPPIVPPAPRGGRCDLLSPALEIPSFPSAAPPVPRGTRALPLIHGSIHPPCPMESTGIAPSRAAPGERKRRGRCARGRERVTGCRRPARTKSGVTPRAMAGQSAPGSGEGHAKGGGSAARPRSGGPASRTSGGSTCLLE

SEQ ID NO: 161990 - protein, 56 aa, Triticum aestivum
  unsure (1)..(56): unsure at all Xaa locations
  Clone ID: PAT_TA_56408.pep
AVQRQFDKRIYIPLPDSQAMQHKFKVHLXGDTAHSSWERDFEGLGRGTEGFFGFDI

SEQ ID NO: 161991 - protein, 89 aa, Triticum aestivum
  unsure (1)..(89): unsure at all Xaa locations
  Clone ID: PAT_TA_56409.pep
RRVSFPASASSSSSXGPTEKSGLHLDPGGGGGVRGGGRTNGEEDAEMLVAEQDKLRAPNALGPRGGHGPPLSEGRPASGSFWRRRQPEG

SEQ ID NO: 161992 - protein, 166 aa, Triticum aestivum
  unsure (1)..(166): unsure at all Xaa locations
  Clone ID: PAT_TA_56410.pep
GTHDTGGHGRQVGYGATGTGTHDAGGFGGSGIAPRHDTTGTGLHDAGGLGTRHAATGTHGTGQTAGLGGTGTGMTGTHGAGHTAGLGGTGTGMTGTHGAGHTAGLGGTGTGMTGTHGTGHTAGLGGTGTGITGTHGTGHTGGYDATGTHGTGHTXGYGATGTGITG

SEQ ID NO: 161993 - protein, 148 aa, Triticum aestivum
  Clone ID: PAT_TA_56411.pep
DAWAGTSQADCAVLIIDSTTGGFEAGISKDGQTREHALLAFTLGVKQMICCCNKMDATTPKYSKARYEEIVKEVSSYLKKVGYNPDKGPFVPISGFEGDNMIERSTNLDWYKGPTLLEALDQINEPKRASDKPLSFPLQDVYKIWGIG

SEQ ID NO: 161994 - protein, 190 aa, Triticum aestivum
  unsure (1)..(190): unsure at all Xaa locations
  Clone ID: PAT_TA_56412.pep
ASSNQTKDLSDDRPLLATEVESILKDLWEKEARFCMLLCDFQQNLCVSEKRRGYEMFFLKSMLVPPNRFRPSTNSSLGIMEHPQNVMLSKVQEANLALQHDNPNHMDILTRWRDLQTSVNLFYDSSKGLVKSDKDGHGVRQLVDKKTGIVRQKIMGKRVNHSCRTVISPGXPFLPGNEIGIPPAAASKLT

SEQ ID NO: 161995 - protein, 80 aa, Triticum aestivum
  Clone ID: PAT_TA_56413.pep
ENHCLKLWPRRKGPSQHSLAPVLLGRSAREVLIAHSRTFEHSRAQWPKSWGVEVGKRGILRSQQPLLGSLRHAPTRSYHR

SEQ ID NO: 161996 - protein, 190 aa, Triticum aestivum
  unsure (1)..(190): unsure at all Xaa locations
  Clone ID: PAT_TA_56414.pep
MAAIGAVSARIMRKDGKDDKQQGGSTSQTTEDLKGQLANYLKEKSYLLLVDDVWSTSMWEKIKNSLPKSKKGRRVIVTTRFQAVASLCGRDKEDHIHKVVVLDKDKSKDLFMIESEISKETKNKIPEILWQMCGGXPLAIVTMAGHAACNTDKXQAKWGESSQCTGYQTPXKALGLDGVTRILNHCYNDM

SEQ ID NO: 161997 - protein, 160 aa, Triticum aestivum
  Clone ID: PAT_TA_56415.pep
VRLPPLPPSCTAAGCTRCSSQNRYLVYDPALSPHYEVFLIPNIPFTLPTGHICMHICRDDESVSAMEWPPSPYIVHVFSSKTGCWKERSLLREGEAAGTVADVKAVYDTVSFFLYAAYWKDALYVRCEEEFLLRQYYISAPILGTRYNWMFSLFPPPISV

SEQ ID NO: 161998 - protein, 112 aa, Triticum aestivum
  unsure (1)..(112): unsure at all Xaa locations
  Clone ID: PAT_TA_56416.pep
PFIPIHSERTSGXHKIHRKXRSREHLVKRMARISCPIGAKKSKGLVLGSNSRKYICIPDWSNLGEYISFSINPIAPSGIPCRIRPFIMDPCTFRLPLAALTLEWYHPYSFHF

SEQ ID NO: 161999 - protein, 189 aa, Triticum aestivum
  unsure (1)..(189): unsure at all Xaa locations
  Clone ID: PAT_TA_56417.pep
KLRSSNGQASESGIQNFQLTGVIANDKSVNIEESPNFDDAELALIIDGNSLVYILEKDLESELFDLATSCKVVICCRVAPLQKAGIVDLIKSRTSDMTLAIGDGANDVSMIQMADVGVGICGQEGRQAGMASDXLGQFRFLKRMLLVHGHWNYQRMAXMILYNFYRKAGFVLMLFWYILHTAYSATLAL

SEQ ID NO: 162000 - protein, 127 aa, Triticum aestivum
  Clone ID: PAT_TA_56418.pep
VPHTTPLFTHLLHSPPPRPTTPHRPRPRRRRAAHREAAATRAAGAWRADPFPAARAEWLSLEHGAALGRRPAPRPALRGGGRCSPPASRARLRPWPLPSAATRRRCWPSTGGDRRPARGAGRLDGRR

SEQ ID NO: 162001 - protein, 69 aa, Triticum aestivum
  unsure (1)..(69): unsure at all Xaa locations
  Clone ID: PAT_TA_56419.pep
PRTSSGVPCQSLRKLSPWYRLLSSXFFQCVFTXACPPPRHGRPKQPRRREGLCQEEEERDVLGSVAIVN

SEQ ID NO: 162002 - protein, 48 aa, Triticum aestivum
  Clone ID: PAT_TA_56420.pep
LALALYLLSEMHLCAYIFLEDCMINSYDIVSYIPFSKASFIYPFLQAQ

SEQ ID NO: 162003 - protein, 55 aa, Triticum aestivum
  Clone ID: PAT_TA_56421.pep
IVINQHGGQHLHLSEHTQSSSIDTYYFHKSTWMLDHLALKLPPARLLPHHHFAGA

SEQ ID NO: 162004 - protein, 60 aa, Triticum aestivum
  Clone ID: PAT_TA_56422.pep
LLYHEDCRQGLIRDNCLLIARVFFISVLLGALHKELSPRIVYQISSWKYQSTGPSDKINL

SEQ ID NO: 162005 - protein, 110 aa, Triticum aestivum
  unsure (1)..(110): unsure at all Xaa locations
  Clone ID: PAT_TA_56423.pep
PHSPVPISPPSDPSAADLPCRHHLRRLLDKRPPPLSTTSARLVATATLALEGRPTVLDRGGGTIWIWAATAKQGHLCYRGTSLPTLPASLSLPRRGRXEPVTVDWGGMGS

SEQ ID NO: 162006 - protein, 58 aa, Triticum aestivum
  Clone ID: PAT_TA_56424.pep
FLRLPALQEEVCELTITRELISKFIEHRYWKLPFMCHELDLPINHHLGHMDDYFFMAI

SEQ ID NO: 162007 - protein, 52 aa, Triticum aestivum
  Clone ID: PAT_TA_56425.pep
YLVYYVHYCIFDLLYSIYTDCDGLVCFTHLLQHISILLVLVYFDAIACSLPL

SEQ ID NO: 162008 - protein, 57 aa, Triticum aestivum
  Clone ID: PAT_TA_56426.pep
PFLDQLLRQRNSKGISQRLRPNHPHTQRTAQERRGLALAMRSSTVDFMSRCWYQYEW

SEQ ID NO: 162009 - protein, 84 aa, Triticum aestivum
  Clone ID: PAT_TA_56427.pep
KVLCFRCFRMEEQLNEQNLKDILPGIATLGCFNISTSQTFLILTITVKRFATIDNMNLILYISYQIYFCNVFFILFEVAYFLRN

SEQ ID NO: 162010 - protein, 73 aa, Triticum aestivum
  Clone ID: PAT_TA_56428.pep
NLIRAPDPLATHPRSQPFRFAATSVLSPSLVSLPPPLPVLPPPPAPCCWFPTYARHYPLRTRGRGRGRARWLR

SEQ ID NO: 162011 - protein, 95 aa, Triticum aestivum
  unsure (1)..(95): unsure at all Xaa locations
  Clone ID: PAT_TA_56429.pep
RRRPWRRRCRCRPWSCRRRRVARARXLLCVPATARAPREMAAEVAAAAALGADLAELRLDRLAWFGPRRDLSALLGKTCTLPALVHTRPXWEGGD

SEQ ID NO: 162012 - protein, 79 aa, Triticum aestivum
  unsure (1)..(79): unsure at all Xaa locations
  Clone ID: PAT_TA_56430.pep
PRFDITHVLXWDLDGGGRRDLRRGARGKGSVGCYSAGAGEEPGCSWDTSVGRRGGNGREEEGAGWRRRHRYGRCLREGF

SEQ ID NO: 162013 - protein, 69 aa, Triticum aestivum
  Clone ID: PAT_TA_56431.pep
ALLVLIPMVMRLLSPRGSQITTTTVAGTGLCDGHDARAMLACVEFFFCFFFDQGIGPSSAAWASRVDFV

SEQ ID NO: 162014 - protein, 64 aa, Triticum aestivum
  unsure (1)..(64): unsure at all Xaa locations
  Clone ID: PAT_TA_56432.pep
SLKSLXENERXXCQXXENKNHSHHCHTGDVNWSFISSEQRETSLYIGMFFFVVIAFCSPSYMIN

SEQ ID NO: 162015 - protein, 133 aa, Triticum aestivum
  Clone ID: PAT_TA_56433.pep
MDTDVISGRDAMAPAAGDGGARGKAGSRKHLSSIANYVLHQCSLTLHKSVDDLLADFESGLKNAALDNYSRRLVEYCSLQALQSLTSPDLGDTLHEGSLGRVTFDMMLAWETPTSSDQQITMGRIAKERENRK

SEQ ID NO: 162016 - protein, 40 aa, Triticum aestivum
  Clone ID: PAT_TA_56434.pep
VDHASADAQSGKGKKGSAWHRMKWTGSMVKLLIIVLSYTG

SEQ ID NO: 162017 - protein, 110 aa, Triticum aestivum
  Clone ID: PAT_TA_56435.pep
DYEAEVWAFKYRIDLSALKASLPLDLRVRCLRKIAVLDKHELLIELDAGHLVHCDIDGKFLGHVKCSECEESRVHITPYRFQENIIPLPLLEMQDDYVIPEAEDDDEIHY

SEQ ID NO: 162018 - protein, 45 aa, Triticum aestivum
  Clone ID: PAT_TA_56436.pep
GPRPAPRRRGVRQGRGRVAWHRSSRSGGPSSLLPSLRLVGEFGVG

SEQ ID NO: 162019 - protein, 63 aa, Triticum aestivum
  unsure (1)..(63): unsure at all Xaa locations
  Clone ID: PAT_TA_56437.pep
PRLVFITDPQPSCTHKSSGPPXQAIPNTQIEAPDGIDGTGYQRCVAEELALYLPPFARLIKNS

SEQ ID NO: 162020 - protein, 183 aa, Triticum aestivum
  Clone ID: PAT_TA_56438.pep
ASYLRRLSELVRRGARSPPHLYSPYQPPPGLPIPKDRDGSGRIGTIRGAYPVTWRGSVLKGPEGGDGSGRVEQVAAYLIAGCRRRFAPAGRDRAAIDRRLRAESAPSWLAAWRALVMRCVYSGRGRPGYFPPGRSAASLSTPRVRRAYARAFFFACEVSCLCGTVSFCSGESLRGVPCLLRLH

SEQ ID NO: 162021 - protein, 52 aa, Triticum aestivum
  Clone ID: PAT_TA_56439.pep
GSAGPSPAPAYCSASSPWPPRSCASRQASAPQTILSSCAQATAMMLLLSRAE

SEQ ID NO: 162022 - protein, 99 aa, Triticum aestivum
  unsure (1)..(99): unsure at all Xaa locations
  Clone ID: PAT_TA_56440.pep
QSGLCVCAAQNNYNTKHLAKILIHLVWXCLQECTSASSVSSSVYRKAINAGYISSIFLKFIIENAQADNWEELCLCIDKDEKGLEKFPSDQGXEYFLMK

SEQ ID NO: 162023 - protein, 126 aa, Triticum aestivum
  Clone ID: PAT_TA_56441.pep
QHKQKELASCGSKGGAMAQAIVERACAKLRSAIGDEAVVRLNFTTDLHDLLEALEDIQPFLDKAVMRPFRDSWLSLWLGGALNAAYKTIDTVDELQDARSATMTRRMKNALAIQVQEGKKLVMWAY

SEQ ID NO: 162024 - protein, 54 aa, Triticum aestivum
  Clone ID: PAT_TA_56442.pep
LIAGHQTCSQYEHAHSRLESLVFYYSGTCQASTMACRIFPMLSSLRLQRFAQVR

SEQ ID NO: 162025 - protein, 51 aa, Triticum aestivum
  Clone ID: PAT_TA_56443.pep
SHRCEPRKRPICRTEQLLSCGSTESIWPDHPSSRCCFSYTEMSTLGSLQRQ

SEQ ID NO: 162026 - protein, 137 aa, Triticum aestivum
  unsure (1)..(137): unsure at all Xaa locations
  Clone ID: PAT_TA_56444.pep
ALEIEGIVKQLSTAGEHDKIAAVIGLLTNDFXYSPQANHRKGGLIGLAAVTVGLTSEAAQHLELIGPSVLNSFLDQDSRVRYYACEALYNIAKGVRGDFIIYFNKIFDALCQLSADSDANVQSAAHLLDRVVKGIVT

SEQ ID NO: 162027 - protein, 89 aa, Triticum aestivum
  Clone ID: PAT_TA_56445.pep
LVCFTLVLLLTLVTTFLCYCNHRNRAGHAHRQLVSSWFQNKRETHPTLLRGKSRTRITYRQLRQRRREADEHPSLVPSKDGEEITTTHD

SEQ ID NO: 162028 - protein, 107 aa, Triticum aestivum
  Clone ID: PAT_TA_56446.pep
PPLYYGGSSTGLGEKGNVSFAFTSFSQMQKQDPKTCAFDGQGMIPFLDPSRGESPFFVGINDSKSFGAPSSGHCCGVFCGGSIFPLWVFMHLRMMGSPPRWKWSVGA

SEQ ID NO: 162029 - protein, 50 aa, Triticum aestivum
  Clone ID: PAT_TA_56447.pep
LPQSVDFEGDLQKEDSQVLRLASPVQNTVACVDPARLSMLLLRRVYDQLR

SEQ ID NO: 162030 - protein, 38 aa, Triticum aestivum
  Clone ID: PAT_TA_56448.pep
EAVMKETKKLQELGGRVSELENVHHSLAEELQKRYICP

SEQ ID NO: 162031 - protein, 108 aa, Triticum aestivum
  Clone ID: PAT_TA_56449.pep
DAWADAWGRGEGAELELAMSLHVAAAIHCGLGRHADAVPVLERAVAVVTPPAPAAEGEEVPQPEEEQVVDERKGEEWALAAFFGWMQLGDTHAMLCRMDESIACYRKG

SEQ ID NO: 162032 - protein, 77 aa, Triticum aestivum
  Clone ID: PAT_TA_56450.pep
RPALLPHRHGPCDDEVWSPQKRGRRQEVEDGWMWGRTEAEAGDWRQVGGEMEGGHCHGRPLLLLAAALSYPLHCSRP

SEQ ID NO: 162033 - protein, 185 aa, Triticum aestivum
  unsure (1)..(185): unsure at all Xaa locations
  Clone ID: PAT_TA_56451.pep
STGRYSAAGDGGPRGRAGTGRSGGGAPPGLRLPLSTVAVKPKRRSSKLVQTQPQPDARIPGTQVPPPPSADPLTTRVLTCCLRSMLDLICFLILVVSVLQTIYVKTFGCSHNQSDSEYMFGQLSAFGYAITEEPEGADLGLINTCTVKNPSQSAMSTFIXXCSTXXKPLVVAGFVPPGSPDLKEL

SEQ ID NO: 162034 - protein, 61 aa, Triticum aestivum
  Clone ID: PAT_TA_56452.pep
NGGSMSYSTACLTNAPRLKYFFTRRESSSALLLWSRGESRPRAPPGGGAGAGPTTSRRTRG

SEQ ID NO: 162035 - protein, 38 aa, Triticum aestivum
  Clone ID: PAT_TA_56453.pep
LNHQLYKIVLSSIEFNLVDHYQLLLPTEAPVKKLTKPP

SEQ ID NO: 162036 - protein, 67 aa, Triticum aestivum
  Clone ID: PAT_TA_56454.pep
LCQLGVAWLAPLHLASSRIWFCLQVNKEYQCTLAVDYALGLSPTMPFSFVQHIPGTAKTEPESAPIS

SEQ ID NO: 162037 - protein, 61 aa, Triticum aestivum
  Clone ID: PAT_TA_56455.pep
DPLISRSRLAVSASSPELCPNGSASVNPAFECARVMPERREFDVPALEDANLQALTSPDTH

SEQ ID NO: 162038 - protein, 63 aa, Triticum aestivum
  Clone ID: PAT_TA_56456.pep
EHEVGMYNSTKVARAEQVRAAAIAVLLITISLAAAGHGPASAFRAPHAPPRRAAHGHGPPPPH

SEQ ID NO: 162039 - protein, 49 aa, Triticum aestivum
  Clone ID: PAT_TA_56457.pep
HRYLYSTDRHPHHRCDLGRERRGRIRNLRVVHSGGSRTHPAGLSYTWRP

SEQ ID NO: 162040 - protein, 66 aa, Triticum aestivum
  Clone ID: PAT_TA_56458.pep
RLMGGRQRHVLGFHRRLLSVIPRRLADRQPGVLGLLGGCLGVLRVRAAGEDRDVLAFKLPSQRAVG

SEQ ID NO: 162041 - protein, 50 aa, Triticum aestivum
  Clone ID: PAT_TA_56459.pep
MESLIQSLRLMPRSRRTLITCQRRESPEAIGLMITHASMPSTKPLSSAEG

SEQ ID NO: 162042 - protein, 97 aa, Triticum aestivum
  Clone ID: PAT_TA_56460.pep
FLECSALPGIAQTCVPGQACGHHVLFFPLIHANKCHMNTPPGKTHRKSSQPATRSLDEINTWIDEQKTSTHSVLVLDDLTEERNLFFSSDREIKYYY

SEQ ID NO: 162043 - protein, 129 aa, Triticum aestivum
  unsure (1)..(129): unsure at all Xaa locations
  Clone ID: PAT_TA_56461.pep
GDGGARRKGAATAEKPGKVEEQRRRKTLKSGVVLYFHTISPGQNDAPNDNYFGTEGVIRSCMRISLFLIGVETFDLRLSLNTLVTRMAVLPIDMGTVGILPEXKKKKKKKKKKKXKKKKKKKKKKKKXK

SEQ ID NO: 162044 - protein, 44 aa, Triticum aestivum
  Clone ID: PAT_TA_56462.pep
LSQGIGVLLAASCPITSASLVCSKKLFSWLSSLHKGYKFYGRVV

SEQ ID NO: 162045 - protein, 96 aa, Triticum aestivum
  Clone ID: PAT_TA_56463.pep
PSPTRTLLSDDLPERPGSSPPLPWRMASTPPRRLRLCRCPTFRNMLHSALGLKRPTATRNGDLCHIQPRRRAAALVQGHSLQQPHHERGRYAHLED

SEQ ID NO: 162046 - protein, 78 aa, Triticum aestivum
  unsure (1)..(78): unsure at all Xaa locations
  Clone ID: PAT_TA_56464.pep
LCIHQLISAFLCKHQLIRGVKVRAQQDLAKHKNASPEKGGASDVKAGGEDGXCKEKPPHGVRRSRQEAASMNQMAGSI

SEQ ID NO: 162047 - protein, 99 aa, Triticum aestivum
  unsure (1)..(99): unsure at all Xaa locations
  Clone ID: PAT_TA_56465.pep
ARRRNTSTRERIPTPLAVAADAARCPWASDSCLTPTPPPPSGPSPPPRPPPPAPXPPHMKKXNSPPPPAAPAPPPGPPRRAGSTWTRAAAGGAMGGGGP

SEQ ID NO: 162048 - protein, 147 aa, Triticum aestivum
  unsure (1)..(147): unsure at all Xaa locations
  Clone ID: PAT_TA_56466.pep
SPGPDRRRPCPAPHXARPAPGPPIGPNRPGPTMPGPPFLAPKGCVKKGSSKGSLPPPKRPGIGAPPRRPNPANGSPAPKGPXPPGPPALHLYGGVCRQERIPRACRDTIQESTARACQARLPGSPEAGGGGGGGCWGRRSCLAGTAL

SEQ ID NO: 162049 - protein, 39 aa, Triticum aestivum
  Clone ID: PAT_TA_56467.pep
VNKRMGNFHHKSHLAITNLNIRIKEQREEKSPYLLQLFS

SEQ ID NO: 162050 - protein, 149 aa, Triticum aestivum
  unsure (1)..(149): unsure at all Xaa locations
  Clone ID: PAT_TA_56468.pep
MDAHQTEPLIVTGHRFGHVQIWNSNMQKVVTSIKASWDTVCKVKFIARKGWIVAVSEDCFVHVYKYEKELKKVTGFKSHDYDNTMCSLDVHPAQPYVLSGCDRQIKLWDWDQDWELHTDILKNTQXXLMKVKFNPEDTNSFASASNDRT

SEQ ID NO: 162051 - protein, 104 aa, Triticum aestivum
  Clone ID: PAT_TA_56469.pep
GSGACAPRTVPRGVAATENGGDPDLAPPVSPTARIDFHASTRHLRSNRAPRIRRIGWTPLLCISLSHQLLPPSRLDPSSHSSSLTLAATAQEWLAGGGPTMKMS

SEQ ID NO: 162052 - protein, 74 aa, Triticum aestivum
  unsure (1)..(74): unsure at all Xaa locations
  Clone ID: PAT_TA_56470.pep
MALNKEYTYADLEKEXYWPFEKLRISITGAGGFIASHIAXRLKGEGHYIIASDLEKNEHIGEDMFCHEIHLADL

SEQ ID NO: 162053 - protein, 79 aa, Triticum aestivum
  Clone ID: PAT_TA_56471.pep
NFTPSHTLTLMTGTLLAGYHSFVGFFHAALTLLHLPRYPSKPGWHVFITVRRLLDHFPPLDPIPYRLEQFEILACDGMP

SEQ ID NO: 162054 - protein, 100 aa, Triticum aestivum
  unsure (1)..(100): unsure at all Xaa locations
  Clone ID: PAT_TA_56472.pep
LIRRRTDDDIKLANSVDVASLRHPEQDAERVKNPEWLVVIGVCTHLGCIPLPNSGDFGGWFCPCHGSHYDISGRIPQGPAPYXLEVPTYRFLEDNKMLIG

SEQ ID NO: 162055 - protein, 113 aa, Triticum aestivum
  Clone ID: PAT_TA_56473.pep
LSRLAAGRPAGWLIWREASLLPYSCSAAGCSAGELKPQGQSVRLRAITTYMSFEEICASSSVEENEAGVCKWPEIQAPQACVPRHLCGGSSLEMGQGITVQSWYPPTRAIGLE

SEQ ID NO: 162056 - protein, 157 aa, Triticum aestivum
  Clone ID: PAT_TA_56474.pep
VQLTELGDLVLFDADGTLVWSTNTTEKSVAGMNLTSTGNLVLLNHANMELWRSFDHPTDTLVTGQVLQEGQKLMASTSMTNWASGKFYLTALPEGMHAFAGTDTPLSYYQSPTGGTVMTNRAAYVALKKGSREGGTCFRDTEAPDYQIQLPKEDYGL

SEQ ID NO: 162057 - protein, 42 aa, Triticum aestivum
  Clone ID: PAT_TA_56475.pep
YTVDIVYQERCRSAITESPSVINISLSMISIRDTYECIYTYS

SEQ ID NO: 162058 - protein, 162 aa, Triticum aestivum
  Clone ID: PAT_TA_56476.pep
MEGSFPASSLHPPAVAPATTRCAPWVLLDSRAYFAVCKNATTAEATTSTSHMVKVSFCLSDPPAISHFCVFGPELKHEDFMMEPLVLFSAKDLVLLRLAFTVGPRSTHKDSRLAEYFLYKAGRGKPSLEPIPVTPPGTRNSFPSASCRPTTTGEICHRRISA

SEQ ID NO: 162059 - protein, 71 aa, Triticum aestivum
  Clone ID: PAT_TA_56477.pep
MAKLHFFLLLLLAAAEAIHGEDGAYIGVNIGTGMSSVPAGTQITTLFRSQNIRHIRLYDADPGMLSALANT

SEQ ID NO: 162060 - protein, 91 aa, Triticum aestivum
  Clone ID: PAT_TA_56478.pep
PAILTASGRHRSTPFETEVQTGQWSRGFWGAEGGRAGPKTLTPPDPRRAGPWRWTRRRPRPRRQWRRRATSTLSPSGFGRSTGGSERDYFF

SEQ ID NO: 162061 - protein, 84 aa, Triticum aestivum
  Clone ID: PAT_TA_56479.pep
QRFLNLVKYTQPDMLLSHLNSQKSLFQYLVLVHKAYISLSICLLRPRTLSVLLHQIILCPAPSNGNRYNFAHKKKPRSFDASAL

SEQ ID NO: 162062 - protein, 140 aa, Triticum aestivum
  Clone ID: PAT_TA_56480.pep
YSMVSTYPNIRPAYRNGEAYPASGPLPVPASDACVGSCGRCYQYTSCVVEGTGGALYTSFCGSNLLEIGQRHPQHSRQVARICARAWILLFPYHLLPIPHTATSTSYRYLGEQTTTASMLKVLQTCRGRMESQQEVAARL

SEQ ID NO: 162063 - protein, 138 aa, Triticum aestivum
  Clone ID: PAT_TA_56481.pep
RMFRSCQRRRRTSAGLGVDGRRSTSGGADSSGRAEEMDWEGRAAFTSAWVLPVDHPLVRRVRPATTEARAAALRDLLVLWSSRRAETPRSRPPQPYAVAEASFVDMQFRDVLVELHIYIGEGRAEGIGFKLSVPINPK

SEQ ID NO: 162064 - protein, 138 aa, Triticum aestivum
  Clone ID: PAT_TA_56482.pep
PGDHKRLLVHAHENGNGHGHVHANGGGAEELKAAPEVEQKEEEKTPEEPTVAQEEQQRHKSIFFDPAKVPDIITEGSARYLVTGTMRSGDEKEAAGETPSTKDKQLEAHENGNGQEINHGPSNGEVENGTHSNGSHQV

SEQ ID NO: 162065 - protein, 159 aa, Triticum aestivum
  unsure (1)..(159): unsure at all Xaa locations
  Clone ID: PAT_TA_56483.pep
KRVQFLIEGLFAIRKAKFQGFPAIRPELDLVEQEDQFTHDMSLETELDPETNLNVFRVNPNFAEDEKAYENLKKSILGEDDEEEEGSDDASDGEDEEESDDEEDEEQMEIRDITETNLINLRRTIYLTIMSSGDFEEAGHKLLXKLNLNPGQEMELNIM

SEQ ID NO: 162066 - protein, 62 aa, Triticum aestivum
  Clone ID: PAT_TA_56484.pep
STDQASNSSTIAVIQGDAGVSETAGEPSNAGSSRTLRRGRSSALASLDVDGAPPQRNKRRRM

SEQ ID NO: 162067 - protein, 168 aa, Triticum aestivum
  unsure (1)..(168): unsure at all Xaa locations
  Clone ID: PAT_TA_56485.pep
LAPPLCAGYDAAAWLALHPPPERRGRVSAAAAYSEERERRRTAPWRDGRGRKRTPRWRGVXTXXAXRKRLRRGXRATEDQARHRRGPXCXRQGAHSPAEGSPRDNKGAGPLRKKGAGTRTYLRGAAALRPILPQGASGRSGLGXERAGSFEGPAXSAYLXPSWTLSGE

SEQ ID NO: 162068 - protein, 96 aa, Triticum aestivum
  unsure (1)..(96): unsure at all Xaa locations
  Clone ID: PAT_TA_56486.pep
MTIKIPAICVQHRRRLCTRGTNENHSHAXEAKGGQNWGHDNGXLWWPLVRRDSLYAGGXEYIERLGNMTTNRTGDLRSAGVAQVLAGGRGGSNFFG

SEQ ID NO: 162069 - protein, 232 aa, Triticum aestivum
  unsure (1)..(232): unsure at all Xaa locations
  Clone ID: PAT_TA_56487.pep
KAWEVDTLRGHMNNVSCVLFHAKQDIIVSNSEDKSLRVWXATKRTGIQTFRREPDRFWVPGGHPGMNLFAAGHDSGMIVVKVEKKAPAFXVRGNPGFIVKNRFPRFYKSFTQKXEAQGAPIRSPGSVSLNQSPRTLSYSPTENAVXLICSDVDGGLIRAFSLVPKILLARADYLQDAKKGSGWVLXVFIAPEQVLQSWEKSSNQVXWVKSLKNEIVKEKPSFLLEPDGYLLC

SEQ ID NO: 162070 - protein, 174 aa, Triticum aestivum
  Clone ID: PAT_TA_56488.pep
LGVKSELSGYELPGLCENSFISSMEPIVKKLHTRTLNCNGGLAPCSRQRKKRDSSEKVLEEDGYKNDEGIPYPSRQKRKKKTATDSIETALEEDAPGLLQILLDKGIVVKEIKLYDVVEDDEMLPDCTESDFQDLENVITKLFPQRTSLLKSVAKHGKGGKAIYCLTCLNSLIE

SEQ ID NO: 162071 - protein, 34 aa, Triticum aestivum
  unsure (1)..(34): unsure at all Xaa locations
  Clone ID: PAT_TA_56489.pep
PTLARRSNISILLLKDRSGSRDPRMRXSNGPDLV

SEQ ID NO: 162072 - protein, 72 aa, Triticum aestivum
  unsure (1)..(72): unsure at all Xaa locations
  Clone ID: PAT_TA_56490.pep
AALEGGAHQHGGNNSDALEALLGAGGKKKEISFATFATGIVHGLQPDALMIILPALAMPSRAAXAXAFLGXF

SEQ ID NO: 162073 - protein, 47 aa, Triticum aestivum
  Clone ID: PAT_TA_56491.pep
CQAGVVPVCGPGREVPSFGPVRRGRPAQGAVLVDAGAGACCPRAADA

SEQ ID NO: 162074 - protein, 126 aa, Triticum aestivum
  Clone ID: PAT_TA_56492.pep
ARFREHRLTWNMIWCLKRLPTLSSVADGRSSSSAGRAQSSSGEKRPKSRRKIRRASRTRNGQGAATCRTRRSYRTATPTERPMMRGRSILHTYGSTRHSSRGSRMARTTTSANHSTPRARRPPRTP

SEQ ID NO: 162075 - protein, 103 aa, Triticum aestivum
  unsure (1)..(103): unsure at all Xaa locations
  Clone ID: PAT_TA_56493.pep
LRENGDPAPTPGFSKLTCFEGEHAIFGNLGRXTGYGPFLKTGKSFAADVNLEDLGLNXFWKKGTDPADVDKLPNYSSGAVXTFLEFFKSEIKGEMKDAPGVNA

SEQ ID NO: 162076 - protein, 43 aa, Triticum aestivum
  Clone ID: PAT_TA_56494.pep
CPPVQSNARRRRSSWGLVSLVHLGFITLWMECFCAIHRTDGRR

SEQ ID NO: 162077 - protein, 112 aa, Triticum aestivum
  unsure (1)..(112): unsure at all Xaa locations
  Clone ID: PAT_TA_56495.pep
KDYTAEKAKETNDSVAHKTSETAEATRNKLGEAKDCTVEKATEAKDTVAQKTNETAEATKNKLGEYKDALCXKTQEAKDSTMQKAHQTKDAAAEKARQAKDVTQQKGGEYTD

SEQ ID NO: 162078 - protein, 63 aa, Triticum aestivum
  Clone ID: PAT_TA_56496.pep
PAARPPLTFGTKPKPPSLNRSQVARKSISSSLVSPVPIQSPSIADASKQTGAEHRELSRGDRG

SEQ ID NO: 162079 - protein, 48 aa, Triticum aestivum
  Clone ID: PAT_TA_56497.pep
QKPRIYVEPCVQITNNLNKQLEPGATPGNVDDEAVADVVACEPGQRVV

SEQ ID NO: 162080 - protein, 86 aa, Triticum aestivum
  unsure (1)..(86): unsure at all Xaa locations
  Clone ID: PAT_TA_56498.pep
TXIHTYIHTWTDERRGVSAGSTVAVTSACLAISPAGLVVEDLHLGVYGLGGDGGGLVVRHGAGRRRRGESARGRGRKEESWLRCAE

SEQ ID NO: 162081 - protein, 59 aa, Triticum aestivum
  Clone ID: PAT_TA_56499.pep
RGTAPPPPRPAPHAGSVRIAGRPRPGKMARAVSLHNFSSKQENVDFGISTMIRAEIPPT

SEQ ID NO: 162082 - protein, 58 aa, Triticum aestivum
  Clone ID: PAT_TA_56500.pep
THELAKEKRGGATPWSIGRPGACVEAGAETTLNGPRFGQGALTLAFSFTYLLVERQQQ

SEQ ID NO: 162083 - protein, 39 aa, Triticum aestivum
  Clone ID: PAT_TA_56501.pep
EQKPRHYAKFANRVDNQQSNAIHRKALLAPHEKSHAGRG

SEQ ID NO: 162084 - protein, 43 aa, Triticum aestivum
  unsure (1)..(43): unsure at all Xaa locations
  Clone ID: PAT_TA_56502.pep
RSQKWRREASASRPRDAGAARSPSFGPNAAXVDSSLLSRTRGD

SEQ ID NO: 162085 - protein, 138 aa, Triticum aestivum
  unsure (1)..(138): unsure at all Xaa locations
  Clone ID: PAT_TA_56503.pep
EHLGRHMAPGAALVVRSAHGARGFLYPVVDPEEIRRGGFEVLTVHHPEDEVINSVIIARKAAAPAAVAADGDVPVNNGGMPAQCAXAXSKPCLGCACELGTRAHQKMKEMAXEEMEGVASGLPADIGIRQSTGMNSPT

SEQ ID NO: 162086 - protein, 53 aa, Triticum aestivum
  Clone ID: PAT_TA_56504.pep
SRRPLPPPTVPPWSVRPALAPPNIDSALKSPRRSVVDQSSQQRIQNRHVGTSP

SEQ ID NO: 162087 - protein, 53 aa, Triticum aestivum
  unsure (1)..(53): unsure at all Xaa locations
  Clone ID: PAT_TA_56505.pep
MGGASPLEAIQLQIVVMNMLMGASTVSSILSTYLCWPAFXTKAFQIDDSVFAD

SEQ ID NO: 162088 - protein, 67 aa, Triticum aestivum
  Clone ID: PAT_TA_56506.pep
MASPALISDTDQWKALQAHVGAIHKTHLRDLMTDADRCKAMTAEFEGVFLDYSRQQATTETVDKLFK

SEQ ID NO: 162089 - protein, 166 aa, Triticum aestivum
  unsure (1)..(166): unsure at all Xaa locations
  Clone ID: PAT_TA_56507.pep
ILQDGSAEPISIPLALLQNITENFADERKIGQGGFGVVYKGVLQNGYVAVKKLLNSRTIDDGLFYRETNXSMSVKHQNIVRFLGYCANTENIAIKVDASGKCGKYLYPEIKERMFCFEYISKGSLHNHLTDELRGLEWHTRYQIIKGICDGLQYLSKEKDIVHMGS

SEQ ID NO: 162090 - protein, 76 aa, Triticum aestivum
  unsure (1)..(76): unsure at all Xaa locations
  Clone ID: PAT_TA_56508.pep
MVPLRRDDGVQWAHGRAREDRVHVXVVSEDQRWLFVGIYNGFNGPEAPDFLVXNLYRFLLHELRGIFYQEADRDSK

SEQ ID NO: 162091 - protein, 56 aa, Triticum aestivum
  Clone ID: PAT_TA_56509.pep
TWMYLLTIKDCHSAAVHIYTCIPAKKTFVKLSGYFTYTHIFSCHMSRLYYTMELII

SEQ ID NO: 162092 - protein, 91 aa, Triticum aestivum
  unsure (1)..(91): unsure at all Xaa locations
  Clone ID: PAT_TA_56510.pep
MSRYEYLGXEXSMYLKKXXYNPDKVPFAPISGFEGDNMIERSTNLDWYKGPTLLEAFDQNNEAERPSDKPLRVPLHEGYKIXGGIGTAPVG

SEQ ID NO: 162093 - protein, 45 aa, Triticum aestivum
  unsure (1)..(45): unsure at all Xaa locations
  Clone ID: PAT_TA_56511.pep
MESKGGKKSSSSSSLMYEAPLGYSIEDVRPAGGAQKXSAXYXXCA

SEQ ID NO: 162094 - protein, 52 aa, Triticum aestivum
  Clone ID: PAT_TA_56512.pep
HLWLQKGHTVISAKDIPAGGRNLGSSFPGLGDEPLFGDPGGELGAQVLGRGL

SEQ ID NO: 162095 - protein, 207 aa, Triticum aestivum
  unsure (1)..(207): unsure at all Xaa locations
  Clone ID: PAT_TA_56513.pep
LKLFEVMASKSKIYFVLEYAKXXAKLFNKITKGKLSEDAARKYFHQLISAVDYCHSRGVYHRDLKPENLLLDENENLKVSDFGLSALAESTRQDGLLHTTCGTPAYVAPEVLSRRGYDGAKADIWSCGVILFVLVAGFLPFHDTNLIEMYRKISRAEYRCPRPFSVELRDLLYKILDPDPSTRASVSRIKRSAWYRKPGRCKWTGDL

SEQ ID NO: 162096 - protein, 69 aa, Triticum aestivum
  unsure (1)..(69): unsure at all Xaa locations
  Clone ID: PAT_TA_56514.pep
LSLTAXRXRAAVSPALGTPIDIRYPAALPGSNSRTRQAALRPTFESLLWPLQALSSALQAAGLLVVDIL

SEQ ID NO: 162097 - protein, 79 aa, Triticum aestivum
  Clone ID: PAT_TA_56515.pep
HVNIMSCVFFLQDVVQGFLFDVLIYAMLSCRWPLGLSEEQQCNAFELRYKKSYLKGDEMMFIKMKLKRVGYHLLVIHHI

SEQ ID NO: 162098 - protein, 144 aa, Triticum aestivum
  Clone ID: PAT_TA_56516.pep
MDISSFFTSLLTSFLIFAVLVLVFTWLSRRPGNAPVYYPSVLLRGLDPWEGRGRGTRSPVGWIRQAFAASEADVVAASGVDAAVYLVFLSSVLAILAFSAIVLLPVLLPVAGTDHALEDSTGRVPRNVTDFERLALGNVQDRSA

SEQ ID NO: 162099 - protein, 120 aa, Triticum aestivum
  Clone ID: PAT_TA_56517.pep
RTRGPPHPLARFAPTLCVLRLGGCRFPGPAAPPPPSFPRLKQIMLFNVGISEDTLQSVISGCAVLQSISLHNMSFGRLCISSPTLRSISVEGVFTFRELVIDDAPCLERLLPIYPDDGAG

SEQ ID NO: 162100 - protein, 46 aa, Triticum aestivum
  Clone ID: PAT_TA_56518.pep
ELVEQWNTTLSQWCVRSKDGSRRGIGHREWGRPRCSSSSQSHRAHR

SEQ ID NO: 162101 - protein, 89 aa, Triticum aestivum
  Clone ID: PAT_TA_56519.pep
FGYQLLNLRIIQNVLPNCTSLAYDHWAMSFDFTTAMDKRRLKLGQTTMSGANREFYYCYGQKKAKAGKDNNVRSQPRILLLLWTKEGSS

SEQ ID NO: 162102 - protein, 36 aa, Triticum aestivum
  Clone ID: PAT_TA_56520.pep
TCMKILLYAMSERSADHQRRCVFSVRAEEMDCEGYG

SEQ ID NO: 162103 - protein, 50 aa, Triticum aestivum
  Clone ID: PAT_TA_56521.pep
RRFELLWSSSIGMDMFIYISIFMGRINSVIGSCYGCYCSYAICVYLHALG

SEQ ID NO: 162104 - protein, 107 aa, Triticum aestivum
  unsure (1)..(107): unsure at all Xaa locations
  Clone ID: PAT_TA_56522.pep
HMARLPSIDPNTRTILICGYPNVGKSXFMNRXRADVDVQPYAFTTKSLFVGHADYKYLRYQVIDTPGILDRPFEDRNIIEMCSITALAHLRAAVLFXLDXSGFLGYT

SEQ ID NO: 162105 - protein, 147 aa, Triticum aestivum
  unsure (1)..(147): unsure at all Xaa locations
  Clone ID: PAT_TA_56523.pep
DQNILLDQNHVAKIGSYNIPILGEAAKSEGGAGSRHQTDSTMLGDKIDIFDFGVILLELVSGKPITSIYEVEIMKELLLWAMAEEDRARRRSFVDPAVSKSCSEESLRTVMEICLRCLAKEAVHRPSVEDVLWNXQFATXVQDDWEG

SEQ ID NO: 162106 - protein, 145 aa, Triticum aestivum
  Clone ID: PAT_TA_56524.pep
HSGSIQRASTIRKATRDLIVLPRVETNTHNSSELQSMMNLTRHSKFNYADPKIQTESSIQTSCSSTLQSCTKSIESNRDLHFGLPVYPPVSLHQTKSSFAPMPLNLSIVKAGDLLDLLGLPNPFRSTVHQTTITCYLNIVSNLAC

SEQ ID NO: 162107 - protein, 110 aa, Triticum aestivum
  Clone ID: PAT_TA_56525.pep
KIAVIGQGFHYGFLSPLQPLFYLFCNHQNAITSSAHSQCSLNYTRQDRFVQTSTNQTSINPQSRHLWKLASQRIMLFCLLLQFRKKKWLAAMEVITIQRRAFHPYCIEWP

SEQ ID NO: 162108 - protein, 105 aa, Triticum aestivum
  Clone ID: PAT_TA_56526.pep
GGSSSRLLNLAKAGFSPWRLCWATPRLFHLGRCKKKVSGRKLGYVILDLLEAHALFFFFFFLFFFFFFFFFFFFLYAKLNLLYCKVEFTQCVHKFNQQVVSSKHT

SEQ ID NO: 162109 - protein, 186 aa, Triticum aestivum
  unsure (1)..(186): unsure at all Xaa locations
  Clone ID: PAT_TA_56527.pep
MVLGGCGNGADGARSDQFNGGSSTGQRQQHGGPPLDWEDAIAKILDPKSALSAIDEVSKFRECQGRFGTRLAQEAAARMEPTQWWFQFGGDVPALQKCAMRICSQCVSSSGCERNWSAFALVHTKQRNRLLYDKLHKLVSVRYNLKIRAEEDQEKERDIDKEVDPSALLIDTTMFDETXXHMEWLN

SEQ ID NO: 162110 - protein, 75 aa, Triticum aestivum
  unsure (1)..(75): unsure at all Xaa locations
  Clone ID: PAT_TA_56528.pep
PLKRPPLFFFFFFFFFFXXFXFFFXXFFFFFFFFFFFFFFFFFFFFKSLTRCALPLFIVSEIAHHSDRPMANCMK

SEQ ID NO: 162111 - protein, 113 aa, Triticum aestivum
  Clone ID: PAT_TA_56529.pep
FILLFYRSSLRGATDQMGAVVKAAKAWQVAWVSMWVVPPCCSGRALWCCSWRLSEGDRVQNIKNLGATWVWISKPCPFGLAKEGLLSFFYNAMNISEFLHWFQPMLNIFPTFL

SEQ ID NO: 162112 - protein, 108 aa, Triticum aestivum
  unsure (1)..(108): unsure at all Xaa locations
  Clone ID: PAT_TA_56530.pep
AGALPTDAASSPSPTSSSKLRNLLWATSKHDVYVMQNYSVRHWWSLLRRGKEVLNVACPNQDMQGRSXPCTGXKISTMTVKDNLLXLGGFHGELICNASHRRSISRSA

SEQ ID NO: 162113 - protein, 99 aa, Triticum aestivum
  Clone ID: PAT_TA_56531.pep
TYEILKCSTVMVTYTREPVLFSQIPRGPKHSGGRMLPVDILVMNQIREGGREGALLKRGIFGGCSPSNSNGIPILSKKGEGLTKSMFFSYQVPSAIVQQ

SEQ ID NO: 162114 - protein, 175 aa, Triticum aestivum
  unsure (1)..(175): unsure at all Xaa locations
  Clone ID: PAT_TA_56532.pep
RILQKHYPVLFRGVNGTVAHEFIIDLRGFKATAGIEPEDVAKRLMDYGFHGPTMSWPVPGTLMIEPTESESKAELDRFCDALISIREEIAQVENGKADAHNNVLKGAPHPPQLLMGDAWTKPYSREYAAFPAAWLRGAKFWPTTCRVDNVYXDRNLICTLQQASQVAEEAAAATA

SEQ ID NO: 162115 - protein, 76 aa, Triticum aestivum
  Clone ID: PAT_TA_56533.pep
WIKTWSSWGPGSSSTQAASGAVQCQLLDILHPGLVLMHKVNFDAKTEYDMIQNYRILLDVFNKLQIGKVWVVILLA

SEQ ID NO: 162116 - protein, 247 aa, Triticum aestivum
  Clone ID: PAT_TA_56534.pep
DAWAESQTKVSRVEKKKRQQRRESESSLAGSRDSIILRTAAQMLAFCQAGGVKKKRTVRVRRSSYVPIMNIEMNRAQVLPRLSQSCLEALYESPGFNFFTKKRSRRVRRHYHRPDGFFQPIENRKFYHDVYSEATEKSSQNSQYKSTPYMDFLQRVASGLKYLDLNTEPVHTNEMYPSLTTSAVVPFGATCSLSNSLVPFGSQMIFPYEMPLHLVKKQRPRAKVDLDFETTRVWDLLMGKATDVPVD

SEQ ID NO: 162117 - protein, 70 aa, Triticum aestivum
  Clone ID: PAT_TA_56535.pep
WGATRYHLATRRTTTQLDSYLHPSSLTQAQVRMMGSSSTYWRGTQMAVQVLQQPFRAERTPSHRHGSRCS

SEQ ID NO: 162118 - protein, 134 aa, Triticum aestivum
  Clone ID: PAT_TA_56536.pep
RLALPPAETGGVRSGSAVAAACRGTPRLLRCCSLAVGSHREDEEKKRKPSMDQMEVDQQPQQPHHQSEKQIFDRCMRNKARDFRDKSYGTLIQPYEFTCSQNGVLGEKHGFIHYSNKAIAFAGNPEEGFVSTEV

SEQ ID NO: 162119 - protein, 54 aa, Triticum aestivum
  Clone ID: PAT_TA_56537.pep
LDGRPCIHRPQDRYCRRPRPRHPTTRTRGRGRGRGRWLALAMVSSADFIVSLFV

SEQ ID NO: 162120 - protein, 44 aa, Triticum aestivum
  Clone ID: PAT_TA_56538.pep
VSIQASMGSVQATDEPSPARGRPPPGSPRRSTRPPILCATRSDA

SEQ ID NO: 162121 - protein, 27 aa, Triticum aestivum
  Clone ID: PAT_TA_56539.pep
PASWPPASGDHQSKQERVAQQLGIVTT

SEQ ID NO: 162122 - protein, 77 aa, Triticum aestivum
  unsure (1)..(77): unsure at all Xaa locations
  Clone ID: PAT_TA_56540.pep
PPPPPPTHPTPTPTPHTXPRPRTPTSTTSPSPATPPPSPQPQXSITHSQKQSQSSLPARTAQPPVSPPCNSHPETKS

SEQ ID NO: 162123 - protein, 100 aa, Triticum aestivum
  Clone ID: PAT_TA_56541.pep
RPVLDEAPVFHPTEEEFKDTLKYIESIRPTAEPYGICRIVPPPSWKPPCLLKEKSTWENSTFSTRVQKVDKLQNRTSSKKSTRGGMMKKRRKLSEPEEDS

SEQ ID NO: 162124 - protein, 79 aa, Triticum aestivum
  unsure (1)..(79): unsure at all Xaa locations
  Clone ID: PAT_TA_56542.pep
XVLRSKKNPDRGEETTICFIRSPHYYILEIICFLKIYYLLANLLCVIERDFVDLAAARTESIFRSLKHIALMGEIRLFV

SEQ ID NO: 162125 - protein, 48 aa, Triticum aestivum
  Clone ID: PAT_TA_56543.pep
ANRKGTNIEDFIWSAMPAHLPTQANQDDPFMHSKSRMKLFNFIHSCTG

SEQ ID NO: 162126 - protein, 60 aa, Triticum aestivum
  Clone ID: PAT_TA_56544.pep
LNPSIKDTSLKSIIFYFTQSFSRVIKCWETTKFMLYSHMVEATQQVVTEPADKESRNPHH

SEQ ID NO: 162127 - protein, 225 aa, Triticum aestivum
  unsure (1)..(225): unsure at all Xaa locations
  Clone ID: PAT_TA_56545.pep
MAGDRRALCLVAGAILLCSCFSRAQCGDGQEQEREIQRLRSKVASLEDEVGWRKEETSQLESVVRERTAQIVALVSGLEAMQVRNVADDESVVKASTNSAMIEKQIERLGSDLEDQVKKGELLEARASEAEKSLLELGQKLDRVEKINAEQRKKIEELERDLQHSKGKLSEVQRQAKLKAQELANVHGMWLPXWXASRSVHCQELASAKWHLHGKPVLDALREKG

SEQ ID NO: 162128 - protein, 82 aa, Triticum aestivum
  Clone ID: PAT_TA_56546.pep
RRPTRGGGQPHRPFGDRVPGETGQDGDGCLWAAAEYRAGGAGGDVNSDLPLAWLVLISLGFGPRIGCCVSRHQSCVLNELVV

SEQ ID NO: 162129 - protein, 148 aa, Triticum aestivum
  Clone ID: PAT_TA_56547.pep
KCTWSCHQILHLGLRSYGLVDRTGMASLLTAAWTGEADRRFYAWLLSRFSWEDMRFTFPDGEYRYFSPRSIVRTLGLKNSGRQVSVVKLPAKHRQNLTLRIRTILGIETRSHARDGGLTIGAVHDAITRMMASGIGGCHPGACWDGLL

SEQ ID NO: 162130 - protein, 95 aa, Triticum aestivum
  Clone ID: PAT_TA_56548.pep
PRAQPTRTSERQHGRLLQKYRAHKQKDGWKWRVLIWFLPRASMEFFLFLFSSHHLGFSEAVEVQNLCVVPRSRIVIGLVHGSAVALGHPARAHES

SEQ ID NO: 162131 - protein, 71 aa, Triticum aestivum
  Clone ID: PAT_TA_56549.pep
PPGRRRIRIPTRQHLAGQTVLSERRVVRQTHGWRARGSLSSWTSLGGPARSGSRGRRVGWPAPGGTGARKT

SEQ ID NO: 162132 - protein, 55 aa, Triticum aestivum
  Clone ID: PAT_TA_56550.pep
ELVEKLLLKDTSEELVEKLRQKRDSDECNEDVMKISRIRNVTVELSQKGLWKRIR

SEQ ID NO: 162133 - protein, 50 aa, Triticum aestivum
  Clone ID: PAT_TA_56551.pep
PQHQLNVHQHTLQKTRRQPQYRAKLIISTTILPGAPGALRGPSLASPACP

SEQ ID NO: 162134 - protein, 103 aa, Triticum aestivum
  Clone ID: PAT_TA_56552.pep
EPLTRSCALFLSSPTTEPQPQHRTSLSSSQTPPPPSSSQPWSSPSKSQPPPSPSKSQPPPSPSSSKPPPRPSSSQSPSSPSRHRSSIVLQPPSVPHQVISSSA

SEQ ID NO: 162135 - protein, 59 aa, Triticum aestivum
  Clone ID: PAT_TA_56553.pep
QGHKHESMKLTVFPGWFYTLRLATLSITLYFGARGPYSDMKFYLCSWAYCYFVDISEAV

SEQ ID NO: 162136 - protein, 223 aa, Triticum aestivum
  unsure (1)..(223): unsure at all Xaa locations
  Clone ID: PAT_TA_56554.pep
GASGWLRGKVKAVTSGDCLLIMGSTKAEIPPEKSITLSYLMAPRLARRGGVDEPFAWESREYLRKLCVGKEVTFRVDYTAPNIGREFGTVYLGDKNVAYLVVAAGWARVKEQGPKGGEPLPNVSELLRLEEVAKQQGLGRWSKEPGAAEDSIRDLPPSAIGELSGFDAKGXAVANKGKSLEAIVEQVRDGSTIRVYLLPSFQFVQIYVAGVQAPSMGRRPPNP

SEQ ID NO: 162137 - protein, 63 aa, Triticum aestivum
  Clone ID: PAT_TA_56555.pep
EFRVPPLPAALLSFLPRREGILGISSSNPPHLDSLNPPRSCRLYRTRLFPFGRCGVLCFFMRP

SEQ ID NO: 162138 - protein, 54 aa, Triticum aestivum
  Clone ID: PAT_TA_56556.pep
YDWHPGLKQMAYSVFSHYIKENNLVDLLDLGASTAAGSRRVLVHASGHVSPRVR

SEQ ID NO: 162139 - protein, 97 aa, Triticum aestivum
  Clone ID: PAT_TA_56557.pep
LIRKYLFLVLLSNNRIINYWFSRHVINSWFSFCPANTNGIKQETNIYSIMSGYGNPYRHQTSRFAYNQKRIFPQFNCQYGYFWTRNKNNLKKLDSFL

SEQ ID NO: 162140 - protein, 100 aa, Triticum aestivum
  unsure (1)..(100): unsure at all Xaa locations
  Clone ID: PAT_TA_56558.pep
RRWQGQGKVIHTVGPKYAVKYHTAAENALSHCYRSCLELLIENGLESIAMGCIYTEAKNYPREPAAHVAIRTVRCFLEKQXGKIAGVIFCITSSSDTEIY

SEQ ID NO: 162141 - protein, 52 aa, Triticum aestivum
  Clone ID: PAT_TA_56559.pep
KPGGAKMGRQQPSKDGEIHHGRSGSALPGRASQSTSRRSQAHTAPPVGLLAP

SEQ ID NO: 162142 - protein, 85 aa, Triticum aestivum
  Clone ID: PAT_TA_56560.pep
LDCRVCPFCTYWIYLLFSCSRSNKPFSDLKKKKKKKKKKKKKKKKKKKKKKKKKKKKKKKKKKKKKKKKKKKKKKKKKKKRGGPL

SEQ ID NO: 162143 - protein, 217 aa, Triticum aestivum
  unsure (1)..(217): unsure at all Xaa locations
  Clone ID: PAT_TA_56561.pep
MLHELLLALLGFTGDFVLDNSSGRRRPEPAEAGGAGDGDVGPAFRLAPDLTFLQPSERSAIERLISLGFYYRELNRFATESRDLSWIQSSVEVSSPNADITLKGKVRKGSAYRRAIANGIAEILSVYRSAVLQVEQNLLSDPLPILATVTHGLNKFEVLLPPLYELVMEIEQKDIKGGQLLNLLHKRCHCXVPELQSCIQRYCLNYSYIYGAFEEIN

SEQ ID NO: 162144 - protein, 73 aa, Triticum aestivum
  Clone ID: PAT_TA_56562.pep
MAEGEETKVEGTREEERADAGAGAEEEEVEVKFRLFDGSDIGPIRCNATATTVAALKDRVVADWPKGPKDSIS

SEQ ID NO: 162145 - protein, 161 aa, Triticum aestivum
  Clone ID: PAT_TA_56563.pep
PSSPHLLVAAIDGAPLDPSHRRLPPLDRAPHPLSLPPLEAPASHRRASCSSAASAATQPPLTTLLPPSSSTTLQPRLSLSRPAPRARRGPVAPLSPSRSGPTRSRTRSPAHPSSPSATPGTRSCSSPLPRPPLLPFRGRRCPPLRPRSSEPRRPARPCVRR

SEQ ID NO: 162146 - protein, 123 aa, Triticum aestivum
  Clone ID: PAT_TA_56564.pep
AAAPSHRLLLPALSVLNGRSAARRRSCSASPSPGGTEAAAPASARPSFPRLRAAHGSSGSSVHHVFSVMRDRRWPSTSRGGHGRCSARPSFPRLRAAHGSSGSSVHHVFSVMRDRRWPPRDVE

SEQ ID NO: 162147 - protein, 73 aa, Triticum aestivum
  Clone ID: PAT_TA_56565.pep
ASCDELWPPSKYPVIKRGMKTCIFFNCDNQVSNFRNHDSDTLLSCRDQPVHLKLKLMGKGWQHVHAHQSQIYA

SEQ ID NO: 162148 - protein, 199 aa, Triticum aestivum
  Clone ID: PAT_TA_56566.pep
IHFGQSGFIRGRGIADNFLHAADVVQTCFKRKTPTIVLKLDFTKPFDSIPWDALTTILRAKGFPLQWDNWIRSLNESTNSAILLNGRPGPWFPCRCGLRQGDSLSPYLFLIVADVLQRMILHASQSGMLSHPLDDNLPCPVLQYADDTLIVLLADAAQLHHLKQVVMQFSAGTGLSINWHKRTVAAIHVDSDTCHYVAT

SEQ ID NO: 162149 - protein, 56 aa, Triticum aestivum
  Clone ID: PAT_TA_56567.pep
GGPPMGGPSPILNAPLPIMHDPRMQDPRMQDPRKIRSYQDLDAPGDEVTVLDYRSL

SEQ ID NO: 162150 - protein, 76 aa, Triticum aestivum
  unsure (1)..(76): unsure at all Xaa locations
  Clone ID: PAT_TA_56568.pep
DNGSALSFYEFISLCKIFQYYKFLDIALPIVLSLVNIPGSTNINVLEKPRTVKTEENWGCKGTSCILDIMXRKYVX

SEQ ID NO: 162151 - protein, 71 aa, Triticum aestivum
  Clone ID: PAT_TA_56569.pep
QGTIVHLLIHRVLYTSQGLSFDTVQTEKDDNTCLFITAYISSDSVKYKLEGLDSFLPCRARSKCALTWFVH

SEQ ID NO: 162152 - protein, 255 aa, Triticum aestivum
  Clone ID: PAT_TA_56570.pep
KKKNRKNKKKKKEKKKKRKKERKKKKKKEKHKKKKKKRTKKKKKKNKKRKKRKKKKKKKKKKKGKTKKKKKKKKKRQKEQKKKKKKKKKKRKKKTKKKQKKNKKTRKKKKKKKKKKKKKKKKKKRKKKKQKNAKKKTKKKKKKKKKKKKRRQQVRKDNRSTDIEHGALTTTVALLQVIGRAVIGGVSPVALLAASSSSLSFLYFSLLALSSSSLCFLSLSSLLSHIIFLSFPLLFLPLLPFILPPRPLFLLSLIS

SEQ ID NO: 162153 - protein, 36 aa, Triticum aestivum
  Clone ID: PAT_TA_56571.pep
MGHEDMDAEETLQALRDIKSRTGAGEPKVLVVDLVY

SEQ ID NO: 162154 - protein, 92 aa, Triticum aestivum
  unsure (1)..(92): unsure at all Xaa locations
  Clone ID: PAT_TA_56572.pep
KKNKNEKKKEEKKTANRKSEQTKKEEKKKKKKRKKRRKNTRKRAEERQKDKNKNEKKEEGHNSKHSTQQXQRQKHQQQDRHSKRGQLQQHRI

SEQ ID NO: 162155 - protein, 73 aa, Triticum aestivum
  unsure (1)..(73): unsure at all Xaa locations
  Clone ID: PAT_TA_56573.pep
PLALAALPRGAGTLRARCYQGRLPAPCPVPRVASNRWIKSACVLVPDLREVVLRXXVASCWRAWAGCGSAVLA

SEQ ID NO: 162156 - protein, 76 aa, Triticum aestivum
  Clone ID: PAT_TA_56574.pep
GDTHTHLCSYNARLMHCGLAILFSSPHRLKHLYAAPVRASCYSIESLLRILSLLLCTLPGTGGGVGPFLRARLGET

SEQ ID NO: 162157 - protein, 156 aa, Triticum aestivum
  Clone ID: PAT_TA_56575.pep
MVSRASSSEELTPNVGQCQPLAMTSESDLPSMVPRESASEDLTPNVGQCQQEVLGNTEHKSIKSAEEVQAAEDILPESPHDPLMAQKLYAPENKLSEPNLKHQDSFDQLPTLGNLSRTLVIPEQTSIWQGIFEGCRTGICCGLFGGDWGPAWGPWA

SEQ ID NO: 162158 - protein, 42 aa, Triticum aestivum
  Clone ID: PAT_TA_56576.pep
QRANRAGPAAKIQNRLSVPRGPATLVVRDKNSTGTGLSKVKA

SEQ ID NO: 162159 - protein, 127 aa, Triticum aestivum
  Clone ID: PAT_TA_56577.pep
MASSGYLRAASGATRSRHTLLLRQRPAAPATSAAPRALVASSATRHASAVPNPPPGAEPLPEDAPRQTPPRLGEEDPVGPPTPTPKEKITGTPPSEEDDGGLPGGVPDTTPPPEVPLPPVSPDGSTV

SEQ ID NO: 162160 - protein, 54 aa, Triticum aestivum
  Clone ID: PAT_TA_56578.pep
SSLAGGPKASCWTGSSSLTITIDPAGEPHPPHPGGADEDSLQPLHCFSSPSDRA

SEQ ID NO: 162161 - protein, 74 aa, Triticum aestivum
  Clone ID: PAT_TA_56579.pep
RPLGRELRGGRPWNFGRTELSYGLASCPLVSPGRIRQVSSFLRRGQEVDEALAAAPTYVSTPPEWTRSTGSLAW

SEQ ID NO: 162162 - protein, 84 aa, Triticum aestivum
  Clone ID: PAT_TA_56580.pep
RQARPSGEGRSPDRADGEQSRSVGPGQATQARPPRSTQGGLRQTKKTVARHPRAAPSRSWPKRNSRQVHPNGTAPPTGGGLILC

SEQ ID NO: 162163 - protein, 90 aa, Triticum aestivum
  Clone ID: PAT_TA_56581.pep
HTGPTPTPPVQILAFVTLILYSSYFLLCNPLTFILITHWMLRELDSQLACQPSNVQHEIQHYHQISLPNPCPIETLRIQQRTSPSLNCLA

SEQ ID NO: 162164 - protein, 76 aa, Triticum aestivum
  unsure (1)..(76): unsure at all Xaa locations
  Clone ID: PAT_TA_56582.pep
GVGGADTGAEQVVLQGRTRRGAGRMRSRRSIXRMGPLIVYGTVGSNIVQAFRNLPGVDVANVACLPLLELAPGGHL

SEQ ID NO: 162165 - protein, 65 aa, Triticum aestivum
  Clone ID: PAT_TA_56583.pep
GPGPCSCSDTLDLFDLLAYPEGLLPMGMIADSEISLAFLIGLHRAISVDTIAITRSAASWRRRAT

SEQ ID NO: 162166 - protein, 55 aa, Triticum aestivum
  Clone ID: PAT_TA_56584.pep
HTAPREGTTRAPLRTCVRQPYMFTEALVGASAPIVGRVVRRAHANYATLYSDLEA

SEQ ID NO: 162167 - protein, 81 aa, Triticum aestivum
  Clone ID: PAT_TA_56585.pep
GCSPSSRLTGQHLTISSCWDRDEIVFNSMDLSRLRSLTVFGKWVPFLVSDKMKVLRVLDLEGTSRTSDGTVSVTDDVLDNI

SEQ ID NO: 162168 - protein, 38 aa, Triticum aestivum
  Clone ID: PAT_TA_56586.pep
LIWIGTDQDETRAAVMLRYLRRQVNGYPTLSALYSSGV

SEQ ID NO: 162169 - protein, 102 aa, Triticum aestivum
  Clone ID: PAT_TA_56587.pep
MTLQYLQNMFVAADRFDLQRLKFICEKRLSEHIGVSSVMYTLALAEQHQCQGLKEACLKFMQVQSPSCLQQVMATNGWDHVVSTYPSVLKEIIAKIALNRCK

SEQ ID NO: 162170 - protein, 180 aa, Triticum aestivum
  Clone ID: PAT_TA_56588.pep
MGSFANGQNGSELGIQMPAMGSSAVPEPPTTSVAARCPRLDMAMVATRAAALVMALLSMSLMVSAKQRGSLIIFGIEIPLYAKWSLSDSLKSLVGLSAAAAAYSLAQLLSIAYKALKKVPVVPSRRYAWMLLAGDQVCYDHFDLIMHFLVITIVICAPTIRFYFFSHVVSYFISLFVMSA

SEQ ID NO: 162171 - protein, 70 aa, Triticum aestivum
  Clone ID: PAT_TA_56589.pep
ARWYGEFIAKTKPDMLNVVTHHIYNLGAGVDRDTQLMDRILNPKALDGMAGPFRDLQGLLKAAGTSAGAW

SEQ ID NO: 162172 - protein, 51 aa, Triticum aestivum
  Clone ID: PAT_TA_56590.pep
TSNDGTGFIACFNHQQCHETVLQDGAGTDSRGQGTGTESISVVLYDVRKKA

SEQ ID NO: 162173 - protein, 84 aa, Triticum aestivum
  Clone ID: PAT_TA_56591.pep
APTGARKPRRETTTLSHSVVTTDSEELLRGCCHPALISRSTLYGSQRIRCLEWTAPTVPRDHGKCKSHASSFGLCIYMKKACLG

SEQ ID NO: 162174 - protein, 119 aa, Triticum aestivum
  Clone ID: PAT_TA_56592.pep
PPLNDFFSVAQKIIFSPLPLASWGDFFPVPSYESVTRKFLSQLWFFGRPLAKPLGFVSKFQALALPRPSVGIKPVMLYFCWLVFPPMDNPKVFVLWGVLSRAAPLGLSLNQAPSGGVFF

SEQ ID NO: 162175 - protein, 78 aa, Triticum aestivum
  Clone ID: PAT_TA_56593.pep
GNARYVADVWRVGVEVDGSHRLERGRIKAAIERMMESGEGREIRERMKGLKMAAEDGINERGSSHTHLSDLVALINSF

SEQ ID NO: 162176 - protein, 121 aa, Triticum aestivum
  Clone ID: PAT_TA_56594.pep
PDVYTLQQALDVAPPPRLNTTEDRAEHVERQRHLLVAQEDERVMGEWRRRHPEDVAYWARRCEEDTRRRHDSRLDRRRRKALANAQSDIVAAGGRSFFTENDDRWLDIWLDTSDDTDEDDD

SEQ ID NO: 162177 - protein, 76 aa, Triticum aestivum
  Clone ID: PAT_TA_56595.pep
EKHHRCSCHAQRKFSHNWLSLAWCGFKKKKKKKKKKKKKKKKKKKKKKKKKKKKKKKKKKKKKKKKLNRSKKKKKK

SEQ ID NO: 162178 - protein, 44 aa, Triticum aestivum
  unsure (1)..(44): unsure at all Xaa locations
  Clone ID: PAT_TA_56596.pep
GGGAVTSLIXMLLTGGSASTGGLRQEPQLTACSTFDVYAKPFSL

SEQ ID NO: 162179 - protein, 264 aa, Triticum aestivum
  unsure (1)..(264): unsure at all Xaa locations
  Clone ID: PAT_TA_56597.pep
EEFGSAALQIDQFQVVRKVIVGKKADFDGFLSNLGFARLGAPAASFADDSQASAPPAAGQDGVIGEREGADSGGDAAQPPQKFAGRLLNIPLSNVERLRSTLSTVSLTELIESVPQLVGRLSTSVDSHPDKKKLFSVQDFFRYAEIEGKRFFEELDRDGDGQVTLEDLEVAMRKRRLPRRYARDLLRRTRSNRFSKSIGWKQFLSLMEQKEATILRAYTTLCLSKSGTLHKNQIVESLKGAGXPPMKICCCHAALSNADQKDQS

SEQ ID NO: 162180 - protein, 214 aa, Triticum aestivum
  Clone ID: PAT_TA_56598.pep
MNGEPRCAPSPEGHAFSADVGGGMTIKTPFSVSLSVPASPSSDAKPDVHHPAVPLKQARQQSLPSPTVRGSAAEVPAIRRSDTARKRDRRFDRLRTFSGRLDRQLSTLRGLSQELPAADLERGSAKISEEDTDEDHDVPTAGRYFDALEGAELDTLRSTEVAVLPKDELWPFLLRFPISAFGMCLGVSSQAMLWKTLESEPSMAFLRVRPAANH

SEQ ID NO: 162181 - protein, 127 aa, Triticum aestivum
  unsure (1)..(127): unsure at all Xaa locations
  Clone ID: PAT_TA_56599.pep
MSSSPPAAPGPASPPGNRTAPPPASAPPATNSTPPSPPAPPASAPPPSSPVPPPSTPAAPPPSSGTTPATPSLPPPTXPGAPAAPSPPSTTPSPPTDRSTPSAQASPPPXSSALNTATVAGIAVGGL

SEQ ID NO: 162182 - protein, 192 aa, Triticum aestivum
  Clone ID: PAT_TA_56600.pep
LAMGMSGTEVAKESSDIIILDDDFTSVVKVVRWGRSVYANIQKFIQFQLTVNVAALVINVIAAVSSGDVPLNAVELLWVNLIMDTLGALALATEPPTDNLMKRQPVGRREPLVTNIMWRNLFVQAIYQIAILLIFNFSGKKILRLQNESPDNAEKMKNTFIFNTFVFCQVGWIFSDSTTVTGCYLNSTLFFR

SEQ ID NO: 162183 - protein, 104 aa, Triticum aestivum
  unsure (1)..(104): unsure at all Xaa locations
  Clone ID: PAT_TA_56601.pep
PGHPLRAPTMQGGLVPACKGACYGDSDLPMXKQIQGSKGKFMLCSATNMPAVEVGGGPWFNGXKGSVVSPEPVNNIVGLXIYVESLFPIPFFQPPGLLVYSEDL

SEQ ID NO: 162184 - protein, 203 aa, Triticum aestivum
  unsure (1)..(203): unsure at all Xaa locations
  Clone ID: PAT_TA_56602.pep
EDHHARCRSFEPTPQHVDLRRPSVVGNHQIRPVSDLPRHPSPVPGVSPTPGAQASAATRLCLLCSGARHGGKKAEWTVRRLVTATGFTGAEAHFLFVLFARGKAQQVGGGSREKLAREEMGKGGELWDDSALVDAFDHAVATYKAMHGKNNQAAPSEKPESEDVAAAAASAAAYAAAAVAEEPVSTEVADEXTEKNDSCTNLP

SEQ ID NO: 162185 - protein, 58 aa, Triticum aestivum
  Clone ID: PAT_TA_56603.pep
NQASMTGADNKKKEGEVEGLAWWRSIIRRRRGSGAEAVVTRGGGIEAGEVVGIEGKGG

SEQ ID NO: 162186 - protein, 122 aa, Triticum aestivum
  Clone ID: PAT_TA_56604.pep
DAWVRVQCLWRRGAALFFIPMLPPVPPHAVVGSGRLHAATSLPKPIATPNHGLLLPFLGRRQAGSLDRRAPATSSFGPLVPVAVRQHDDMRPVGALVQFRCRWSQDLPTDPTLSASTSPILL

SEQ ID NO: 162187 - protein, 46 aa, Triticum aestivum
  Clone ID: PAT_TA_56605.pep
SERDVTAQPASSRPSSSLEWINHASASTAGSSLIKCELWLCSAEID

SEQ ID NO: 162188 - protein, 125 aa, Triticum aestivum
  Clone ID: PAT_TA_56606.pep
MVDGEKAPAPAPALLRLETLLALGLDQRTAENALVNSKVTANLAAVVAEAGITGCDKSVGNLLYAVATKYPNNALVHRPALINYIVSTKIKNPAQLDAALSFLTNTGPESLDIGKFEEACGVGVG

SEQ ID NO: 162189 - protein, 35 aa, Triticum aestivum
  Clone ID: PAT_TA_56607.pep
RQGGGALAHPVAGKARMVRAMARASSCCPHALRPA

SEQ ID NO: 162190 - protein, 98 aa, Triticum aestivum
  Clone ID: PAT_TA_56608.pep
LLRLVAQIPSSSDVAARIPLARVAARILLAHVAVALVASSARPASPLDGVKGAFFSQAERSVGTNGGEDQREELCCWLDLKLLYTQREYEVGGRRPSP

SEQ ID NO: 162191 - protein, 46 aa, Triticum aestivum
  Clone ID: PAT_TA_56609.pep
LAKPDRIWTPNHLRITTWTNKPNHGRLCSTRDAAPKLPFVRTHVRA

SEQ ID NO: 162192 - protein, 183 aa, Triticum aestivum
  Clone ID: PAT_TA_56610.pep
MLTVSLLDAQLARCSSARHLLQIHGQFIASGLLADAFAASRLLLFTSATRLLPLPIHHSFRLLRLVRCPNAFSCNTLLKAALLAGTPHLCLPLYTSLPASPDAYTHPILAAACAARRDVSEGRQVQSHAIRHGFGDDLYLRNGLMHMYSVCGCLRDARMVFDAGPVWDAVSWNTILAAYVHAG

SEQ ID NO: 162193 - protein, 60 aa, Triticum aestivum
  unsure (1)..(60): unsure at all Xaa locations
  Clone ID: PAT_TA_56611.pep
KKKKTPLQNSPITHLSHFHALRRRITIVWAKTTPHLDTPSFLYLQICAHPRIFXQTLAPL

SEQ ID NO: 162194 - protein, 222 aa, Triticum aestivum
  unsure (1)..(222): unsure at all Xaa locations
  Clone ID: PAT_TA_56612.pep
AGELRSQRLELKNSRIMSLVDNSNEVSQPEVESVASAGAMVRKANMQXHIVPSRSSVAVEKVSVDESNQSFKMEETLLGRVAGQAEAVRAIGRAIPRARVGLRTPSRPVASFNFASPPGVGKSELAKALATSYCGLEEAMVQLHMSEFMEQHTVAKLIGPPLGYVSCGRVEGKDDGSKIRLVRKAAGEGRGEIWWRQLEMAKGRDAASSSSGQPSSLEPPAP

SEQ ID NO: 162195 - protein, 68 aa, Triticum aestivum
  Clone ID: PAT_TA_56613.pep
PSPPRPSSSPGSRPPPRRRRRGRPWARRPAHSSWHPPPLRTPSASHPPRRSLLIRFVDAKGSLGGMER

SEQ ID NO: 162196 - protein, 74 aa, Triticum aestivum
  Clone ID: PAT_TA_56614.pep
CCSRDSSLESHQKSALEHTDSSETTAESDNNGTQQSTAHMATIPEADPLTSCSLGESKSVGRPDFTGCAPEVCT

SEQ ID NO: 162197 - protein, 60 aa, Triticum aestivum
  Clone ID: PAT_TA_56615.pep
PSGMAVINNNIFAYYTGNMVFCLYLNFTKDMLQFMPGVQYLLPEIRFLPMVIEYTYKVCF

SEQ ID NO: 162198 - protein, 55 aa, Triticum aestivum
  Clone ID: PAT_TA_56616.pep
NKRELNRCGGWRQACASLISSGRTSVKPYTTSYEFTTNKHNDTRGLEDIIGYTGI

SEQ ID NO: 162199 - protein, 87 aa, Triticum aestivum
  Clone ID: PAT_TA_56617.pep
LKRNINHLAQHGTQLFFVKMLDHGNIMHKTNQFFVTFSHDNCEVEQSLVGFGLNINIRRTRKMSLDKNKSSRLLFKEKHQASSTVSG

SEQ ID NO: 162200 - protein, 38 aa, Triticum aestivum
  Clone ID: PAT_TA_56618.pep
DCGFCQKGESLLTFSPPIVDTHQVNAELLVVPWSISGA

SEQ ID NO: 162201 - protein, 116 aa, Triticum aestivum
  Clone ID: PAT_TA_56619.pep
RHMYTHACSSTNRMRTLYYFGQLIHYHNMGAHAQMLQSFSRLFHPRRKRIFTSSTIQRNLVNCTLGALAFLFLRVIISCCRHCRAASPKDSSGERFTSFADSDRSGVCKQGAQSPA

SEQ ID NO: 162202 - protein, 98 aa, Triticum aestivum
  Clone ID: PAT_TA_56620.pep
CYQVFAPRHPFRWRADVVGFLVMLELALPSFPPPVNLNLFVFLFLVMERGKARFKNKIKSNTIFFKLTNHRILTGYVSGSIRAVSEYQGSIRLDTRTF

SEQ ID NO: 162203 - protein, 238 aa, Triticum aestivum
  Clone ID: PAT_TA_56621.pep
PNRTGAEADGIAEGTSSQLSLENGSIEPVQFGELGVNRHSSAVTDETHQDRHYEKQASAPSRTSDILDAQGQRNGPILQRSISFKQGIQQFRVSEWEDREKWVWSPLSELRLAYRQELQAGCLEKFELVNRYSPSHLPPLHKQSAEEAPSPRFVVGPGGNVLSVSEDEISSIVSRALAISEDRRHLLDSIVESHASDTTSMLSESSSSASSSSWSSESSDSEAGFFVRRTVQLRQLAP

SEQ ID NO: 162204 - protein, 41 aa, Triticum aestivum
  unsure (1)..(41): unsure at all Xaa locations
  Clone ID: PAT_TA_56622.pep
MLVVLTVYTFVWGRLYLALSGLEAGIQGSANATNNKALXAV

SEQ ID NO: 162205 - protein, 34 aa, Triticum aestivum
  Clone ID: PAT_TA_56623.pep
SSYLVQSILILYLCFVLGCLYLHRPEVLSRGFVG

SEQ ID NO: 162206 - protein, 161 aa, Triticum aestivum
  unsure (1)..(161): unsure at all Xaa locations
  Clone ID: PAT_TA_56624.pep
GALNRIIDRGSNAINFILTVTVFNIVPTILEIGMVSSILAYKFGSTFAWITSVSVATYIVFTLALTQWRTKFRTAMNKADNASGAVAVDSLLNYEXYEDSALKAQSSLAYLNFGQNVIFSVSLSTAMVLSSYGVMSGALTVGDLVMXNGLLFQLSRPLNLL

SEQ ID NO: 162207 - protein, 41 aa, Triticum aestivum
  Clone ID: PAT_TA_56625.pep
QTIKVQDYEFSSMMMMIYLIKYHCRNSKAFCSIPSVTKLRK

SEQ ID NO: 162208 - protein, 160 aa, Triticum aestivum
  Clone ID: PAT_TA_56626.pep
EEDDSGYGSKPQPAYGFRPQQEEQPAYGSGYGSKPQRSEEDTYGSGYGRKPQQQEELAYGSGYGSGYGRKPQAEESYGSGYGNATQPEEGYGSGYGSKPQVEQTYGGSEYGSGYGRKPQVEESYGSGYGSRPQGGGEEYGSAGYGGRKTEEEGYGGSGYG

SEQ ID NO: 162209 - protein, 34 aa, Triticum aestivum
  unsure (1)..(34): unsure at all Xaa locations
  Clone ID: PAT_TA_56627.pep
PKGPCHWLSRSGRSAAVGRLEAPIPTGGGLNPMX

SEQ ID NO: 162210 - protein, 64 aa, Triticum aestivum
  Clone ID: PAT_TA_56628.pep
LGGANIRTGLGGSKGPEQRQPQAEGPTSAPGLRPSGLYRGPAPPPWGAGHCRRGGGAPRRSSRG

SEQ ID NO: 162211 - protein, 96 aa, Triticum aestivum
  Clone ID: PAT_TA_56629.pep
ICNLGRNLFVFRVLYFVRVRVNKYMTDQNSFSLFASIWSSDEEIHPTKIVLVYLLGFGAVMRKFTQYDLSDVIINRYVLTELLSVCYLYFFCFYDM

SEQ ID NO: 162212 - protein, 78 aa, Triticum aestivum
  Clone ID: PAT_TA_56630.pep
DFQSSLSMYTSQPSYGILIYQCQRSSMSLHWAGDGCFTGLGTVGTTVVNLKLPENKASLSVNDRQVASLRVYLASAWT

SEQ ID NO: 162213 - protein, 51 aa, Triticum aestivum
  Clone ID: PAT_TA_56631.pep
SRPRRKETRGWGGAAGAPEWGSLVAALSRGGGGDGGGTRAAAPSVEGLKRP

SEQ ID NO: 162214 - protein, 63 aa, Triticum aestivum
  Clone ID: PAT_TA_56632.pep
AQALGATSCRASPSTQSQHRPDGARDDDPASPRPSSSRCSRRHPCHAYCPTTQRHCSHPSNCP

SEQ ID NO: 162215 - protein, 61 aa, Triticum aestivum
  unsure (1)..(61): unsure at all Xaa locations
  Clone ID: PAT_TA_56633.pep
YYIFLLGYGVLASIIAXGCYLIIAFICVEVNLKRLLEAVPRLRNEANFVHYLATHRQLGGG

SEQ ID NO: 162216 - protein, 53 aa, Triticum aestivum
  Clone ID: PAT_TA_56634.pep
SPRVRPASHGRALGAQAPLTWVGAGVGRTRSMLAWILTYRQLPVAQGCFEYCT

SEQ ID NO: 162217 - protein, 65 aa, Triticum aestivum
  unsure (1)..(65): unsure at all Xaa locations
  Clone ID: PAT_TA_56635.pep
PRIXNXTLVTTPPPKSIYYLTTKAYNEQEYGIIHWCFLTKLHISNMSSSRHRYAKVKPVELISTN

SEQ ID NO: 162218 - protein, 153 aa, Triticum aestivum
  unsure (1)..(153): unsure at all Xaa locations
  Clone ID: PAT_TA_56636.pep
AIPSCWGFLRRRHRXYSLPGVXVESXRSGVALRRILLPSXRFGPRSATSGDRRVPAAAARQEVRAAGRRRGPALAGASPKNRATELRCRGSAGHSNPTLPAMRIAEISEQHRAGRRVEEVPRIARRQRGEAAGEEAAQYKFFFFLDGNGDLRN

SEQ ID NO: 162219 - protein, 104 aa, Triticum aestivum
  unsure (1)..(104): unsure at all Xaa locations
  Clone ID: PAT_TA_56637.pep
XDAMAVFAESVRIFIHCLSTICTVEEEFGYLECALELLEDNSITRSQLLGHKYRKVSLQIKTMGGRNTTRRSWVRQDSRWLCLSIKGLLCHHEHWGFGPALLTG

SEQ ID NO: 162220 - protein, 103 aa, Triticum aestivum
  Clone ID: PAT_TA_56638.pep
PNEALAAAGCKSLSNFRSEKSMHLCRRGAPRHGRGRAPVRLHLCWGTPRHRGRRRVTLRARHRDRHRVPRRLRRAATGHVIWTPGLIPANLAHMFPYMTLHVN

SEQ ID NO: 162221 - protein, 63 aa, Triticum aestivum
  Clone ID: PAT_TA_56639.pep
WCQLDLILEASFAHIGIVTCLGGLQCGLVHFKKCKVYYLENRSLQPDVHDGVMLDLILEASFG

SEQ ID NO: 162222 - protein, 66 aa, Triticum aestivum
  Clone ID: PAT_TA_56640.pep
LIMVFSKVEVNLKRLLEAAPRQQNQAKLVHYITTARELLEQLGAEITPEGISRYGIVLCAIGELIC

SEQ ID NO: 162223 - protein, 180 aa, Triticum aestivum
  Clone ID: PAT_TA_56641.pep
MGRRSGGRKLPFFSAASTSSSTKRTRSARRLPSLPKPSSPPPPSPTTPPPAPQTTTSPPAPSPGGGAAVAAKVGKKKAGARLWMRLDRWGSSEILELDKASIIRRAGVPPRDLRILGPVFSHSSSILAREKAMVINLEFIRAIVTAEEVLLLDPLMQEVLPFVDQLRQHLPLRSLVGGEW

SEQ ID NO: 162224 - protein, 87 aa, Triticum aestivum
  Clone ID: PAT_TA_56642.pep
RKHIKLHKHGFFSIVTKQLALGVSKASFGDAAGGFHGVFSRDGVRQVTCAGHVKLRCLKFLYGLILSLSAPLQDHCFMNSSKFLYFY

SEQ ID NO: 162225 - protein, 51 aa, Triticum aestivum
  unsure (1)..(51): unsure at all Xaa locations
  Clone ID: PAT_TA_56643.pep
ASVGVASHAACAHEQEEVCLRHGVRFVEGCTXLEQELGAVVVVDDDGARHA

SEQ ID NO: 162226 - protein, 91 aa, Triticum aestivum
  Clone ID: PAT_TA_56644.pep
PAAAALIPNRRPPATPRRPVPHLNPRPPSSPRRPSISPAAADSCRSATAVPPRRSSASPPTAHSLRASRTWPPSPVPVPPRRAPAASAPAI

SEQ ID NO: 162227 - protein, 156 aa, Triticum aestivum
  unsure (1)..(156): unsure at all Xaa locations
  Clone ID: PAT_TA_56645.pep
HRLPVDELPIVSFXTEASTAPTVLATLTRIAQAELLPLLTVAPLPRFLSEYAESLLASLKLPVVMPVSAAMAATALHLRLRYGESSDGLVTRRDAEVPGSVVVRPERRLDHAWLVFSTLSRRRAEADATQVCEALLAMLVEIGGKRRRCLIEEIVT

SEQ ID NO: 162228 - protein, 61 aa, Triticum aestivum
  Clone ID: PAT_TA_56646.pep
ARRSGVKRIARDIGQLDVSASFIIMRTEKIACYMLSMMREGNARSLESIEAELVRASEAQL

SEQ ID NO: 162229 - protein, 214 aa, Triticum aestivum
  Clone ID: PAT_TA_56647.pep
YWDNISPRDICYGQHDRLVTITGQLDNQLQAIFLILSELLDVVHYSCSDAGVNFSSYPVSPVGCEDGYVKRYNSKPTTSLRSSVNNSDEQESLTITVADKHVGAIVGRAGRTIKEIEQVTGAFIRISGKGDIIHGTNDRKVVIRGTLEALNAAEAMIMQLVCDTGRQLDGGDRKPLEQPNTSMRSPDNSNDTSVPDKHVSTVIGQAGEDHQYPT

SEQ ID NO: 162230 - protein, 167 aa, Triticum aestivum
  Clone ID: PAT_TA_56648.pep
AAVDGFLTGWLHVASDLILSPSVALPLPRCGRMHLNPKPELNQSSARCQIVVPSSRSPPRQFHTATAQPTTATPLAWICLRHGLGTVRCCLMHVPHWEVWSADARYEQLLSLIAGCAHACMYTSHLHCLYNTLHVHHGRGQANVLLLLTRHPQSITKPIQNFTMHFF

SEQ ID NO: 162231 - protein, 60 aa, Triticum aestivum
  Clone ID: PAT_TA_56649.pep
TGRHQGYNLQKGGTLTRSRAHTHTHDRPHQVTTARWRRCPQLQTSNDIRPHRALPPAKKW

SEQ ID NO: 162232 - protein, 153 aa, Triticum aestivum
  Clone ID: PAT_TA_56650.pep
SSISASVAMVPPGASASGRHRRGRHQGPVPGRSCVESDAAAALGSEILHRRRHPTRLTPVCLLSFEQKWCQGRHRVSKAKEQQAPPQMSQLRGSRCSIEKSRRRGAASPAVSRPGHGILHDGGSTTMLYNIACRWPCQRASSLARCLPVHLLY

SEQ ID NO: 162233 - protein, 126 aa, Triticum aestivum
  unsure (1)..(126): unsure at all Xaa locations
  Clone ID: PAT_TA_56651.pep
MYTLRNVIFCADLNCXDECDWPFPLSDGWLVAWAELKPXDDGWTYDTKANGMLACNXQLQMRLDXLECNLPDFEIDTMEMIGEEAIPAISHYKENTARKVDHNIDYAVLPSDHLRLVLSITYASSG

SEQ ID NO: 162234 - protein, 128 aa, Triticum aestivum
  Clone ID: PAT_TA_56652.pep
GSRQERVTGCCRPAPARSGATWRLVAARSDPGSGEEEGRWGAGRLCASSTPSCGCSVRSRRRKGGGREDEEVDQQEEERISGRAPYWTYCSINRYMLCSSCFFLLPSVSFSPLMLLVLVCCPRRCVLP

SEQ ID NO: 162235 - protein, 90 aa, Triticum aestivum
  unsure (1)..(90): unsure at all Xaa locations
  Clone ID: PAT_TA_56653.pep
DITTGTELMCRVTCRQVNGSALFSYLVSMLLQFQQDQLIAALLLNASSFSTGSIRQFWYVELSYPLWEVPFLPXIWYQLRTVLXSRNQSR

SEQ ID NO: 162236 - protein, 191 aa, Triticum aestivum
  Clone ID: PAT_TA_56654.pep
RAAPSSLLSPPSLSLSLSLSSTQQQQLRPWETFVRPHRGRRRRRILARSTASPIQTSSVSSVLTDPWNFCRSILCPRGLRITQRVKIHSGARASWATSPLVGRWQPAQACRQPNGGPHPACETLGRLLAHPVRWGFRRPPATASPSPFRTRRRAPPPPLRHPSPPTPPAPGEGCLQWREKVTLVREEEVRR

SEQ ID NO: 162237 - protein, 94 aa, Triticum aestivum
  Clone ID: PAT_TA_56655.pep
QNYNLFYFRIKLILENAINFENEYKIIRNSDENTLHMKVAQNDETNPDTHPVRPSHIPNISNMQLSPSGSPARKRETPGILSRMFLLFTGITYY

SEQ ID NO: 162238 - protein, 170 aa, Triticum aestivum
  Clone ID: PAT_TA_56656.pep
MAGVGRNMVAPLLVLNLIMYIIVIGFASWNLNHFINGLTNRPGVGGNGATFYFLVFAILAGVVGTWRGDSLATSASSALVAWAITALAFGLACKEIHIGGYRGWRLRVLEAFVIILMFTQLLYVLALHSGLFGNQFGNHAGAGGYGAEHGAYGAGDPHNKGMGTGGVARV

SEQ ID NO: 162239 - protein, 102 aa, Triticum aestivum
  Clone ID: PAT_TA_56657.pep
GFGIGPFETLDWQRDRDPVGLGSGELGASEVGDIVNEGHHGLHLRPLAGGLPVIDVAGRALAATSMIFSGRAVGRPVDEDSTTTTEVCPPLLALGLASLIRL

SEQ ID NO: 162240 - protein, 49 aa, Triticum aestivum
  Clone ID: PAT_TA_56658.pep
EAIETMMVAEEGLAVRQRAEVLGEAVRSSAAQGGSSHKEMDDFISYMTR

SEQ ID NO: 162241 - protein, 113 aa, Triticum aestivum
  Clone ID: PAT_TA_56659.pep
SDWIAQRIQDMLIHGIESWAPILPVKRVVLDFSSPNIAKEMHVGHIRSTIIGDTLARIFEFANIEVLRRNHVGDWGTQFGMLIEFLFEKFANGEEAGNQAIENLQVDVNSTRA

SEQ ID NO: 162242 - protein, 148 aa, Triticum aestivum
  Clone ID: PAT_TA_56660.pep
EDDKKGGAAAPGSSAPGTRFKNLVSREYYSHKKKLHSVAWNCIGTKLASGSIDHTARVWSIDPHGHSKVKDIELKGHSDSVDQLCWDPKHPDTVATAAADKSIRLWDARSGKCQVVELSGENINITYKHDGTHIAVGNKVYNNRTWVH

SEQ ID NO: 162243 - protein, 104 aa, Triticum aestivum
  Clone ID: PAT_TA_56661.pep
TTQQGLNTPRTHHTPPQDPNPNSNEPIPQHLLWTALGAGPQQPIWTGRTLTVRYVPLAPLICSPYLLRPTPLPQKVNEVPPLRLVGPVPSRCAPSASPVQRIST

SEQ ID NO: 162244 - protein, 139 aa, Triticum aestivum
  unsure (1)..(139): unsure at all Xaa locations
  Clone ID: PAT_TA_56662.pep
ERSSSSAKGDATXRRQQQQGEEEQQQRWRGKRSSVVRRRRSAARGIHAEDQTPVTLLSGQAREVRRWLEMVAMVDGFGCVWWVVKMARWSWWRRGEELMTRHHAGLAVAAVGVGEGGARERCVARPDGEWRRASYFDPP

SEQ ID NO: 162245 - protein, 53 aa, Triticum aestivum
  Clone ID: PAT_TA_56663.pep
MFFIRSNEICQYGKKCILNLYASLPWASVENNENALVFSSAQIWVNSLDMHTL

SEQ ID NO: 162246 - protein, 240 aa, Triticum aestivum
  unsure (1)..(240): unsure at all Xaa locations
  Clone ID: PAT_TA_56664.pep
SLDRGFGRCIAXKKYKVTMQKYGNNISEKNVKPERDKDGVLMKKNMQALDEDGFAAPGRIIHNHDIHVNKKTPKIIPDDTANSPAVRLTDRXTIVIFLCFFLACSIYFLAPKFCCSRMLYVLSRFKHYSPRDYKDSPAVYRGDDDETTVVDRVILSSDTNDQLTIKCMIRHTRRPEVGDKFSSRHGQKGVCGTIIQQEDFPFSERGICPDLIMNPHGFPSRMTIGKMLELVGGKAGVSGG

SEQ ID NO: 162247 - protein, 150 aa, Triticum aestivum
  unsure (1)..(150): unsure at all Xaa locations
  Clone ID: PAT_TA_56665.pep
GAKKGKTLLPDYASDAEDNREEWPSRVKPLAKSVQLGDSSSGSLNSSDVNSASLPTASSPLPADDAEAESQKGPNQEEVILEVPQGDLPDSRPTGGKAPEGSKSGPGPDTAPEPPMVPESDRRRLHKKGEPTPPATSVHSEAPDICWXGA

SEQ ID NO: 162248 - protein, 99 aa, Triticum aestivum
  unsure (1)..(99): unsure at all Xaa locations
  Clone ID: PAT_TA_56666.pep
MADGGDGGTKINWHNAPELQGAILEAENAXGLVDRITLSEQMGWGQFGSIRSWSDMATGEVLDMESIAKDRVTSTDDLRGARLQMEALARLLGQPMLYN

SEQ ID NO: 162249 - protein, 119 aa, Triticum aestivum
  Clone ID: PAT_TA_56667.pep
CHRRPISSHTSDLRARDAEARRCSTRSTRLVCYLQVIVGLAGSLFDLCQLATLRPQLCRSTSFLLPFSAFRLGLNFCSHVFSLDCLCRAAIRFGLFLPVVSVGVHPGQWVCLFLVLLYW

SEQ ID NO: 162250 - protein, 88 aa, Triticum aestivum
  Clone ID: PAT_TA_56668.pep
CAETELIQTCIGDNIDWQLAFAVSYREERSENAIVMVRMQVKSSYSALGFGQGCVEACYPCVTSFYLCARAILPEMFDRTTRDGWPYY

SEQ ID NO: 162251 - protein, 125 aa, Triticum aestivum
  Clone ID: PAT_TA_56669.pep
TTIAAKIMSTEVNVKLSKKFARVLAMLPSVRVSEGTWSLMIQKVLIGINNLLNDAFVGLEEEKKGREIMMLLVPPGNDPPPVLGDQVKLGGNLHVTKKFRVFTVPTISALAHCCCMMLTSYYPVQ

SEQ ID NO: 162252 - protein, 78 aa, Triticum aestivum
  Clone ID: PAT_TA_56670.pep
AYRNYLEELMERHVGSHTNKLGQCHLHSVIQSPLIQSPRHVGSHTNKLGQCHLHSSKDGGSMLSLKFHSVSPTCRITY

SEQ ID NO: 162253 - protein, 167 aa, Triticum aestivum
  Clone ID: PAT_TA_56671.pep
MAQVAEEVPVVQTAMGMMRDEQKVALSVRLQSYGGFIPEHVVEFIKRHVNDDNDADEDELTIDMNALSDDTLFELQKLLDDYDRVNQSGNPTKDEPQEVEFQSEYGLANSSMHHEGNELVEEDIDIGGNDLPPLTYPPVVFESETADRSSKHSSSSSSSSESGSSSS

SEQ ID NO: 162254 - protein, 182 aa, Triticum aestivum
  Clone ID: PAT_TA_56672.pep
VMEYGDMTFKDEKLYLYQGFNPANTNITNKLFLQAPKAAINQRDADLLFLWRRYELLHGKSKEKANVLTEISETVAHRKHLDNSIDFIGKLLFGFENGPSELQAVRPSGKPLVDDWDCLKRMVRIFESHCGSLTQYGMKHMRAFANICNNGVSGTTMKEASINTCGGHNSARLSTLIQGYSA

SEQ ID NO: 162255 - protein, 67 aa, Triticum aestivum
  Clone ID: PAT_TA_56673.pep
GPQKKKKNFPTPGRKNWTLKNGPPLFFFFFFFFFFFFFFFFWVFFFFFFFFFFFFFFFFFFFFFFFF

SEQ ID NO: 162256 - protein, 214 aa, Triticum aestivum
  Clone ID: PAT_TA_56674.pep
MSAHLRLLTAGAALPLPAPASLRRARLLPPAPPLPSARLLAPHRRGLSPHAAVRVVRCAAAAGAADGGEREVGVEAIAADGAGIWAQVRDVVVFAGPALGLWICGPLMSLIDTMVIGQTSSLQLAALGPGTVFCDYLCYIFMFLSVATSNMVATSLANKDEELAQHQVSTLLFIALTFGIGMVLFTKIFGVQVLTAFTGSKNHGIISAANTYAQ

SEQ ID NO: 162257 - protein, 230 aa, Triticum aestivum
  unsure (1)..(230): unsure at all Xaa locations
  Clone ID: PAT_TA_56675.pep
GPCMKLRILLLTLMENLVEWWTTESSEETKEFLIPNLHHLEIKDCPRLKFLPYPPRSMNWVLSNSETVLPEQGFGKLSSSIRPSLMVLKRCSFSQDKWDRLQHFPTLEKFQVISASGLRTLPVVMRGFTSLTELYLKSLKFLEALPVWFGDLASLVEISIDDCPNLTCLPESMKNLTALRKLTLIECXGMETLPAXVGTLTSLEEILIGDCHNLTSLPESLKTLSALKTL

SEQ ID NO: 162258 - protein, 90 aa, Triticum aestivum
  Clone ID: PAT_TA_56676.pep
LEGRRSDSATAAAPAGAAERGDGGGGMAVNLFTAVNQALHIALDTDPRSYVFGEDVGFGGVFRCPSGLAVRFGTLAVFVALLCGLGLGGF

SEQ ID NO: 162259 - protein, 217 aa, Triticum aestivum
  unsure (1)..(217): unsure at all Xaa locations
  Clone ID: PAT_TA_56677.pep
HGRHEQEEQGRGHGRHGEGEREEEQGRGRGRRGQGEREEEQGRGRGRRGEGERDEEHGDGRRPYVFGPRSFRRIIRSDHGFVKALRPFDEVSRLLRGIRNYRVAKAXEEEEKSISIVRASEEQLRELRRQASEGDQGHHWPLPPFRGDSRDTFNLLEQRPKIANRHGRLYEADARSFHALAQHDVRVAVANITPGSMTAPYLNTQSFKLAVVLGGDG

SEQ ID NO: 162260 - protein, 116 aa, Triticum aestivum
  Clone ID: PAT_TA_56678.pep
HCCSLSVLSTSPLPMRHLSPGSPASLLHPHHGPIGPPLISQSGGRGSAKRSMAAGHLCSLCYPSASRMKTILPEGRVGGQRGVRDAGGNGDFFPSFPVNPSLDSFLTLGMAAAARR

SEQ ID NO: 162261 - protein, 48 aa, Triticum aestivum
  unsure (1)..(48): unsure at all Xaa locations
  Clone ID: PAT_TA_56679.pep
TGGAVTQCFDRRSALSVLAVLVVVMINMWSRELGGXQGANVSLLKTVF

SEQ ID NO: 162262 - protein, 53 aa, Triticum aestivum
  unsure (1)..(53): unsure at all Xaa locations
  Clone ID: PAT_TA_56680.pep
DTPRAKDEEXQHSAEDIRAGDATLHGCCRESNRHRIRCRGGGCAAHTVVAQRP

SEQ ID NO: 162263 - protein, 72 aa, Triticum aestivum
  Clone ID: PAT_TA_56681.pep
DKRVNSFHLYHLGPVLKKRVWDYYRGLILRNIIRDYGTVRSVATMVINVFVSNCRFSLPQRRTHIVVSHMVL

SEQ ID NO: 162264 - protein, 60 aa, Triticum aestivum
  Clone ID: PAT_TA_56682.pep
TGAPKKGPPQFYFFLGVPILFFFFFFFFCFFFFFFFFFFFFFFFFFFFFFFFFFFFFFFF

SEQ ID NO: 162265 - protein, 136 aa, Triticum aestivum
  unsure (1)..(136): unsure at all Xaa locations
  Clone ID: PAT_TA_56683.pep
THRLLLLPSLILLCLGEVXQAGAHTKGGCGYGSDAGAVEVESELQQKEVDGRDNSFSFDEFHHLHCYLRLVSLLACRWVQSRLCFGCLVRRFHSACVDLASVWILDLEHLGGCSGLLRSVVTGFVFHILQEMKSRG

SEQ ID NO: 162266 - protein, 72 aa, Triticum aestivum
  Clone ID: PAT_TA_56684.pep
KKKKKKKKKKKKKKKKKKKKKKKKKKKKKKKKKKKKKKKKKKKKKKGGAFLRNQILGPGGGKVKFFFWGPQI

SEQ ID NO: 162267 - protein, 185 aa, Triticum aestivum
  unsure (1)..(185): unsure at all Xaa locations
  Clone ID: PAT_TA_56685.pep
SHQNDESVIPTEGKVQNPHXIKYSGTVQGLKYIWRTEGLRRQFKGNGTNCARIVPNSAVKLFSYEQASRCKLQVNSXDQPEMKTNRRRSVSYTGQKTSRNANPNRALPVADWGXNAQPSPLLRLGAGATAGIIAMSAAYPMDMLGGXELLVQKKKSPRVWFHAFGHCTGEESFFSALYREEGFRH

SEQ ID NO: 162268 - protein, 171 aa, Triticum aestivum
  unsure (1)..(171): unsure at all Xaa locations
  Clone ID: PAT_TA_56686.pep
PRPPTRPNSPDAPAVAHPVHPQPPPHPLEAKANPRVLRRLPRHSGGRRGRRQRSGSAQLLRAPACARRLFHRCGTPQPAVRGKVAARSGGVAIFTGARRENSKLPNPRSYFLRPRDGEARAGGWRRRXXQGSIXAXLQQPDSLLLGLGAGVVDADKSIFRLWANCEAAVSD

SEQ ID NO: 162269 - protein, 35 aa, Triticum aestivum
  Clone ID: PAT_TA_56687.pep
GTYYTSVLLIPTICVYNKGILHMSTLYIAKHLEKY

SEQ ID NO: 162270 - protein, 182 aa, Triticum aestivum
  unsure (1)..(182): unsure at all Xaa locations
  Clone ID: PAT_TA_56688.pep
MAGVGRNMVAPLLVLNLIMYLIVIGFASWNLNHFINGLTNRPGVGGNGATFYFLVFAILAGVVGAASKLAGVHHVRTWRGDSLATSASPRWWRGAVTAXLAFGLACKEIHIGGYRXGWRLRVLEAFVIILAFTQLLYVIALHSGLFGNXFGGNHAGGYPAEHAYGAGDPHNKGMGTGGVARV

SEQ ID NO: 162271 - protein, 101 aa, Triticum aestivum
  Clone ID: PAT_TA_56689.pep
YMSSPGFLIFIVVVTLLVVSGILEVMVLLSKVVHDALRVGKKHLVQALGSVARQLTIHRVHVSVLLAPPALHVLDQGASHSTVGLHEQVARAVCPGLFASR

SEQ ID NO: 162272 - protein, 219 aa, Triticum aestivum
  unsure (1)..(219): unsure at all Xaa locations
  Clone ID: PAT_TA_56690.pep
LSLWCWEVRDLKVLPVRTRGFLSVRRTARKKIHERMTALHSTLSALESTGAEGQVNELRKVSTKLSKALNLEGIRSMVERVTQKNNIQRGAKDVESTDQSMQVMENNEGTVGGVDAVNGSELPNGNAPANEQSILKMQKQSQKETKRQEKEEHQMMKQQKKMQEEALREQKRREKEEAEVKKRQKRQEXEEALKEQKRREKEEAEMRKQEKKQQEDALK

SEQ ID NO: 162273 - protein, 127 aa, Triticum aestivum
  Clone ID: PAT_TA_56691.pep
FVSDHAYQIHLKSPEKSRHFHHVRPFVPAIKNLEGLVAAADQDNEVTNDTVVHEQMPIQAKAADGRQWVYGPNAALNTEVPSYDLGIDNAGPVLMDDFSRAVTPEGKLILSHGMYHTSPVIFQYSCT

SEQ ID NO: 162274 - protein, 84 aa, Triticum aestivum
  unsure (1)..(84): unsure at all Xaa locations
  Clone ID: PAT_TA_56692.pep
MSALEKTLRRKLTVVSLWHLQGIPKKSNTRTCRCRCPALIRLLRSKDNGWYISEFIPSHNHSLMEKCGEKVYXPSQRHIDIYTC

SEQ ID NO: 162275 - protein, 208 aa, Triticum aestivum
  unsure (1)..(208): unsure at all Xaa locations
  Clone ID: PAT_TA_56693.pep
ILQDFLELRXYTYERLDGSVRAEERFAAIRNFSSQPTKGVVRDDSNPSGAFVFMISTRAGGVGLNLIGADTVIFYEQDWNPQADKQALQRTHRIGQLNHVLSINLVSQRTIEEVIMRRAERKLKLSHNIFGDKDATDGKGNDLGNEANDMRSIIFGLHQFDPADTAAETINEETLXKLKSMSENVIKMRTHEPSEXDDRAFEINPDLT

SEQ ID NO: 162276 - protein, 187 aa, Triticum aestivum
  Clone ID: PAT_TA_56694.pep
MGQTHRDVQSFKSELKRIIDSDKVHVEERDAPGGSFSSTKSSTTSLKMLLAKETSKEVESKSNAPSVVARLMGLEDDFPAKEPVLYHAKRDFRKSQSCDHLTVTKKAVQQQQHQNSIQSVTQVIHTSCETIEYDGVYERMLKRKPEWSLFQDQSSQEGRHSESKSGRMDTVPEKFRQGKSLAMEEKL

SEQ ID NO: 162277 - protein, 107 aa, Triticum aestivum
  unsure (1)..(107): unsure at all Xaa locations
  Clone ID: PAT_TA_56695.pep
FVCTETGRQASGKASDAKEAAEQAATGAANKAGQAKDKAAETVKGTVGEASKKTEQAKHKTKEAAXEAAAKTGAETHERSKQGKAKVEEAAKEKAGQGYETLKQTKD

SEQ ID NO: 162278 - protein, 187 aa, Triticum aestivum
  unsure (1)..(187): unsure at all Xaa locations
  Clone ID: PAT_TA_56696.pep
MTMPSEFHSQPLTTILLLLVLLSTASHLILEAVAAEHDEQQPITLPGCPDKCGNISIPYPFGMKPGCFREGFQVSCNDSFNPHRAYLAYDGVFQRINEIYFRAQKGLCRRNRVWNRTREDTALELIDISVAKGEARATPAVSSRCSANHTDSLSKSLXDAVGRKDXARFSWSVTRNVLIGVGWKSPA

SEQ ID NO: 162279 - protein, 51 aa, Triticum aestivum
  Clone ID: PAT_TA_56697.pep
NIVSYEFHGSKIAMASASPRPLPVPLPLVRVRGMPRTYRRGSLTWSEGGDH

SEQ ID NO: 162280 - protein, 79 aa, Triticum aestivum
  Clone ID: PAT_TA_56698.pep
TGQGAINRYIHPNKQHLNRIILVYPYTCRKRIRTKNMRGVGKERRGTCKWKNELPKSGCQSRMKMTYRAASLGRQRRCD

SEQ ID NO: 162281 - protein, 61 aa, Triticum aestivum
  Clone ID: PAT_TA_56699.pep
AVSERLSASIKVVDLALVDGVVTLCGEEEGPPPALEGLLPRVLSSSSELPYLGLAGSILAL

SEQ ID NO: 162282 - protein, 182 aa, Triticum aestivum
  unsure (1)..(182): unsure at all Xaa locations
  Clone ID: PAT_TA_56700.pep
MDPYAPAAPRSPVSSRRADLYGRMARDLDERGAAFLKGGETSQSLTLSDLFDIRDGAVVPRLKAADPPVRANVLYLDPVFAAEIAKAVKEVFLPYFDKAIWFQNSSMYHFSMFHASHHLEPILATKDEIEAEVDAVKRVTEAACPLKISLDRVVLTATGXVLFGLWQGESGTDPWRLRSKLV

SEQ ID NO: 162283 - protein, 116 aa, Triticum aestivum
  unsure (1)..(116): unsure at all Xaa locations
  Clone ID: PAT_TA_56701.pep
ILFQVQKPDSIRYKGAVDGLEGLRRTQGXLHHWVKAVPTNLPRVVPNAAAKAXSYEQAXRGILYXYRHQTVADNAQISPISRLAAGATXAGAIAMTVTYPMDMGRSRITAHTEKPP

SEQ ID NO: 162284 - protein, 79 aa, Triticum aestivum
  Clone ID: PAT_TA_56702.pep
SRRRVKEIETLVPTREDRLSQTCTRQGKGAGQGFWSSANASARLAGVSRWRGPEEDDAKGKRRRRVRNDCFLLTKGQFF

SEQ ID NO: 162285 - protein, 230 aa, Triticum aestivum
  Clone ID: PAT_TA_56703.pep
PRVRKFQPGHSPSRAVKHEASPKELSESDRVQLICRGQTRILHDNPDRLVGPGEVERKSQPAPPLLPHPDGNRNDVNTKADTRNTPSERNMVLMKSVHDNRGPNRTSHSSVLENAHSHPRETDDGAHLKKLKEDNLPLDQQPIIKKNAALIEKIGSLNNKARNVDARNVAEAFSNKEIKEKQLKNADSKADRVIKDVPCTPAITAFASASGQQDGFLLVLLWYRNCRRDL

SEQ ID NO: 162286 - protein, 199 aa, Triticum aestivum
  Clone ID: PAT_TA_56704.pep
DAWVRKKKKKKKKKKKKKKKKKKKKKKKKKKKKKKKKKKKKKKKKKKKKKKKKKKGGGLFKGSRFSSRGLQSFFFFLGAPNLIFWAGFLQRGGGKNPGVPQFFGFGKNPLFPGGGKRKRAPPVPLFQKLPPLKGKGDPPFRGPFSAGGVGGSPQGARFFCRGLYPRFFGFFPFFFPPFWGFSPGSFNGGASFLGPVFWF

SEQ ID NO: 162287 - protein, 77 aa, Triticum aestivum
  unsure (1)..(77): unsure at all Xaa locations
  Clone ID: PAT_TA_56705.pep
PSFDLLTIHLMENPNQRLTSLRRAALIRVLTCTKKSPDEYLVNAGHVCLEKNRDKQKIKXXPLPASYCYAPPPPRLI

SEQ ID NO: 162288 - protein, 84 aa, Triticum aestivum
  Clone ID: PAT_TA_56706.pep
LSHRTTPKPPSRRRALSRADIKLPSRLESGLPPVPTRLASPLRPSPPPAAFSSAPIGQIRLTRISHCLLQYGYQLPIIYQHSWS

SEQ ID NO: 162289 - protein, 186 aa, Triticum aestivum
  Clone ID: PAT_TA_56707.pep
MRGGRNTNCAQTTEGLGAPVSGQPARMQQVQHTVQTHGYGLARKHTYDWVVLILLAAVVVVLHYAPPFNRFVGKDMMTDIRYPVKPSTVPAWAVPVISMLCPVLVFIALYVARRDVYDLHHATLGVIFAVLITAAFTDVIKNAVGRPRPDFFWRCFPDGRPVFDQVTGGVICHGEKGFFTDGRKSF

SEQ ID NO: 162290 - protein, 81 aa, Triticum aestivum
  Clone ID: PAT_TA_56708.pep
RRSGGGRDPRAGVLREEIVLAPALIEAVVPVSYVFHPRLAGGHLIVFESSLPARPRGRGCSPYRSPARMVVTSSSFHHRHG

SEQ ID NO: 162291 - protein, 141 aa, Triticum aestivum
  unsure (1)..(141): unsure at all Xaa locations
  Clone ID: PAT_TA_56709.pep
MASSGGDESPSPAKPVLLHGDLDLWVVEARLLPNMDMFSEHIRRCFASCGTASSCAPXXSPPPNSRGVGEAGSRRHHHRRIITSDPYVTLSVAGAVVARTGVIPNSQEPGWDEQFFVPFAHRATLLGFQVKDNDTFGAQLI

SEQ ID NO: 162292 - protein, 180 aa, Triticum aestivum
  Clone ID: PAT_TA_56710.pep
IKSSVPRPDSLAHGPCSQLSSSSSSFCTNSDGITASVSLTNSQAFVRNPSFSHTQRSLDNCEHSVGSKPLFQGVDQVSNSTGWQVELSSNISTEKGNPTPLLQKVLQNGHLSDNTLVGVNMQNNGLSPVLSTAHNHGSLDAGLGHSRHRRQLTRERSSSSLSRGELQHEEQLVLNGAGCC

SEQ ID NO: 162293 - protein, 149 aa, Triticum aestivum
  Clone ID: PAT_TA_56711.pep
ELEKPVTCIVGFGGVGKTAIATALYRRFGDKFHHRAMVTVSQISDLGGILRSIDGQVRPQASNEKQQSSSAESGITAAIKGVRGHISQGTSAVMAKCCGGAGIPEEDRAKLDLLKKDLKDHFKENSYLILIDDVVCNNAGQYYKCTSRK

SEQ ID NO: 162294 - protein, 175 aa, Triticum aestivum
  unsure (1)..(175): unsure at all Xaa locations
  Clone ID: PAT_TA_56712.pep
MAPRWCFALLLLLCAAARARAGADASKGKWDPVIRMPGEEEPATGDESSEEEDGVGTRWAVLVAGSSGYGNYRHQADICHAYQILRKGGVKEENIVVFMYDDIANNPLNPRPGVIINHPEGEDVYAGVPKDYTGEAVTAKNFYAVLLGNKTAVTGGSKKVIDSXPNDHIFIYYSD

SEQ ID NO: 162295 - protein, 60 aa, Triticum aestivum
  Clone ID: PAT_TA_56713.pep
FRLKGFINPANLEGQLGACRLKALSGDRNDIDRTNNFVVSVQKSYHLQLQREILLKSLLS

SEQ ID NO: 162296 - protein, 74 aa, Triticum aestivum
  Clone ID: PAT_TA_56714.pep
KKKKKKKKKKKKKKKKKKKKKKKKKKKKKKKKKKKKKKKKKKKKKKKKGGGRFRGPNLTPPAWGGEVFFLGPQK

SEQ ID NO: 162297 - protein, 215 aa, Triticum aestivum
  unsure (1)..(215): unsure at all Xaa locations
  Clone ID: PAT_TA_56715.pep
THLINLWTFTMHTKTVAIVMTVAKVSTAVVSCATALMLVHIIPDLLSVKTRELFLKKKADELDREMGLIRTQEETGRHVRMLTHEIRSTLDRHTILMTTLVELGRTLGLEECALWMPSRXSGSSLQLTHTLRHPIPGGSSVQINLPVVNQVFSSNRAIIVPHTSPLARIRPVQGRYVPPEVAAVRVPLLAPFNFPNYDWPELSXAKSYAIMVLML

SEQ ID NO: 162298 - protein, 114 aa, Triticum aestivum
  unsure (1)..(114): unsure at all Xaa locations
  Clone ID: PAT_TA_56716.pep
GLGPSAARSASPSLCPGPCSSASPGACSPPSRSRGYPGPTCASRWTGPIRRPFRPAAFRAPWSSIPRRWRRSRPPFASPSSXGAXLGPLSRPAPGRRVRLRLQRRRRRGARLLC

SEQ ID NO: 162299 - protein, 194 aa, Triticum aestivum
  unsure (1)..(194): unsure at all Xaa locations
  Clone ID: PAT_TA_56717.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALXCVXTLGVKQMICCCNKMDATTPKYSKARYEEIAREVSSYLKKXVGYNPDKVPFRS

SEQ ID NO: 162300 - protein, 179 aa, Triticum aestivum
  unsure (1)..(179): unsure at all Xaa locations
  Clone ID: PAT_TA_56718.pep
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKXIGDCFGRTIKDEGXGSLWRGNTANVIRYFPTQALNFAFKDYFXRMFNFKKDKD

SEQ ID NO: 162301 - protein, 103 aa, Triticum aestivum
  unsure (1)..(103): unsure at all Xaa locations
  Clone ID: PAT_TA_56719.pep
ATVPLVPPLPPWPAAAAASLPWWRLASLPPSYPHRPPPSLPLPQARALLASYPPXRERRGKEAPALRLVPSDLASRSPVCWDLARPMAVVAPTPAPAAAPXPA

SEQ ID NO: 162302 - protein, 209 aa, Triticum aestivum
  unsure (1)..(209): unsure at all Xaa locations
  Clone ID: PAT_TA_56720.pep
MMVGHLPGGVLALSASAIATSLASVSGFSLLIGMSNGLETLCGQAYGAEQYGRLGVQTYRAMVTLTAVSIPISLLWVFMGKLLTLIGQDPMISHEAGRYIMWLIPALFAYAVSQPLTKFLQSQSLIIPMLWSSXATLLLHIPVCWLLVFKTSLXYIGAALAISVSYWLXNVFMLVAYIGCSNSCKETFSRPTLDAFSGVGWGFXRLALP

SEQ ID NO: 162303 - protein, 110 aa, Triticum aestivum
  Clone ID: PAT_TA_56721.pep
KKKKKKKKKKKKKKGKRALKDNRTNEQRTSNRGGPSLEDPDIQYTGPRTYNVLDWGKPKSIPMSRGFATHRTCQNLAVSQLRPDGETPSLLPAGAEREKASGTAPFPISC

SEQ ID NO: 162304 - protein, 133 aa, Triticum aestivum
  Clone ID: PAT_TA_56722.pep
TRGPFAAPLLRHPVAGVAPISCGRGFGLCSTSLIFDLCSDGLGLLRIWPRVKSQCILCWRRRHQAGVVPLLGGAATAVICVLLRASGETLCPVLRIWTANGVSASFSFVKTLSCLLAASLVLDLKTLVVFLLV

SEQ ID NO: 162305 - protein, 32 aa, Triticum aestivum
  Clone ID: PAT_TA_56723.pep
GGGGGYGSRDGGGYGGGGGGGYGGSGGGNWRE

SEQ ID NO: 162306 - protein, 60 aa, Triticum aestivum
  Clone ID: PAT_TA_56724.pep
RMCPVPQGAPDRQNLASQSTVAPLEPAVGFEGPKHRKDFPIKGAKALAAPFAGGLTILGP

SEQ ID NO: 162307 - protein, 68 aa, Triticum aestivum
  unsure (1)..(68): unsure at all Xaa locations
  Clone ID: PAT_TA_56725.pep
QPTTRVANAKKYRGFVTYEREGVSYRDPNERVKDWNEXCHLEIPKVFPPKRGAPTWFKNTPSSCLPVW

SEQ ID NO: 162308 - protein, 133 aa, Triticum aestivum
  Clone ID: PAT_TA_56726.pep
MGLGVRAAPFTYVAHALAVVAAAMVLYWCIHFRGGLAFEADNKNLIFNVHPVLMLIGFIILGSEAIMIYKVLPTVNHDTTKLIHLVLHAIALVLGAVGIYCAFKNHNETGIANLYSLHSWLGIGTISLYGIQV

SEQ ID NO: 162309 - protein, 67 aa, Triticum aestivum
  Clone ID: PAT_TA_56727.pep
LNYTGRPTTKMHTQWHQLQNTGQADEPLSKLHANRVQEPSAHNRVKRMTPVSIPERCTAETKLHACR

SEQ ID NO: 162310 - protein, 54 aa, Triticum aestivum
  Clone ID: PAT_TA_56728.pep
PLTQSSVQSVSSHAQLTRVMRSNRARHNCQSAWASDGKARSGWGFFAITAQDQR

SEQ ID NO: 162311 - protein, 43 aa, Triticum aestivum
  Clone ID: PAT_TA_56729.pep
QAPFVSPEYLRCGSRSSRSGSRSSRRRLHARAGAAWLRFSDSS

SEQ ID NO: 162312 - protein, 97 aa, Triticum aestivum
  Clone ID: PAT_TA_56730.pep
WIYHHYLAMLMALVSLTWEIKGQPDCSSKQRGVQLFLRWAIMQGIAMHLQNRYQRQRLRTRIALGKVRPFFDLTNRSICALCSFNIRTLQLEYKKSN

SEQ ID NO: 162313 - protein, 190 aa, Triticum aestivum
  Clone ID: PAT_TA_56731.pep
MLQWDYLSMGNETAPSPSDTPRDSLSSEHDIEGCASPRYTLIYNTSLNTVQKEEVDEQVKSIHKDNPIFVAVMRRFNVTGTCTLTFSKKYVQTHVGDKERRICLQRCGKRWDVQFSSSVEVKRIVSGWRKFVKDNDVETGDICIFELLKIDEMCTMEVHIIHAKDFDRPSQIGGRSVGWCKEPTTKTGEP

SEQ ID NO: 162314 - protein, 204 aa, Triticum aestivum
  unsure (1)..(204): unsure at all Xaa locations
  Clone ID: PAT_TA_56732.pep
MDHLAGASVSSADDPAPSTGNDGGLLDVIRAVERAEGTIRDQLQENSRLKEELMKKTRLLQRVSEDAASQATFGAGASQEPRAXRRRWQDGRPQQALRRALXPANPRGASALRQNXXFQRVGGDPLMHQQMRHNKYLDSGQANGAFRREPAGMDNGGPSHFSTPSSRSVSPARPRKEADYDSRLNLPGQGLLPGLEMNSNMSWK

SEQ ID NO: 162315 - protein, 121 aa, Triticum aestivum
  unsure (1)..(121): unsure at all Xaa locations
  Clone ID: PAT_TA_56733.pep
SYLNSIDWPSTIQRTDRKKPVPTQLNWLEIHLSLASXRTNKQAPTDLPYKQARRLNGERHAAWSHSLRAACGVLTRRAIDSLASYLPLVPFAFFPFLLXTLAVFARLAINRWLHVCDRLID

SEQ ID NO: 162316 - protein, 56 aa, Triticum aestivum
  Clone ID: PAT_TA_56734.pep
VLNSIISQIQPCSTYYALARMIHCGGERRRTSEGQGQYIGGLSSPDSKEPTAWPDR

SEQ ID NO: 162317 - protein, 146 aa, Triticum aestivum
  Clone ID: PAT_TA_56735.pep
GGKKGNVHRKGRKKGEGPETKALKRGAESLPGTATTPKHKGPGQGGSPQPVRKGNGKEGRTGRASKRIRQADERGNGRQNPKGRATPGNKPESSNEKRRNNENKKSDHHKIVFFFFFFFFLIFFFFFFFFFFFFFFFFFFFFFFFF

SEQ ID NO: 162318 - protein, 87 aa, Triticum aestivum
  Clone ID: PAT_TA_56736.pep
LILQTLENMRSFYCFCRELGELGTEYGVNNQYIPEQYFCDIVYTDLVIVEYLPNFFPWTLYCIFELVRIADAFYIFLVVYATIQGSI

SEQ ID NO: 162319 - protein, 57 aa, Triticum aestivum
  unsure (1)..(57): unsure at all Xaa locations
  Clone ID: PAT_TA_56737.pep
TQKKGYXLVXXPLRDKKCLVNWFKCCFNWRRIHLAPPTSTCNLRAREGFSIQYFCLA

SEQ ID NO: 162320 - protein, 140 aa, Triticum aestivum
  Clone ID: PAT_TA_56738.pep
AGSSSGLSSQEDASGRGEPEPRPLVGRRCSTRSTPPPPPAPPSSSCWSPPSSTAPPPPKQMELAESPAVRRSRGRRGGRPAVRRGEAPRPDRPEPVASLRAGLPSMGDSSCTYPDQKLQKHARGEGEKRTRNLLACGTYE

SEQ ID NO: 162321 - protein, 65 aa, Triticum aestivum
  Clone ID: PAT_TA_56739.pep
PKFTALGVTHNDWTDTAVTQPNLLALHHIFLWSGGIEENRTERTALHQQQPKRRGERDLHWSITL

SEQ ID NO: 162322 - protein, 81 aa, Triticum aestivum
  Clone ID: PAT_TA_56740.pep
FNFGGPKKKILRWKDGVVKLDSLKRAPLFFFFFFFFFFFFFFFFFFFFFFFFFFFFFFFFFFFFFFFVNLRTSRTRGRTSG

SEQ ID NO: 162323 - protein, 143 aa, Triticum aestivum
  Clone ID: PAT_TA_56741.pep
MDAPAMLTRNHVPENIAAEEGGQQQMHRDEKQHKPVLKKVKDKVKKIKNTIVGHGHGNGNGHGHDHDHEQDTGGSNSTDEDEEDVAMREAEVEKGGYQQDVEDKPIFTDSSPELHGAPMYDSERIPAAAKEVKHNDAPGVRAG

SEQ ID NO: 162324 - protein, 102 aa, Triticum aestivum
  unsure (1)..(102): unsure at all Xaa locations
  Clone ID: PAT_TA_56742.pep
WRCGGSFSSSSSCRRGEERPSSSSSHGVPPFTFLGCLXSSLFIQVGXGFVPVIPLSCSSWRWGCVFFSSCCVLSSQLDCMFVVSQGISSLWAPXXXXXXXXX

SEQ ID NO: 162325 - protein, 187 aa, Triticum aestivum
  unsure (1)..(187): unsure at all Xaa locations
  Clone ID: PAT_TA_56743.pep
MSDELKRGIAATVRGMSFGGASSVAAGGKRPFEYGRTHVVRPKGAHKATIVWLHGLGDNGASWSQLLETLPLPNIKWICPTAPTRPVAIFGGFPSTAXVXMLADLSEDSPDDVEXLDSSAAHVANLLSTEPADIKLGXVGGFSMGXAATALYSGTCFAHGKYGNGNPYPVNLRXGXGLRGWLPCARS

SEQ ID NO: 162326 - protein, 196 aa, Triticum aestivum
  unsure (1)..(196): unsure at all Xaa locations
  Clone ID: PAT_TA_56744.pep
MGRNSPEHRRRCPPRPPPRRHGPQDMASLPIPDELLAEIFVRLPTPTDLVRASAACVSFRRVVADRSFLRQFRKLHAPPLLGFLGPHTGFDPAERPHPSASAATAVALAADFSFSFLPAPDPXSXAGLVWDVRDGRVLLRGMPLENSHGVVFTETVVCDPLHRRYLMLPSIPDDLAASGGATPTFMRDFSCSRRRR

SEQ ID NO: 162327 - protein, 75 aa, Triticum aestivum
  unsure (1)..(75): unsure at all Xaa locations
  Clone ID: PAT_TA_56745.pep
NVQLYDTISSKKKKFAPPSSRINLFLSRANPXNKYSFATKCRQINFRRLNQVMWMSYLVLNAHKPSLNRVSQPWL

SEQ ID NO: 162328 - protein, 81 aa, Triticum aestivum
  Clone ID: PAT_TA_56746.pep
VSVRFAANWRFVSLVSEHSSPAQQQASQWLCAFSGIRCDMSCLISSLFGVAVSKPANQRNCRIYVVGYELLLVSLCSLLVQ

SEQ ID NO: 162329 - protein, 179 aa, Triticum aestivum
  unsure (1)..(179): unsure at all Xaa locations
  Clone ID: PAT_TA_56747.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKDAAEGQESEVAAAATEEAKKSNNVQRKLEKRQXGRTLDSHIEGAV

SEQ ID NO: 162330 - protein, 185 aa, Triticum aestivum
  unsure (1)..(185): unsure at all Xaa locations
  Clone ID: PAT_TA_56748.pep
MLMFRSYTVQYIEKTFPLSRANREMLQKAEYDIQVWCILLDDKVPFRMHWPLHSDMQVNGIPXRVVSRQATQPLGANGRDDGLMLTQFLKEGPNKIVLFRSDSRAFCLGVRIAKRRSLEXVLNLVPKEQDGEXFDDALSRVRRCVGGGTEADNADSDSILKXVADSVSVNXRCPMTGSRIKELVG

SEQ ID NO: 162331 - protein, 65 aa, Triticum aestivum
  Clone ID: PAT_TA_56749.pep
KKKKKKKKKKKKKKKKKKKKKKKKKKKKKKKKKKKKKKKKKKKKKKKKKGGPPWRAPFYRPREAT

SEQ ID NO: 162332 - protein, 161 aa, Triticum aestivum
  unsure (1)..(161): unsure at all Xaa locations
  Clone ID: PAT_TA_56750.pep
PPATSPTSPSSSRAPPHLSLLPWPPQVSAXIRVAPSPTPPTSTSSSPPPPWRASPSTLIIAGVPYPEFHLCPKPPSAATAVPLVRALPGVRAVSHVKRGVSLIIPVAGALPEVACGARTAAGVELLPLLHGRRREGEEGPDPSLPAGPGGLAVPPVSRTPR

SEQ ID NO: 162333 - protein, 157 aa, Triticum aestivum
  Clone ID: PAT_TA_56751.pep
EEVRMRVTYVMPPESPSEIAEESDGPQRILAPMQRIVNNGRSASELSSGSVSLRSAELGTEVGSPTGPVVRTEELLKAAGHAAETRTYTGPDAQSLELLALITKLTKEKDSALEQNKKLHNELELVRRDASKQGGFSLIFVLVCGLLSIILGYLVKK

SEQ ID NO: 162334 - protein, 102 aa, Triticum aestivum
  unsure (1)..(102): unsure at all Xaa locations
  Clone ID: PAT_TA_56752.pep
MPRHLLLPLPLLLLVAAVGASAGDAGGERTYIVRVDADAKPSAFPTHAHWYESAVLAASGGGGGWPXXXPLIHTYSSALHGFSARMSPSAAAXLAGALGVSV

SEQ ID NO: 162335 - protein, 69 aa, Triticum aestivum
  Clone ID: PAT_TA_56753.pep
IEQGHLWQEYHRPKCYLFISIRVHKNKIRQSHRRCSNSEITSHPNSHLKQEDNPKVNAIPKPRSAPWLR

SEQ ID NO: 162336 - protein, 54 aa, Triticum aestivum
  Clone ID: PAT_TA_56754.pep
HDQEGTSLQQRWSTSLSSVESLLARFVLKKPNLLDLFLRSQTITNKILATKLEI

SEQ ID NO: 162337 - protein, 121 aa, Triticum aestivum
  Clone ID: PAT_TA_56755.pep
MPPSMPKRRRGVAASPRCRKKQKRLDAICDVAPTPPPGGGGGGGGGGEDSDPESVRRSTRSRRAPVTLDTSPAPSPRRMRPRRGGGVAGPSGSPRTGGKGRARGQAVARAVDGEEDEEDGG

SEQ ID NO: 162338 - protein, 71 aa, Triticum aestivum
  Clone ID: PAT_TA_56756.pep
FNFFKKKKKKKKKKTKKKKKKKKKKKKKKKKKKKKKKKKKKKKKKKKKKKRGGRFKGTKFNYRGLERKNFF

SEQ ID NO: 162339 - protein, 177 aa, Triticum aestivum
  Clone ID: PAT_TA_56757.pep
MEVATATEASAPAASGGASRRGHPFPWLDVAISEPYYFLHLIAFFSYFAARTTAPAAEDDPELHSRLIRREIQAVLVFLVLFTVKIVKEEHWETFIADSLLYAKGLLLVVTFVIDYWLTVGYLLGFIVIYAMAQQPPYDGLGTFYNYILSHLTWEVMYRCCPPQKKRKKICVGKLYS

SEQ ID NO: 162340 - protein, 42 aa, Triticum aestivum
  unsure (1)..(42): unsure at all Xaa locations
  Clone ID: PAT_TA_56758.pep
XPPPPPLPQAPAYSFKLNQQVSMSFIYKIILSNLIPQRQESR

SEQ ID NO: 162341 - protein, 65 aa, Triticum aestivum
  Clone ID: PAT_TA_56759.pep
SLGGCNVGDSRAVVSKGGKAIAVSRDHKPDQTDERQRIEEAGGFVMWAGIVIRPKKLPTSPCACY

SEQ ID NO: 162342 - protein, 72 aa, Triticum aestivum
  Clone ID: PAT_TA_56760.pep
SRGHGLARMESVIEEDEVSLEKLMAGTALHTARSSDSQTVLAFRGPLMLRLFLCTLYNLCGTLFGAIFFSRC

SEQ ID NO: 162343 - protein, 94 aa, Triticum aestivum
  Clone ID: PAT_TA_56761.pep
ESCEVSVVEARWATSVSNAAARRPAAATLHAHGCSVSWSEERSERGGEMDIRDCIVRTARLSVAGPEMALGLILAFLSIPLYDGACPAAMLPTP

SEQ ID NO: 162344 - protein, 151 aa, Triticum aestivum
  Clone ID: PAT_TA_56762.pep
LTVAASSQSSPSSPRHHPPRKGGCLAAAATADAAPAASAATAAAGARCSPTWRPPPAPPPWSCPPPPTRGAPAGSRRPARPPAATAPPASAAPRAAAAAAAATDPPPTRTPGRDEHEDEKDTHARTITTSSHTNQYIITSRRMRSRCARAE

SEQ ID NO: 162345 - protein, 97 aa, Triticum aestivum
  unsure (1)..(97): unsure at all Xaa locations
  Clone ID: PAT_TA_56763.pep
CRPCVCPPGCLAARLLGPLPSSSSALWSSLGGGRGVGRXVWSWSFSAPSALVRAVPLPSSRLPRWPPRRSACLGAWGAWRGAPGLVLPGCRSSSGSA

SEQ ID NO: 162346 - protein, 199 aa, Triticum aestivum
  unsure (1)..(199): unsure at all Xaa locations
  Clone ID: PAT_TA_56764.pep
KNLNQSHARLSCPPLSIPSRRRRPRLSIPSSKLRRRRSRFPRDRCAAIPSRSPDLTPPPPVPPPLATRRTRAGPQQGWLPRAPDVQEFRQIRFRPGCESCTGHSGGPTSCASSSPSTPSLSSSGPLNSTTNFFDAVMQVRVHTVRRLIHACLFQSRSLNKCSERGSYGRLAMSSMCXLTSSSVLQLGCRFLELLLQGIL

SEQ ID NO: 162347 - protein, 131 aa, Triticum aestivum
  Clone ID: PAT_TA_56765.pep
QLARGTQHPGQRCGVWLRPCGVKKRREGKKKASSIIVKGEPETKLFFVLLLTRSLPPFKKKKKKKKKKGKKKKKKKKKKKKKKKKKKKYKKKKKKKKIHEKKKKKKKGGDTLRNPNLFPLLGRQYFFFGGT

SEQ ID NO: 162348 - protein, 239 aa, Triticum aestivum
  unsure (1)..(239): unsure at all Xaa locations
  Clone ID: PAT_TA_56766.pep
GAINVVRGTKSSDEELFQIYSHSESIALVVDSPQFFNRLAESFISRINARFIVXLWGDKSSLNSKAVMDIPVYDYNDITELGRENRNALCYSSELFEQGQQGVFEAIGPEDVATLIYTSGTGGTPKGVMLTHRNLLHQINNLWDIVPAVPGDRFLSMLPXHAYERSTEYFIFTHGIQQVYTTVKHLKADLQHHQPHYIISVPLVYETLYSSIQRQISASPPARKTVALALIKDKFAIYG

SEQ ID NO: 162349 - protein, 61 aa, Triticum aestivum
  Clone ID: PAT_TA_56767.pep
PRPPTRPSSLSDEEKGGSEKKKKKKKSKEGGEDVAPESVEVEKSEKKKEKKKKKKDAEEAQ

SEQ ID NO: 162350 - protein, 187 aa, Triticum aestivum
  unsure (1)..(187): unsure at all Xaa locations
  Clone ID: PAT_TA_56768.pep
GRVGTVVGPDGVEVTNTVPAVTPEVKDALVKNIRRRMTPQPLKIRADVEMKCFQFDGVLHIKEAMRKAEAAGNADCPVKIKLVAPPLYVLTTQTLDKDQGIAVLTNATKVCAEAIEKHKGKLVVKEAARAVSERDDKLFADTIEKLKLAXEEVDGDDDSEEEDNXHGRTWTSQRLALARTERVSSRG

SEQ ID NO: 162351 - protein, 170 aa, Triticum aestivum
  unsure (1)..(170): unsure at all Xaa locations
  Clone ID: PAT_TA_56769.pep
HTERVRAMAASELHFLLVPLVAQGHIIPMVDLARLIAARGPRVTVLTTPVNAARNRPAVEGAARAGLRVDLAELPFPGPRFGLPEGLENADQMVDQTIYVKFFQXXWGMAEPLEEYXRALPRRPDCLIADSCNPWTAGVCASLGIPRLVMHCPFAYFLLGVHSLAKRGVY

SEQ ID NO: 162352 - protein, 82 aa, Triticum aestivum
  Clone ID: PAT_TA_56770.pep
FMGLVRERPLCLSVWATFGKGDWCRPFWVVVQLGERRTVSQGGFIWVPPGVFPSPERCKTGGPCGLYLRWPYCRGYCCCVRA

SEQ ID NO: 162353 - protein, 147 aa, Triticum aestivum
  unsure (1)..(147): unsure at all Xaa locations
  Clone ID: PAT_TA_56771.pep
GRRGRARRRARGSRGWRRRRSGPARRGGASRGXCAXQREXARERGEVPRLRRRARXWRAARRRARRARGAARRRRGRWARRRRRPAAASSASAWGTGAGTPPARRPTPESMAALDSLPSGREREREENGREIGPPPLFLGSLRLTSD

SEQ ID NO: 162354 - protein, 176 aa, Triticum aestivum
  Clone ID: PAT_TA_56772.pep
KKKKKKKKKKKKKKKKKKKKKKKKKKKKKKKKKKKKKKKKRGGPFKGTKFYSPGLARKNFFFGAPKINSRARVLKRGGGENPGGPQIKCLGKKPPFPRGGKKKKAPPKSPFQKLAHPKGKRDPPLNGPLNPGGGWGFPPGDPLLLQAPKPPLFRFFPFLFSPGWRVSPEKFKRGAP

SEQ ID NO: 162355 - protein, 79 aa, Triticum aestivum
  Clone ID: PAT_TA_56773.pep
TKKKKKKKKKKKKKKKKKKKKKKKKKKKKKKKKKKKKKKKKKKKKKGGGLLKEPNLTTPAWQGKIFFMGPPKLISGAGF

SEQ ID NO: 162356 - protein, 117 aa, Triticum aestivum
  unsure (1)..(117): unsure at all Xaa locations
  Clone ID: PAT_TA_56774.pep
XRXRERERERERAHGAAAARRREGTXXXSPPPPSSLLISSRSSRHQPPGRARPRRRRTTAVCDPLLPGASPPSPLSSHFLQRGRGAAAAAHEKLGSRGGLGLGAFLSLSLAARSIRW

SEQ ID NO: 162357 - protein, 50 aa, Triticum aestivum
  Clone ID: PAT_TA_56775.pep
RKIVQKLEGHSDTVIAVSCHPKENMIASGALDNDKTVKVWVQKDGDQREA

SEQ ID NO: 162358 - protein, 62 aa, Triticum aestivum
  unsure (1)..(62): unsure at all Xaa locations
  Clone ID: PAT_TA_56776.pep
MEIGECGINLSSSQKQRIQLGRVGYQDCDIYXLDDVFSTIDAHTGSEIFKVHFTIYYWTYLY

SEQ ID NO: 162359 - protein, 109 aa, Triticum aestivum
  Clone ID: PAT_TA_56777.pep
MPTDVIERKLAERKGTTRDAGRGEALNADDVMMRVKEADQMTGTGFNDVGKMGEEGTGMKAALRADDEEDVMLRVKAADQMTGQAFNDVGPMGEEGTGWGPALRARKDA

SEQ ID NO: 162360 - protein, 55 aa, Triticum aestivum
  Clone ID: PAT_TA_56778.pep
KGTPHFFFIFHFFLSLYSFYFILFFFFFLFFFFFFFFFFFFFFFFFFFFFFFFFF

SEQ ID NO: 162361 - protein, 100 aa, Triticum aestivum
  unsure (1)..(100): unsure at all Xaa locations
  Clone ID: PAT_TA_56779.pep
TNCDHDGITKLHDHYXSPNNATFGELCFTTIGEACFTGTRRADIMSARLTQAMNACVTYADTSSCKLRESNRSILQTFTGSYSPLLIRIKLALTLLITQL

SEQ ID NO: 162362 - protein, 53 aa, Triticum aestivum
  Clone ID: PAT_TA_56780.pep
SELFVNFVSEFKERRGELSHYIIYSKFSEYYHQKYSAFLHHLPSTPLSAWEIF

SEQ ID NO: 162363 - protein, 218 aa, Triticum aestivum
  unsure (1)..(218): unsure at all Xaa locations
  Clone ID: PAT_TA_56781.pep
RKIKLTTGDDCTEPSSLKKPRDHAEPSLKKPRGRPRKYPLSVAKAVDSTKNSGSPGSSFVDPLVTSGVIPGDLALSCAIPSVKPVESAPKKGRGRPRKIPIDKXKVXRLTLNXTEDISRALICCTKPKKKRGRPRKYPLPSSSKHVSGTDTEFERETGYTESNSNLSLVTVDAELPVPSSSLTICGKRSRGRKVRGRPKETNPCALSSSVVFWCPITE

SEQ ID NO: 162364 - protein, 68 aa, Triticum aestivum
  unsure (1)..(68): unsure at all Xaa locations
  Clone ID: PAT_TA_56782.pep
MMHAVVIRSGFHLNVCVCNALLELYLYSGCLREAVMLFRQMEEKDSITWSTMIGGLVXNGRPNSALNL

SEQ ID NO: 162365 - protein, 71 aa, Triticum aestivum
  Clone ID: PAT_TA_56783.pep
ESHLWDNSCRREGQSRKGRQVYLGGYDKEEKAAWAYDLAVLKFWRVMCLLLWLFFWLWWWGGGGSLLLCVF

SEQ ID NO: 162366 - protein, 165 aa, Triticum aestivum
  Clone ID: PAT_TA_56784.pep
KKKKKKKKKKKKKKKKKKKKKKKKKKKKKKKKKKKGGGLLGATILTPACRRLNFFFLGPPKINWGAVFQHRGGGKTRGAPQINLVEKPPFSPGGNKKKDAPNGPPYQLCPLLGEGGAPPWGALLPGGGGGVSPRGDYFFCHPITPPFFGFPPFFPRVVGRFPPGI

SEQ ID NO: 162367 - protein, 52 aa, Triticum aestivum
  Clone ID: PAT_TA_56785.pep
HSLIQRLHHIQFEGMLTVRQDAHRRQIHAHHQGSCLEQEEMHFSLLLLFVKK

SEQ ID NO: 162368 - protein, 108 aa, Triticum aestivum
  unsure (1)..(108): unsure at all Xaa locations
  Clone ID: PAT_TA_56786.pep
IPCIPHVQSLLFAAXVATCLTREEDTRGARSVQRSVQRSQQDRPQGYHARRVQECHHDHNHHGMHEHYQQRPRSLXHGKVYHEEEHGRGRHRTCQGQREEDQPRQPGP

SEQ ID NO: 162369 - protein, 65 aa, Triticum aestivum
  Clone ID: PAT_TA_56787.pep
QTPTQQRVGTQAATRRRHLAPPTVHSTAQHSTAPPKLMPRVHKCSSIRVHQIRSMLKPYSHLSVG

SEQ ID NO: 162370 - protein, 149 aa, Triticum aestivum
  unsure (1)..(149): unsure at all Xaa locations
  Clone ID: PAT_TA_56788.pep
SSSPLSLKLSSAQQAYEKSDMSGAYPLFSTISLLSIFCLLWELGVTGGELLFRKALCFATPSPRLPXRAAAGGNRRAKPAXGGRRRPGLPXSRARRRSTTATAPGGEGSASGAAAVAALPGGPLLRLALLLLWVGGVAWPGAWPAVAAA

SEQ ID NO: 162371 - protein, 210 aa, Triticum aestivum
  unsure (1)..(210): unsure at all Xaa locations
  Clone ID: PAT_TA_56789.pep
LWLNLHFVDRGSSFSKIILAGRLPAQQNATVNLDLSTRSVSEFSSWAEFHNGVAAGLRLAPFQEKMLRTWIQYNRPSEPNFTHAGLLLAFGLHEHLRVLTMTDAYRYLSQEHDITTXGLLLGLATSHRGTMHPAISKMLYFHVPSRHPSSTPELELPTLLQSAAVMGIGLLXEGSAHALTMKILLGEIGRRSXGVDNVLEREGYACCRLC

SEQ ID NO: 162372 - protein, 69 aa, Triticum aestivum
  unsure (1)..(69): unsure at all Xaa locations
  Clone ID: PAT_TA_56790.pep
RRRLGRHLLMLLLETSLLTCGLNLEDPKTFRTRIQRMLKLVLIIVEDDKSAXQNDTDMPALKDDAGESN

SEQ ID NO: 162373 - protein, 151 aa, Triticum aestivum
  unsure (1)..(151): unsure at all Xaa locations
  Clone ID: PAT_TA_56791.pep
WRQCFRVVFSPGLALLVDAAAAKRRQGGTAVHLPGWYCEERCHGKQDYIYCYRRCRASPSASSGAGLRLASHRGAGEEDTGGGGGGAGLVGEGVGREEERKQVNMVIHPPWSCELECEDIVDPESDPDSYMACVRECXLGVQEYRVWEGXR

SEQ ID NO: 162374 - protein, 188 aa, Triticum aestivum
  Clone ID: PAT_TA_56792.pep
MVKGMPKSRPIKAAAEVVFDPSVSGPRKPRRAEAPSSSSEYHHFMGSNLSNMYHKPAPAKSTDMSDDEPDIDIEKLLKDVELFGATTWKDKNKIQNRKVVELGGKAIKKQRTPLSVAIPAMKNQQKREQKKIEEERLLGIFRKQNKNKKFEKLRPEDRVLRATEGRFKNGIPRCEAPHGRTKTIPRRH

SEQ ID NO: 162375 - protein, 148 aa, Triticum aestivum
  Clone ID: PAT_TA_56793.pep
LAPVDPSSNQSLHGVPSGLLNLPNPFATRIVAGVTKSEDHCSSQPLDARSSPLDHLSDVAGSAEAIVDEYMFYIGSVLVKMPAAEPEMEAIKQNFRTPSCNWCLLEISSNTIPCKGREGHVFFFVLSTSSTSYVAMWFRLLGESMWAE

SEQ ID NO: 162376 - protein, 216 aa, Triticum aestivum
  unsure (1)..(216): unsure at all Xaa locations
  Clone ID: PAT_TA_56794.pep
EDPSEGKQDKAAVDVSECLTEDHAINSETIENVTAGVSELNLPQEKTTEEQTEEKEHQHLSTEEIDSLLDICLLQALHTNIKDKDLPMPGSILWSNHILPCRPPGVTLDIKKSSHKKLSKWLQSKSSSGLISVKEDKHKKEVMLISISRKHPDYTAFKHHKRVQEPVEQHDNIVADGSSTKHXEVDEIYKPSSHVNPIFXAVDADQXKYYSASEAS

SEQ ID NO: 162377 - protein, 74 aa, Triticum aestivum
  Clone ID: PAT_TA_56795.pep
LKFVYVLALSCLNKFFAVFFKEDWRLSTVVKTTLILSNRCIVEGMCGVCINQCIVLPLNLHGFTINFYFARFVL

SEQ ID NO: 162378 - protein, 216 aa, Triticum aestivum
  unsure (1)..(216): unsure at all Xaa locations
  Clone ID: PAT_TA_56796.pep
VLESMCRAESQILSGSNLTSLLSNERFHRCMIACSAELVLATHKTVTMMFPAVLEKTGITAFDLSKVIESFVRHEDSLPRELKRHLNSLEERLLESMAWEKGSSMYNSLIVARPTLSAEINRLGLLAEPMPSLDAIAVHHDISLGGLPPLPFHKQPDKDEVRSPKRACTERRNVLVDNSFRSPVKDAIKSKFLPPLQSAFXSPTRPNPAAGRRNMR

SEQ ID NO: 162379 - protein, 76 aa, Triticum aestivum
  Clone ID: PAT_TA_56797.pep
QNGPLIVQLALHASYIICLTLDASTRLQRQKPLPNTQPYYYYQTRHATLARTDHTPRTHFTLLRELLHPRSRTGRG

SEQ ID NO: 162380 - protein, 43 aa, Triticum aestivum
  Clone ID: PAT_TA_56798.pep
LKKKYLINRALSFLIFFFFIFFPLFFFFFFFFFFFFFFFFFFE

SEQ ID NO: 162381 - protein, 92 aa, Triticum aestivum
  Clone ID: PAT_TA_56799.pep
ISSSRAFGASLHLSVLVSAYSLTSRLAYNAYTCGKAYWNYGTRTPLYGSSVALLPFYPFHSVLTNAMASSLPLTLSLTYYTRDTTGSGTSYA

SEQ ID NO: 162382 - protein, 132 aa, Triticum aestivum
  unsure (1)..(132): unsure at all Xaa locations
  Clone ID: PAT_TA_56800.pep
LKYNGFYDDSFLLVVADRHQCLHLKVSLLQDFFVRELWXKIGKQTYLEKVHPSVITNLYSSHNKITASAASIVLVGSNEELGISVTVQQVYPDTIHTDEYLYFDSLTTILMEQQVHCFGKGLLLMELKVWSG

SEQ ID NO: 162383 - protein, 87 aa, Triticum aestivum
  Clone ID: PAT_TA_56801.pep
QLSKMLIQEEIDENCTVYIDAANKDELAYRVDRSGGLVNAETGQRSDILIQVPNGAVANGGGGEAAKAVKKMRVMEDGDEDGMDEDV

SEQ ID NO: 162384 - protein, 81 aa, Triticum aestivum
  Clone ID: PAT_TA_56802.pep
TMPQEATTCLIGRNRKELRSRPEAWVSDTAGIEMGPQAPPSRDGCGRIHKRGDKPPDPAPTPSPAGGQARAGASPAGGQKR

SEQ ID NO: 162385 - protein, 56 aa, Triticum aestivum
  unsure (1)..(56): unsure at all Xaa locations
  Clone ID: PAT_TA_56803.pep
GCHGVVRASPNHTRRGGELXPSTPWSALDRGAEALRLAEVRNAMSGGVAAGPVLGR

SEQ ID NO: 162386 - protein, 79 aa, Triticum aestivum
  unsure (1)..(79): unsure at all Xaa locations
  Clone ID: PAT_TA_56804.pep
NHCSCSSTDRSSSLLVSYKQQEAALARCARATWPARRRWRWRSWSSSSRRRRRRCATWTTTTSWRASRRRRXXRRXPPQ

SEQ ID NO: 162387 - protein, 126 aa, Triticum aestivum
  unsure (1)..(126): unsure at all Xaa locations
  Clone ID: PAT_TA_56805.pep
SPPPAPMVCATEASGGACVLGSAPYRSASCLPAQAPPPSHVCRSGRLDKLLIRGHQPSLRGGHPRQXSCRCWSPACAAMPPPSPATNLAHCKLQSPCPSPLSRMLIRQPKVCTPLLPQGTQASRLG

SEQ ID NO: 162388 - protein, 50 aa, Triticum aestivum
  Clone ID: PAT_TA_56806.pep
KKKKKKKKKKKKKKKKKKKKKKKKKKKKKKKKKKKKKKKKKKKKKKGGAV

SEQ ID NO: 162389 - protein, 78 aa, Triticum aestivum
  Clone ID: PAT_TA_56807.pep
EAGRKGATTIGRPGSGCGRPYHFREESFRKRPKTRDGHFNVLERIDHELLRGSIGDYRVSRLDSAPCAFLHPAHYDAD

SEQ ID NO: 162390 - protein, 128 aa, Triticum aestivum
  Clone ID: PAT_TA_56808.pep
HHHVGQLILFNLLAFLRIDLHLYICYEIIGLCLWHYLKNRYSNLIEDHVKNRCPCCHNNCNCMDCLQSDIMHKIDKWNVSHEDRIKFAHRTIYFLLPWLKKLHEDQIQEKRIQAIIDGWIFFFFGALI

SEQ ID NO: 162391 - protein, 69 aa, Triticum aestivum
  unsure (1)..(69): unsure at all Xaa locations
  Clone ID: PAT_TA_56809.pep
TRRRGRPPRWPPPGSPRRGGRPAPPRTRRGEARPKPRRRRSPSSPAAPTXRSGGGAPQXPHGDHPEVRX

SEQ ID NO: 162392 - protein, 46 aa, Triticum aestivum
  unsure (1)..(46): unsure at all Xaa locations
  Clone ID: PAT_TA_56810.pep
ATKTKDHTRETARRRRRGRAATRPAXRTPGRXRPAPPAGTRETTPG

SEQ ID NO: 162393 - protein, 98 aa, Triticum aestivum
  Clone ID: PAT_TA_56811.pep
SELRQVKSVMDLKRVLDIVEEEVVDGDEEELASPDAKRRRTLLNSSSMQEAIGAQYMQKHLPKLEPFLRRVVQEEVHNVLIRHIDSAHRLVPKYYSCV

SEQ ID NO: 162394 - protein, 80 aa, Triticum aestivum
  unsure (1)..(80): unsure at all Xaa locations
  Clone ID: PAT_TA_56812.pep
GRGAAPAPWPSLLARDDQAEQXEGGADRVRQDRXRHPAPRRVGRDGQGPLXEGQARRRRRRRAATRPASRTPGEEARPPA

SEQ ID NO: 162395 - protein, 154 aa, Triticum aestivum
  unsure (1)..(154): unsure at all Xaa locations
  Clone ID: PAT_TA_56813.pep
GPRLPLASSPPQIRRPHPAHHRPPPAPTTPTLAPIHELEQPDEDDPTETXPLPPATTPPSATRTPPHHHRASSSPRPNPVLRPAAPPAPPEAAQADSSSCARLPPTPAEAVLDPVKGDIFTRAAVLDPCWSSGRRTEAQRASVLPCCREAAPAC

SEQ ID NO: 162396 - protein, 189 aa, Triticum aestivum
  unsure (1)..(189): unsure at all Xaa locations
  Clone ID: PAT_TA_56814.pep
PRRGRIPCTVGWPERQETLQLAPGMPPLHTSLMSWNNAGAPEGQHIIFDLVCRNNKFNDLAEMTVCNSFQEAEAGAFKLFPNILPIGPLFADGEFQKPVGNFLPEDARCLKWLDARADGSVVYVAFGSMAIFDPRQFQELAEGLELAGRPFLWVVRPDFTPGLSQAWLAEFXXRVXGPGMIVNWCFHHQ

SEQ ID NO: 162397 - protein, 146 aa, Triticum aestivum
  Clone ID: PAT_TA_56815.pep
MEMLSMLKVGYTVLRSETPATDLVNTFMDWAARRSLLLLALFMPPYYVYKLTASAAATVAPQDVAGKVVLVTGASSGIGEQIAYQYAKKGARLALVARREGSLREVAAKATDLGSPDVLVVPGDVARPEDCKAFVQATVERFGRCK

SEQ ID NO: 162398 - protein, 49 aa, Triticum aestivum
  unsure (1)..(49): unsure at all Xaa locations
  Clone ID: PAT_TA_56816.pep
QVKKAXPSSSNKTAQIKEAGTKRQQTSDESLDPKREEANSXLIRESXRT

SEQ ID NO: 162399 - protein, 106 aa, Triticum aestivum
  Clone ID: PAT_TA_56817.pep
FRQCNDTHIKTDRNLLPPGTRTPTVQPRRPGLPELPPLPPVIPLTHLHPNPTTSYMSSANDAGTICIIPASVHVLDLHLGDAAAGSVASIFFLENNVASISALAPS

SEQ ID NO: 162400 - protein, 148 aa, Triticum aestivum
  Clone ID: PAT_TA_56818.pep
GRALGPRPRARPPCPEPPPPPRLMRPPRGRSLCPFGWATFGKGPLCGPFCQYPPLPKGGFLPGHLVWDPPGFSPPPLFKPRPLDLILVPLFKSFCLARPRSLALVLLSRPPFFFFFFFFFFFFFFFFFFFFFFFFFFFFFFFFFFFFF

SEQ ID NO: 162401 - protein, 76 aa, Triticum aestivum
  Clone ID: PAT_TA_56819.pep
KKKKKKKKKKKKKKKKKKKKKKKKKKKKKKKKKKKKKKKKKKKRGGRLKGPNFTTRGWQGKIFFLGPPNLNYGAGV

SEQ ID NO: 162402 - protein, 230 aa, Triticum aestivum
  unsure (1)..(230): unsure at all Xaa locations
  Clone ID: PAT_TA_56820.pep
PMRDPGATPIHDGMRTPMRSRAWAPMSXPPRDNWEDGNPDTWGSSPAYQPGTPPARPYEAPTPGSGWANTPGVSYNDVPTPREGNYANAPSPYVPSTPVGQPMTPNSAAYLPGXPGGQPMTPGNAGMDIMSPVIGGEGEVNWALPDVLVNVLAAGDEGPGVVREVLGDGTCRVALGSSGNGDXVTVLPSELRVIRPKKSDRIKIMNGTLRGICWKTYRIXTGSDGIGEAR

SEQ ID NO: 162403 - protein, 218 aa, Triticum aestivum
  unsure (1)..(218): unsure at all Xaa locations
  Clone ID: PAT_TA_56821.pep
EKLVCFEYLPNGSLDNYISDESTGLDWSTRYNIIEGICXGFNLIYLHVQNDKPIIHFDLKPANILLGEGMIPKIADFGLSRLHDQQQSIYTTSRLGTRGYMAREFVDEGKITLQLDIFSLGVIILEVVTRHRHYPDVITETSSDDFIKLTLEKWRSVQRSPGHDSPKPDYEQIKRCXTGRSIXCVNHDHTKRPPITKVINMLQGSEIIDSNISNEEAA

SEQ ID NO: 162404 - protein, 84 aa, Triticum aestivum
  Clone ID: PAT_TA_56822.pep
APGRWPRARSPRASAPQAACLMPLCRARPWQRSAGGGCSKAHPLRPRGLYGRRIRGGLLPPPPGGRRQGFPSGVDVGRPISAPI

SEQ ID NO: 162405 - protein, 69 aa, Triticum aestivum
  unsure (1)..(69): unsure at all Xaa locations
  Clone ID: PAT_TA_56823.pep
SMARGRGPQREEXPLAALDVAGQGVFVSAFSVGQTSGSPQRSGPHMYTSSLGKADAWPCWSLGSPLALH

SEQ ID NO: 162406 - protein, 77 aa, Triticum aestivum
  unsure (1)..(77): unsure at all Xaa locations
  Clone ID: PAT_TA_56824.pep
MAXTPRERRMVAKXIEDGSLDELVRKRYQSFDTEIGAMIEAGKGDFETLEKKVLEWGEPTVPSGKQELAEMLFQSAL

SEQ ID NO: 162407 - protein, 63 aa, Triticum aestivum
  Clone ID: PAT_TA_56825.pep
KTRNGLMEAGYKFKSAVPQARCGMRQEDLFTVYVWCFLSPFSFLLFCSWNIFTLQCTSLSSTR

SEQ ID NO: 162408 - protein, 132 aa, Triticum aestivum
  Clone ID: PAT_TA_56826.pep
ILFKSESWSVMSILHPASANAFKYVTYKASSSRFFVLLVSRVPTIILYCSRSYGAIRNGSIRTDWSTRSTSRNATESRMVPASSAMSSRRSSATIASAPGGLPVRCVALESRLAERGRAAAARRGGRSLGFL

SEQ ID NO: 162409 - protein, 53 aa, Triticum aestivum
  unsure (1)..(53): unsure at all Xaa locations
  Clone ID: PAT_TA_56827.pep
WSVGLYRGFVPNALKNLPNSSXKLTAFDTMKILISTGQKELEKIMQDNQEKTS

SEQ ID NO: 162410 - protein, 93 aa, Triticum aestivum
  Clone ID: PAT_TA_56828.pep
GPTSPGSPRRSEKKKKKKKKKKKKKKKKKKKKKKKKKKKKKKKKKKKKKKKKKKKKKKKKRGARFKGPNFTSPAGEGKIFFLGPPNLIPGPGF

SEQ ID NO: 162411 - protein, 61 aa, Triticum aestivum
  Clone ID: PAT_TA_56829.pep
PEHPPRGPHQVRRSSVPQRRACPDPQGLGQVPVHRRQRRVRAYVRGRGGGLLAESTLDFSL

SEQ ID NO: 162412 - protein, 108 aa, Triticum aestivum
  Clone ID: PAT_TA_56830.pep
NIRTSGLGALAGLEPTNFITLATPHLGVRGKNREGLRFLQKLAAPLAPFIVGRTGAQLFLTDGEPSEPPLLLLLTSDHEDIKPISALAALEDRLLYAMVHMTASSYEI

SEQ ID NO: 162413 - protein, 44 aa, Triticum aestivum
  Clone ID: PAT_TA_56831.pep
GHKTQQAGHAIQSRAEDARAGGGGHTGATGGAGAGTGTGTRASS

SEQ ID NO: 162414 - protein, 121 aa, Triticum aestivum
  Clone ID: PAT_TA_56832.pep
MASEQSRREERAQAAAHKATDELAAARRDMREPSSPGRRTGIFGTVQESARSLMGAVRDTFSGGVRDTTTAHDSHSTGAMGTAGGKLNEYGSYASQKADEGKESASEMAEAAAGKTKETKD

SEQ ID NO: 162415 - protein, 133 aa, Triticum aestivum
  Clone ID: PAT_TA_56833.pep
TSSSVTCINSSVLGEAPASNITNLLGSFLMGNIVNTVRRLVNVISEGLSSTVSPKENCSTDAVVAKGLERGPARDTHKSKELRPHSVPSENNLFHCDAYEKLINGELNLSCRSSPEASEDYKMIPNADRAVSG

SEQ ID NO: 162416 - protein, 88 aa, Triticum aestivum
  Clone ID: PAT_TA_56834.pep
FSCRISILSCHRDCTFRIRGLRAASNQSSCSHGSVYQSVSQPLPVVSRLSRVRRVKLAEARNLLEEQAGRQASPSRATLLLLLMVADT

SEQ ID NO: 162417 - protein, 40 aa, Triticum aestivum
  unsure (1)..(40): unsure at all Xaa locations
  Clone ID: PAT_TA_56835.pep
FLSILVHWVQLFNIFPFRXFSVHATLDFTSVPSIYYHQFQ

SEQ ID NO: 162418 - protein, 121 aa, Triticum aestivum
  Clone ID: PAT_TA_56836.pep
VAKRLRPIILLQAETTTGRLVACRQPTASPVVLLGESGHWAGCRWTYSAFPMVRSILKSPVHSPNSLFLPPLLPSLSAPHLSLLQGPGHGAGSNRTPQSLPLAKVWCFGFLSLCSKQRMHP

SEQ ID NO: 162419 - protein, 50 aa, Triticum aestivum
  unsure (1)..(50): unsure at all Xaa locations
  Clone ID: PAT_TA_56837.pep
QLYKYIGEMPPEGISLIGXTGSGTSLIARAAANETGXAFLFLMNGPEIIS

SEQ ID NO: 162420 - protein, 71 aa, Triticum aestivum
  Clone ID: PAT_TA_56838.pep
TVVITNFSFGIKKKKKKKKKKKKKKKKKKKKKKKKKKKKKKKNKKKKKKKKKRSFKKKKKKKKRGRFLKTP

SEQ ID NO: 162421 - protein, 133 aa, Triticum aestivum
  unsure (1)..(133): unsure at all Xaa locations
  Clone ID: PAT_TA_56839.pep
APYHACRFLMGSGNERGSFAMSFLSTGLDKRLVDSSNDCSIKAVVFQVVPWSVKVYYHSLEVFIGGNSMAISEAVVLIHVAXSDDXLLPGXVXVLVMFPCRLRLATLALGFRGGFLPVDDFPRAAAGGFDVAS

SEQ ID NO: 162422 - protein, 121 aa, Triticum aestivum
  Clone ID: PAT_TA_56840.pep
RTGRDPSHTVGGFLVGPVLPALYILDGLRSGDTTGIAAMAPHAFLLSAQVFTEGLTTAFPWRFSLPVRAAVPVMYNASRMFAAGEWLRQEMEGATAAMGREGGGAAGGWAGRGVPRRRRWR

SEQ ID NO: 162423 - protein, 66 aa, Triticum aestivum
  unsure (1)..(66): unsure at all Xaa locations
  Clone ID: PAT_TA_56841.pep
RSHGTRPPRGRRGRRRRGPHRTGRRXAGGRXRRGPRRARPRSSGTPXPPWISPYLSSPNYGSPRLG

SEQ ID NO: 162424 - protein, 72 aa, Triticum aestivum
  Clone ID: PAT_TA_56842.pep
NSISPARDQTVSGSLPEYYGSGGNGGRASARGRGSRAVPRAGAPKPDAEHDADAHVPGTVQTLQINPCEKMI

SEQ ID NO: 162425 - protein, 146 aa, Triticum aestivum
  Clone ID: PAT_TA_56843.pep
LCPTIFFPCHRHPLPLPSKGPPQRAPTVQQPPSLPFPLLLRALGEVDWAVSMDEGGERWHGRERERERERERGRGGTGSATVALAAEAPVRCPEECLAAVHRLWTTSYNRCHQPRALPPPFLLLVWGADPGRRKEAEEDGGERTRG

SEQ ID NO: 162426 - protein, 233 aa, Triticum aestivum
  unsure (1)..(233): unsure at all Xaa locations
  Clone ID: PAT_TA_56844.pep
ELALPLAEVADNDGEGTIERPSKRRYRRNGSANATFDQERSSLYLAKLIILHDYPLHIVQQPAFSALIGSLQPCFKLSDVDAMEXEVYAVYLKEKHNLLQALSTMPGRMSLTVGLWITSQTLGYVSXLAGQFIDTEWRVHRRVLNFMMVASPHSQDALAEAISRSLFDWGMREKLLAITLDNDCPSHDIYSANLXRDHLSNKNGVMLKGQLFVVRCYAHILNAAGQDVITSVH

SEQ ID NO: 162427 - protein, 42 aa, Triticum aestivum
  unsure (1)..(42): unsure at all Xaa locations
  Clone ID: PAT_TA_56845.pep
RQFKRFTYGESPDLRNXPAPRSSASHDTPLLVSARLXTHRKP

SEQ ID NO: 162428 - protein, 97 aa, Triticum aestivum
  Clone ID: PAT_TA_56846.pep
EREIMSGGEIRIGEAHPDMHLSGSVLKFPCSCMSVALTAVHLKSYGLRAKLTVHLSGFLSSVDQPSNGLEDAGEAVHRPTSHVLALFCFSALQLCNG

SEQ ID NO: 162429 - protein, 236 aa, Triticum aestivum
  unsure (1)..(236): unsure at all Xaa locations
  Clone ID: PAT_TA_56847.pep
EASVYLVKPILMTIMSSFEGTPTTGYVGREVPNNMVSKATLSPALETALDYYLRVLAISISYAGPVLLNYREELKHVIMSAFQAPSWKVNGAGDHLLRSVLGSLVSFYPLDQYKPFSCHSIANIIEPWXCSKAHQDREVEMLNFPPKWHDPSQDELSFANELLEFHFQSAVEDLLTICQMEVQSETGDEKEHLXVTLLRIHSALQGVMSCLPELRXSYKDGRSKVVEPXFFIAGSS

SEQ ID NO: 162430 - protein, 97 aa, Triticum aestivum
  unsure (1)..(97): unsure at all Xaa locations
  Clone ID: PAT_TA_56848.pep
RPXAPGRRAPXGTASXXWRRTRWAGAPALLLRLRWRPRRPPAGSRRRTPCGPDPGCLCSAAGSSRIAGTPPPPRSPRPARPPPACLLLLFPHPLLER

SEQ ID NO: 162431 - protein, 119 aa, Triticum aestivum
  Clone ID: PAT_TA_56849.pep
PPSTFCPPCCSGVPRFRGLCCITPLCSFPPFSPFSIYGGGPPQLRSPSPPPPLLRTTPTLRGPPITPSTPTTTTSSVLGSPPPGVFLFFSVSSFVLSFLKRPCFFYVCGPRMLLPRGCR

SEQ ID NO: 162432 - protein, 75 aa, Triticum aestivum
  Clone ID: PAT_TA_56850.pep
SRNISSLFSKKKKKKKKKKKKKKKKKKKKKKKKKKKKKKKKKKKKKKKGGALKRTKVKDRGKERKNFFKGGTKIK

SEQ ID NO: 162433 - protein, 142 aa, Triticum aestivum
  unsure (1)..(142): unsure at all Xaa locations
  Clone ID: PAT_TA_56851.pep
MASVQYTGSQPTACDVLRLISCILTPIHSPLADSVQTGDCQNPASSQLMHLSTTFPFWHXRNRQEPIALRTCRPLCMLNGTRHAPWHEALSAGGVLATRTVNVTLAYGLLLAPFSXFFFLTRHGCPLYALNSKLPARFRVTA

SEQ ID NO: 162434 - protein, 149 aa, Triticum aestivum
  unsure (1)..(149): unsure at all Xaa locations
  Clone ID: PAT_TA_56852.pep
APEADARAGPSRGRSPKGLPGAACXRERWCTSLQRHPEDAEQLVEGALARAGGPQRERRVEAQRREDQVAAPVGAGGEALVQAEGEGLQARGQRRARPPPNGIWRRASARPVGIGRRRDRPRIWATCRAYGLWRRDRPQPPGRAIGLAS

SEQ ID NO: 162435 - protein, 70 aa, Triticum aestivum
  Clone ID: PAT_TA_56853.pep
KHIGHPLQARQSRFLMSGFMRDDILLLVKTQVAPEDGRTSAHVRPPITALVINDPHSITSHTHAEAIGFR

SEQ ID NO: 162436 - protein, 183 aa, Triticum aestivum
  Clone ID: PAT_TA_56854.pep
VWETATRAEGRPLSRLDKTRDSPTQHHRDLRTPSKLGVTFRFRSRRKHTSSSSCVDSDSLEDGDDAGGVPGEIHRLRPFHHRTPSSCSPNTASYHSAPARTSARSQPKHHRVHRRGSHPIDLAIQELPQDHDLEAKIFERGRLYEEEEAVGGKRMERWEASVGWWWRRWWRRRIRVRVRVRRG

SEQ ID NO: 162437 - protein, 175 aa, Triticum aestivum
  Clone ID: PAT_TA_56855.pep
THPPIGNSARKISKQPPGSRQTLAPRTRAAGTARSLGPIRIRPRPGGAPPAGRRQIRRRPHRHTLPPPCRINKYGIFRPPNPGSKNRRRRTGAARLSGKGRGRGNLLLGWLELEGGAVLVLAFPRPSSGFERGRGPQKWQKGEEGGRRRRSRSSKSLCSGGRAESVGAGEQQRAS

SEQ ID NO: 162438 - protein, 92 aa, Triticum aestivum
  Clone ID: PAT_TA_56856.pep
MAQAMEEWYQQMPIITRSYLIAAVLTTVGCTLEIILPYHLYLNPKLVVQHYRIWRLVTNFLYFHKMGKKNGADNLLGYSKPGRKMSTLVTDN

SEQ ID NO: 162439 - protein, 123 aa, Triticum aestivum
  Clone ID: PAT_TA_56857.pep
QPQVADAKKGQRGLRWVVQPGELQHDSHKLDRNGFPRRPEPGLDSHDRGDGGWRRRRPSSTWTYAAGATKERGAAQSDSPESDLDSHELDGDGCQQLAGDRDVQEPRSTVEMAQLCYHGIERT

SEQ ID NO: 162440 - protein, 102 aa, Triticum aestivum
  unsure (1)..(102): unsure at all Xaa locations
  Clone ID: PAT_TA_56858.pep
RPILTIGLCLDHDGLHDQTWQRTILRLHQTMTYNRDSRYRKRALKHAXIXDLEDLLHHLSDENAGLDTDVSTILLTKKQMLVEKMIEQSKENVNANKGAPLS

SEQ ID NO: 162441 - protein, 107 aa, Triticum aestivum
  Clone ID: PAT_TA_56859.pep
KVIDLFLTGPFSMLYWIGPSYTFLQALCQTAGGLQDSNAHLQISCLTAREDLVFHTHLFILIYIEFISYHFNCDVDLWLRCTLNTTCFCEFEVPTTKVLQNFSETPA

SEQ ID NO: 162442 - protein, 74 aa, Triticum aestivum
  Clone ID: PAT_TA_56860.pep
FQRREAFLVLRLDAAILMLRPSSGDHTSSERGLMPDISIAFTPAPSRVTALLPTATVGPRKRARHHHAEVGGRE

SEQ ID NO: 162443 - protein, 34 aa, Triticum aestivum
  Clone ID: PAT_TA_56861.pep
RSGDSYWIVILKFCFHFRVPSHPVVVVLSLFPSK

SEQ ID NO: 162444 - protein, 63 aa, Triticum aestivum
  Clone ID: PAT_TA_56862.pep
LGSVWILDLNIWIGLDWLPEGKDIRLVIPMVVYFKNYITGHYSRHDNFPFITIFIRNFCNNVH

SEQ ID NO: 162445 - protein, 247 aa, Triticum aestivum
  Clone ID: PAT_TA_56863.pep
ETCLRSAVFLFCSLVGSFNQDSGLNAFNESEVPCTSVRFQISGLHGRSQAVFVLFSLIGIGKTQWKNLQAKFRYHSLKRELSKVDCTYTDIKQLISGNDQNVRTSMNLFSKSLSSDAQEPQFCSESNYPDADPVIFCLDNQSECTRNHVDVAAARHHLKLLTETNLTSNAVVHQAAHSEISVEDNQQSISQHRSALVKQVCSLETGTVSLDCDNSDGDINVISRRLPDQNGTCIAGDKLCSSIIMLQ

SEQ ID NO: 162446 - protein, 62 aa, Triticum aestivum
  unsure (1)..(62): unsure at all Xaa locations
  Clone ID: PAT_TA_56864.pep
STWTLFARSRRRAPARVVRRTCAALLGXAAPLDRGRSSWTAISELVDKKSGAWVGPGISRVR

SEQ ID NO: 162447 - protein, 181 aa, Triticum aestivum
  Clone ID: PAT_TA_56865.pep
QCILIHNDLYISRCPRLSSLENILKSASLPTVRSIFIEECLGLSSMRGERFGELSCLKELKLSKCPNILWNGLVLPSSLLKLHLEDCGDISNYIPNCLVNLENLIRMSLVKLITIRSIPAEIWYDNLLELQTLEISGCPDLISIGGPEAIEHIENAFVESCAKLTGLTQPLERCRRPPKSA

SEQ ID NO: 162448 - protein, 110 aa, Triticum aestivum
  Clone ID: PAT_TA_56866.pep
RIKALRTWHRCCWTWDLGLLLLDLGTGIAAAVCLLGTPGSGIAAGNKDQGSLLEARTWERLGPGRMEEKQGQAEEKQGRASGRWPGERAGYGLADGGRRWGYRFKLGATM

SEQ ID NO: 162449 - protein, 225 aa, Triticum aestivum
  unsure (1)..(225): unsure at all Xaa locations
  Clone ID: PAT_TA_56867.pep
APAINLPRRRTQNPKIPGAEEGAAGAAVRRWVEAGGGRLVLDGGLATELEAHGADLNDPLWSAKCILSSPHLIRKVHLDYIEAGANIIITASYQATIQGFESKGFSKEQGENLLTKSVEIACEAREMFLKQHPDQSTPLRPILVAASIGSYGAYLADGSEYSGDYGEAGTLEFLKDFHRRRLQVLAEARPDLIAFETIPNKLEAQAYVELLEECNIXIPSWFLQL

SEQ ID NO: 162450 - protein, 138 aa, Triticum aestivum
  Clone ID: PAT_TA_56868.pep
SARCSQRRLTRASGSQGPPERSTGRGSGLWRRTRRPGDPRGARSPERSLLWGMGMPAAPPASLKTKVGPRLLRLPQIMLAPQAPHGAGQETAALFFLLALPVLALALLIVLTAHRNRSCESVRKSRIQEVTYSHERHR

SEQ ID NO: 162451 - protein, 145 aa, Triticum aestivum
  Clone ID: PAT_TA_56869.pep
RSPSRFPSPPWPPSTSRPPSPPRRAWEPRRYASTPSFSFPTQERPGALHRRHRLRLLHRCPELATDDSPPSAATKLPPAFLAPRDVGTQDPDATVEMTPTTLEVPTTTCRPLTTAGSSLGESQAGGMRLFRSISQFVLAILWQLV

SEQ ID NO: 162452 - protein, 198 aa, Triticum aestivum
  unsure (1)..(198): unsure at all Xaa locations
  Clone ID: PAT_TA_56870.pep
MQAQFMKSVTKGPRLNFPRFSGTNPVGWIRQCNKYFQMSGAPEEYKVSFAQMYVVDEADVWLKRSGLLKKQLNWKXFGEEVIKIFSDKGSYGLTEKFNSVKQLHHSVSEYTKIFEDLMADVQEENPELGELWFVRCYVNGLREGIKFQLRPFRPQTLTDAYCMAKDIEPNHPHIATISKKHSAPFNNFYQIPNWTPQA

SEQ ID NO: 162453 - protein, 251 aa, Triticum aestivum
  Clone ID: PAT_TA_56871.pep
AVQAITRKGSSEVVQDNKLDGSDSTDSVNVKSSLVPEDKGATFEMSDSAVPKPSSPRSKDNDKILEEEKAIRATGTTLENGKKNVVKGSADHEYFLAEDLAKEYTGNLSQVGGKDTSKEVDEKLISNSISGNKVFDTSMEIPNQLQDTSLGRKSNDLTDAELGSEVEECVSSLDKTSSWVDDAKHGSDSVENGICNHHDCNMDHVHGQPFFNFDDSHSYIHPFIKTKIAHLWDHDLKQNSRHSIVLKSNYA

SEQ ID NO: 162454 - protein, 78 aa, Triticum aestivum
  Clone ID: PAT_TA_56872.pep
AVILLKLSSSISTIERRSNSQFTNHKQRAITKQGFGLNIKIPSSRRAGQAYDDSTAITSDDLRTMYSPSEPLTRRTRG

SEQ ID NO: 162455 - protein, 49 aa, Triticum aestivum
  Clone ID: PAT_TA_56873.pep
STDIPRCFQTDIIFCKFRFALGFIRIRICTTCVGEVPVLKLHSFNHLFL

SEQ ID NO: 162456 - protein, 145 aa, Triticum aestivum
  unsure (1)..(145): unsure at all Xaa locations
  Clone ID: PAT_TA_56874.pep
NLPEECDISWTXFLLEAAPSVEDLCITVWDHKCRKESQKSRSRKMDVHWEPSDPDFKHKNLARLTIYGFQSDDNFIGYVRRVIQAAANIREVSLHDRKVCRLCSEKFPHLGVRPSSYPRTSEEVDLLMKNMTAAATTSPDIHFCS

SEQ ID NO: 162457 - protein, 59 aa, Triticum aestivum
  Clone ID: PAT_TA_56875.pep
SAPLSEIAHLGPWWHKEKEAWSRTNCQMLGSRFLFYDMSFSGKLLSRTQLMCSFFFQET

SEQ ID NO: 162458 - protein, 86 aa, Triticum aestivum
  Clone ID: PAT_TA_56876.pep
CINFIHIDIYEKNILLQISIEKREHLNHWRRKVEIELSNSKHLGLQWSLLSSIPCLSKLYTRRRPIREPKLNKLQKDKMENGLKKY

SEQ ID NO: 162459 - protein, 187 aa, Triticum aestivum
  Clone ID: PAT_TA_56877.pep
MAAPAASDAASCCSLYRCICCWRRACSPRIPRVAPGRDYFCMPAGADDQPAWSLVVGCRSLSLSFSDSALRLHRFRVTRCGRVLGGSNDALEVLQDVRAEDKKAPAEKWCLWTASATQCPDGHSLCIFCEDFDPVNIRYSAPPQVLRLDVNAEDKLELSPHASSSSRASLAVLPSLSCWPDLGCIRC

SEQ ID NO: 162460 - protein, 67 aa, Triticum aestivum
  Clone ID: PAT_TA_56878.pep
CGNPILRGELIMPHPCHCTPYKNYKIRKQETYLIINLNENRCSICPQTNYKHLIKLLPHNKKGSVKI

SEQ ID NO: 162461 - protein, 131 aa, Triticum aestivum
  unsure (1)..(131): unsure at all Xaa locations
  Clone ID: PAT_TA_56879.pep
LAVKCWVIKTTVEIIRSSVTVYRPMTLSKVMGPAYTMIITPGRNKLDQYQILEYPLTTESALKKIGDNXHLVLIVDLKADWKKINAAVKKMYDIQAKKVNTLIMPVGKNKAFVKLTPHYDALDVGNKIGVI

SEQ ID NO: 162462 - protein, 239 aa, Triticum aestivum
  unsure (1)..(239): unsure at all Xaa locations
  Clone ID: PAT_TA_56880.pep
ATMSSGLNMXLDDLIKQSKSRPKANPAFSSGPTRRAAPSARTMPYPPSAPKAATADSLYGVYSEHVAAMATSPPPPAVAGPQALETGTKLHISNLDSSVTVEDVQELFSEIGELRRYSVNYDKDGKSQGSAEVVFARKVDALDAIERYNGVLLDGKPMKIELIGNKTEPHPTEPLMDNDTSSNYNATPNSLLQRGDQRGPFHGNGRSGSSGQGGAGKRGMFQGNVRPGKHCQDRGWAGT

SEQ ID NO: 162463 - protein, 150 aa, Triticum aestivum
  Clone ID: PAT_TA_56881.pep
SSIAAAAELQRPGRGPIAAAAELQRPGRRSIAAPGALHWSAGDNGGRCYAARDSHGGSSRSANRLGHAGTSTAPTTPPAARPRTPGSARPRAAAARPWAPCRCDETRGVAAGEEVSESKAIAGRDLGWGVVIWRVMSRGGGEWGGRRTRG

SEQ ID NO: 162464 - protein, 28 aa, Triticum aestivum
  Clone ID: PAT_TA_56882.pep
RLWSIIRCSALEDEVERESDRTFNLSTF

SEQ ID NO: 162465 - protein, 140 aa, Triticum aestivum
  unsure (1)..(140): unsure at all Xaa locations
  Clone ID: PAT_TA_56883.pep
MCHVRGAGDKFSAWGRYYSGVGKSLTDRILIVVDDMRHFTRRCYVDXADTDRLFEHAGKIHGDRNPTCTGLFAKRVVGRTLTDPSSLTDMILRAFXVIFGPVDETMIGFNYKAVDKQLALEEIFTVVLIMMTEIVDDFVG

SEQ ID NO: 162466 - protein, 118 aa, Triticum aestivum
  Clone ID: PAT_TA_56884.pep
QCSAGRGSMERRRQRRTLSTQHATVMAKAPGPATRFGHAGTSTAPTTPPAARPRTTGSARPRAATARPWAPCRCDETRGVTAGEEVSESKATAGRDLGWGVGICRAMSRGGGELVRKT

SEQ ID NO: 162467 - protein, 147 aa, Triticum aestivum
  unsure (1)..(147): unsure at all Xaa locations
  Clone ID: PAT_TA_56885.pep
PRRGTAARTASAPRAARRRATGGGSTSTPGCTSSPPSSSSPAFCGTFVAVGGVHRRVLERHGLNLLIAGPALWCLGSIHNMCQVYERANGHVQILQKSVHIPFLLGSTLFFIGGVVNRNDVHXRSSHSSTLLGRSWAWYCLFRSLLF

SEQ ID NO: 162468 - protein, 167 aa, Triticum aestivum
  Clone ID: PAT_TA_56886.pep
LVVIAYMETIHRALTPPASPPVLPSSLSPPPEGGGVQIWSWHCRRAPAARTRIGTGHGARVCWQRDGLRVGGARPVLLAAVCLIQDPIGAGWPWRRSGGGFSLPLLCWCSRYVARRPGRIDGLVWWLILQRAGAGRRWQGLFRKKAGGSPSTTSTWSGGVMGSFNMA

SEQ ID NO: 162469 - protein, 57 aa, Triticum aestivum
  Clone ID: PAT_TA_56887.pep
GHRLHQSSRFKVPRTEELNFLDPTARFIFFFFFAFRYFFFFFFVFFFFFFFFFFFFF

SEQ ID NO: 162470 - protein, 72 aa, Triticum aestivum
  Clone ID: PAT_TA_56888.pep
IYNLWVKKKNAGLTPIDPPPVGLAGGHSYFYFALEGSSCRSFKKRPEIVGGLLFAPMWGRLHISFSNVHAGA

SEQ ID NO: 162471 - protein, 77 aa, Triticum aestivum
  Clone ID: PAT_TA_56889.pep
PTGEFVILFIYRRSILYRVIMNQFFSTNNVLLVTLYLCNISSAVPTLLLNMSAGCSNDSTHTVVIVFALQIGCLEQL

SEQ ID NO: 162472 - protein, 61 aa, Triticum aestivum
  unsure (1)..(61): unsure at all Xaa locations
  Clone ID: PAT_TA_56890.pep
RIGRVAGNXDLYLGTFSTQEEAAEAYDIAAIKFRGLNAVTNFDMSRYDVESILNSDLPIGA

SEQ ID NO: 162473 - protein, 109 aa, Triticum aestivum
  unsure (1)..(109): unsure at all Xaa locations
  Clone ID: PAT_TA_56891.pep
LRFVAVAVQGWLPNPLFPIYVHNIHKSKHGSDSGTYDKEGRYVVVDLIYSKQVTHAXETSDMCVLCRFMPVNFENIFSKYARTYPDRLSYRELWRXDGGSRXVFDFVGW

SEQ ID NO: 162474 - protein, 65 aa, Triticum aestivum
  Clone ID: PAT_TA_56892.pep
ESPGLDPTPVRIYKKKKKKKKKKKKKKKKKKKKKKKKKKKKKKKKKKKKKKKKKKKKKKKKGGPF

SEQ ID NO: 162475 - protein, 111 aa, Triticum aestivum
  unsure (1)..(111): unsure at all Xaa locations
  Clone ID: PAT_TA_56893.pep
SPNINILGARFSTVVTTENTWCYHNLLRLVAHPPLXSWCSIEEDATDGPSXQLRSLLGEWDAPLCGALFAAGVVVSRSXVTASLVSTLLPAASAFFPSFFATLVGFSPQAA

SEQ ID NO: 162476 - protein, 137 aa, Triticum aestivum
  Clone ID: PAT_TA_56894.pep
RCKFPGLPLPECTPSHNHSQLHYQSKLTLTFTASIAHRSLVYCFVLLSTPRQQQQPTNKFRFRQHTSSLFVEATSHLHLHYLTSSPFLCSHTQQAPGTRHLPFFSLATYQQPQLKGTSPSTFSTLLHCSSSATQFHQ

SEQ ID NO: 162477 - protein, 29 aa, Triticum aestivum
  Clone ID: PAT_TA_56895.pep
LSKGRMQLAVEMIDHRTISSTSYRVVFTC

SEQ ID NO: 162478 - protein, 100 aa, Triticum aestivum
  Clone ID: PAT_TA_56896.pep
QAQPFVLNHSDWYLSLISELSASPTNSNSLPLKIQYRRQTVNVALRGEASDMAGEARFSPRVHISSSSTPSSRPWWLGGAGEPRTPHSSLRRRKRWRQQS

SEQ ID NO: 162479 - protein, 220 aa, Triticum aestivum
  unsure (1)..(220): unsure at all Xaa locations
  Clone ID: PAT_TA_56897.pep
MAPATADAAGAAVGGRVKTALGVAACERDAEKLELIEQLTKGFDDEQQRVLAAILARNNGAEYLRRHGMEGCTDRDAFKARVPVVTYEDLRPEIERIANGDRSNIISSHPISEFLTSSGTSAGERKLMPTIEDELDRRQMLYSLLMPVMNLFVPGLDKGKGLYFLFIKSETKTPGGLPARPVLTSYYKSDHFKYRPFDAYQVYTSPTAAILCTDSXQSMY

SEQ ID NO: 162480 - protein, 80 aa, Triticum aestivum
  Clone ID: PAT_TA_56898.pep
MPPKGKTRANPRIFPPPKKKKPRPKPGNRRPETKKRAPPFFFFLIFYFFYFFFFFFFFFFFFFFFFFFFFFFFFFFFFFF

SEQ ID NO: 162481 - protein, 76 aa, Triticum aestivum
  Clone ID: PAT_TA_56899.pep
GIVWDGFIMLGLAVDFLAEPYREQCIPSLLPEKEGEEGFLVAAIPRGYSICNLAPNVSNVLIGDEGNERRLQWNLY

SEQ ID NO: 162482 - protein, 90 aa, Triticum aestivum
  Clone ID: PAT_TA_56900.pep
MLPMHRDYKFLDGFPIVGGRTATSQEPLEREKWKEEMSRGNQGLPGEASEESNRSSPRVPRSMEMLESEDDDDDISSWFSGANSSRNLKK

SEQ ID NO: 162483 - protein, 241 aa, Triticum aestivum
  unsure (1)..(241): unsure at all Xaa locations
  Clone ID: PAT_TA_56901.pep
TAKDGEWVPVTEFSFLSARXNIEEKFCVPYNWKDRXKSLHMPLMNLIRMFGRGLSRYWLSLTQGAESPPFFVQVTMEVKHWPEDGIQPERIESAINKVLVTAHEERCQSNSPSSCHSSSRVRIQSIERSKENPSMAXLAVLEVVYAAPTECQSAGWFKSLTPAADVEREIHDSQKAGLFEEINFPYPVVSVIGGGKREIDLYAYYFGADMAVLFLVLMFYQSILKXKSEFLGAYQLEEQFP

SEQ ID NO: 162484 - protein, 82 aa, Triticum aestivum
  Clone ID: PAT_TA_56902.pep
MRSAWNIAQEAKFKPLEDNLYSVQLSCLGDWERVMHEGPWNFRGDAVLLAPYDGVSKPSSIKLETIDIWIMFQICLLTWLLH

SEQ ID NO: 162485 - protein, 44 aa, Triticum aestivum
  Clone ID: PAT_TA_56903.pep
PSLIVIIHLWPVAGLRLHMSSHSPILVYGKPAPSLLACSSAHAD

SEQ ID NO: 162486 - protein, 82 aa, Triticum aestivum
  Clone ID: PAT_TA_56904.pep
NDNRRNHYNSELRQRFARAHNSSRQPKFKTPASSELVVSKVNRQFNLSHSLRHTAQQVEDRTGSFSLGSELFRHHPRGQQVL

SEQ ID NO: 162487 - protein, 250 aa, Triticum aestivum
  unsure (1)..(250): unsure at all Xaa locations
  Clone ID: PAT_TA_56905.pep
VVQVLRFSFVVKLLHLKSSHRITNSAFTDILKLLAEAFPQPNTLPKSYEEAKNLLKELGLGYESIHVCFNNCVLFRKQYAKHDNCPVCGMSRWKDPARKKIPQKVLRHFPLVPRLKRMFLSRKIAEEAQWHKLKRXPSEKEMSHPAYGDAWQDFDKKYKKIAEDARNMRLGIATDGFNPFGNFNTSYGMWPVFVVPYNFPPWACMDQSNFMMALLIPGPKSPGKHFDVFLQPXEDLLELWXGVRTYDAYS

SEQ ID NO: 162488 - protein, 243 aa, Triticum aestivum
  unsure (1)..(243): unsure at all Xaa locations
  Clone ID: PAT_TA_56906.pep
FTLEKNADKKYRITGLTSQGSSQLPCPCDDSGTGKTVLEYFKETYRCTIRSRVPCLKVRDQEKPTTYLPMEVCEISDAKQISYLLSVACQHPMDREKTILQTVNPYNEDPYAKEFGITFENKLTIVKGRVLPPPVLKFNDQGKVKEFLPKVGKWNMRLKQMVKGGXVNTWACINFASDITHAAAVAFCDELAVTCLISGMKLKGDPVLPLVNAKPNHVRPFLKIHYQRFMAILRPLHKELDLL

SEQ ID NO: 162489 - protein, 69 aa, Triticum aestivum
  Clone ID: PAT_TA_56907.pep
PLLLYACNPEAVFVRNNYPCRWQGLTEPHHFLVRLDKTSCCCRWCVVSRVKFGYCCRGNFVFDFVLLLQ

SEQ ID NO: 162490 - protein, 126 aa, Triticum aestivum
  Clone ID: PAT_TA_56908.pep
LNDDRICVLLYATATIHKDDNWKKSISTFSSHQTCACYSEHYDGYVRVSDLPAAIPNNEDRPAGKTNTTAAGSTFSFTFSSWISTTIYYPRRQEHCVASSLRVADDEGMFGGLFFSQSLLSNQLGS

SEQ ID NO: 162491 - protein, 255 aa, Triticum aestivum
  unsure (1)..(255): unsure at all Xaa locations
  Clone ID: PAT_TA_56909.pep
MGKEKTHINIVVLGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQXVYKIGGIGTVPVGRV

SEQ ID NO: 162492 - protein, 87 aa, Triticum aestivum
  Clone ID: PAT_TA_56910.pep
MSSSSAAVSSTLNYNTSEPLTRTNYVLWKAQARSQILSAGLYGYIDGTTVEPPKTLTTKDKDGKDQVTPNPAHTPWLVQDQKIRNDL

SEQ ID NO: 162493 - protein, 84 aa, Triticum aestivum
  Clone ID: PAT_TA_56911.pep
PSSTSPPKPSLSSAPHLILLQVSLLFLTRHHPSSLCSFLFVLPCSAYSMPQQVWASYIAITLPGLSSAAAGRWVCRLCSYGSTA

SEQ ID NO: 162494 - protein, 105 aa, Triticum aestivum
  Clone ID: PAT_TA_56912.pep
ARGEINREQITWERGERQSSLPRCVSWRRARAAGHAVMGGGAPSRSHHWCHGVKRSTAGDEMRIRRQTPSSPSRVRSFFHSLGSPVLLLPLTCSLHLRRIHGTGS

SEQ ID NO: 162495 - protein, 91 aa, Triticum aestivum
  Clone ID: PAT_TA_56913.pep
MIYIEYLLLIWIILFALIIGVRQRGPGAGFSCSGHMQKKKKKKKKKKKKKKKKKKKKKKKKKKKKKKKKKNKKKKKEKKKKKKKKKKGGAF

SEQ ID NO: 162496 - protein, 263 aa, Triticum aestivum
  unsure (1)..(263): unsure at all Xaa locations
  Clone ID: PAT_TA_56914.pep
RTRGQLLLSRGYAVHATLRDPXSDPKNAHLMQLDGAAESLRLFKADVLDSAALAAAVEGCEGVFHVASPVPADKIVDPESEVMVPAVKGTLNILEVCSSLKVHKVVVVSSTAAVHYDPNWPQGKPKDESCWSDRKVCKDNERRTXLNAVTVCPCIVLGPQLQSVVNTTSELLLYVITGGPNALNEMLWHIVDVRDVAEALLLVYEKPESSGRYICAPNYISTKALLELLKKTYPDYNYVKCKADAQQNSRITPISSGKLSNLG

SEQ ID NO: 162497 - protein, 149 aa, Triticum aestivum
  Clone ID: PAT_TA_56915.pep
CRASRDLRAVVFRITYSLSRYTLFTAYFIPMVLLPHHWFVYIKSQELHELNWLLCRRAFFQGAVDFLNMLPAGPFSVCTEFVENGCEKIDHPVDLYARYVQNSATTIEVRPWSKNSVGHPLHLSCQVPMLHSMCVSVAVHTYTAVHTAI

SEQ ID NO: 162498 - protein, 80 aa, Triticum aestivum
  Clone ID: PAT_TA_56916.pep
SHLKHGPWQFNMNMSSLPTKKLQMFQSSSCWLQILQDTRNIEVKGRQIIANNKDIHWLKGKQGNDIYYGPVLETINQLSK

SEQ ID NO: 162499 - protein, 206 aa, Triticum aestivum
  unsure (1)..(206): unsure at all Xaa locations
  Clone ID: PAT_TA_56917.pep
MSGWDEGAVFYSDQAQFPQGDPAAADITRHSALRKFKEFLRGFTGPTGDFPYRESLVHNRDHVTVAIEDLDAFDAELADRIRKAPADYLPLFETAGSEVLASLRSKVAGETGEMEEPVTGDVQIFLSSKENCVSMRSIGADYMSKLVKIAGIAIAASRVKAKATHVTLLCKNCRSVRTVPCRPGLGGAIXPRSCDHVPQXGEEPAP

SEQ ID NO: 162500 - protein, 99 aa, Triticum aestivum
  Clone ID: PAT_TA_56918.pep
PFFLVTPKTKSNLFLTSGQIYSVASFFVISPEHKLTLLPCYSQDKIKSAIDMLQNLGQLSRQPLICSSTFRNTQFLLPSCKYPGQKHVQLIGEQPYQSS

SEQ ID NO: 162501 - protein, 91 aa, Triticum aestivum
  Clone ID: PAT_TA_56919.pep
VFFFLKLSLRYSLGHVSWLGSSGHQRKAMGNHVQYESMNHIFVVRGSVMLSILCHCNSVTGVLFFIISVQQSFIQKEKKIPSSSNLPFAKA

SEQ ID NO: 162502 - protein, 164 aa, Triticum aestivum
  Clone ID: PAT_TA_56920.pep
FGMGLVDQAIQRYEPEEHTIIEAHPEVYARMLKLGWGEKKNVRILFGRWQDVIPQLGSYDVIFFDTYGEYYEDMREFHEHLPKLLNPGGVYSYFNGLCGDNAFFHVVYCQLVAMELASLGYSTQFVPLPVRDCLKAEVWEGVKQKYWQLDTYHLPVCQAESESE

SEQ ID NO: 162503 - protein, 68 aa, Triticum aestivum
  Clone ID: PAT_TA_56921.pep
SLRSFVGSVVATIPLCLAVKKKKKKKKKKKKKKKKKKKKKKKKKKKKKKKKKKKKKKKKKKKKGGGPF

SEQ ID NO: 162504 - protein, 35 aa, Triticum aestivum
  Clone ID: PAT_TA_56922.pep
RGRATKSSCPLISGAEDLLQVPVGPAEGQILVGHV

SEQ ID NO: 162505 - protein, 170 aa, Triticum aestivum
  Clone ID: PAT_TA_56923.pep
SPKRQRRLRLMDEFISLGDEPQPRASEDLHQPLQVDAVDLNLNLNHAPPQPEPEPEPLPSQHHPQGTKASTSSVVVEVIDLEEGQIACQQSSSSAAAAAAQDAAADNPQAKAKEEALGANGVGPPPPPSHQQPQDDDIIDLEEGQVEDMDLSDDNALVIVTKQHGLCFSS

SEQ ID NO: 162506 - protein, 67 aa, Triticum aestivum
  Clone ID: PAT_TA_56924.pep
IRTVPRLLKIYLFTNIISLHKYYPSAIASKGAQTHNKRSAAPTRLIPLKLSSILINRNHPPMMILYS

SEQ ID NO: 162507 - protein, 141 aa, Triticum aestivum
  Clone ID: PAT_TA_56925.pep
RPVLQQHNIAHASSQVLQQSSYQQLQQLCCQQLFQIPEQSRCQAIHNVVHAIILHHHQQQQQQPSSQVSYQQPQEQYPSGQGSFQSSQQNPQAQGSVQPQQLPQFQEIRNLALQTLPAMCNVYIPPYCSTTIAPFGIFGTN

SEQ ID NO: 162508 - protein, 136 aa, Triticum aestivum
  Clone ID: PAT_TA_56926.pep
QLQQSAQGQKGQQPGQGQQPGQGQQGQQPGQGQQGQQPGQGQPGYYPTSPQQSGQGQQPGQWQQPGQGQQGYYPTSLQQTGQGQQSGQGQQGYYSSYHVSVEHQAASLKVAKAQQLAAQLPAMCRLEGGDALSASQ

SEQ ID NO: 162509 - protein, 204 aa, Triticum aestivum
  unsure (1)..(204): unsure at all Xaa locations
  Clone ID: PAT_TA_56927.pep
SKDELHLKIKSKDKSSVNEEDEKKEIEIEIDAKVVEKEEVSSDGSKSAGKVKETKKDKEKEGKNKSEKHVDEHEDDQKTSKKDKKEKDEKKKEDGEGSEKDKAKKGKDKKSESKEKDKNSAKETGPDADDSSPKNKKKDKDKAKKKDESDEKQEKDKDKEEHENKKKCXXGGIRQEKSSYKIMSRAKKGTDASEKEKGWHGQSG

SEQ ID NO: 162510 - protein, 168 aa, Triticum aestivum
  unsure (1)..(168): unsure at all Xaa locations
  Clone ID: PAT_TA_56928.pep
FYCQKDRKYPTGIRTNRATKAGYWKATGKDKEIVNPHCMSMLMGMKKTLVFYKGRAPXGRKTNWVMHEYRLEIGKQSTSGLPTTIANAASNNVSSKEYVVCRIFHKHWKGCHPWCHMRTLGPVLATTTRVNGGATTTDKILFDEHAYRWGMGSTNNDDPRNIYVGLCI

SEQ ID NO: 162511 - protein, 200 aa, Triticum aestivum
  unsure (1)..(200): unsure at all Xaa locations
  Clone ID: PAT_TA_56929.pep
SVCTLQVLSQDETPFLYSLVFGEGVVNDATSVVLFNAIQNFDLGNFSSLKFLQFIGNFLYLFGASTFLGVASGLLSAYVIKKLYFGRHSTDREVAIMMLMAYLSYMLAELLDLSGILTVFFCGIVMSHYTWHNVTESSRVTTKHAFATLSFISETFLFLYVGMDALDIEKWKIVSETYSPMKSIALSSIIXLALVLVGRA

SEQ ID NO: 162512 - protein, 48 aa, Triticum aestivum
  Clone ID: PAT_TA_56930.pep
NLLLRILMRSTTWPNNVEMKQLAHGTFEQPHQIAQLKVMTSIALRTRP

SEQ ID NO: 162513 - protein, 183 aa, Triticum aestivum
  Clone ID: PAT_TA_56931.pep
DSTFEKKPRQSKVGADNQTDLPTEKDHARMGKEQMNSTSQTKHHGKNRKHDGSIDGRENANPKVVSNVVQSSPISPQASNESTYGTPAVNRFRVAVRKVPRKKFEQLNDKSKKDTSKRGAGAIFSDTISEDSDELLNTMGEKVGKENSSDDSSTSADSGISSTAWEGSDVPDDEGIDSLSQRE

SEQ ID NO: 162514 - protein, 142 aa, Triticum aestivum
  unsure (1)..(142): unsure at all Xaa locations
  Clone ID: PAT_TA_56932.pep
SSSKEVRQEGRIQEQQQKERWSRPPPKILKINTDGAYLKESNSGGWGFVIRNDCGMVIAAGAGNLGQVSNALHSEAMAMLHAINAAIQMGLSXVIMETDSVQLQSAVNNEDYDLSTLGAIFKDIKFKLRVSFNMELVGLGLE

SEQ ID NO: 162515 - protein, 57 aa, Triticum aestivum
  Clone ID: PAT_TA_56933.pep
MRRPVTDGKCKKKAPRMIHKAEREKHKRDLLNDLFSELDEMLGETDRQTNGKACIFD

SEQ ID NO: 162516 - protein, 201 aa, Triticum aestivum
  Clone ID: PAT_TA_56934.pep
HFHSNQPPFSQQQQPVLPQQPPFSQQQQPILPQQPPFSQQQQQPVLPQQQIPFVHPSILQQLNPCKVFLQQQCSPVAMPQSLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRTLPTMWPCQ

SEQ ID NO: 162517 - protein, 56 aa, Triticum aestivum
  Clone ID: PAT_TA_56935.pep
APRAQPGQGQQGYASPYHVSAEYQAARLKVAKAQQLAAQLPAMCRLEGSDALSTRQ

SEQ ID NO: 162518 - protein, 122 aa, Triticum aestivum
  Clone ID: PAT_TA_56936.pep
RCQSLPPFLFILFSEWGEIIVSNRKTEVTFISHSFLGEKQLRSKYGSVAVQTVLGNLINCADSNRKRMLLKVFAVQLSSSDETKTPLYKATQFIYLFHIFIKLFCSLVNYSYSLAKRTYILE

SEQ ID NO: 162519 - protein, 176 aa, Triticum aestivum
  unsure (1)..(176): unsure at all Xaa locations
  Clone ID: PAT_TA_56937.pep
QQAQQQQQQQQQQQQQQXQQQQILQQILQQQLIPCRDVVLQQHNIAHARSQVLQQSTYQPLQQLCCQQLWQIPEQSRCQAIHNVVHAIILHQQQRQQQPSSQVSLQQPQQQYPSGQGFFQPSQQNPQAQGSVQPQQLPQFEEIRNLALQTLPRMCNVYIPPYCSTTIAPFGIFGTN

SEQ ID NO: 162520 - protein, 89 aa, Triticum aestivum
  unsure (1)..(89): unsure at all Xaa locations
  Clone ID: PAT_TA_56938.pep
RIRAKEIEEAASKAKPAAAVDDDDDNGEDAEEADDLTMLVGMEMEKELWARIGIHHDDDDDMPLGDNDDEQEAIETARAXYGKAAYERI

SEQ ID NO: 162521 - protein, 88 aa, Triticum aestivum
  unsure (1)..(88): unsure at all Xaa locations
  Clone ID: PAT_TA_56939.pep
KKXTTSVFPNVYRILSFQAQYLLFFFVDEHTAPXSCGLTVPRSGASVEGITTGGWVHRDLATVGDPSYYHVIPEELVEAGQLVTSNLV

SEQ ID NO: 162522 - protein, 58 aa, Triticum aestivum
  Clone ID: PAT_TA_56940.pep
DTDGDGRISPSELAAVSRAIAPPATESAQGREVASMMDELDTDRDGYVDLGEFAAFHG

SEQ ID NO: 162523 - protein, 227 aa, Triticum aestivum
  unsure (1)..(227): unsure at all Xaa locations
  Clone ID: PAT_TA_56941.pep
KLSSKLRQVTNGLKLTNPGKKVPPTPAPKTVRKRYDRSKSSAAVALKGLQFVTAKVGNDGWTAVEKRFNHLQVDGMLLRSRFGKCIGMEGSDEFAMQMFDSLARKRGMVKQVLTKEELKDFWEQLSDQGFDNRLQTFFDLVDKNADGRITSXEVXREIIALSASANKLSKIKERADEYTALIXEELDPNNLGYIELEXLEALLLQSPSESCCQDQRPPTARNLALLA

SEQ ID NO: 162524 - protein, 219 aa, Triticum aestivum
  unsure (1)..(219): unsure at all Xaa locations
  Clone ID: PAT_TA_56942.pep
PPSSRSSSPPSPSWHYPASLQQVGQGQQIGQLGQRQQPGQGQQTRQGQQLEQGQQPGQGQQTRQGQQLEQGQQPGQGQQGYYPTSPQQSGQGQQPGQSQQPGQGQQGYYSSSLQQPGQGLQGHYPASLQQPGQGHPGQRQQPGQGQQPEQGQQPGQGQQGYYPTSPQQPGQGKQLGQGXXGYYPTSPQQPGXQGQQLGQGQPGHCPMSPQQTGQAQQLG

SEQ ID NO: 162525 - protein, 191 aa, Triticum aestivum
  unsure (1)..(191): unsure at all Xaa locations
  Clone ID: PAT_TA_56943.pep
RRTQPFPPQQPYPQPQPQYPQPQQPISQQQAQQQQILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGSFQSSQQNPQAQGXSVQPQQLPQFQEIRNLALQTLPAMCNVYIPPYCSTTIAPFGIFGTN

SEQ ID NO: 162526 - protein, 216 aa, Triticum aestivum
  Clone ID: PAT_TA_56944.pep
ALAAASAVAQISQQQQQPPFSQQQQPPFSQQQQSPFSQQQQQPPFLQQQQPPFSQQPPISQQQQPPFSQQQQPQFSQQQQPPYSQQQQPPYSQQQQPPFSQQQQPPFSQQQQPPFSQQQQQPPFTQQQQIPFVHPSILQQLNPCKVFLQQQCSPGAMPQSLARSQMLQQSSCHVMQQQCCQQLPHIPQQSRYEAIRAIIYSIILAEQQQVQGSIPT

SEQ ID NO: 162527 - protein, 78 aa, Triticum aestivum
  unsure (1)..(78): unsure at all Xaa locations
  Clone ID: PAT_TA_56945.pep
CKMECKEVHGRTLKWLRGLLKDYEVPQQTDGCSCALWVLKFIQYWTGVRLSAIFNQDDIRQFRRWLAAALLNSPHNEX

SEQ ID NO: 162528 - protein, 236 aa, Triticum aestivum
  unsure (1)..(236): unsure at all Xaa locations
  Clone ID: PAT_TA_56946.pep
PYLQLQPFPQPQLPYPQPQLPYPQPQLPYPQPQPFRPQQPYPQSQPQYSQPQQPISQQQQQQQQQQQKQQQQQQQQQILQQILQQQLIPCRDVVLQQHSIAYGSSQVLQQSTYQLVXQLCCQQLWQIPEQSRCQAIXNVVHAIILHQQQQQQQQQQQKQPLSQVSFQQPQQQYPSGQGSFQPSQQNPQAXGSVQPQQLXPQFEEIRNLALETLPAMXNGYIPPYCTIGSSWHFFVL

SEQ ID NO: 162529 - protein, 205 aa, Triticum aestivum
  unsure (1)..(205): unsure at all Xaa locations
  Clone ID: PAT_TA_56947.pep
ITGVSNFHSLSFILSILIENGQLELLLQKYSSTDTATVAPASVRGFRLAVITSLKHFNPNDDEALSLVYKHFDMKHEAASLLESRAEQYMESWLDRHDKERRNDELLKAMHNLVQTAEILSTIDAGQRTHRACARASLLSLQIRIPDLVWXIGLTETNARRIFXVDQSRFQEALIVAEAYSINQPMEWAPVFWNQMLKPDLIELF

SEQ ID NO: 162530 - protein, 200 aa, Triticum aestivum
  unsure (1)..(200): unsure at all Xaa locations
  Clone ID: PAT_TA_56948.pep
NLIPCFGFGDVSTCDHSVLXFYKDYRPCCGFEEVLDRYKQMIPYLDLSGPTSFAPLIYAAISVVENSNYQHHVLVIIADGQVATSKSYSIVSPQEEATIQALIDASFYPLSIVXXGVGDGPWKEMQPADECIPARAFYNFQFVNFTDIMSTSKDXAKKEAAFAFAALMEIPTQYKAAQGLYPPEWHEEMADPLDDPSATN

SEQ ID NO: 162531 - protein, 112 aa, Triticum aestivum
  unsure (1)..(112): unsure at all Xaa locations
  Clone ID: PAT_TA_56949.pep
QNSIKDFSTNNCSKILSLCVSYFTPVYVMKLKDFFPNKELKXAPYFDGRVVCYPNMKTIHDYLAWRQLDRHNRIQYKTCFXWMLVKSGKGENEAYDIEVFFHHLRQRTRTSC

SEQ ID NO: 162532 - protein, 35 aa, Triticum aestivum
  Clone ID: PAT_TA_56950.pep
RLNFAWLSFCRCTRIIVLDNRLSNGFIIHLFQNLP

SEQ ID NO: 162533 - protein, 82 aa, Triticum aestivum
  unsure (1)..(82): unsure at all Xaa locations
  Clone ID: PAT_TA_56951.pep
ILQSPHLNEKEKASKRISLLVGRRNHSCHVSGTVGTRNGNGGREPEAGKSRVQRXVYISRTIFLKRKREPXQFWYDESSTVP

SEQ ID NO: 162534 - protein, 239 aa, Triticum aestivum
  unsure (1)..(239): unsure at all Xaa locations
  Clone ID: PAT_TA_56952.pep
RQQPFPPQQPYPQAQPFPSQQPYLQLQPFPQPQLPYSQPQPFRPQQPYPQPQPQYSQPQQPISQQQQQQQQQQQQQQQQQQQQKILQQILQQQLIPCMDVVXQEHNIAHGRSQVLQQSTYQLLQELCCQHLWQIPEQSQCQAIHNVVHAIILHQQXKQQQQQPSSQVSFQQPQQQYPLGQGSFRPSQQNPQAQXLCPASTTGPSSEEIRNLALQTLPAICNVYIPPYCTITPFGMHPSV

SEQ ID NO: 162535 - protein, 48 aa, Triticum aestivum
  Clone ID: PAT_TA_56953.pep
SDPNSGVLKDLPGCPREPQRDFAKVLVTPGHCNVMTVHNTPYCLGLDI

SEQ ID NO: 162536 - protein, 42 aa, Triticum aestivum
  Clone ID: PAT_TA_56954.pep
QESITLLCFLYVSLFFFFFFFLFFFFFFFFFFFFFFFLDKTC

SEQ ID NO: 162537 - protein, 152 aa, Triticum aestivum
  unsure (1)..(152): unsure at all Xaa locations
  Clone ID: PAT_TA_56955.pep
FAKSALDSRASLVRKRSKGPNHPISAFCNKIRDLRCFLQQQLIPSLDVVLQQHNIXHGRSQVLQQSTYQLLQEXLCCQHLWQIPEQSQCQAIHNVVHAIILHQQQKQQQQPSSQVSFQQPLQQYPLGQGSFRPSQQNPQAQGSVQPQQLPQF

SEQ ID NO: 162538 - protein, 129 aa, Triticum aestivum
  unsure (1)..(129): unsure at all Xaa locations
  Clone ID: PAT_TA_56956.pep
MEANQSPPRKRPRRDRNREKASFLNSAEAMKLDIWSEFPEDLFETVIARLPVAAIFRFRSVXRXWCSLVGSDNFSQQYSEVPQGMPWFYTITHENGNNNXSXMMTPSLNKWHHPFXPLAPANIVMPVAS

SEQ ID NO: 162539 - protein, 133 aa, Triticum aestivum
  Clone ID: PAT_TA_56957.pep
DAWERNVGIKLWNSEPEETLKRMCSDGLQNVQICFFRVACLAVRDAICLFGCTVTTLVLTSCTTHRLIFLFRQHSTATCLTHGSERLPRASAQKMSSAWDVSYPMESVLPDQLSYETLFTFPMFRMVGRERIP

SEQ ID NO: 162540 - protein, 163 aa, Triticum aestivum
  Clone ID: PAT_TA_56958.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQSWVLASHNNKHNWIQGWIWR

SEQ ID NO: 162541 - protein, 87 aa, Triticum aestivum
  Clone ID: PAT_TA_56959.pep
IINLTDWPTAIQHHHANLRCGSAFFINGNTKGMKHKRPYGHNQVYQRASDSARHDQPHRSPSSLELNQIQRHDHTTARPTKRKSAGP

SEQ ID NO: 162542 - protein, 185 aa, Triticum aestivum
  unsure (1)..(185): unsure at all Xaa locations
  Clone ID: PAT_TA_56960.pep
SLHPEIGLTKVNTRAKWSHQMKLFLVRLLKDYDVPGFRTHNAWSKEAWTNIVSRLNQRFDQSFTLNQVKQKEQDLKRDYRNVKELLDQSGFGWDKDRKMVDAPDNVWASFAARKNSKDVLQWKERSFPLYEELAPLYEGRYAEGRTRRGLDHYLRKRKHAPVPSSQSTQVXDLYQSPSPTMPAAG

SEQ ID NO: 162543 - protein, 157 aa, Triticum aestivum
  unsure (1)..(157): unsure at all Xaa locations
  Clone ID: PAT_TA_56961.pep
QILKQILQQQLIPCMDVVLQQHNIAHGRSQVLQQGTYQLLQELCCQHLWQIPEQSQCQAIHNVVHAIILHQQQKQQQQPSSQFSFQQPLQQYPLGQGSFRPSQQNPQAQGSVQPQQLPQFEEIRNLALQTLPAMCNVYIPPYCTIAPFGIFGTNXRR

SEQ ID NO: 162544 - protein, 134 aa, Triticum aestivum
  unsure (1)..(134): unsure at all Xaa locations
  Clone ID: PAT_TA_56962.pep
QQQQQILQHILQQQLIPCMDVDLQQHNIRACNAHKSLQQSTYQLLQQLCCQQLXQIPDQSRCQAIHNVAHAIIMHQQQQQQQEQNQQLQHQQHQHXMQLLQLHQHLQQQPSSQVYLQQPQQQYPSSQVLLPSPS

SEQ ID NO: 162545 - protein, 141 aa, Triticum aestivum
  Clone ID: PAT_TA_56963.pep
LWHHRRCARPHDKPATSYAGRRHPGLYSACITLIDHSNNIPVLPDHAPPVTLRLQHQQVWQQQIPVVQPSILQQLNPCELFLQQQGSPVAMPQRLARTQMLQQSSCHVMQQQCCQHLPEIPQQSRYDAIRAIIYSIILQNN

SEQ ID NO: 162546 - protein, 68 aa, Triticum aestivum
  Clone ID: PAT_TA_56964.pep
KKLGSPPPIKFWAESILRCTYTGMKGWWRDALQQSICRVMHTNNSCSAGCGKYPEQSRHEPIRAIIYL

SEQ ID NO: 162547 - protein, 69 aa, Triticum aestivum
  Clone ID: PAT_TA_56965.pep
NALKDNYCDHTLSVNIDRLPTHSVIYNPCAMTITPTELANTFLMLYHRAHYCYKSTSLPYHHYFTIMKH

SEQ ID NO: 162548 - protein, 123 aa, Triticum aestivum
  Clone ID: PAT_TA_56966.pep
PIAQVAMQHHATSSNRQHHDSSSFLQDAPLLAKSCSRQYVLLRLVSSRSMHGLGRPDPARRQIISRPIARMLSHRVQTTVPPISGNRVCGWPSSSAVIPIMGDGSMSKRFGIRSTVRHVPCVA

SEQ ID NO: 162549 - protein, 125 aa, Triticum aestivum
  Clone ID: PAT_TA_56967.pep
LRKIVPQLSEERSARCRLRKPCSSLSIASRDELLKEKGAVIRGRKLFKAYKELRERHLREESRALRIRTFGKSTGSEHWARGSRLRQRSACLTRMLESTPPVRAGRREPPVETVRECPSAGFRSA

SEQ ID NO: 162550 - protein, 142 aa, Triticum aestivum
  unsure (1)..(142): unsure at all Xaa locations
  Clone ID: PAT_TA_56968.pep
DKGMKHKRHFDSTLGSANLREVARLSXGEDLNEWLDVNTVHFCNHGSLLHGTLMEFCTPATCPTMINGXRMTAGVLGWCRCNRPIEGMAPXTFXYLVDWIGGHLDEESILPQKLGAPLPPNIQGRRQCHYSSVMFKRVRPHM

SEQ ID NO: 162551 - protein, 89 aa, Triticum aestivum
  Clone ID: PAT_TA_56969.pep
NNIVKNKLYIWETKGGCVKAIKDDQYAREINPQNRSCYLIIRVERKLFIFLILVVACVQGSVLDCSVVQRFREACSNIVKELLILLPLS

SEQ ID NO: 162552 - protein, 223 aa, Triticum aestivum
  unsure (1)..(223): unsure at all Xaa locations
  Clone ID: PAT_TA_56970.pep
QQPYLQLQPFPQPQLPYPQPHLPYPQPQPFXRPQQPYPQPQPQYSQPQQPISQQQQQQQQQQQQQILQQILQQQLIPCRDVVLQQHSIAHGSSQVLQQSTYQLVQQLCCQQLWQIPEQSRCQAIHNVVHAIILHQQQQQQQQQQQQQPLSQVSFQQPQQQYPSGQGSFQPSQQNPQAQXSVQPQQLPQFEEIRNLALETLPAMCNVYIPPYCTIAPVGFFRTN

SEQ ID NO: 162553 - protein, 62 aa, Triticum aestivum
  Clone ID: PAT_TA_56971.pep
VSGLSGEVLILTSAPPPPGDSLLLRLSSCLSAAVARGAKYVVQEALYGIFLFFSKKWTCRSG

SEQ ID NO: 162554 - protein, 206 aa, Triticum aestivum
  unsure (1)..(206): unsure at all Xaa locations
  Clone ID: PAT_TA_56972.pep
GKCRFLRIDLVCLPNLEKLVCDTWVSQCAPLTFGFVPSLGELELSCGSDCEQRGFKLSELLHGVTSIHSLTLDFQGETLWLHPEMEDLRTAFSKLRKLSVLGIFVEFDILWTTAFLVAAPSIEMLHXXRYXEHTCDVXEARPASFHDRRSPQWEMHLDSSSENKLLKELEFXXFKSLEQQFTFIRSMFGIIFDQRKKLNTDRVKIF

SEQ ID NO: 162555 - protein, 61 aa, Triticum aestivum
  Clone ID: PAT_TA_56973.pep
QQLVQIPEQAECQAIHNDAHAIIMHHHLQQLQDQKQQVQQQQQQQQALQQQQPQQQQQPSS

SEQ ID NO: 162556 - protein, 76 aa, Triticum aestivum
  unsure (1)..(76): unsure at all Xaa locations
  Clone ID: PAT_TA_56974.pep
NHFHTTAISXSRNHFHHNNXIXXAXXAXHXVLWGXPPXPXXXTPLFKTPPPQYFLYIXXPPPAGAPPGEEPHKTPI

SEQ ID NO: 162557 - protein, 236 aa, Triticum aestivum
  unsure (1)..(236): unsure at all Xaa locations
  Clone ID: PAT_TA_56975.pep
MVKEAAEISTDEESDGVVICPPDGNTRDCEEVVSGSDHDSSPEGQVTSVEPAIDGETGEDKLINQDSLKLIDQEMSALPKSPTKPSMSGSEKSKRTVPHLRTFNSRRXSGGGRGGVAHPSSXGEKSGKXSSASPASMIKKSTLVTPKKMPQPGLTFQPQDDDSCSVTSSTTASARAGRTKTTVAFAPXFVCDDRADKRKEFYTKLEEKHKALGAEKNEAETRKKDEXQEAALKQLR

SEQ ID NO: 162558 - protein, 47 aa, Triticum aestivum
  Clone ID: PAT_TA_56976.pep
LAHIPLYRKPSSDQGRVCTLSAPHRCSRFTDGFVSVGRAAVGHRSHY

SEQ ID NO: 162559 - protein, 170 aa, Triticum aestivum
  unsure (1)..(170): unsure at all Xaa locations
  Clone ID: PAT_TA_56977.pep
MARGLKKHLKRLNAPSHWMLDKLGGAFAPKPSSGPHKARECLPLILILRNRLKYALTYREVQSILMQRHIMVDGKVRTDKTYPAGFMDIISISKTGENYRLLYDTKGRFRLHSVRDEDAKFKLCKXKXLVQFGQKGIPYLNTYDGRTIRYPDPLIKANDTIKLDLETNKC

SEQ ID NO: 162560 - protein, 63 aa, Triticum aestivum
  Clone ID: PAT_TA_56978.pep
MASKGLIVVAFLLAAAFLVATAEQTQANKEETQPGVQGGYPGHNGGGGGGYPGHGGGGAASNP

SEQ ID NO: 162561 - protein, 72 aa, Triticum aestivum
  unsure (1)..(72): unsure at all Xaa locations
  Clone ID: PAT_TA_56979.pep
IMRSRTHQFELLRNIYVVMMTHYSSSGNRTIXDVIKGNDVIGEGKKDHIWVPYXXAGCAMADLERDHIAMXH

SEQ ID NO: 162562 - protein, 151 aa, Triticum aestivum
  unsure (1)..(151): unsure at all Xaa locations
  Clone ID: PAT_TA_56980.pep
QQHQQPVLPQQQIPFVHPSILQQLNPCXVFLQQXCTPVAXMPQSLDRSQMLQNSSCHVMQQQXCASQLPHIPQNSRYEAIRAIIYCIILXQEQQQVSXSIQTEKQQPQQLSQCDFQPQQQSQQLRRQHPQQQQLAQGTLLXAHQIAQLEVM

SEQ ID NO: 162563 - protein, 241 aa, Triticum aestivum
  unsure (1)..(241): unsure at all Xaa locations
  Clone ID: PAT_TA_56981.pep
VPLMQQQQQFPGQQEQFPPQQPYPHQQPFPSQQPYPQPQPFPPQLPYPQTQPFPPQQPYPQPQPQYPQPQQPISQQQAQQQQILQQILQQQLIPCRDVVLQQHNIAHASSQVLQQSSYQQLQQLCCQQLFQIXXEQSRCQAIHNXVVHAIILHHHQQQQQQPSSQVSYQQPQEQYPSGQGSXFQSSQQNPQAQGXSVQPQQLXPQFQEIRNLALQTLAGMXNVYIPPYCSTTIAPFGIFRY

SEQ ID NO: 162564 - protein, 151 aa, Triticum aestivum
  unsure (1)..(151): unsure at all Xaa locations
  Clone ID: PAT_TA_56982.pep
MACKSSCSLLLLAAVLLSVLAAASASGSCVPGVAFRTNLLPHCRDYVLQQTCGTFTPGSKLPEWMTSASIYSPGKPYLAKLYCCQELAEISQQCRCEALRYFIALPVPSQPVDPRSGNVXGESGLIDLPGCPREMXWDFVRLLGRRGQCNL

SEQ ID NO: 162565 - protein, 138 aa, Triticum aestivum
  unsure (1)..(138): unsure at all Xaa locations
  Clone ID: PAT_TA_56983.pep
YYPTSPQQPGQGQQPGQGQQGHCPTSPQQTGQAQQPGQGQQIGQVQQPGQGQQGYYPISLQQXRQGQQSRQGQQSRQGHQLRQGHDSRQEQXGYDNPYHVNTEQCTDRPKVGQVQEPATQLTIMTSMDDGDALSARHR

SEQ ID NO: 162566 - protein, 93 aa, Triticum aestivum
  Clone ID: PAT_TA_56984.pep
ATSLSCIPRTVCLFSGHRCTTGNFPPSVLSARDVQITSFVNRQHHPVVFKNKTHKCVEFPSCRIRHCLHETSFSAEVKIYCRSMRAASMSNLP

SEQ ID NO: 162567 - protein, 154 aa, Triticum aestivum
  Clone ID: PAT_TA_56985.pep
ELSRSRSRSYSRSVSPRRDERRSRSPRDSRSPRRSPRDSRSPRRSPRDSRSPRRSPRDSRSPMKSPRGSRSPMRSPRDSRSPRRSASPAKGRARSPTPPGSRSPAPRENSRSPMKADSPNNMSPAANGRSPSPRDGEDNGNHRAPSGSASPGGG

SEQ ID NO: 162568 - protein, 213 aa, Triticum aestivum
  Clone ID: PAT_TA_56986.pep
MPFSPIEELKKAVFDLTMLRNPPGPDGFIRGSFKKCWGLIKNDLLEAINQFFHLRGNTWKLLNNAFIVLLPKKGNVDRASDFRPISLMHSVAKILCKIMANRLAPELQHMISASQSAFLKGRSIQDNFLFVQNVIRRAFTRNSPLIFLKLDIAKAFDSVHWSYMLEVSKGFGFGQRWTDMIALLLSTSSSRVLLNGCPGMPFLHRRGLRQGDP

SEQ ID NO: 162569 - protein, 61 aa, Triticum aestivum
  Clone ID: PAT_TA_56987.pep
LIQNHYANIQLVRKNYKYLLYGFNYECSTGEIIYLLYMCPSFATVIKKWENKYISSTVAHL

SEQ ID NO: 162570 - protein, 61 aa, Triticum aestivum
  Clone ID: PAT_TA_56988.pep
GGPFIFSFFFFFFFYFFFFFFFFFFFFFFFFFFFFFFFFFFFLKPGYNIAIYEVHKQAITR

SEQ ID NO: 162571 - protein, 35 aa, Triticum aestivum
  Clone ID: PAT_TA_56989.pep
EEEEAPFVLIYWIYVHSRAYCITEHMKEHPLLRSS

SEQ ID NO: 162572 - protein, 54 aa, Triticum aestivum
  Clone ID: PAT_TA_56990.pep
IGQPNRPGPILIHKSVINRSIGRTRAASHTVESSHTHVHARTHTHTRSCRHVEG

SEQ ID NO: 162573 - protein, 79 aa, Triticum aestivum
  unsure (1)..(79): unsure at all Xaa locations
  Clone ID: PAT_TA_56991.pep
MSGTEDTPTAAXARGWRSAGSAKAEAPDEIDKAPEEKARGITISTAHVECETAKRHYAHVDCAGHADYVKNMITGAAQM

SEQ ID NO: 162574 - protein, 75 aa, Triticum aestivum
  unsure (1)..(75): unsure at all Xaa locations
  Clone ID: PAT_TA_56992.pep
IKKASHLMAPLFCPLPLLHCPLLXFPRGGFTLPLPPPSGVGPIPFSSHXFPFSPPAPFPLAFSPVAPPXFAPPPF

SEQ ID NO: 162575 - protein, 124 aa, Triticum aestivum
  Clone ID: PAT_TA_56993.pep
KGGAAGGGPHRPARRTKGGEGQRGGPPPHPNRGKKGDFPPRVIRKAPPPVTPKTGPPPPRAQSNDNGAQKKGPQKRRPARVKKFFIQKTLLSFYFFFFFFFFFFFFFFFFFFFFFFFFFFFYFF

SEQ ID NO: 162576 - protein, 100 aa, Triticum aestivum
  Clone ID: PAT_TA_56994.pep
SNEQKLTHGWIPLINQPYLAPRTNHSACMHAPARSERADLAGRRRRRHLARAQGHDAAHCVLAVRDSALDGALELLHRRRRRRRQRHGPHANAACHGRRC

SEQ ID NO: 162577 - protein, 90 aa, Triticum aestivum
  Clone ID: PAT_TA_56995.pep
AISPLVFASRAPHARRLLPPPPHARPARRIRAGPGLAPCGEISAGVYQRVPSYSWRRRWGWLAGGGWRSTKDARSARPYHQVERPCWRYA

SEQ ID NO: 162578 - protein, 81 aa, Triticum aestivum
  Clone ID: PAT_TA_56996.pep
ESNKAEKKVQDLNSKLESLQKASGEQKRMIHKTERALKVAEEELMRLQLEATTKAKQLTEVIICPIIAACCNIFNQNDNFC

SEQ ID NO: 162579 - protein, 104 aa, Triticum aestivum
  Clone ID: PAT_TA_56997.pep
SGDMEHGAHATTEVANNQVRRGRAVHGGASPVAIIIIPRVVSSYPATASIIIIYHPPPIIIIPRIVSSSAMASATIIIIHHPPIIIIPGSSHHSLRLGTPPHYS

SEQ ID NO: 162580 - protein, 213 aa, Triticum aestivum
  unsure (1)..(213): unsure at all Xaa locations
  Clone ID: PAT_TA_56998.pep
PRVRAPPTPPPSRISIWAAALISSAAEDGSDLPFPPERAPHHRELAAAAASVERACRLCVDVKRSLLSGGRKILEKNDQSPVTIADFGVQALISFELQQLFPSIPLVAEEDSTFLKSSNPDDNSGNVLIESISSAVTDKVKNSGSPLTHDDVLRAIDRGGKDAVSFDSNPATYWVLDPIDGTKGFLKGDDALYVXSGLALVVNGKVAVGVWXM

SEQ ID NO: 162581 - protein, 169 aa, Triticum aestivum
  Clone ID: PAT_TA_56999.pep
LRSLKSTVDTSSYHGHSGTLSPVDNLPYVSPLDGSPATPLSPANSSDSSYGDVSMAHPVMLEQFFVFRRSVPRGQNFYQPSTEEGDALVPVQGAGFLIGNEHNGENEVVNVPVLVAASPIYVGSSDDDEADNEAGDEAGMEAEDEIIQADPEPREVIVISSDEDESEDE

SEQ ID NO: 162582 - protein, 34 aa, Triticum aestivum
  Clone ID: PAT_TA_57000.pep
PLSRMTVSIYCKYLFTQSSTVSAIPNAILAVLEL

SEQ ID NO: 162583 - protein, 68 aa, Triticum aestivum
  Clone ID: PAT_TA_57001.pep
GSSCVRHHAIGFLPQVLVRNIPPDPDESVSKLVEHFFLVNHPDHYLKHQVITKFWNISHLKNHLQIQM

SEQ ID NO: 162584 - protein, 58 aa, Triticum aestivum
  Clone ID: PAT_TA_57002.pep
QCIEDITCSACNHAVAASRAQGIVSPIISYATRSYYSTQYRASYLFPSQSHVQSCMHA

SEQ ID NO: 162585 - protein, 116 aa, Triticum aestivum
  Clone ID: PAT_TA_57003.pep
EKVKSILCGCISGTRFHPALSSRLRPLVAMDLKWMHAAADIHASPWPKLAVSASARCPNHQLKLCLGQRTSRIAPVSCRLLMHVAAGLHDASLNLLRLQDLHSAAEALPWEYFGGG

SEQ ID NO: 162586 - protein, 225 aa, Triticum aestivum
  unsure (1)..(225): unsure at all Xaa locations
  Clone ID: PAT_TA_57004.pep
KKKKKKKKKKKKKKKKKKKKKKKKKKKKKKKKKKKKKKKKKKKKKKKKKKRGAPFKGPSFTPRGGEGKIFFLGPPNLFSGPGFYPGGGGKTPGVPHLIPLGKNPLFPGGVFTKRPPPVPLSQFCPPLLGNGPPPFGGLLPPGGGGFPPXGPLPLAGPLAPPLWVFSLSFLPALAVFPRNPFFGGPLLGPXFGFSAPRPHKSFFAGLVPLWGPLPLKNGFFPPLGG

SEQ ID NO: 162587 - protein, 63 aa, Triticum aestivum
  Clone ID: PAT_TA_57005.pep
KKSPECDKVPDRPQLGSSIDQIERSNIKDKIFIELLLELGCIICTDSSAPARLKSRKEEESSP

SEQ ID NO: 162588 - protein, 136 aa, Triticum aestivum
  unsure (1)..(136): unsure at all Xaa locations
  Clone ID: PAT_TA_57006.pep
MLVYQDKLSGDELLSDSFPYRELENGVLWEVDGHWVVQGAVDVDIGANPSAEGGGDDEGVDDQAVKVVDIVDTFRLQEHPAFDMKQFISHMMRXXXILSAXLXGDDLDVXLMIVVSASXSLLSALXGLLFFVGGRL

SEQ ID NO: 162589 - protein, 173 aa, Triticum aestivum
  Clone ID: PAT_TA_57007.pep
MADVEYRCFVGGLAWATDDQSLQNAFSKYGDVIDSKIITDRETGRSRGFGFVTFASDEAMRQAIEAMNGQDLDGRIITVNEAQSRRSGGGGGGFGGGGGGGGYGGQRREGGGGGGYGGGGGGYGGGRSGGGGGLGCPGPSDLGRRVRLGRPGHPLRPLPGCHLPELLGAAGPG

SEQ ID NO: 162590 - protein, 76 aa, Triticum aestivum
  unsure (1)..(76): unsure at all Xaa locations
  Clone ID: PAT_TA_57008.pep
RHLAHHHSAHWPTMHGTDRLVSGAAKLYRLRCSADARSADCLVFALFRLVDVLPLFPSLXCXKGPAPTALPTGPPP

SEQ ID NO: 162591 - protein, 150 aa, Triticum aestivum
  Clone ID: PAT_TA_57009.pep
MVGRKIDVSIKKKKKKKKKKKKKKKKKKKKKKKKKKKKKKKKKKKKKKKKKKKKKKKKKKKKKGGPFKKNKFKPPGRERKNFFLGGPKINYRGGVLKRGEGKKPGGKKIKSLKKKPPFPEGGKKKKGPKNTPSKKGGNPKGEREPPPRGD

SEQ ID NO: 162592 - protein, 71 aa, Triticum aestivum
  Clone ID: PAT_TA_57010.pep
LFFFCRRYRFISSQTYNKQTKPHSSKIHEILHTIEYHWLFLLINLQITKTCFSGLASSPQQYTVRTFAQTD

SEQ ID NO: 162593 - protein, 61 aa, Triticum aestivum
  unsure (1)..(61): unsure at all Xaa locations
  Clone ID: PAT_TA_57011.pep
AFGRPAREVQEVFRAKDXQDEGFVAGPDHHHEHDRGDRRRGDRGRGDEAVEAFLRMATAAL

SEQ ID NO: 162594 - protein, 45 aa, Triticum aestivum
  Clone ID: PAT_TA_57012.pep
KRGAMPLCLKYVAHACVGVSVGRRTHIFVLVRPSPSLFILLPRTY

SEQ ID NO: 162595 - protein, 133 aa, Triticum aestivum
  unsure (1)..(133): unsure at all Xaa locations
  Clone ID: PAT_TA_57013.pep
GVQELVLVNRPWPFDVPLPDTLFGISTLVRLYIGLWKLPDTAGLRGASFPHLRELGICTVVMEQGDVDSIVARCPVLEILIIQGCHXGLRLRLVSQSLRCVXVCRSVVVSLXVALAPCLGRVGLAGCRRPGAG

SEQ ID NO: 162596 - protein, 67 aa, Triticum aestivum
  Clone ID: PAT_TA_57014.pep
NTFYALCATVLFPINEWPVLARFNLILGMPYLSYTFYYYFKCLTIWHSKSSMPLENSQINLRCVLGY

SEQ ID NO: 162597 - protein, 98 aa, Triticum aestivum
  Clone ID: PAT_TA_57015.pep
MAVAYRAEEEYDYLFKVVLIGDSGVGKSNLLSRFARDEFCLDTRSTIGVEFATKTVRVDGLLVKAHIWDSAGPDWFRAFTCAYFRGAVGALVVVVVSR

SEQ ID NO: 162598 - protein, 52 aa, Triticum aestivum
  Clone ID: PAT_TA_57016.pep
DESNTRYHVSETAYHEHKLALKRIKYEEPWLHKYLSLAGQEKITHNLAASTK

SEQ ID NO: 162599 - protein, 76 aa, Triticum aestivum
  Clone ID: PAT_TA_57017.pep
YFYHSPCVVKNDGSCCCLYISSRWLFGSFFYYFSSSFTSFWFCMSLMSRLGINIVLLQKPNVLVSSFIFVEKVFQR

SEQ ID NO: 162600 - protein, 78 aa, Triticum aestivum
  Clone ID: PAT_TA_57018.pep
TPAHEIKLGGPKKPPKRCKPGEVNFEPLKRPPLFFFFFFFFFFFFFFFFFFFFFFFFFFFFFFFFFFFFFFFFFSARV

SEQ ID NO: 162601 - protein, 98 aa, Triticum aestivum
  Clone ID: PAT_TA_57019.pep
HSLTLQQCNADGPLLLGIRGLPNSLLTWPSVSSVGHRKFPGVAHLIRLAACALPRLPFYRGGPHRPFFPVGRSLNAVGTRPAAGRSARWVWGSRPAWP

SEQ ID NO: 162602 - protein, 71 aa, Triticum aestivum
  Clone ID: PAT_TA_57020.pep
HYSECTNNNWNQATLQKNFPVSKKKKKKKKKKKKKKKKKKKKKKKKKKKKKKKKKKKEKKFKKKKKKRGAV

SEQ ID NO: 162603 - protein, 128 aa, Triticum aestivum
  unsure (1)..(128): unsure at all Xaa locations
  Clone ID: PAT_TA_57021.pep
PSHVHARDSRRRPFPFQLALAGHPPRPPPPPXRPAAPALPSPPRSSPRSSPRAAACRSAHTRMAVAEGGSGAALAPLXPPPPVPSSPAAPLPPPFPPHTLPSPAPLRCCSTGYDFHGCPGSMASDLAS

SEQ ID NO: 162604 - protein, 121 aa, Triticum aestivum
  Clone ID: PAT_TA_57022.pep
HGAVPGQLAACLRVMRPRWRCVICCRNICSVWPAATCAHLLPQPVADAAYGRRRRRKYKVHSPCVGITIVLLLLSASTKCPSIIQPTEYAILFKHRCKEIRIFPLIQVGLILQTETAMSTK

SEQ ID NO: 162605 - protein, 88 aa, Triticum aestivum
  Clone ID: PAT_TA_57023.pep
TDVCSCLGEETCHRGKEKRNKMQLTTVSKSHLLICPAIGELAFFLPSTLRVLNWALCVLVMYMSDTFFFTFYIASAELGFVCARYVHE

SEQ ID NO: 162606 - protein, 220 aa, Triticum aestivum
  unsure (1)..(220): unsure at all Xaa locations
  Clone ID: PAT_TA_57024.pep
CGELKLNGWRASSAPRSYWPPHXTDSDTNGYLRVRCIGGLNQQRTAICNAVVAARIMNATLVLPELYTNSFWRXRGIYDVPHFIKTLKYDVRIATIVPYIITNRKAKKLKAYQIRPPRDASEDINDPDIQILRCRVNYHALRFKPNIMKTSSEIVNKLRSXSHFMSIXLRFEMDMLAFAGCIDIFTPHEQKILIKYRKENFAEKELVYRERRLIXKCPLT

SEQ ID NO: 162607 - protein, 125 aa, Triticum aestivum
  Clone ID: PAT_TA_57025.pep
VSIFVTRFWEGVFFFFGPFFLFSGGGFFKGGGGKSLGVPFFFGFGGIPFLPFGVFALKAWTVGLSHMVPTFLGYCFPLFWGALRGGGGGFSPWVGFHFGGFLKTRFFFFFPFFLGKFFLFSRFFF

SEQ ID NO: 162608 - protein, 83 aa, Triticum aestivum
  Clone ID: PAT_TA_57026.pep
LAASPQSSRWSRWQEYASWTPKRLLPRRMHRRRSPVCRELAMVILMMFHRQENRADYSEHDRHHSEDAGHHHETSVPHGGSHY

SEQ ID NO: 162609 - protein, 92 aa, Triticum aestivum
  Clone ID: PAT_TA_57027.pep
RRKQQCRRVQDSSAPAVHCHHPGSFNMTAPSRSMPSSGGARRSFPPTSHWMFMLLLLCTFSSTSGGFSVHLKCAFSASSCSEEDIPMIRLSL

SEQ ID NO: 162610 - protein, 129 aa, Triticum aestivum
  unsure (1)..(129): unsure at all Xaa locations
  Clone ID: PAT_TA_57028.pep
VARPXXDXQEXHPSRALXAPPSTWTVVRAAASGTRNRLQSAXPYRCSPHQDRLISTPPVCAPPTTTTTLSPYRNRQHHHRAQQPWRPGVTTPAGSNARAPVVQIQIQNQKGRDRDGTEPSGRRNRRQHR

SEQ ID NO: 162611 - protein, 126 aa, Triticum aestivum
  unsure (1)..(126): unsure at all Xaa locations
  Clone ID: PAT_TA_57029.pep
MASTFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMXTRFVGXAGVGXXAQ

SEQ ID NO: 162612 - protein, 124 aa, Triticum aestivum
  Clone ID: PAT_TA_57030.pep
GISRPDRPIRGRDNKSPLGRHLGVRGIVGASWQSVSTAVIAAVISVSNRSNNIVVSPAQCSNLRMGCGRSRRGFRDIELGVVDGVLESLCDVRGSEARGFCPDSPSSHINEDRGLFGGQAGACT

SEQ ID NO: 162613 - protein, 94 aa, Triticum aestivum
  Clone ID: PAT_TA_57031.pep
MILCGSQGNTLAKKKKKKKKKKKKKKKKKKKKKKKKKKKKKKKKKKKKKKKKKKKKKKKKKGGGPFKGPNFTPRGWKGIFFFLGPPNLISGAGF

SEQ ID NO: 162614 - protein, 226 aa, Triticum aestivum
  unsure (1)..(226): unsure at all Xaa locations
  Clone ID: PAT_TA_57032.pep
SLRGSFGETNQSELAAFTSYALAFPNSFLALVDTYDVMRSGVPNFCAVALALNDMGYKAVGIRLDSGDLAYLSIETRKFFCAIEKXFGVVGFGKTNITASNDLNEETIDALNKQGHEVDSFGIGTYLVTCYAQAALXGCVFKLVEINKQPRIKLSEDVTKVSIPCKKRCYRLYGKEGYPLVDIMTGQDEPSPKVGERILGRHPFIESKRAHVVPQXVEELXLKCFW

SEQ ID NO: 162615 - protein, 118 aa, Triticum aestivum
  unsure (1)..(118): unsure at all Xaa locations
  Clone ID: PAT_TA_57033.pep
VHQYISDCEDEDNEILRQTLQNSLHEDHGRTSGVRGTVGSSGGVKGSSSGGVKDFFDVDLAYSKTRPQQTMEVCINKADYESWIGKAWAKWFHAIGLPGRLAICPYFVGAAXLPRDLG

SEQ ID NO: 162616 - protein, 56 aa, Triticum aestivum
  Clone ID: PAT_TA_57034.pep
RRLQPREHTTCGCGEHCGSNPCACGREGTPSGRANRRANCSCGAACNCASCGSTTA

SEQ ID NO: 162617 - protein, 94 aa, Triticum aestivum
  Clone ID: PAT_TA_57035.pep
LLRPNRSPSSRTPSGAHTHNLTPIPTHPHAMRIWRGRRPTRAPASARRRTAATPAPRHRPPRTRPWAMRPRRPPRRPSRGEEAMGPGLTLSRTG

SEQ ID NO: 162618 - protein, 167 aa, Triticum aestivum
  unsure (1)..(167): unsure at all Xaa locations
  Clone ID: PAT_TA_57036.pep
SQCLTKEPGAIEAEFARLGTELVLRKFFTYRTPGPLFIPKSGWGSPDDEVPLPSWITEEDIKYYASQFDKSGFTGALNYYRALNKTWELTSPWTGAEIKVPTKFIVGDVDLSYHVAGAHDFINKGGLKKXVPLLDDVVVMKDVGHFINEEKPEEISAHIISFLKKFD

SEQ ID NO: 162619 - protein, 71 aa, Triticum aestivum
  Clone ID: PAT_TA_57037.pep
MAGIGPIRQDWEPIVVRKKAQNAADKKDEKAVNAARRSGAEIDTTKKCRCLIGSILAAVLLSDLLDAVFPR

SEQ ID NO: 162620 - protein, 115 aa, Triticum aestivum
  Clone ID: PAT_TA_57038.pep
FVLSSPARVHDAAAVRARALSLHLPSRAGPPPTTSPLIFSIDLDLRSEPEEGQVPVAETGAMRSGSPPPPPSRLRAATQGGAPDSQEELKQRRWSTAPSWSSSAGAARAIETCCP

SEQ ID NO: 162621 - protein, 44 aa, Triticum aestivum
  Clone ID: PAT_TA_57039.pep
AFVFLSGFFFFFFFFWFFFFFFFFFFFFFFFFLYASEQPHLYQD

SEQ ID NO: 162622 - protein, 151 aa, Triticum aestivum
  Clone ID: PAT_TA_57040.pep
VFALGINDPGTKTYLGLYSLNFETAHKQNPSICIENLSSLQKTIMQAARIAYVTDLIFSMVSVPLSTLAFDAEYVPWYWPLIMACSSGCLKQRLTQIPHRKFLCTAPDEKRDDSPCAEFFGSKASFCRPVVKSFSRSHGFHGVVLLPVFLP

SEQ ID NO: 162623 - protein, 203 aa, Triticum aestivum
  unsure (1)..(203): unsure at all Xaa locations
  Clone ID: PAT_TA_57041.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNVQRKLEKRQQGRTLDSHIEEQFSGXGRLLACISSRPGQCGRADGYI

SEQ ID NO: 162624 - protein, 182 aa, Triticum aestivum
  unsure (1)..(182): unsure at all Xaa locations
  Clone ID: PAT_TA_57042.pep
NASSVRSFPSLHRAIESGPASSLVGWWDAGVPGGGRIAGAVDLRLSKDYPAPSGTPHPQAATAVADAHGDLCPRCESRHTKFCYYNNYNTXQSCHYCMCCRRYWTKGXGSLRNVPVVRMITQELLLVIVIFVQPHARQELHTPTGRAETAPVAMRPCARSTPHSQRALWLGLYWPHAPSYTW

SEQ ID NO: 162625 - protein, 156 aa, Triticum aestivum
  Clone ID: PAT_TA_57043.pep
FIHNHKKTSRDNSSRAHALCSSRKYSMQRKPTGDSAVQSHAVVPVEFNPVAAVKDAAEGVVQFGLTGSACSKGWSRQPCSVYGNCLKRSRRPHCLRRGTFRHHTQLGLFAPGQWSPLMWSQFTACGDAPPPGRYGQEHDRHPPGSQRRGGHVWIHE

SEQ ID NO: 162626 - protein, 71 aa, Triticum aestivum
  Clone ID: PAT_TA_57044.pep
KKNKKKKKKKKKKKKKKKKKKKKKKKKKKKKKKKKKKKKKKKKKKKKGGAVLRDPIFLPGPGKEKFFFWGP

SEQ ID NO: 162627 - protein, 49 aa, Triticum aestivum
  Clone ID: PAT_TA_57045.pep
VRVDPAGLLLPPVGVFLRYGIGVEFWICLLLTVLGYIPGIIYAIFVLVA

SEQ ID NO: 162628 - protein, 184 aa, Triticum aestivum
  Clone ID: PAT_TA_57046.pep
DSTLVSLPSHAAAAAAAHHPGDLPTGDPQPLPLLLPCIRRPHLPSQSQITHSLSLVTHSLDAPRLLGHPLPHPAPPRRGNWAMAMSMSAATRAMRRIHARRTSASCLLRSARPDPNPAVLQGQAPVPRWYWGAAAGADPPSTQAHLGVATVPQRQVFVVERFCQYHKILPTRVHFLVPVLFLCY

SEQ ID NO: 162629 - protein, 130 aa, Triticum aestivum
  unsure (1)..(130): unsure at all Xaa locations
  Clone ID: PAT_TA_57047.pep
GRSTWRICGGYVQVSARTSTEENTTVGSSSTVRQMGEQINGMLXEKAPSASQALTVATLFPLGXLLLVLPGLGLAGTVVGLAVXTPVFLVVRPVLGPAVLSIGLGRTGVLTSGSLRLGGLFSVTCVGLHG

SEQ ID NO: 162630 - protein, 117 aa, Triticum aestivum
  Clone ID: PAT_TA_57048.pep
PNLWEQGTGGARRPKKPPRANGQVGTTPPNGGKPRAFPKAKGGNSKPGNNPPRPPGKKTETLAEDPRSKRRGPLNAPSHIFFFCSLFVRYFFFFFFFFSFFFFFFFFFFFFFFFYIF

SEQ ID NO: 162631 - protein, 181 aa, Triticum aestivum
  Clone ID: PAT_TA_57049.pep
QQHTEPEQRVEEVSRDEEKERRTWAADGSPPSQVRRMAAAICCHACLTCSMALGSDQRNIHGGWPISEASLLMHAPAMDQPLVSADHTTARLQPYLSTRPLSGVSSVAPSSTGMRQLADPAPTRRKTKGGDDGAAAPVTRRPARLVPPVRRLSLDTPGYDTGSGCGPLVLRHHQVRRGKEI

SEQ ID NO: 162632 - protein, 53 aa, Triticum aestivum
  unsure (1)..(53): unsure at all Xaa locations
  Clone ID: PAT_TA_57050.pep
CHSPFRLSMCWXGQSVRACSLLLQLQKGECASRPLSWVSAGFWQSQRCRCTAT

SEQ ID NO: 162633 - protein, 69 aa, Triticum aestivum
  Clone ID: PAT_TA_57051.pep
LPSCSAVNNLIYTYVKYIYLLKGFCVLLLVLYVTFTFAVSHKWIQVDVWISIWWMIRVILLQVIICTHT

SEQ ID NO: 162634 - protein, 61 aa, Triticum aestivum
  Clone ID: PAT_TA_57052.pep
ERWIKNELTSLCRNGEITLYACVHYMNKLLLCILAKKKKKKKREEKKKNYKKKRGKQNKII

SEQ ID NO: 162635 - protein, 64 aa, Triticum aestivum
  Clone ID: PAT_TA_57053.pep
IWGPQKKNKNLPAPGRKTGTPKTAPPFFFFFGFFFFFFFFFFFFFFFFFFFFFFFFFFFFFFFF

SEQ ID NO: 162636 - protein, 198 aa, Triticum aestivum
  Clone ID: PAT_TA_57054.pep
MVEDTYGCIIGNRILTSSHNEFVSLFGEYKELYGTSSTSELASQARASENASESSLMRSRYNKKRMRTCGEGSTSSNMRTELDKYLAEDTEELTAEFDLLEWWKLNAARFPVLSKMARDILAIPISTVASESAFSTSGRILDDFRSSLTPATLQALICTQDWLRSKPINVELDLAELTKLEEGVGALRLEDNGVISID

SEQ ID NO: 162637 - protein, 40 aa, Triticum aestivum
  Clone ID: PAT_TA_57055.pep
LGRCKPGFFKGTPLLFSFILLLAYVRILYSSSGRVARHAW

SEQ ID NO: 162638 - protein, 161 aa, Triticum aestivum; identical to SEQ ID NO: 129051
  Clone ID: PAT_TA_57056.pep

SEQ ID NO: 162639 - protein, 215 aa, Triticum aestivum
  Clone ID: PAT_TA_57057.pep
LPSPLGLSCGSILMESVELSSTSLAEAMFEKLGLPKPVYFVHHLSQDRFRTEIQFHRTKARYDASARRTKVSSRTCQNGVASMNHALDKAIEYMQNREGKVLVDYNYYQLEQMKMAHTRLSTRLPEQSDEINQHIKTIKQITKEACNYVEQVRNASNRIQDLAAVFLDPATSMCVSNMKQAIMEIHSSIVVLQSSTTTTSRVLEEKACTQMMKCL

SEQ ID NO: 162640 - protein, 73 aa, Triticum aestivum
  unsure (1)..(73): unsure at all Xaa locations
  Clone ID: PAT_TA_57058.pep
EYKIPRPKAIVQSRKTXQSRQLHRHSQFQSSCRCIQQNLHPWMEASGRKKILSADMKLNMSELNVPMTLLFLS

SEQ ID NO: 162641 - protein, 90 aa, Triticum aestivum
  Clone ID: PAT_TA_57059.pep
GSTQVTKILPRAWGPPKFTLFSPPLKGGGNFFLIGKGPPLFFFFFFFFFFFFFFFFFFFFFFFFFFFFFFFFFFGRKNIRQPCDMWRTCI

SEQ ID NO: 162642 - protein, 192 aa, Triticum aestivum
  Clone ID: PAT_TA_57060.pep
PPPKNAPREQGPGKPERETQKRNPQKKPPRENPRGKAESTAKKRKERAQRNGPKGGGQGEGPPGRGPPKGPPQRGGPRASSVPHSREGHAGKAHLARPQREKRGWQKGQVKGGTTGGAPQGGTKTGAPQMRSGAPKEGPPRNKHEDARREPQKRDPPKRGPPIFFFFFFFFFFFFFFFFFFFFFFFFFFFYF

SEQ ID NO: 162643 - protein, 119 aa, Triticum aestivum
  unsure (1)..(119): unsure at all Xaa locations
  Clone ID: PAT_TA_57061.pep
LSNFSTLDRIYLNRRYRQNRVVTQFSYLAXYPCFTSCFNKVEDYTKRPYQQLFTLNGQCDWPWRRALNAGIKGGTRSGNATLDRVIWQGPIALFFCFLASLSGFARRVFTWGFPLGVPF

SEQ ID NO: 162644 - protein, 79 aa, Triticum aestivum
  Clone ID: PAT_TA_57062.pep
GLVNSGIKKLEAPYISVLYCKNNTASFDRTTTLSRREKRLPNLRIKPQPPWMKVELDSQLKCWGSRVVLVELAPYIFHA

SEQ ID NO: 162645 - protein, 119 aa, Triticum aestivum
  unsure (1)..(119): unsure at all Xaa locations
  Clone ID: PAT_TA_57063.pep
AWEFLSKLGDLSQTLIFAKIENVEGLNHFDEILEEAYGIILSRGNFGIDLQPEKVFLFQKSALHKCNMAGKPXAVVTHVVDCMTDNLRPARAEATDVAKMRCWTVSFCLLLTSYTLVIL

SEQ ID NO: 162646 - protein, 37 aa, Triticum aestivum
  Clone ID: PAT_TA_57064.pep
KDTGGGREKKLRNINRPCLEELLCLPLDNYSMYYSGF

SEQ ID NO: 162647 - protein, 227 aa, Triticum aestivum
  Clone ID: PAT_TA_57065.pep
NHLRNLLKAISDLHECLCSLSITIPVAGPHEAELPEVNVSYLKKHPKILESLSIKGTTQKGRLLPLFIKGDNNKLAKITLCHTLLSQDDLEVLAKLPKLRCVRLQHILCTEHKLNFKKGEFGCLKYLLVEDSDLTNITFEDEAASELEKMVLSITSKCSISGVDCLLNLKELELNSSFCGSLLDDAKQISKLTLRGTLLEQDALQTLAKKPNIRSLLLRDKSFRGKS

SEQ ID NO: 162648 - protein, 37 aa, Triticum aestivum
  unsure (1)..(37): unsure at all Xaa locations
  Clone ID: PAT_TA_57066.pep
ALPCFGAXFLSFLVGPRSWXXLLLXSSXAXSCVSTSE

SEQ ID NO: 162649 - protein, 225 aa, Triticum aestivum
  unsure (1)..(225): unsure at all Xaa locations
  Clone ID: PAT_TA_57067.pep
KYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALXGDNVGFXVKNVACKDL

SEQ ID NO: 162650 - protein, 51 aa, Triticum aestivum
  Clone ID: PAT_TA_57068.pep
PLRSSHDYIVTMKFLTFSSFIIRTQHTTLIYPLIDRDPKKHQAHKPKTKQW

SEQ ID NO: 162651 - protein, 190 aa, Triticum aestivum
  Clone ID: PAT_TA_57069.pep
KNKKKDPQAVGGGTLGKQKAPKRSGRPHAKGEKTVFRGEGPQGEPPPKKNFLGRGAGKTQNGTPKGGPPLKPSGGKPPNGGKKKGKKPKERGLRARQKERGPWGETPPPPRLNGPEKGGAPFPLRGANFWKGESGGPFSFYPHRGKGDFFPRDLIGGPPGFSPPPGFKTRPRELNLGAPKKKYYLARPGE

SEQ ID NO: 162652 - protein, 65 aa, Triticum aestivum
  Clone ID: PAT_TA_57070.pep
TIKVSWWQCLLLHDGNSTAFCCFVVKYKLGMSFVHRSSNMTISCRQNARGKSQPCTCDRWNGILF

SEQ ID NO: 162653 - protein, 82 aa, Triticum aestivum
  Clone ID: PAT_TA_57071.pep
MASPRPMAAAPAVLLLVLLLVATEMGTMKTAEARTCQSQSHKFKGACFSDTNCASVCRTEKFPRGQCNTHYVERKCYCERDC

SEQ ID NO: 162654 - protein, 148 aa, Triticum aestivum
  Clone ID: PAT_TA_57072.pep
KGPKNGQPGERPQRGAKDERENPKAPGPKSPKGERRKGGGKNTPTGKKGPPGRGAKKKTKGAGFRGGARGGAPPRGPPPPKRAKWPHNKKGGTPQVAPPTGGKGERGGPLRGDPKRKKGDAPQGEKKGEPPPPPTPFCCKKTGQGTRK

SEQ ID NO: 162655 - protein, 89 aa, Triticum aestivum
  unsure (1)..(89): unsure at all Xaa locations
  Clone ID: PAT_TA_57073.pep
KATEEETKMKESELMRGNPLINMNNFCSFDVEVTMLPTILYXQGHGETKTPKRFINYTVISDFHRKFLHRYYASCLVSCRSSSPITCRH

SEQ ID NO: 162656 - protein, 118 aa, Triticum aestivum
  Clone ID: PAT_TA_57074.pep
EELCRDAGETNWDYISTMMHPDVMGCRIDWVKKFMFLVNFMDCWSLYILDTEKKIMIVHEMTETDPACEMKIKHEALAKKFQHSFCTLFNDMFGAGLVETRGLSFVYPLVAQHGQCSS

SEQ ID NO: 162657 - protein, 247 aa, Triticum aestivum
  Clone ID: PAT_TA_57075.pep
DAWAEVLDFVNDAIITLDAFADAYQPAALSLCASFERGDRAEELLNTLASLYDLLLPSLLQGFQVMSSSQSNGETSSESILNDIVLGIRMLSKRAVGFGWRLLEFCYLNDQLKEEDVQASTKMFPAKVEDPMIRGEIIVQILKDINREATYSSKGNPGKTFLQALQKEFQLMSRIGDIRNKGWIYMEDEQFQFISRLCGSTVTSWNSGPDLPILPMVVNLHSKMRKLLSLSPVLSDKGPSSSSGKGS

SEQ ID NO: 162658 - protein, 209 aa, Triticum aestivum
  unsure (1)..(209): unsure at all Xaa locations
  Clone ID: PAT_TA_57076.pep
RMQYHYFGDAITFDTTYRTNLYDIPFRLFVGVNNHFQSIIFGGVLVRDETSETFEWVFNEFIRMMGGKHPQTILTDQCWAMELAIEKTMPETTHRWCKWHILKKAKEKLGTYYTKRSNFRAEFHKIVNHMLTEDEFENAWRELLDKYSLQKTXYMASIYEVRQKWAKPXFWGKFCAXMTSTQRSESANHMLKGYVPASCPMHLFVRQYM

SEQ ID NO: 162659 - protein, 68 aa, Triticum aestivum
  Clone ID: PAT_TA_57077.pep
KIMLYMPIKSVLVQNPTNESSPKQINFQSMDHTKFSNVEILHLDFDSRICMRVVKIVIKVSPGFRFPI

SEQ ID NO: 162660 - protein, 77 aa, Triticum aestivum
  Clone ID: PAT_TA_57078.pep
MNAPWTDDRAVSVDEALLIDPNKVDALWCWLNGLTYAGFLIYETVQTDECLDEAIGCLQKAVDSEPLYDLDTKQFNE

SEQ ID NO: 162661 - protein, 44 aa, Triticum aestivum
  Clone ID: PAT_TA_57079.pep
YKFFPWTMANLHSSQTLTTHLQPAEKNDLLVATTSSRRRALPAG

SEQ ID NO: 162662 - protein, 123 aa, Triticum aestivum
  unsure (1)..(123): unsure at all Xaa locations
  Clone ID: PAT_TA_57080.pep
MARGLKKHLKRLNAPSHWMLDKLGGAFAPKPSSGPHKARECLPLILILRNRLKYALTYREVQSILMQRHIMVDGKVRXDKTYPAGFMDIXSFPKTGVNYXSLYDTPGXFRLLSVRDAAAFFML

SEQ ID NO: 162663 - protein, 79 aa, Triticum aestivum
  unsure (1)..(79): unsure at all Xaa locations
  Clone ID: PAT_TA_57081.pep
GTPKTGPPFFFFFXFFLNLFKIXTXFNNKXXIFFXXFFFFXXLSQHLIARQISGNKIIQLFTHIYYIYMAQKHIMIYNK

SEQ ID NO: 162664 - protein, 93 aa, Triticum aestivum
  unsure (1)..(93): unsure at all Xaa locations
  Clone ID: PAT_TA_57082.pep
QRGNGKNLGVPKLNPFEKNPLFPSWGKTKKARPNRLSKNLPTLKGKXEPPLNRPLXSAGGGGVTPRGTVTFASPLAPVLFVFFLSFLPTFAGF

SEQ ID NO: 162665 - protein, 205 aa, Triticum aestivum
  Clone ID: PAT_TA_57083.pep
ERFQREEEERKKREEEERARREKERKQREEEQRKREEEERERREEKERKQREEEERARREKERKEREDDYSARREQEEEEERRRREEEEGGGGQGGGGGDDPREEEERRRREEEEGGGGGDDPREEEERRRMEEEEGVGCQGGRGDDPREEEERRRRREEEEGGRGGDDPWEEEEGDWGDSTKFRAAKNLKKRFRGRMGAVFQSA

SEQ ID NO: 162666 - protein, 54 aa, Triticum aestivum
  Clone ID: PAT_TA_57084.pep
LTQNRGQSTKPNNAEKLLSMLFLSSAFSPKSNAPHNIHLTHSTRSSSLLCLDLV

SEQ ID NO: 162667 - protein, 79 aa, Triticum aestivum
  Clone ID: PAT_TA_57085.pep
QGKKVKVPTFLVPATQKVWMDVYSLPVPGSGGKTCSQIFEEAGCDAPASPNCGACLGGPRDTYARMNEPTASLFQYFQI

SEQ ID NO: 162668 - protein, 64 aa, Triticum aestivum
  Clone ID: PAT_TA_57086.pep
TAPPFFFFFFFFFFFFFFFFFFFFFFFFFFFFFFFFFFFFFFFFFVLNGIFMHIHVIISTRYGI

SEQ ID NO: 162669 - protein, 111 aa, Triticum aestivum
  Clone ID: PAT_TA_57087.pep
AVAATEHADTSPDLKWHGFQLAHSVNNTAVAASKLGGCHRQERQAVFVVMLGVKQLVVLALRLPEVMVLGGVAHRRDIVGPEHHLHLLVGLAEDEHTWAGSMHAWRTPGCS

SEQ ID NO: 162670 - protein, 197 aa, Triticum aestivum
  unsure (1)..(197): unsure at all Xaa locations
  Clone ID: PAT_TA_57088.pep
LRFTKLLLAIPXILELAEELSLPLAAVKYSRGTFIFPEAQPSPHKNFSDEVAFLNGYFGGLKSGGNAYVIGDPAKPGQKWHVYYATQQPEQPMVNLEMCMTGLDKKKASVFFKTSADGYTSCAKEMTKLSGISEIIPEMEICDFDFEPCGYSMNAIHGSAFSTIHVTPEDGFSYASYEVMGVDPASMAYGDLVKRVL

SEQ ID NO: 162671 - protein, 34 aa, Triticum aestivum
  Clone ID: PAT_TA_57089.pep
SPNTNIYSSIEISSKVSKPNHCIKVRKVTIGTPS

SEQ ID NO: 162672 - protein, 56 aa, Triticum aestivum
  Clone ID: PAT_TA_57090.pep
ITCQELIFAQKNGLRNLKPEQEWFNYKYIQSLFEFMASQESIMANLSTVSFSVSTH

SEQ ID NO: 162673 - protein, 244 aa, Triticum aestivum
  unsure (1)..(244): unsure at all Xaa locations
  Clone ID: PAT_TA_57091.pep
DDGLVLCSPRYRFFXYKDGGKDDDPIEEKLNXENTNCLPGLKCYFAPTESGWNMDEPYILPGKTINQAAQLFMLIHTAPTLVKHMDRXALILXSKTITKDVDLSAVHVXRLDDKPCSHENGGIVQRDGELLIHTDGTGLISEDLAEKCPTIMYKRKLLKSQDVQACDDTLMTYPHAKKQRSIARKPPLLIQFRMFYKGSAVMGTALIDRQLSPGTILIRXPSMIKIKTDPKLCRCSSPLLFGNW

SEQ ID NO: 162674 - protein, 80 aa, Triticum aestivum
  Clone ID: PAT_TA_57092.pep
PILSHSALKTILKELAELRKTRFMPPAKFFKTCNHPTDIWPKDVLIHAPCRSSKIFHKPWRSVLIMLVKFIWCHVLYAAV

SEQ ID NO: 162675 - protein, 48 aa, Triticum aestivum
  Clone ID: PAT_TA_57093.pep
SSKSCDCDCTRKADLLDKVSYGAVVRTYLYYIKPSTSSDLQATNIYVS

SEQ ID NO: 162676 - protein, 121 aa, Triticum aestivum
  unsure (1)..(121): unsure at all Xaa locations
  Clone ID: PAT_TA_57094.pep
CLRCRVTGGAGSGGCAMSADVEATCCATCMAMPAASHMGSSPPFTTGAETGCXTLGQIGGWDCTTLMLGAXACAAAQDAAQPRPTRPCGGRAREDHDRQLAAPSASFHHHPCAHGRAPVVL

SEQ ID NO: 162677 - protein, 220 aa, Triticum aestivum
  unsure (1)..(220): unsure at all Xaa locations
  Clone ID: PAT_TA_57095.pep
MADELLWLVQRLFFLNGDQDLSSFLLVDLGLVKFPDYTCSVVHRIFQERNDLLQYEEAIRVAQFMDESLDNDNMELVSRCTDLSENRLCTSLKEEDSSLADSPPSFYSCFSSTWIYSKILTLGVSVYERERRYADAIRTLKILLSKVASGRRRGYWTLRLSIDLEHMGRPNESLSIAEGGVTDPWIRAGSKIALQKRALRLGKPPRRWKSSXYADSLKRT

SEQ ID NO: 162678 - protein, 197 aa, Triticum aestivum
  unsure (1)..(197): unsure at all Xaa locations
  Clone ID: PAT_TA_57096.pep
PPRRPRAXSTAPXAAPEAWPLWRRGPPEPRVPPASHTAAPATWPRGRREPPEESCAPPPQRAASPAAWPRGRREPPEPRVPPALREAAPAAWPRGRREPPERRGPPASRPSWRRWRGEPRETRGPPPRGWGGAAAPAAWPCRRREARGPRAPPPRGTASAPGPGAAVGEAARPRQPRGPSAGACAAGAGGVVAAAAS

SEQ ID NO: 162679 - protein, 230 aa, Triticum aestivum
  unsure (1)..(230): unsure at all Xaa locations
  Clone ID: PAT_TA_57097.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNSVLSTHSLLEHTDVSILLDXEAIYDICRRSLDIERPTYTNLNRL

SEQ ID NO: 162680 - protein, 41 aa, Triticum aestivum
  Clone ID: PAT_TA_57098.pep
PENADMEKISAVCRDGVLTVTVEKLPPPEPKKPKTIQVQVA

SEQ ID NO: 162681 - protein, 57 aa, Triticum aestivum
  Clone ID: PAT_TA_57099.pep
TPSTLSLPSKYAQLQIYSLLLSTHDLYVSNPCHIELILSEKEEPVKKEAESQIARKA

SEQ ID NO: 162682 - protein, 66 aa, Triticum aestivum
  Clone ID: PAT_TA_57100.pep
KCVSLFFFFFFFFFFFFFFFFFFFFFFFFFFFFFFFFFSENILFFFFIISVSVLSILIFSRTVGPG

SEQ ID NO: 162683 - protein, 51 aa, Triticum aestivum
  unsure (1)..(51): unsure at all Xaa locations
  Clone ID: PAT_TA_57101.pep
TPATEFLFFFFKXFFFFFFFFFLIFFFLKGPPPFFFFFFFFFFFSIFPFFL

SEQ ID NO: 162684 - protein, 42 aa, Triticum aestivum
  Clone ID: PAT_TA_57102.pep
DYNYEGTIAILEVIVYKEIQPPELGGTSSHNKKICGQKEING

SEQ ID NO: 162685 - protein, 66 aa, Triticum aestivum
  Clone ID: PAT_TA_57103.pep
NNAEEEPACSAFRLCGSIRMPQAHVLVNSPYYIFFDKENKPYLSVRAYTRLLTGTYSDVPQLNFVA

SEQ ID NO: 162686 - protein, 112 aa, Triticum aestivum
  Clone ID: PAT_TA_57104.pep
FPGFPGGKQEEKKLGQKFVVNVDAWMDLPPPGDSDDIAHPVRYPDIYRITKGVVEGPSRNLLESVGQSIPGTTLLEFPQISPVRVKVGKPPVPVQGVVDYLGVEILRRRKKA

SEQ ID NO: 162687 - protein, 198 aa, Triticum aestivum
  unsure (1)..(198): unsure at all Xaa locations
  Clone ID: PAT_TA_57105.pep
MAEHGEEEAATLEFTPTWIAAXVCSIIVLISLLAERCLHYLRKTFKRKNQKPIYEAILKVKEELMLRRVNALLLTVCQGKIQNMWIRASWTLHMLPCQGEDEVRAGEAAPTXEHLVTSQIIGRICRRLLNGGAAEADVCRSKGKATLMSLEPIHQLHIFISVLAITHVVIRVLTMLLGGAKIHQWKLWEDAIQIDTAG

SEQ ID NO: 162688 - protein, 130 aa, Triticum aestivum
  unsure (1)..(130): unsure at all Xaa locations
  Clone ID: PAT_TA_57106.pep
MAAEEASSSGGGGGEEGSGAGGWTREQEKAFENALATVDEEEGEAMWDKIADAVEGKTPEEVRRHYELLVEDVDGIEAGRVPLLVYAGDGEEGGSGAGAGGSGXGGGXGGKKTAEEGAGTGRRARPSPPS

SEQ ID NO: 162689 - protein, 241 aa, Triticum aestivum
  Clone ID: PAT_TA_57107.pep
PRRLLHHLPAPTHTPTFLSSLSSMELIKPTATPSSKALFQHEPADGGDAASGTIGGLPFHLTERILRRISPLESAPFAAVCKSWAATISERLARPTPHLFALEVLNEDEYFIDLLFVPDLERRRGAIFSVPTDDEESPAPVIPARLPATVSHAKDDNIKLSGALPCGGLSFAEDNRVVLVNPVTGAFQSIEMYPPRHRLLIQPTVRAVAGADAFFVSQYFERTVTLRWREVEEWSEQNLLL

SEQ ID NO: 162690 - protein, 224 aa, Triticum aestivum
  unsure (1)..(224): unsure at all Xaa locations
  Clone ID: PAT_TA_57108.pep
CCDITVADVAAPYWQRPAGPTWWCHVTAGHPAVDAWLAGARWLHPAIRVALRDESMLISEKMKHLLYEVPVRVAGGLLFELLGQSVGDPAGDEDDIPIVLRAWQAQNFLITALHVKGSATNINVIGVTEVQELLSACGSTAPKSIHEVVAHLASRLARWDDRLWRKYVFGAADEIEVKFVNRRNQEDLXLLCIIFNQDIRRLATQVIRVKWSLHAREEIIFELL

SEQ ID NO: 162691 - protein, 78 aa, Triticum aestivum
  Clone ID: PAT_TA_57109.pep
LVTTTTLYFLFFVAAEGLRPAQQWMQPVRGAAGDLEVQFNKAANIFPCKRQKLKPSPPSRFGVLSLKHGKKMCRLCFI

SEQ ID NO: 162692 - protein, 164 aa, Triticum aestivum
  Clone ID: PAT_TA_57110.pep
KNIKKKKKKKKKKKKKKKKKKKKKKKKKKKGGEGFKGKQNSILVPATKITGSLLSGDTHFSWALVLPRLSLCKARRLSRFLRLVAHTPFSGRPCYRKGPLPLPFSPFFPCEWGKGAALFTAFFPGAVGVVPQRAPLTFDLSLARAFGFFPFFSRHGGGFFPLRF

SEQ ID NO: 162693 - protein, 124 aa, Triticum aestivum
  Clone ID: PAT_TA_57111.pep
MECQSEVSKAPSFAICDVQSDAESAVHTRPSLDIGFTTPQKSYSAPFCGSSCTPECDDAIRPAIGMTFADLNAAKEFYEAYAHHVGFSVRVGQQKIVNGVITHKRFYCDREGFREERKDSFILI

SEQ ID NO: 162694 - protein, 131 aa, Triticum aestivum
  unsure (1)..(131): unsure at all Xaa locations
  Clone ID: PAT_TA_57112.pep
SISLAYFWNKKKKKKKKKKKKKKKKKKKKKKKKKKKKKKKKKKKKKKKKKKKKKKGGPFKKKQIKQXRARKGKIFLKGPQKKNKGPGFKKRGKGKNRGEPKKNALKKNPLFQRGEKKKKPQTNPLSKNCPT

SEQ ID NO: 162695 - protein, 236 aa, Triticum aestivum
  unsure (1)..(236): unsure at all Xaa locations
  Clone ID: PAT_TA_57113.pep
NDLAGEIPQVGSLVNQGPTAFDDNPRLCGFPLKIECAGERDEPRIPQSNPGMNPGAAAQVGRPPKRRSSPTVPILAVIVVAAIVAGLVLQWQCRRRCAATTRDEEKESSTKEKSAAVTLAGTEERRGGGEEXGXFVAVDDGFGMELEELLRASAYVVGKSRGGIVYRXVVPGRGTAVAVRRLSEPDDGDGTESGWRRRRAFEAEAAAIGRARHPNVAXLRAYYYAPDEKLLIYDYL

SEQ ID NO: 162696 - protein, 120 aa, Triticum aestivum
  Clone ID: PAT_TA_57114.pep
HARTHTLACVNTYEGPSIHKTGNRRRARALLRGAADWHRPASSSLRRRPGAGAGAPSPGGAGVAASSGAGLLRAALDGVAGLLRLVPPRPPLFFFFFFFFFFFFFFFFFFFFFFFFFFFF

SEQ ID NO: 162697 - protein, 155 aa, Triticum aestivum
  Clone ID: PAT_TA_57115.pep
MEAALNMSLDDMIKNRSGRGRGRGRGQRVGRGRGDGQRSGRGDGQRLGRGLGRGRGAGTFRGRGVPSQRPLGVNTRSSSYAIAKSFNKTKDFAWTHDRFEDSMVAAGLPGIETGTKLYVSNLHYGVTKEDLQELFSEMGHLKDCIVHYDNNRHPT

SEQ ID NO: 162698 - protein, 107 aa, Triticum aestivum
  Clone ID: PAT_TA_57116.pep
MAEVKPEEMVHHPPMDQLQGFEYCIDSNPSWGEAIGLGFQHYILSLGTAVMIPTMLVPLMGGNDHDKAKVVQTLLFVTGIKTLLQTLFGTRLPTVIGGSYAYVVPVL

SEQ ID NO: 162699 - protein, 161 aa, Triticum aestivum
  Clone ID: PAT_TA_57117.pep
MADDDQQWKIPPNVQELAAAGPEEPPSRYVVRDHDRPALAGAGSDVTDPIPVVDLGRLSSGDADEAAKLRSALQTWGLFLAVGHGIEPALLGEMMAVTREFFNLPLEEKQRYTNLVGDKKEYRIEGYGGDMVLSETQVLDWCDRFYLVVDPESRRLHDLWP

SEQ ID NO: 162700 - protein, 193 aa, Triticum aestivum
  unsure (1)..(193): unsure at all Xaa locations
  Clone ID: PAT_TA_57118.pep
HPPTTSSPAPRRPTTRSPAPPHHPSPAPPNHPPARRPRRRRQPPWRPTPSPPAPFPNTSFLSCPPPHPPSHLPPPAKDRQQPPDPXDPAPPPLISPSSEFPPPHGSRSPAPPXPPMRRPLLPPSSSPDPAEXGPQQPPPPPRSVRRAPEVPSHGRFHGVDPESHRPQDTVASGPVDSSKIRRVFHRIQTLPLP

SEQ ID NO: 162701 - protein, 117 aa, Triticum aestivum
  Clone ID: PAT_TA_57119.pep
QKIVVIVDHPSAQAQDIVCYPILDASIAFTNSLSIGGCITGVVLLTIQVAFVVAELPRRSHPGSPPTIVEENSCVGALGSHERCCHCSISIAPPTCCSALEHITEASQAYYWLWLWL

SEQ ID NO: 162702 - protein, 194 aa, Triticum aestivum
  unsure (1)..(194): unsure at all Xaa locations
  Clone ID: PAT_TA_57120.pep
HASARSRAAARDLEPKEFEKRGVKLLGISCDDVQSHKEWTKDIEAYKAGSKVTYPIMADPDRSAIKQLNMVDPDEKDAEGQLPSRTLHIVGPDKKVKLSFLYPSCTGRNMDEVVRAVDSLLTAAKHKVATPANWKPGECVVIAPGVSDDEAKKMFPQGFETADLPSKXGYXRFTRSRRASVLARRRLLRYSWRS

SEQ ID NO: 162703 - protein, 172 aa, Triticum aestivum
  unsure (1)..(172): unsure at all Xaa locations
  Clone ID: PAT_TA_57121.pep
CSSSFLPCPCADRPPHPTHAPLPTGHPTLLTRRCRRPPAPPYPRAAAVDRPPLPTLALPPPAARPSLSTRCCRQPPAPPYPRVVANLPFLPRAVVMLPRPSPSSTAQPASFFRAAGNLPPPRSRPPSHAPPPPGHPASRRRPAIPRPAAARPSRXPPPPEPPAGYAPRHFSA

SEQ ID NO: 162704 - protein, 66 aa, Triticum aestivum
  Clone ID: PAT_TA_57122.pep
PMFLSTNDLIPFSTPRHTDQHVYVPQLVGGTKWEVALKLWKCKGGRKSALLHCCPVSPYCCRLTFV

SEQ ID NO: 162705 - protein, 144 aa, Triticum aestivum
  Clone ID: PAT_TA_57123.pep
TPGFGTPLLLPIFFFLGPIPFFFGGRFFKPGGWENPWGPPFFLFGERPFFWGGALRGGGRAVTLFKTVSLAIGVGAPPFAGFFSFLGGWVSFPGGLLLGAVFLAGLFFCFPLFFPPKGGFSPGIFYWGVSFWGGFLAFWAAPPQ

SEQ ID NO: 162706 - protein, 198 aa, Triticum aestivum
  unsure (1)..(198): unsure at all Xaa locations
  Clone ID: PAT_TA_57124.pep
MEKGKSISRTSARSPLHKGFSRSPDMPPRKTXSRSPQRNAHRNFSRSPVGSSRRSLTPVRGGRSRRNASRSPSPPRRAVSPLNHGRSPSRSVSPDGSKRIRRGRGFTQRYSFARQYRSPSVDRSHRYGGRGDRDRYISHRGSRYRSPPRRYRSPPRRASPRSSRYRRRSRSVSRSPPAYRDRTRGGGYSRSSVRSRSP

SEQ ID NO: 162707 - protein, 127 aa, Triticum aestivum
  Clone ID: PAT_TA_57125.pep
WWQGFSNKKKEESLKRMGRTCVYVHHVDKEAFLKGNVETDPDELDMVFESSPSYAELLKQVRKDLNWMDPSDVVEFEGRHNVGLGMHIRWKTMRVNSEQRWVAYKETVESTLTRLLSYLPPRRLSLL

SEQ ID NO: 162708 - protein, 104 aa, Triticum aestivum
  Clone ID: PAT_TA_57126.pep
IQSSGIALRLFKWQRKSIKWRQKSWFGGSSTLAGLHNSQDWQGYDLARQIKRIIRVRPTKLGVDKYSGKKCETIAKRFAGSSSLSEGDVYGQGQNGHFRYVKTL

SEQ ID NO: 162709 - protein, 63 aa, Triticum aestivum
  Clone ID: PAT_TA_57127.pep
SEGRAVCTSVFFSVCLSVLGKDRLSNKQSKTSDVCGCMNDYVLKLMYLCLCVVLMLRKECRSW

SEQ ID NO: 162710 - protein, 123 aa, Triticum aestivum
  Clone ID: PAT_TA_57128.pep
QLLSTKLRRIKQSQTETTDNLFRTALDWCPASGDIQRALQRGVRRPVGSRRIRRPAESPRRRGRRAPRQAQPGSPRGPVPRAGSGARLMTASGGEAALGEGAATARRRGGGAGLGGGVWRPAA

SEQ ID NO: 162711 - protein, 164 aa, Triticum aestivum
  Clone ID: PAT_TA_57129.pep
INSMFDETKVATNALVPGTSRIKRVHGNIKGVRVTVIDTPGLVPHYHSQRRNRKILHAVKRFIKRNPPDIVLYFERLDHINSRCSDYPLLKLITDTLGSSIWFNTVLVMTHCSSSPPEGPDGHPLEYDAYTRYCKNVVERHIQLAASNTQLENPIVLVDNHPMC

SEQ ID NO: 162712 - protein, 134 aa, Triticum aestivum
  Clone ID: PAT_TA_57130.pep
MGSMAAEMTAVEEEACIYAMQLSSTAVLPLTLKNAIELGMLEVLMGAGGKMLSPSEVAARLPPTTTNPDAPAMVDRMLHLLASYKVVSCEVEEGTHARRYGPTPVCKWFTPNQDGISMAPLLLLTNDKVPMESL

SEQ ID NO: 162713 - protein, 114 aa, Triticum aestivum
  Clone ID: PAT_TA_57131.pep
FSCTNMCFYLHRHYIHSMFLVWAVLLHIFCKTNPLYLFAHIQAEVGFATGSSCTEWCLFTQTSDYYCYSLQLWRRPVEYPEAKGKGKGQKGGSGARSEHTLDDADCSEGFWVWG

SEQ ID NO: 162714 - protein, 47 aa, Triticum aestivum
  Clone ID: PAT_TA_57132.pep
NEFRCHYRKGRSVACIASVTFVFFYIFFSFFFFFFFFFFFFFFFFFF

SEQ ID NO: 162715 - protein, 97 aa, Triticum aestivum
  Clone ID: PAT_TA_57133.pep
IVNYYPPCPDPTVTVTLGFFPHCDPHLLTMLSQSQGDRRWLIVPQYPIHLSSTWAPDGVIESNGVLSEGRAQHHVVTNSIAARLLVAPSSCPRWSAA

SEQ ID NO: 162716 - protein, 67 aa, Triticum aestivum
  Clone ID: PAT_TA_57134.pep
VEIVVGSKKKKKKKKKKKKKKKKKKKKKKKKKKKKKKKKKKKKKKKKKKKKKKKKKKKKKGGGKFKE

SEQ ID NO: 162717 - protein, 135 aa, Triticum aestivum
  Clone ID: PAT_TA_57135.pep
PRVRSILPFSMYCTVEVSTKDTLPRVFRNFVDCVCSPNASGDPLLQHLKEASCNTAQRPQDCPSGTRHLDLGRATSSVLSLSSWSMLPFFEVCVVGVYGKGALPGVFRNFKDCICSPDASGDPLLQRVKEASCTA

SEQ ID NO: 162718 - protein, 56 aa, Triticum aestivum
  Clone ID: PAT_TA_57136.pep
VSLSDLFPLDLPAWVVYCPFTEYQCLPAGELVRCKLYALSILWTYPSGQLWIRSHA

SEQ ID NO: 162719 - protein, 62 aa, Triticum aestivum
  Clone ID: PAT_TA_57137.pep
LATTKRGGGKRREKSLGGFPSVGVLLACCLFSKQACRQRCLGVFACSPLFFSGSFSGGLVFQ

SEQ ID NO: 162720 - protein, 148 aa, Triticum aestivum
  Clone ID: PAT_TA_57138.pep
WSHWPSRRCSPCTRPSCFRWRPPPGRSCRRRCPWRRRTCGRPRWPGTWRPPACSPGCRRRRSGARRRHRRPVRRARGPRGRARSRPPRVARPSPPASPARPARARSRPPRGERRPRPSPRAGLASTTWSRAVVELLWNLLARASAVVL

SEQ ID NO: 162721 - protein, 94 aa, Triticum aestivum
  Clone ID: PAT_TA_57139.pep
SGSHIFKMWRLDLCSNKAMTFNFVVNLTAVLIVPIDRLIRANLVSCELEHPIFHDYIKSFLFFMIILRTHRSPSQPHLTCTSSRFKRALLLHPS

SEQ ID NO: 162722 - protein, 125 aa, Triticum aestivum
  Clone ID: PAT_TA_57140.pep
EKRREGRGRRRGRSTGRTLRTLWQCMTPRLDFGGDVEHGGVVVDSGRPSTKQWPIPQTDGENHSKTVLPPSLHYSKSASPTGLLGNHSRELSYCSFSGKVHYARSSRRVLAGGRVKCAGGYGGVV

SEQ ID NO: 162723 - protein, 242 aa, Triticum aestivum
  unsure (1)..(242): unsure at all Xaa locations
  Clone ID: PAT_TA_57141.pep
QMRAIAKLRHGNILRLRGFYWGPDEMLLIHDLAANGSLANASVKRKPGTPPMNLGWSARLRIARGVARGLAYLHDKKCVHGNVRPSNILLDADMEPLLADLGIHRLVRGAGDSRLKPAGRFGSKRSAKSLPDLSPPPPGAGGASPLAGAGPSSSAEAAAHYQAPEAAKNPTKPSAKWDVYSFGMVLLELVAGRALTSVELCQWAAXEGEGQXAFLLADAALRXEMEGKGEXLASCLRLGVRV

SEQ ID NO: 162724 - protein, 125 aa, Triticum aestivum
  Clone ID: PAT_TA_57142.pep
SWRPRSPSNCCDSMTIKTDTAPNHVVLPDCQDHLGFRKYRYARRHWMHQVSLPSPKLETKYPYSSSRTANHKTVLDIVKYHDDPRRVRFRQVLLPWHEPLLSRCRVYPYCHPEDVGVMKYLSERT

SEQ ID NO: 162725 - protein, 113 aa, Triticum aestivum
  unsure (1)..(113): unsure at all Xaa locations
  Clone ID: PAT_TA_57143.pep
AYLALKSSTSVLFQQNGHSPDQVXSTMEKVRAAGVDVITFGQYMRPSKRHMPVSEYITPEAFENYRALGVEMGFRYVASGPMVRSSYKAGEFYIKAMIEDDRAKSGAVAESSC

SEQ ID NO: 162726 - protein, 155 aa, Triticum aestivum
  unsure (1)..(155): unsure at all Xaa locations
  Clone ID: PAT_TA_57144.pep
ERHGYVTRFVTSAELALVFNMKNTKKNXHNVKIEVRHEGSEVYQGFLATYDVDYNYSVVKVKTFLDVNVGLIEHAVGILPDGKVVALGRGTCGELMARSVMLADDLSVCEDIKDPVSSMLNITKVQLHYDMSILICFCCALNCIFEGNRKMHFPI

SEQ ID NO: 162727 - protein, 138 aa, Triticum aestivum
  Clone ID: PAT_TA_57145.pep
MADRGGYVQVQHGQYGGQQHGRQMGEQMKGMLQEKAPSASQALTVATLFPLGGLLSGLALAGTVVGLAVATPVFLLFSPVLVPAALTIGLAVTGFLTSGALGLGGLSSLTVLANTARQAFQRTPDYVEEARQRMADAA

SEQ ID NO: 162728 - protein, 208 aa, Triticum aestivum
  unsure (1)..(208): unsure at all Xaa locations
  Clone ID: PAT_TA_57146.pep
IEFEVDGPYKAMILPASKEEGILIKKRYAVFNEDGTLAELKGFEIKRRGELKLIKVFQAEVFDKFLHGSTLEECYAAVASVANRWLDLLDNQGIDISDSELLGFISESSTMSKSLVDYGEQKSCAVTTAKRLAEFLGDSMVKDKGLHCQYIVAREPQGTPVSERAVPVAIFETDAEVAKFYLRKWCXVSTEANIRFILDWSYYKQRLS

SEQ ID NO: 162729 - protein, 118 aa, Triticum aestivum
  Clone ID: PAT_TA_57147.pep
MGYLQEARENHVKKKVEEALRSKMKQKALKECDVLCSKYAECARGRTFSVVWTCRKQAKELNNCLHQFTNDAILEDMKKAYMAEEESKEKNNNLYASMPVCTLLLLEFGSCLLVILVD

SEQ ID NO: 162730 - protein, 206 aa, Triticum aestivum
  Clone ID: PAT_TA_57148.pep
MVGWLKALVYGAGGMAVVGLAALVALQERLVYVPVLPGLPRAYPIKPSRLRLIYEDVWLRAADGVRLHSWFLRHSPTCRGPTILFFQENAGNIAHRLECVRLMMQRLQCNVFMLSYRGYGESEGYPSQSGITKDAQAALDHLVERKDIDTSRIVIFGRSLGGAVGAVLAKNNPDKVSALILENTFTSILDMAGIMLPFLRWFIGGS

SEQ ID NO: 162731 - protein, 61 aa, Triticum aestivum
  Clone ID: PAT_TA_57149.pep
IHGKMKKKGAFFLQINEGKDLTTGWIRCLRRPHHHLRLSAYCIRCRSRYTLLESLLIGSQR

SEQ ID NO: 162732 - protein, 205 aa, Triticum aestivum
  unsure (1)..(205): unsure at all Xaa locations
  Clone ID: PAT_TA_57150.pep
ERVKGTVKWLTSXQGFGFISPDDGGEDLFVHQSSIKSDGYRSLNENDAVEFEIITGDDGRTKANDVTAPGGGALSGGSRPVEGGGDRGGRGGYGGGGGGYGGGGGGYGGGGGGYGGGGGGYGGGGGGGRGCYKCGEEGHISRDCPQGGGGGYGGGGYGGGGGGGGGRECYKCGEEGHIXRDCPQGGGGGGGYGGGGGRGGGGRGG

SEQ ID NO: 162733 - protein, 226 aa, Triticum aestivum
  Clone ID: PAT_TA_57151.pep
LIFHFLSSDANICAVLQTLIDENVADYVFEVLRLSGNNDPLVISSIQVLSLLATSEEMFKEKLAIGFSTLLPVLHYVTEIPFHPVQSQVLRLVWTCIANCSGILSLSQEEQIACTLTLILRRNDSGELGMCSETFALVCSILIEIMRSPSAHDIQKLPLLIEEASKHAISSTLPHAYDSAFLVPHSLCLLKEALIFCLEGNTDKISVKKDLEDSVIEICGTYLLHW

SEQ ID NO: 162734 - protein, 125 aa, Triticum aestivum
  unsure (1)..(125): unsure at all Xaa locations
  Clone ID: PAT_TA_57152.pep
QRGDGKTPGVPQLNRFEKNPLFPSGGNSKKARPDPLSKNLPTLKGKGNPPCTGPLTAGGGGVPPRGTVTFARALAPVLLVFFLSFSPTFAGFPRKVLNXGAPLRVPIKGLRAPGPKKICLGGGST

SEQ ID NO: 162735 - protein, 208 aa, Triticum aestivum
  unsure (1)..(208): unsure at all Xaa locations
  Clone ID: PAT_TA_57153.pep
LAPLCALEKIDSLSLSSAASVGLAVVFVAVSCMIAAVKLVEGKLAAPRMGPDFSSKAAILDLLVVIPIMTNAYICHFNVQPIYNELKEKTPQNMYNISRISTVLCVVVYALTAISGYLLFGDDTESDVLTNFDKDLGIKFSTVLNYIVRIGYIVHLVLVFPVVHFSLRQTVDSLVFGELAPHSRKRMLSLTXVLLALMYLESTMIPNM

SEQ ID NO: 162736 - protein, 48 aa, Triticum aestivum
  unsure (1)..(48): unsure at all Xaa locations
  Clone ID: PAT_TA_57154.pep
VRRSRINCKSSITHIKPRQFHKDSSPVTSPQPPTLKHQHSIKKYLXNI

SEQ ID NO: 162737 - protein, 159 aa, Triticum aestivum
  Clone ID: PAT_TA_57155.pep
EQATPPAAAGIDLSPAATDLGRVHLLPCGIRHNSAAAVSDYFKPRDTGVEVDGVKVEEAFFRGRNLQGATVALPDGYRGSVLEKKKNEEKDAQGMDEEASNFVSRAEFQNITYWNHDTMPSAEDPLPRCFHWLAIANAMHKPVTAEDMANMSARQNQNS

SEQ ID NO: 162738 - protein, 109 aa, Triticum aestivum
  Clone ID: PAT_TA_57156.pep
KKKKKKKKKKKKKKKKKKKKKKKKKKKKKKKKKKKKKKKKKKKKKKKKKKGGPFLGAPFFPPRPAGVIFFFWGPQIKFPGPGFTPVGRGKPRGSPILSPWNHSPFSPVG

SEQ ID NO: 162739 - protein, 90 aa, Triticum aestivum
  Clone ID: PAT_TA_57157.pep
LTRALLKDCSAAMRIEEASSVSMGSSSSVSDSSCDKEGFQCEKEIEVYVQTKKLCKATDSDDTTSIYLSSYTSSEGQGEPKEISYSAKKS

SEQ ID NO: 162740 - protein, 132 aa, Triticum aestivum
  Clone ID: PAT_TA_57158.pep
PQPPPSCSPLLSFPNHSTTSSEDGGSTDQGSNSSATIQTSPYPSGGAVQSHRAGRIKASGGVAPRWLRSCAQSLSVPSRQGMRRAPSSPRGPFPPHTPSSTLSSPSTSTGCEPHAPPGPSLPSTTFDFFRLP

SEQ ID NO: 162741 - protein, 37 aa, Triticum aestivum
  Clone ID: PAT_TA_57159.pep
NFLPFFFFFFFFFFFFFFFFFFFFFFFFFFFFFYFFY

SEQ ID NO: 162742 - protein, 224 aa, Triticum aestivum
  Clone ID: PAT_TA_57160.pep
ASSHSPSSASSATRLSRRHSTLVNITRGSMTALRYATRSTRIYIVVEGRDGYFEMACPHVSSFGRSERREHEQEREREHGHGRRSEEREREHGQGRRSEERKDEQGRQEEEQGRGQEQEKSRGYRQVRAQIKVGSVIVLPAGHPATFVAGNEGNLALLSFGVGANNDEEVFVTGGNSVLKQLDDAAKALAFPQQARELADRVIRAQPESVFVAGPQQQRRVADM

SEQ ID NO: 162743 - protein, 126 aa, Triticum aestivum
  Clone ID: PAT_TA_57161.pep
ETVKGGVQFPIKGGEFLERGNGRGLFLLTQTGKRGFSLKGLNLGKTGVFPALRFKTPAREIKFGCPKKKFSNCKDGAVKLGSLKGPPLFFFFFFFFFFFFFFFFFFFFFFFFFFFFFFFFFFFFFF

SEQ ID NO: 162744 - protein, 159 aa, Triticum aestivum
  unsure (1)..(159): unsure at all Xaa locations
  Clone ID: PAT_TA_57162.pep
SAGVVPFSXFPFLRGSVPWAXCXGRACGGXRXAARPAFCGARXPSALLVSPPLVVGGXCPAPGSRALXALFVRGXSXFALRCSVLGXPPPPAGVPGFLVPXFXRXVVCAFXRLLGFPGSFPSLXLAWRRFSFSLGWLVLSPRAPAXVXFAKGVPGXRGS

SEQ ID NO: 162745 - protein, 77 aa, Triticum aestivum
  Clone ID: PAT_TA_57163.pep
KKYKKKKKKKKKKKKKKKKKKKKKKKKKKKKKKKKKKKKKNKKKQKIKKKKKRGGPFLRFLIFLAGGAPFFFFFCGP

SEQ ID NO: 162746 - protein, 61 aa, Triticum aestivum
  Clone ID: PAT_TA_57164.pep
HSFRALKVASYLELAGESRQTVKRKKRKKPKVARCRALPTVSVSLRVTTTLMALNRPLHGA

SEQ ID NO: 162747 - protein, 184 aa, Triticum aestivum
  unsure (1)..(184): unsure at all Xaa locations
  Clone ID: PAT_TA_57165.pep
APAGQTVPHRRGQRVWQSVKRQRCPLWLAASRACATDDGNSTGTRPSADLAPVRPTALMSSSPWPSPPSSXRSSRPPVMTEVELSRSGDSPNPSVQVVPCRVGDVVALLGKTRASAVAGRYVIARHEQEPGEDGSERGCCSRVVHRVEALLRGRAYRRRGVCRNLANSDYHAGCRFPLRPACRG

SEQ ID NO: 162748 - protein, 138 aa, Triticum aestivum
  Clone ID: PAT_TA_57166.pep
PSPPPISRRSSHRTSSSPQPPRRAAPAGRFLPRLDAVSRGRHDLHGDRHVLPHGRAAARVAVAEGWDRRGRRDDPPRLRLRPHPGERHPPQAVSFCPPPPFVPGFCKFMSFLGFGDKLPWEIEHIQTQVLRALGLGFA

SEQ ID NO: 162749 - protein, 92 aa, Triticum aestivum
  Clone ID: PAT_TA_57167.pep
GLANTKSKWRGLPIPLCWEEPCRFPGLVGLAITTLFAGCLENGTPPSGDLYAPWTCCLRAGCAPFLRALIAPLVWVFSLAFLPFSPALPAKL

SEQ ID NO: 162750 - protein, 77 aa, Triticum aestivum
  Clone ID: PAT_TA_57168.pep
RALGLCPVDRSSCMYAPRKGMIRLHAWEASLFIIQCGQVLVKPVGLVLVVYSEVYKNLMQRTLNKLGSLIVLTLTAV

SEQ ID NO: 162751 - protein, 56 aa, Triticum aestivum
  Clone ID: PAT_TA_57169.pep
TNSCCCVVKKKKKKKKKKKKKKKKKKKKKKKKKKKKKKKKKKKKKKKKKKKRGGPF

SEQ ID NO: 162752 - protein, 99 aa, Triticum aestivum
  unsure (1)..(99): unsure at all Xaa locations
  Clone ID: PAT_TA_57170.pep
ALARSFKCTQANPIFSRITSHTHPRFGIGLSSSIKGKAANLLPLPSPRSDFSSRTSDLPHRLLHQSPALTQRSDRRPLFPSHGDCLPLRRXSSPGSTAP

SEQ ID NO: 162753 - protein, 78 aa, Triticum aestivum
  Clone ID: PAT_TA_57171.pep
QFLRIITFYSTQLPGPNYHCREGSKLATLPPPKNVLEVLLINFPRGVLFGCGDLIFSSHMIFTLVFVRTYHKYGSKRY

SEQ ID NO: 162754 - protein, 169 aa, Triticum aestivum
  Clone ID: PAT_TA_57172.pep
DTSFSELTKTASGSTIFQKSSLKAIRKPFMPMQRKRLKACNCPAEMIKSSYRDACFRRPKKHAGETDSSGEEEKENTRDSCGSVLSEVTSAPTARDQLKYNLIVCKQMVGIFVTVWVKKELVQHIGHLRTSCIGRGILGCLGNKGCISVSMTVHQTSFCFICSHLASGQ

SEQ ID NO: 162755 - protein, 148 aa, Triticum aestivum
  unsure (1)..(148): unsure at all Xaa locations
  Clone ID: PAT_TA_57173.pep
TPHSRSILSVLTFLPYATIPPRKGGCLAAAATADAAPAASAASAAAGARCSPTMRPPPAPTPWSCPPPTTRGAPAGSRRPAERPAAATAPPASAARPAAAPAASATEPAPRTPAXRGQHEDEEDNWTSNHXPPPPPSLAAVCARPRAR

SEQ ID NO: 162756 - protein, 162 aa, Triticum aestivum
  Clone ID: PAT_TA_57174.pep
MSPRNTGDHVPAWISAVRAAMVDAKRRSSTRVSGEGVGSPRDGATYAFSGVGRLRSGRARGARAAGATSTSSVFTTGGCASTRAAADGETNSDTGHSSAERSARDPRWRVSGTGDTVRSRGAGMYQSALGPPSSHAMRGTANADGGGSSSSGSAVTLEAEAF

SEQ ID NO: 162757 - protein, 199 aa, Triticum aestivum
  Clone ID: PAT_TA_57175.pep
KKFKKKKKKKKKKKKKKKKKKKKKKKKKKKKKKKKKKKKKKKGGPLFKEPRFPSPGFQRFTFFLGAPNFIFWAAFLQRGAGKTPGVPQLNPLGTHPLFPGGLITKKPRPVPLSNHLPTLFGNGTPPFRGPLTPRGGGFPPRGPVTFARPLAPVLLVFFLSFLAIFPVFPRKVLNGGPLLGSQLRVLGPLAPKKLVWGDG

SEQ ID NO: 162758 - protein, 38 aa, Triticum aestivum
  Clone ID: PAT_TA_57176.pep
AYASLCRSCVTMRVASNRQTLKTLTCGSSRCTIRQTRG

SEQ ID NO: 162759 - protein, 233 aa, Triticum aestivum
  Clone ID: PAT_TA_57177.pep
AAVSASHDEEDDRRGGHSLQQCVQRCQQDRPRYSHARCVQECRDDQQQHGRHEQEEQGRGHGRHGEGERDEEHGDSRRPYVFGPRSFRSIIRSDHGFVKALRPFDEVSRLLRGIRNYRVAIMEVNPRAFVVPGLTDADGVGYVAQGEGVLTVIENGEKRSYTVREGDVIVAPAGSIMHLANTDGRRKLIIAKILHTISVPGMFQYFSAKPLLASLSKRVLRAALKTSDERLER

SEQ ID NO: 162760 - protein, 191 aa, Triticum aestivum
  unsure (1)..(191): unsure at all Xaa locations
  Clone ID: PAT_TA_57178.pep
MATSSSNSNPFSFALRGLRDRDGGNCGSYYSIPDLGDQRIDKLPYTIRVLLESAVRNCDEFQITKEDVEKIMGWEKTSLEQVEIPFKPSRVILQDFTGVPVLVDLASMRDAMSELGGNPDKINPMVPADLVIDHSVTANVVRSQNAIQANMELEFERNKERFAFLKWGSSAFHNMLIIPPXSGIXHQGNLE

SEQ ID NO: 162761 - protein, 160 aa, Triticum aestivum
  Clone ID: PAT_TA_57179.pep
KGPPGKTPQEKTEQKAKKEGKKTKEPAGKALPNLPPTLKGATATRGKKGAQKGGSHSPIWETTGREGQSGGGPKRENARQAKRGWKCKEKKKGNPQGFPKQLAKKRRPVKQKKSPEQNSKALESWAPQAGPPIFFFLFFFFFFFFFFFFFFFFFFFKIFA

SEQ ID NO: 162762 - protein, 125 aa, Triticum aestivum
  Clone ID: PAT_TA_57180.pep
TCPSRRPTRRAPLPWSPAPSPLRPPRRRRSSPWPSSGTPPPSFLPSPRFRPACHCRRASLSSGTWAVERRCQARPGRWDLPRRSWRGSRLPSRHERAAASSPTPQGRSHPLKSLAEMQKWLRARA

SEQ ID NO: 162763 - protein, 171 aa, Triticum aestivum
  unsure (1)..(171): unsure at all Xaa locations
  Clone ID: PAT_TA_57181.pep
MSEEDSTSRPAPKLNERILSSLSRRAVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHXLQEIKRFFEDYQKN

SEQ ID NO: 162764 - protein, 139 aa, Triticum aestivum
  Clone ID: PAT_TA_57182.pep
EWTKDIEAYKPGSKVTYPIMADPDRSAIKQLNMVDPDEKDGEGQLPSRTLHIVGPDKVVKLSFLYPSCTGRNMDEVVRAVDSLLTAAKHKVATPANWKPGECVVIAPGVSDDEAKKMFPQGFETADLPSKKGYLRFTKV

SEQ ID NO: 162765 - protein, 148 aa, Triticum aestivum
  Clone ID: PAT_TA_57183.pep
GMTGTHGTGHTGTGMTGTHGTGHTAGLGGTGTGITGTHGAGHTGIGMTGTHGTGHTAGLGGTGTGITGTHGTGHTAGYDATGTGITGTHGTGHTPGYGATGTGITGTHGAAGTHPHGGLPEHKTRGILHRSGGSCSSSVPRIPCFLLG

SEQ ID NO: 162766 - protein, 108 aa, Triticum aestivum
  unsure (1)..(108): unsure at all Xaa locations
  Clone ID: PAT_TA_57184.pep
GTLNACIAGFTILCFVLGLLISQPEIPLHVNVMFPKLSGESAYSLMALMGANIMSHNFYVHSSIVQVFHGRAHVHTLXALFHDHLFSILFTFTGVXLVNYVLLSSAAA

SEQ ID NO: 162767 - protein, 63 aa, Triticum aestivum
  Clone ID: PAT_TA_57185.pep
MAILCPCSCKKKKKKKKKKKKKKKKKKKKKKKKKKKKKKKKKKKKKKKKKKKKGGPFKKNKFN

SEQ ID NO: 162768 - protein, 189 aa, Triticum aestivum
  unsure (1)..(189): unsure at all Xaa locations
  Clone ID: PAT_TA_57186.pep
MAAAMPPSLPALLAALLLLVTLSPAAARVPGVYTGGDWQSAHATFYGGSDASGTMGGACGYGNLYSQGYGVNNAALSTALSTRGSAAGACFEIRCVNQPGWAWCLPGRPSIVVTATNFCPPNYALPSDDGGWCNPPRPHFDLAMPMFLHMAQYRAGIVPVSYRRVACRKSAGVRXTINGFRYFNLVLIT

SEQ ID NO: 162769 - protein, 103 aa, Triticum aestivum
  unsure (1)..(103): unsure at all Xaa locations
  Clone ID: PAT_TA_57187.pep
PSNPSRPRSLSPRRIGPVRGGYNKAXAQSAVTSLPSTARGCVRPPPNAGNGSGDRQKQQPLHSAQGRKPTSGTGPTEAQPLLSLPSALVTRRRRLGGGKNGSV

SEQ ID NO: 162770 - protein, 50 aa, Triticum aestivum
  Clone ID: PAT_TA_57188.pep
TQGRCLADLCEALHCDLTMEFKKPKSKCNAAAAARNRHLCEVLIILFELP

SEQ ID NO: 162771 - protein, 173 aa, Triticum aestivum
  Clone ID: PAT_TA_57189.pep
FQAERYVPYRTSQMITFFLTTVSSCRWHIIPLLNSMNVYLLIGYPSLHAFLLLQMNCNGTIDKNHNCRANHNNGRSQQSDNREHEQTTTINRKTLDPAANPNPSRNALVSGELEWSVLEHASMAGGEHKASAVGLHIHKTLCFCRIAIWKRVAKAYIFSKRMNSTSSSFFAVI

SEQ ID NO: 162772 - protein, 103 aa, Triticum aestivum
  Clone ID: PAT_TA_57190.pep
PRLITSPRMIEFRFSLIATCYYSSHARRYVSCGSCRQIRPFTFWVNCIILLACKSTWHIIIRSYVFSHVFVASCSFTQELRKASQVGACCARARSTEDGHTPM

SEQ ID NO: 162773 - protein, 62 aa, Triticum aestivum
  Clone ID: PAT_TA_57191.pep
LNILLSTKKVNLCISSCNLPIDSDTPFAYCVGWMLLFMNSTGWILSRKKSTGWFILYYTPTH

SEQ ID NO: 162774 - protein, 54 aa, Triticum aestivum
  Clone ID: PAT_TA_57192.pep
LQFATTIQSFVSMLLQNKNKLRHFLHPIITKHLSVSIPVNLYLNDMNTMEHLFL

SEQ ID NO: 162775 - protein, 68 aa, Triticum aestivum
  Clone ID: PAT_TA_57193.pep
IKHQATNKIDKLGINNSIMNIIARSPGVALSFYNLPSPLPDMDLVLRVWLHGFAILPLPLCSPSSSAF

SEQ ID NO: 162776 - protein, 226 aa, Triticum aestivum
  unsure (1)..(226): unsure at all Xaa locations
  Clone ID: PAT_TA_57194.pep
MENERVSQAHKHEEKHRDGHGDVARGYNGKIKSRKHRSERHESLESGCSDWPSEFADAGTSRSPSGSKSTNRYNDHKRNRRQSSDDPNLERGYSAADKSSGKAHIAKSSSRHYVEDDSCGEKGSGRGKSGKHSDHCDDPDDRWLATNSDVDSDAETQFPRSSSGVGKGGRNDNAPPDEDDCYRRSSSRSGRSRAKDDKSSRKKKKRHSEIRKNXDSDDHPSNLTTF

SEQ ID NO: 162777 - protein, 79 aa, Triticum aestivum
  Clone ID: PAT_TA_57195.pep
RDAPCTGAVRATRRVTTTIATALLASALAPVPFFFFTFFGFTREALNRGLLLGGLPIGLRYIDLKKLDQREGEQGEASP

SEQ ID NO: 162778 - protein, 109 aa, Triticum aestivum
  unsure (1)..(109): unsure at all Xaa locations
  Clone ID: PAT_TA_57196.pep
LAGMYQLLSACIVNTGRANGKKFPMELSAVLPLCSWLRHLTTTQVKEIAAGEALGVDQMHLQKTTXPLFSSLGAIPFKSLMRPVDPKVCYFSGHGNTSPFCSGARLCSD

SEQ ID NO: 162779 - protein, 87 aa, Triticum aestivum
  unsure (1)..(87): unsure at all Xaa locations
  Clone ID: PAT_TA_57197.pep
MAGPAKASWMVAMSVGAVEALKDQAGLCRWNYALRSTGQXKANVRGGVSQGSKQLPASASAVAERRRAEKAEEGLRTVMYLSCWGPN

SEQ ID NO: 162780 - protein, 106 aa, Triticum aestivum
  unsure (1)..(106): unsure at all Xaa locations
  Clone ID: PAT_TA_57198.pep
AWLLINAVMLVEARQLPSIYPMSGLRVLYEAHSPAARRVPRPPKDRSLCICLVSTMYVVTTEERDMFCWFSSSCGCTRRGEHSIYIYKTFYGISKLLAEFNSFCXX

SEQ ID NO: 162781 - protein, 67 aa, Triticum aestivum
  Clone ID: PAT_TA_57199.pep
VGPKKKKKIPCKGAERRVASKGRPPLFFFFFFFFFFFFFFFFFFFFFFFFFFFFFFFFFFFFFKFFF

SEQ ID NO: 162782 - protein, 95 aa, Triticum aestivum
  Clone ID: PAT_TA_57200.pep
KQCIDFKYPYIRFDSFEWPAPFFFFFFFFFFFFFFFFFFFFFFFFFFFFFFFFFFFNHHRVGVRIYQNVVLTRDISKCHHPGMNHHLTSTSTTPN

SEQ ID NO: 162783 - protein, 207 aa, Triticum aestivum
  Clone ID: PAT_TA_57201.pep
MSRYKIPKAKKDQTIPDFIEIEGFHTSLQNFHASLKPRADLDSEVMTLYLKTFNLEQMYNKKKPKKFAFSVFMGSQLGVDPDLFDHKSCEREFRRACENNQISRCDLLFITIVQNKHWAVVVVNLSHNQFNVFDSVKTIMDVSLLHKATNNVITNIKQVVTTESAFKIDLNGFEKVTQAYPKQSTHYNCGFHAILYLENLDGVVMKH

SEQ ID NO: 162784 - protein, 70 aa, Triticum aestivum
  Clone ID: PAT_TA_57202.pep
STFYWISGAAPHSTFNILASHSLLDPCSSGAGTVLSVPKDEPECSSNISSMVKEGHGFGNEDHKSFNQFD

SEQ ID NO: 162785 - protein, 142 aa, Triticum aestivum
  Clone ID: PAT_TA_57203.pep
LLLPPHPAAPPPSFPASRIALSLVGRFPQPVSLSRCILPEIRYGESHGGRGRCMRRRRPWSWWRDGGRGSPPAASLVPPFSLPPSPVSLPLPWPPPDSRSAAGRGAVAAVRAAACRGGEVKDGCQFMEERCNTTVQQRQSSR

SEQ ID NO: 162786 - protein, 155 aa, Triticum aestivum
  Clone ID: PAT_TA_57204.pep
VPEKKLYKKKKKKKKKKKKKKKKKKKKKKKRKKNYKKKKAKELETSKMKAAVLGTRSFFFFGAPCFNAWGLFFSCGFQTIPLWAPSLFGRGPVPLSPSRLFALPARSLGRFVKGGPPRGGSSFSGGGALSPCRPPSPPPLLLPLFLFSFPSFLSF

SEQ ID NO: 162787 - protein, 71 aa, Triticum aestivum
  Clone ID: PAT_TA_57205.pep
KKKKKKKKKKKKKKKKKKKKKKKKKKKKKKKKKKKKKKKKKKKKKKKGGAVLGVQVLVPGVGKVIVFFWGP

SEQ ID NO: 162788 - protein, 101 aa, Triticum aestivum
  Clone ID: PAT_TA_57206.pep
MEQSSKGGVVYIIFFGVQGKGWEYCITSGCRLPMDLIHGDQDEQYRQDPCKLHARRGTEAGHHGSLSQFFGINNQPSGTKDLCFSIARKTPNPAYCFYLNL

SEQ ID NO: 162789 - protein, 166 aa, Triticum aestivum
  unsure (1)..(166): unsure at all Xaa locations
  Clone ID: PAT_TA_57207.pep
MEADELLKKIRALEEGQAELKREVGRLMPDRRAAARRRALRALPPPPRPSSSSRRVAARGRLPDRHCHWILQSLGQAVHIIAPDGKLLYWNRYAEHMYGYSAAEAVGRNAVELIVHPTDFDAAKLXIQNIFMGKCWRGRFPVKNKAGERFFISGHHTPFXDDDGSL

SEQ ID NO: 162790 - protein, 51 aa, Triticum aestivum
  Clone ID: PAT_TA_57208.pep
PVRLFGSSKGRAVLAFSLVGQMGIWGYATKLVSCMVLAFSQSVTLWTVDQI

SEQ ID NO: 162791 - protein, 171 aa, Triticum aestivum
  Clone ID: PAT_TA_57209.pep
KKRPPPPGFFFGGPPPPGGRGGGNLPYWPGGPPPQIFFAPPRALPTPTPPQGPFLKGGGPHSNFLERAPAPQKGGGGPFKEGPPGFSPRAPLKEPNLPTRAWERKIFFLGPPNSIHGAGFYNGGGGKTPGVPQLKALEKNPLFPGGGKTKRPPPNPLPKNCPPLMGNGPPP

SEQ ID NO: 162792 - protein, 122 aa, Triticum aestivum
  unsure (1)..(122): unsure at all Xaa locations
  Clone ID: PAT_TA_57210.pep
GGASGWMGXEGAPPRRPGRGXGRSWRRRGEGERDVPGPRGIGDGLGILTPQSDLPFAQWPSCFLLPSQEHPSLLKLAPWLLCFFSHKSILPPLLRSLSHLVRILKFIVPSRTFLQNKPLSSK

SEQ ID NO: 162793 - protein, 206 aa, Triticum aestivum
  Clone ID: PAT_TA_57211.pep
AAPKLIITDEDQSMRRGIEAIFPNTKHRLCMWHILMKLPEKVGPILRNNEDFKPKFMVCVCGSETPDEFESRWSSIISEFGLEDNEWLKEKYDLRQSWIPAYFMEFSLGGILRTTSRSESENAFFRHFTNRKLALIEFWVRFETALEEQRQKELQEDNSTLHTLPILHTCWGIEAHAREVYTHNIFVAFQLEVVAARDRRHVKTIE

SEQ ID NO: 162794 - protein, 106 aa, Triticum aestivum
  Clone ID: PAT_TA_57212.pep
DRCRRCVEIGLASVPRIWCTWSTSSRSLRHHPRTGRRRLCVEVDVALIPSTRSGDELRASCLKLAVPPHAIALLFSATLHADERYRAPHHVSYHTDGDRGACSPLR

SEQ ID NO: 162795 - protein, 204 aa, Triticum aestivum
  unsure (1)..(204): unsure at all Xaa locations
  Clone ID: PAT_TA_57213.pep
VTCQLISSTLIDHDNGGRGKVGAEAELEQWVTSLPSLTTGESKFGLTFDWEVEKLGVPGAIIVNNHHSSEFLLKTVTLHDVPGRGNLSFVANSWIYPTSSYTYSRVFFANDTYLPSQMPAVLKPYRDDELRNLRGDDQQGPYQEHDRVYRYDVYNDLGEGRPVLGGSADHPYPRXGRTGRKPNANDPNLEKPLSLLEQIYVPRD

SEQ ID NO: 162796 - protein, 175 aa, Triticum aestivum
  Clone ID: PAT_TA_57214.pep
NGHLARGCRNQWRPLSSLACLAMPQVLGIVHRPAPASCEGPMKSTLPSKALRHGSWASVVSTSVGLATPPDVMLQSALADQTALLQICLARVGSLLERAEAALSSLSLAPALSQTTPMSRPPGVADVGSIEKGDQELYGCFSPHVGDSSSSLSASSPMLSTTEGESVVVLQAPVL

SEQ ID NO: 162797 - protein, 83 aa, Triticum aestivum
  unsure (1)..(83): unsure at all Xaa locations
  Clone ID: PAT_TA_57215.pep
FFIGGRFHQGPDPPLMVRSRCNLPGSERICHKRAERLHMDRVPGPCPCARIRKVWVVSSIRIELLVFWXSFLRPXPAWRNCPG

SEQ ID NO: 162798 - protein, 181 aa, Triticum aestivum
  unsure (1)..(181): unsure at all Xaa locations
  Clone ID: PAT_TA_57216.pep
MGVRGANAPAFGPPGWQGQTRPGTVRMPGMPGAMPPNALGQGMPSTPTMPYSPHAEAQVSTPSKIDPNQIPRPITETSVVIFETRQAGQAAVPPAASSEFIVKDTGNCSPRLMRCTMNQIPCTGDLLTTSGMPLAIMVQPFALPHPSEEAIQLVDFGEMGPIRCSRCXAYINPFMXFVDQG

SEQ ID NO: 162799 - protein, 227 aa, Triticum aestivum
  unsure (1)..(227): unsure at all Xaa locations
  Clone ID: PAT_TA_57217.pep
KCSWYSFDSLGEAYDFYNLYSWEKCFVIRYGKSRPNVEWVKCIQEIVCGCSGKAGVDXLRAEDNGRYIAEHRENHKHSLSPNFADKIHCPSHKHIDVYLRDLIKQLRQNNVNLGKVYSIIGGIFGSMENVPFTKRSLRNLCGQINRDQADDDVRKTVEVFADIGATDLHFTYWVQADTEGRIKNLIWATGTRRLQYXFFGDVITFDTTYRTNLYDMPFQLFAGVNII

SEQ ID NO: 162800 - protein, 127 aa, Triticum aestivum
  Clone ID: PAT_TA_57218.pep
ASNFYIYARLSSSHRSTIEPWSCGDSAVPATGVLFHAMAIQEECHGYRSSPHAILLDVDRVLAPAAAGAWYVQRGMALDWSIAVIDPLRGSHGVGWRRTQPRELQFTSSFLSCKPSKKENGLCYIYD

SEQ ID NO: 162801 - protein, 213 aa, Triticum aestivum
  unsure (1)..(213): unsure at all Xaa locations
  Clone ID: PAT_TA_57219.pep
SASTNKEMESQIPNYPNLPPQLICQLHNVTMHADAETDEVYAQMTLQPLSPQELKDPFLPAELGNASKQPTNYFCKTLTASDTSTHGGFSVPRRAAEKVFPPLDFTQQPPAQELVAKDLHGNEWKFRHIFRGQPKRHLLTTGWSVFISAKRLVAGDSVLFIWNDNNQLLLGIRRANRSQTVMPSSVLSSDSMHIGLLAAAAHAASTNSRXTIF

SEQ ID NO: 162802 - protein, 167 aa, Triticum aestivum
  unsure (1)..(167): unsure at all Xaa locations
  Clone ID: PAT_TA_57220.pep
MDPHDGEPAADELPPPPPLPPNVVPIIAEDAAAASESEPPPPPPPSKPAKPRRHIMARPPNGXGKEGQPIQLLANHYKVSVKPSEEFFNHYYVNLKYEDDTPVDSKGIGRKVLDKLQHTYHSELADKDXAYDGEKSLFTIGALPQINNEFIVVLEDIGSGKTAAGSP

SEQ ID NO: 162803 - protein, 199 aa, Triticum aestivum
  unsure (1)..(199): unsure at all Xaa locations
  Clone ID: PAT_TA_57221.pep
MQRRTAAPAASSNPPARSHQSHPDAAASLTNSAGELRLPNGDLYSGTLSGGVPEGTGRCVWSGSGCVYEGGWRRGMRHGIGRTEWPSGAVYEGEYSGGFMDGEGTHVAAGSSSSSSYKGQWKLDRKHGLGLQAHANGDVYQGAWVQGQMEGQGRYTWANGNNYVGTMRNGLMSGKGVLTWSTXDSFQGNWVGGVAHGYG

SEQ ID NO: 162804 - protein, 130 aa, Triticum aestivum
  unsure (1)..(130): unsure at all Xaa locations
  Clone ID: PAT_TA_57222.pep
MHAHMGESTEYRARRARLTVAVRYLDTNKDRTDTCDSXGHKYYWPNLICAATQAEAXILRDDASTGSFESGVDGEGGKSVGQTKEHAHLIRIYGGEQLIVAVNKMDAIGYSKDRLEFIKVRLGSFLRSCN

SEQ ID NO: 162805 - protein, 69 aa, Triticum aestivum
  Clone ID: PAT_TA_57223.pep
TFRLCFPSSRHMKLHTTVKLEALKQIAQKWLLNSAITETDSPVRLITKSPNQPAHVSFWCTSVTPAALS

SEQ ID NO: 162806 - protein, 34 aa, Triticum aestivum
  Clone ID: PAT_TA_57224.pep
EVTRREDYERMQQRFDWGEDSIYNQDAIELSAGR

SEQ ID NO: 162807 - protein, 206 aa, Triticum aestivum
  Clone ID: PAT_TA_57225.pep
HRSVQLPPPRRPLPPRVSTREQRGSGVSYAPPPPAVRRSPPSRSRNCRRGRVNIWPGGRRATSRSQSSEETKSGQLASLHQLPNSRRPNLLGRRRIFVAAMGKGKKVDRLSALPDDVLVNILDRLNVHEAARTSILSRRWTQLCAKLSRLIISALDFLPKGVSCTNISDDELVRINAAVFQATDSILARRNHGEHTIRLLSTRFYL

SEQ ID NO: 162808 - protein, 202 aa, Triticum aestivum
  Clone ID: PAT_TA_57226.pep
MPKGDDALARKRGKVRRKRMRSSENAVSTRVAAFFFSKRRRKTGKRRGCEGMCFSLPCPEDPFNERHGKKRKTEDAADTNDDHKKKSKGSKKQERATGPNAIHVRKKETGEDRLEYDRPSKFLVVCLNAIRDGAGASEEDGGGIHDTASWGMELWKSCAASPPSDVLDTSYQYATREQTAWLVSTACDIVARKEKLGVVVSC

SEQ ID NO: 162809 - protein, 141 aa, Triticum aestivum
  Clone ID: PAT_TA_57227.pep
VVHTFSRLPSNVHDSDIPCLLVLTGVCSPYCCAGGWRTSGRKGSRGWRLVLHGRARSRLAAGNVLLPCKFRTALKHPTHDVATLQVGYQPSMFRGETSIKFVWRNCAVQLLRAGHRAPLCPAHPTMCSTASRSTDLVAELH

SEQ ID NO: 162810 - protein, 226 aa, Triticum aestivum
  Clone ID: PAT_TA_57228.pep
ARRHWILTITNNLKVDEADEPHGDRRCNKVNVDEPNDDSNLKLVDLRVLKTATTTPLGIRPRRLLLRCFSGGRPAPATPRQQRRLSSGSSLLTWQQRRRLQIFSSLGHLRHQRLQPGVQSRATAARAGSRSSSTGSSVEQQQHGQGQWSSSSTGRVRGAAAARAETTGDRGEAAARVRGQGRRSSTGARAWEIDEVALEIEYHVRVLLVHRIVEAASGDAGRRSRQ

SEQ ID NO: 162811 - protein, 161 aa, Triticum aestivum
  Clone ID: PAT_TA_57229.pep
KPLSLEPPACVKDAGDKDEPEALNAFHLISLSEGFDLSPLFEGHPASRRLEGGMRFATREPARGVVSRLEEVAARGGGRMRVTKSSPGGVRLEGAERGGRKGRLAVAAEIFSVAPSVLVVDVKKDGGDTLEYLSFCCDELRPALQDIVWAADPPASVAIAV

SEQ ID NO: 162812 - protein, 74 aa, Triticum aestivum
  Clone ID: PAT_TA_57230.pep
CRLLEFELQREFYIKQSSALPFCKKFASTANSSAHIPSTNWPYALDILQQIHDGIGVASLQVSGCARRRKRCRP

SEQ ID NO: 162813 - protein, 124 aa, Triticum aestivum
  Clone ID: PAT_TA_57231.pep
LVISLPSSRVQKWVKNKSQKKKKKKKKKKKKKKKKKKKKKKKKKKKKKKKKKKKKKKKKKKKKKKKGGPFKRTKVNYPGKEKKKFFYGAPKIKLRGRGLKTGEGEKPGGTQIKWLGKKSPFRKW

SEQ ID NO: 162814 - protein, 135 aa, Triticum aestivum
  unsure (1)..(135): unsure at all Xaa locations
  Clone ID: PAT_TA_57232.pep
VAARPAAAAHRNAGCGAGSPPSGPDSMAALGGRSPIVVEATPGGARPSMPGMCGFSCGXPSDKNGRSSPPSXGXVGCRVSRAXPPVLPGWRLLXRXSWSFLPPLVVAAXPRRRXPLRGPRPPPPAXPPKLFGRWV

SEQ ID NO: 162815 - protein, 194 aa, Triticum aestivum
  Clone ID: PAT_TA_57233.pep
MVKGRFLGACLLLLAAALADGEGEEGKRGVPLLDAGRLEKFVDELPDMPVLRGYGVAEGGRLVAGELAVGMYDTMWKFHRDLPATRVFAYGASRETATVPGPTIVAMKGVPTRVTWTNHLPPHHILPWDRSLAAARVGNAAGIPTVAHLHGGVQQSTSDGHSMAWVTSGFATTGPHFSSPAYEYPNQQLPGNLW

SEQ ID NO: 162816 - protein, 116 aa, Triticum aestivum
  Clone ID: PAT_TA_57234.pep
CSILGMAMIQLVQSSNAGLVFLSISAISSLTSYPDYKNHTRARDNDQYPSAVMQRMKEMTPSGWLQSGNLVRTTPSGRRGRRHMASQAGALGLPWPAEASAVVRAPTWQPRPHHTL

SEQ ID NO: 162817 - protein, 69 aa, Triticum aestivum
  Clone ID: PAT_TA_57235.pep
FQFLALRPPFFFFYFFRFFFFFFFFFFFFFFFFFFFFFFFFLSQDCVANSTSSIIKHLYVVNYATTCVS

SEQ ID NO: 162818 - protein, 134 aa, Triticum aestivum
  unsure (1)..(134): unsure at all Xaa locations
  Clone ID: PAT_TA_57236.pep
VLAPEIPMSTDPXDKERXTCKPSNTLYAPDPPPLSPSSPNGLSRSEWLHLRSSMPSPPTWQPMQSPLIARRGSPCSETNYKSRKACELLRIALCHLNKNLRQRLGNLHRRYTLRLRIMGFPPSGFVWHRWFSSP

SEQ ID NO: 162819 - protein, 93 aa, Triticum aestivum
  Clone ID: PAT_TA_57237.pep
VVRPLPLIWVSLSMCYGLEEKCTCPPPLLIWRCRSRGPGPGPAAVAVGVGGGVPMLLCQLSRPGSGSLPCVPFRRSRVPPLRAGVTPSPDAGS

SEQ ID NO: 162820 - protein, 256 aa, Triticum aestivum
  unsure (1)..(256): unsure at all Xaa locations
  Clone ID: PAT_TA_57238.pep
SKLGFDCWKKHHAQIYHPFGHMHKFGHDVFSKLGFDCWKNAVAAFRKHVGGPCSIHNISKTACDDFKNQRASVKSKVTTYSKGSLVKYETRVDTSLAIVSYLALQGEPFRGHDESSSSLNKGNFLELLDWVKERIPEVKVAFDELCPKNAQMTSGKIQKILISHCANAVTKAIKEEMGDCLFSVLIDECRDISVKEQMVVVIRYLSKQGETIERFLGIKHVPETTSASLKXALLGSFCTRSGLLRDYRGKGMMGDL

SEQ ID NO: 162821 - protein, 154 aa, Triticum aestivum
  unsure (1)..(154): unsure at all Xaa locations
  Clone ID: PAT_TA_57239.pep
ILQRHTPTKKXSNRTPISWXGRKNGNGSAGADLVVASEGDLLLVEDGDVEVKYAALRHAAATAPSAYKIIYNWGFSCCMLQTDRGFSRQSKVTNQLSAIDGRYPLMFFSHASCQTSNHTQNIPAHREKRWWQISHPLTGRTGGHGTCVLGAPHQ

SEQ ID NO: 162822 - protein, 226 aa, Triticum aestivum
  unsure (1)..(226): unsure at all Xaa locations
  Clone ID: PAT_TA_57240.pep
MARGAPMLAAVVIAAVALGSVGAREQEAAGGGGDDLRQPTLAQGLSFDFYRQLCPRAESIVRDFVLDAVRKDIGLAAGLLRLHFHDCFVQGCDASVLLDGSATGPGEQQAPPNLTLRPSAFKAVNDIRDRLERECRGAVVSCSDILALAARDSVVASGGPEYRVPLGRRDSPRFATAQDVLSGLPPPSSNVPSLLDVLRKIGLDAXDLVGLSXGHTVGLGHCTSFD

SEQ ID NO: 162823 - protein, 95 aa, Triticum aestivum
  unsure (1)..(95): unsure at all Xaa locations
  Clone ID: PAT_TA_57241.pep
RMAIVDGRRVVPKRLLPXREAFKGTFMANGGYDREEGGKVVADGYTDLVSFGRSFLANPDLPKRFEIGAELNKYDRMTFYISDPVIGYTDYPFLD

SEQ ID NO: 162824 - protein, 181 aa, Triticum aestivum
  unsure (1)..(181): unsure at all Xaa locations
  Clone ID: PAT_TA_57242.pep
MDPWGTSDPYVVLQLNGQTAKSQIKWGTKEPTWNQDFTFNIRTSLENLLQVEAWDANLITPHKRMGNAGLYLETLCDGNKHDITVELEGLGADGGGTIDLEVKYKSYDDIERDKQWWRTPFVSDFLEKSSLGSALRTVLGSETVNASQFVQSAFXQLSSLTDTNLLKPSSSDSEAEISERP

SEQ ID NO: 162825 - protein, 204 aa, Triticum aestivum
  Clone ID: PAT_TA_57243.pep
LQGDVPATEGQNSPLKPRAQHNSGRAQHHESQTGQFRRAAKAILLEANQPIPRRFLASNPNLTPIKNPHPDSAIARDARSGKKNINLSKRGESNRGERREGRGLRTRGSCRRGTRRRRGRGRTSRRGRARASRSRTAAGSPPSLRPPAARALVPSLLRRVAGWIRGATNVTRFRFPGGGGLGSGCLGGDASRSGRLGFGWFGFV

SEQ ID NO: 162826 - protein, 91 aa, Triticum aestivum
  Clone ID: PAT_TA_57244.pep
VNSIFNSVLKSRMCRHDVIKEEMISSNSNCIKKTFGGIYSSMSTMHLIKGKSITLMAETFNKICATTVHMKKITFTKNVSSLLGKESAGIL

SEQ ID NO: 162827 - protein, 96 aa, Triticum aestivum
  Clone ID: PAT_TA_57245.pep
APVLFHPQGATAEHHYHSQSQLHRLCASSSTRTTSASWIPAEDLRPLPRGLPSTPHTSCLQWRGMREPVCVMLLSPLHRHGVTTTRLLSPIFTPHT

SEQ ID NO: 162828 - protein, 201 aa, Triticum aestivum
  unsure (1)..(201): unsure at all Xaa locations
  Clone ID: PAT_TA_57246.pep
MGPPTNTYLPHNQFPEQSGLSEVKSEDTGAIFDNTGQEGNQFIPMNTFSFDHNAAIPDISYTELNIGEATGSMNNGNGSCLTVQGDYLQGEFGECPKAEYGSLDMAGEMPMHDLPHNNQSYEMEQIPQNICESSSMQTGSPDQYCDDTSLSGYYMSSXESLSCEQIQSEYIGFKSESSTDSSPIPSSRNSTTEDADKYLRG

SEQ ID NO: 162829 - protein, 54 aa, Triticum aestivum
  Clone ID: PAT_TA_57247.pep
HCSKRRKSRVRRMTRVPAISTKAAEIPADDFSWRKYGRSRLWRMPWTHQLTQLG

SEQ ID NO: 162830 - protein, 220 aa, Triticum aestivum
  unsure (1)..(220): unsure at all Xaa locations
  Clone ID: PAT_TA_57248.pep
FLYGGGYQSGSTTKKIDIPNGRVGVIIGKAGETIKHLQAQSGAKIQVTRDMDVQPGSQTRSVDLSGTPDQINRAEQLIIDVLAEADAGSSGTISNRKYNAPQPGAEQFQMQIANNKVGLVIGKGGETIKSMQAKSQARIQVIPLHLPPGDTSTERTLYIDGTAEQIEIAKQLVSEVTSENRARNPMSGGYSQQGYXPPRXQANWGAPGAPXTQQPXYGYM

SEQ ID NO: 162831 - protein, 219 aa, Triticum aestivum
  unsure (1)..(219): unsure at all Xaa locations
  Clone ID: PAT_TA_57249.pep
VPFRSLERLSLSGCHIDLATFIPYCPRLRVLQVNTTGLIDMSNITVHSASLEELVVEHGNRWTRRTHVSVDSPVLKQLTASFHACGNIRVSILSPMVEKVWWRCSYAKPIYRLGLWGLSEVGLNTEDSHSGRDACVQLPSVHVLSLHISPAQDSVSFPNADLSLFAAEIDKHIVTNFSGLDLHLSTKGHVFGAFVLHLLGMHRIRTALXTLRLSCKDQR

SEQ ID NO: 162832 - protein, 104 aa, Triticum aestivum
  Clone ID: PAT_TA_57250.pep
IIIITKRYVRTLLQPNANLCTLSPIHTFETNLVRISRGTNQLVDHRASPPAVLLKPMSWPPLRSVLVSDDELSESDEESSDGFSPSALSRTRCPAGSAAAGGWR

SEQ ID NO: 162833 - protein, 147 aa, Triticum aestivum
  unsure (1)..(147): unsure at all Xaa locations
  Clone ID: PAT_TA_57251.pep
MATMGSLIGLVNRIQQACTVLGDHGGGAGGSLWEALPSVAVVGGQSSGKSSVLESIVGRDFLPRGSGIVTRRPLVLQLHKTEGGQEYAEFLHAPRKRFSDFAAVRKEIADETDRMTGKSKAISNVPIHLSIYSPHVVNLTLIDLXGL

SEQ ID NO: 162834 - protein, 113 aa, Triticum aestivum
  Clone ID: PAT_TA_57252.pep
ARCERCWIYRATSLAWPWWESSKASDSFSARARGSWWCLPVERQSTPPAGDRDSSALAAVAIHREGSVRCTANARRRQPRRNLPVSPCQTLTLPPPPQSIRPDREDLRDLVLW

SEQ ID NO: 162835 - protein, 200 aa, Triticum aestivum
  Clone ID: PAT_TA_57253.pep
MAEAPAASRRAEEAGSRRRADDEAEAAAAADGDGDSSVYTSEDEGTEDYRRGGYHAVRPGDTFKQGAYVVQSKLGWGHFSTVWLAWDTAHSTYVALKVQKSAQHYTEAAMDEIKILRQIADGDPEDSRCVVKLLDHFKHSGPNGSHVCMVFEFLGDNLLTLIKYTDYRGIPLPMVKEICPHVLIGLDYLHRELSIIHTDL

SEQ ID NO: 162836 - protein, 94 aa, Triticum aestivum
  Clone ID: PAT_TA_57254.pep
MSRLRALWQASVNATKRAVVWNSEDLFPPSERYIFNFNSKDEVKKWHLYSDSEYGGLSSASLEITDSVSGGDTSSTGTMSLTCLIFQLAQSFEV

SEQ ID NO: 162837 - protein, 113 aa, Triticum aestivum
  unsure (1)..(113): unsure at all Xaa locations
  Clone ID: PAT_TA_57255.pep
LSPDSDPPFAAAATYLKPIPPPAPARHHRSSSARRPTPSLRPRSSPSAAGPNPTQASPRTNSSPPTPPPRASSYPTPGSLASVHRXPPPPSPLPKLLRRRPDLPPPSSTTTPM

SEQ ID NO: 162838 - protein, 71 aa, Triticum aestivum
  Clone ID: PAT_TA_57256.pep
CITIRSSIIISVEQQPHNFQLQPPKNRIHVHVHGPPLDAYAVCTRSSYLQEEMSEESLSILQALHQQTDLG

SEQ ID NO: 162839 - protein, 131 aa, Triticum aestivum
  unsure (1)..(131): unsure at all Xaa locations
  Clone ID: PAT_TA_57257.pep
GDLGKHLNFAQNTLFFAIFNPLSEQIGVKKKKTRPPEEHGLACFPLSPPPPPPPTPAVSGNLAGGGALAMNQNDSEAVALVKDGKCPRTKGVAVALDAKTFAILGLGKAGAXLPPRALGLGMAALAPHPFA

SEQ ID NO: 162840 - protein, 163 aa, Triticum aestivum
  unsure (1)..(163): unsure at all Xaa locations
  Clone ID: PAT_TA_57258.pep
MVTPPSPRRSAAGAGAAAGAPRVLLALVVLYGFMSFLVYRVIHMRHVAPLDSDASPDEFSEGRVLQHLRRLVVDIPGRQEGRPGLETAAQYIKGQLEGLAAHAGPEYRIDVEETIVSGSFSMMFLRHRVTLGYRNHKNIVMRISSNVSEEDEXSLLVNGHFDS

SEQ ID NO: 162841 - protein, 216 aa, Triticum aestivum
  unsure (1)..(216): unsure at all Xaa locations
  Clone ID: PAT_TA_57259.pep
INHLDKLFITNDAATIVNELDVQHPAAKLLVLAARAQQEEIGDGANLTISFAGELLEKAEELIRMGLHPSEIIIGYTKAINKTLEILDDLVEKGSENMDVRNKEEVVLRMKSAVASKQFGQEDVLCPLVADACIQVCPQNPDTCIGDKGTLRKLVARRLASSAVVRGMALKNDAVGSIKKVEKVKVAVFAGGVDTSXTETKGTVLIHSAEQLGNYA

SEQ ID NO: 162842 - protein, 172 aa, Triticum aestivum
  Clone ID: PAT_TA_57260.pep
MASNQDKASYRAGEAKAHTEEKAGQVTGAAKDEACDAKDRASGAAGQATGKGQGAVEATKQKAGEAGQKTSETAQAGKDRAAEGKDRTGSYLGHATEGTKQKASEATGYTQDRASDAAQYTKDSAVAGKDKTGSVLSQAGEQVKNAVVGAKDAVASTLGMGGRQHQRNQGRE

SEQ ID NO: 162843 - protein, 228 aa, Triticum aestivum
  unsure (1)..(228): unsure at all Xaa locations
  Clone ID: PAT_TA_57261.pep
MHWRPSPKENSTACSPEMVPSGHENLQPLPYPAFLPQAQTPDVVATGAVIGALDQMHHPAPVLGTIEEGTSPILSPPLESGSLPQLEPQMNSVTAHVVDTPMHVPATDCVAVNSEGTVLPLPALQAMVTNMDSATTSLPRFENGAEGSLPQLRQQSSSPNVQAAPCSLDAVELLPPPPPPFVNKEVGQMVCGSCRELIAYPRGAXHVQCAACRTVNLVVEAHESGNVH

SEQ ID NO: 162844 - protein, 235 aa, Triticum aestivum
  unsure (1)..(235): unsure at all Xaa locations
  Clone ID: PAT_TA_57262.pep
GGSSTRPANGAVTVNSAATTVGSANARFHSQQPHQDRQSRWASCFPGLSCFGSQKGGKRIVPAARMPDGNASTNRGNALQSGRNSNQNGAMNLSLLAPPSSPASFSNSALPSTAQSPNRFLSISANSPGGPTSNMFAVGPYANEPQLVSPPTAFSTFTTEPSTAPLTPPPELAHATTPSSPDVPYXXRFFHSYTGLKTAGKEHSMHYLSTTXXSGGLGLQGSYPLYPXSPSSSLI

SEQ ID NO: 162845 - protein, 157 aa, Triticum aestivum
  Clone ID: PAT_TA_57263.pep
DVAVLVALSGAHTIGRSQCGSFSDRSQRADDTFSRKLAANCSKNPDRLQNLDVITPDLFDNGYYKALGFIQGVFTSDMALVKNKTTAPIVKQFAASKDAFFAQFAKSMTKLASVPKPAGNIGEIRRFSCFRTNAQSVVLIEAAVDAADEEEGFAASA

SEQ ID NO: 162846 - protein, 158 aa, Triticum aestivum
  unsure (1)..(158): unsure at all Xaa locations
  Clone ID: PAT_TA_57264.pep
VHRPIPIHLRQVARQEIVRLPNHFRFFVRDAQDSAFGLGLYRFRNGLIRDVVVGKSYLLGEDNEVTFVKHDEGLNMRMPSLGRQIWFLMLAFPQDYQKKFGIDKAVSQFGKLIQWFTPQDPVSSVLVKSWIMSLSLVPSSXVMRQMGGQRRSWTVPVY

SEQ ID NO: 162847 - protein, 228 aa, Triticum aestivum
  unsure (1)..(228): unsure at all Xaa locations
  Clone ID: PAT_TA_57265.pep
RIPVAHASATEPSTIPLLFLLGTSLLFAAAVSASHDEEEDRRGGRSLQQCVQRCHQDRPRYSHARCVQECRDEQQQHGRHEQEEQGRGHGRHGEGGREEEQGRGRGRHGQGEREEEEGRGRGRHGEGEREEEEGRGRGRHGEGEREEHGDSRRPYVFGPRNFRSIIRSDHGFVKALRPFDEVSRLLRGIRNYRVAIMEVNPRSFVVPGLTDADGVGYVAQXEGVLTVI

SEQ ID NO: 162848 - protein, 222 aa, Triticum aestivum
  Clone ID: PAT_TA_57266.pep
ELEYDQYLEGRIPWFKEHAWPHLCAYWCSKEFKTLRKRGQESRFKSEDIAQNRGGSLPFVEARQILAQKYGPEKATTLNTYAALKSGLKNWDGSGSISSTLSGKAKKRHDDYCDLARAAHPDDWEERELDGQMLYESSGGIPHGRLAIADGAIKKAYVISIAREKKLRPLSSASFRRTIQNEELKRRAIQNEELKRRNENLQKIVDMHGRLFLAPFRRWEKT

SEQ ID NO: 162849 - protein, 261 aa, Triticum aestivum
  unsure (1)..(261): unsure at all Xaa locations
  Clone ID: PAT_TA_57267.pep
AELTKLSNLGHLNLSSNGFGGALPVGFRSLRKLKYLDLRGNGFVGKLDDIFAQLQSPVHVDFSCNQFSGSLASISDNSSVATTLQYLNVSHNVLSGPVFASDPTPLFDSLEVFDTSYNALTGNVPSFNFMISLKVLLLQNNKFSGSIPEALFRETSMVLTQLDLSCNQLTGPIRRVTSVNLKYLNLSSNSLQGTLPITFGSCSVVDLSRNMLSGNISVVHTWXDYVEMIDLSSNRLTGTWPGQTTQFLRLTSLRISNNLLA

SEQ ID NO: 162850 - protein, 73 aa, Triticum aestivum
  Clone ID: PAT_TA_57268.pep
AIQLDQHKNISGSTRTARHMDHHPHVHHINSQLVNSIVYVWASTFSQLEASTCENNGEGDGQPYPPREVDIRY

SEQ ID NO: 162851 - protein, 179 aa, Triticum aestivum
  Clone ID: PAT_TA_57269.pep
EPVGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLSNAMNAAEITDKL

SEQ ID NO: 162852 - protein, 114 aa, Triticum aestivum
  unsure (1)..(114): unsure at all Xaa locations
  Clone ID: PAT_TA_57270.pep
SLVALLPFASRRPPPPRPPPRPPPRSPSLPVAAIILPPLLTPVVHSHPAPLTPCVQGQSLDFCSGGELMAMEELDPRAPALDLATEVVDATFEVHMGGGLLPAAAXEXRXGGAA

SEQ ID NO: 162853 - protein, 235 aa, Triticum aestivum
  unsure (1)..(235): unsure at all Xaa locations
  Clone ID: PAT_TA_57271.pep
NSIIHDITKGQYSDKALTVLPVVGPGGMGKTTLIQHIFRNQQVQNHFPIRIWICVPFISNLVKVLEQIRRNTFRVEGEDRRSTTKELIQHRLRHKRFLLVLDDIWQISNSDDWKKLLLIFGQSQEKGCVILVTTRFHAIAEMVRTTNHCIELNGLEHEEFWKLFLAFVFGYEHAGRDHHDLLQTGNKIMEKLKGSPLAARTVSRLLRNNHSLQHXERVLESKEWEMKTSSXDIMP

SEQ ID NO: 162854 - protein, 237 aa, Triticum aestivum
  Clone ID: PAT_TA_57272.pep
RSPYVDWNLYLNTLFWNLNYWDSISTLSGEIRNPAKTLPKALFYAVIFVVVGYLYPLLTGTGAVPLDRGQWTDGYFADIAKVLGGAWLMWWMQAAAAMSNMGMFVAEMSSDSYQLLGMAERGMLPAFFATRSRYGTPLVGILFSASGVLLLSTMSFQEIVAAENFLYCFGMLLEFLSFVLLRVRRPDAPRPYRVPLGTAGCVAMLVPATALIVAVLALSTLKVALVSLGAVAVGLVL

SEQ ID NO: 162855 - protein, 129 aa, Triticum aestivum
  Clone ID: PAT_TA_57273.pep
ARSAGIFRLLSSPLRLSKYSTLYNFVTELVLEFVTWNALSCLVSAVAFLPRSLSIRTETCESWDISERGIRVRNLVLPDWCLPADLRHSSLVPPQHSSHPRVRIVIELPYLLWLLLVWSEIRTRCFCLL

SEQ ID NO: 162856 - protein, 250 aa, Triticum aestivum
  Clone ID: PAT_TA_57274.pep
QLQQPAQGQQPEQGQQGQQPGQGQQGQQPGQGQQPGQGQPGYYPTSPQQSGQGQPGYYPTSSQQPTQSQQPGQGQQGQQVGQGQQAQQPGQGQQPGQGQPGYYPTSPLQSGQGQPGYYLTSPQQSGQGQQPGQLQQSAQGQKGQQPGQGQQPGQGQQGQQPGQGQQGSIQTPQQQPQQLGQCVSQPQQQSQQQLGQQPQQQQLAQGTFLQPHQIAQLEVMTSIALRTLPTMCRVNVPLYRTTTSVPFGVG

SEQ ID NO: 162857 - protein, 256 aa, Triticum aestivum
  unsure (1)..(256): unsure at all Xaa locations
  Clone ID: PAT_TA_57275.pep
ISTQQPYPQPQPFPSQQPYLQLQPFPQPQPFPPQLPYPQPQSFPPQQPYPQQQPQYLQPQQPISQQQAQQQQQQQQQQQQQQQILQQILQQQLIPCRDVVLQQHNIAHASSQVLQQSTYQLLQQLCCQQLLQIPEQSRCQAIHNVAHAIIMHQQQQQQQEQKQQLQQQQQQQQQLQQQQQKQQQQPSSQVSFQQPLQQYPLGQGSFRPSQQNPQAQGSVQPQQLPQYEEIRNLALQTLPAMCNVYIPXHCSTTIAP

SEQ ID NO: 162858 - protein, 257 aa, Triticum aestivum
  Clone ID: PAT_TA_57276.pep
TFPNNHYFHNNQQLFPQQPSFSQQQPPFWQQQPPFSQQQPILPQQPPFSQQQQLVLPQQPPFSQQQQPVLPPQQSPFPQQQQHQQLVQQQIPVVQPSILQQLNPCKLFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVPFDVGT

SEQ ID NO: 162859 - protein, 159 aa, Triticum aestivum
  Clone ID: PAT_TA_57277.pep
PPSRRPPRGGPPDPRGPLFSPRRPAGEKQQVPLFLGGAPRAEKKGEEGGGGGPQGPPEPPGEAAGGAPRRRPPPPGGPPLGAPPPPPPPGGPRRGRPPPQHPARRAPGRRCQEGQRPKTARRRLLPHRLKGERTSFFLAGLRGRRGASLLFFYRGVLVV

SEQ ID NO: 162860 - protein, 65 aa, Triticum aestivum
  Clone ID: PAT_TA_57278.pep
KKTAPGLNQATRKKTPGGARNVVLNYGTSKSFRPLFFFYFFFFFFFFSFFFFFFFFFFFFFFFIF

SEQ ID NO: 162861 - protein, 95 aa, Triticum aestivum
  Clone ID: PAT_TA_57279.pep
GTCSRRPCCTLRGGSGPSVSGNETYVNIEYEASEMFDLNNVVISIPLPALREAPTVKQIDGEWKYDSRNSALEWSIILIDQSNRSGSMEFIVPPA

SEQ ID NO: 162862 - protein, 225 aa, Triticum aestivum
  unsure (1)..(225): unsure at all Xaa locations
  Clone ID: PAT_TA_57280.pep
NHLFSQQQQQPLSQQQQPPFSQQQPPFSQQQQPPFSQQQPPFSQQQQPVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMAQSLARTQMLHQSSCHVMQQQCCQQLPHIPQQSRYEAIRAIMYSIILQEQQQVHGSMHTTQHKPQQLGQCVSQPHSSXQQQLGQQ

SEQ ID NO: 162863 - protein, 139 aa, Triticum aestivum
  Clone ID: PAT_TA_57281.pep
EIGLPYQLVSIVSGALNDAAAKKYDLEAWFPASKTFRELVSCSNCTDYQARRLGIGYGQKKNDEQSKQFVHMLNSTLTATERTLCCILENYQREDGVEVPKALQPFMGGIDFLPFKRPLDSKQAADSKPSKSKPKGNAA

SEQ ID NO: 162864 - protein, 128 aa, Triticum aestivum
  Clone ID: PAT_TA_57282.pep
DNLLRSGDNLLLLHVLKDPDYEQGETLLWEASGSPLIPLSEFSHPSTAKKYGVKPDAETLDMLNTIAKQKEVSVVSKVLFGDPREKLCQAIHDMPISSLVIGSRGLGKLKRVLLGSVSDYVVNNAATY

SEQ ID NO: 162865 - protein, 102 aa, Triticum aestivum; identical to SEQ ID NO: 124553
  Clone ID: PAT_TA_57283.pep

SEQ ID NO: 162866 - protein, 254 aa, Triticum aestivum
  unsure (1)..(254): unsure at all Xaa locations
  Clone ID: PAT_TA_57284.pep
RLFLILALLAIVATXVTIADRVPEPQLYAQNSISXQQPQKQVALRHQQHFXGEQRPFPSLQPYPELRPFPSQQAIYAAVTIYXAKLPYPQTQLPYPQPQPFGPQHLYPQPQPQYSQPQQPISQQQLQQQQQQQQQQILQQILQQQLIPCRDVVLQQHSIAHGSSQVLQQSTYQLVQQLCCQQLWQIPEQSRCQAIHNVGHAIILHQQQQQQQQQQPLSQVCFQQSQQHXPSGQGXSFQPSQQNPQAQGSXQPQH

SEQ ID NO: 162867 - protein, 32 aa, Triticum aestivum
  Clone ID: PAT_TA_57285.pep
NNFPFFNSKLIHPNHWISIQQPPTSFFLARHG

SEQ ID NO: 162868 - protein, 89 aa, Triticum aestivum
  unsure (1)..(89): unsure at all Xaa locations
  Clone ID: PAT_TA_57286.pep
RPASVTYCQYPVVTIIAPALLFLNPWGLRRPLCLLRHGRRRLRLQAYGPQLAPLSLLYRGGLLPVFFLLLSVAVAGISLPFPXFPPLPL

SEQ ID NO: 162869 - protein, 64 aa, Triticum aestivum
  Clone ID: PAT_TA_57287.pep
KDVAIGRCQGKRTVCACLSPMPRLKSCIRAGRHCLSACQPAQSGTVRASSVLVRVRMGMWCKAI

SEQ ID NO: 162870 - protein, 233 aa, Triticum aestivum
  unsure (1)..(233): unsure at all Xaa locations
  Clone ID: PAT_TA_57288.pep
PFPPQQPYPQPQPFPSQQPYLQLQPFLQPQLPYSQPQPFRPQQPYPQPQPQYSQPQQPISQQQQQQQQQQQQQQQQQQQIIQQILQQQLIPCMDVXVLQQHNIVHGKSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 162871 - protein, 87 aa, Triticum aestivum
  Clone ID: PAT_TA_57289.pep
NVVLTYEPVWAIGTGKVHDGLRKWLQANVGPAVAESTRIIYGGSVNGANCKELAAQPDLDGFLVGGASLKPEFVDIIKSATVKSASA

SEQ ID NO: 162872 - protein, 38 aa, Triticum aestivum
  Clone ID: PAT_TA_57290.pep
SPQFEEIRNLALQTLPAMCNVYIPPYCTIAPFGIFGTN

SEQ ID NO: 162873 - protein, 108 aa, Triticum aestivum
  Clone ID: PAT_TA_57291.pep
LVDGPGEGSKRLGVRTTVAIIFARLILVPIAGVGIVMLVDKLGFIPKDDKMFKFVLLLQHSMPTSVLSGAVANLRGCGKESAAILFWVHIFAVFSMAGWIIFYLTLLF

SEQ ID NO: 162874 - protein, 192 aa, Triticum aestivum
  Clone ID: PAT_TA_57292.pep
MKTFLVFALLAVAATSAIAQMETRCIPGLERPWQQQPLPPQQTFPQQPLFSQQQQLFPQQPSFSQQQPPFWQQQPPFSQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVPFDVGTGVGAY

SEQ ID NO: 162875 - protein, 257 aa, Triticum aestivum
  unsure (1)..(257): unsure at all Xaa locations
  Clone ID: PAT_TA_57293.pep
MLPSLSELVSGQVVFFCMDVISCCSVVSQQQPPFSQQQQPVLPQQPPFSQQQQQFPQQQQPLLPQQPPFSQQQPPFSQQQQQPPFSQQQQQPILLQQPPFSQHQQPVLPQQQIPSVQPSILQQLNPCKVFLQQQCSPVAMPQSLARSQTLWQSSCHVMQQQCCRQLPQIPEQSRYDAIRAIIYSIVLQEQQHGQGLNQPQQQQPQQSVQGXVSQPQQQQKQLGQCSFQQPQQQQLGSMGLNTNRYPKGTLLQPHQIA

SEQ ID NO: 162876 - protein, 256 aa, Triticum aestivum
  unsure (1)..(256): unsure at all Xaa locations
  Clone ID: PAT_TA_57294.pep
MKTFLILALLAIVATTATTAVRVPVPQLQPQNPSQQQPQEQVPLVQQHQFLGQQQPFPPQQPYPQPQPFPSQQPYLQLQPFPXLQQPYSQPQLPYPQPQPFPPQQPYPQPQPQYPQPQQPISQQQAQQQQQPVLPQQQIPFVHPSILQQLNPCKVFLQQQCSPVAMPQSLARSQMLQQSSCHVMQQQCCQQLPQIPQQSRYEAXPCYHLLHHPARTQQVQGSIQSQQQQPPQLGQMCFPTPTAVAAATRATTSTTT

SEQ ID NO: 162877 - protein, 54 aa, Triticum aestivum
  Clone ID: PAT_TA_57295.pep
HKKKNIAHYWQQCISKNCKVASSKLLQSPSSILDDHFLQATMTALCTSAGQNSS

SEQ ID NO: 162878 - protein, 121 aa, Triticum aestivum
  Clone ID: PAT_TA_57296.pep
IMVYDVTRRETFTNLSDIWAKEIDLYSTNQDCIKMLVGNKVDKESERAVTKKEGIDFAREYGCLFLECSAKTKVNVEQCFEELVLKILDTPSLLADASSGAKKNIFKQKAPEADAAASGCC

SEQ ID NO: 162879 - protein, 113 aa, Triticum aestivum
  unsure (1)..(113): unsure at all Xaa locations
  Clone ID: PAT_TA_57297.pep
IHVTGGGFPAVVDWQNLAVPPLFFLGGIPDXAGFTNSYQPRTDRLSHRXRTLNGEWNAPFPVALPPRVAEVTRTVTAPFSGALGPFLFAFFVFFPDGLAGWPRHGLPWGLPWG

SEQ ID NO: 162880 - protein, 253 aa, Triticum aestivum
  unsure (1)..(253): unsure at all Xaa locations
  Clone ID: PAT_TA_57298.pep
WHIAPPEGRAFFHHPTGRFCDGRLVIDFLCESLNISYLSPYLKAIGSNYSNGVNFAISGSTTLPREALFVLHGQVQEFFFFKARSLELINQGQEAPIDAEAFQNALYIIDIGQNDINALLSNLPYDQVVAKLPPILAEIKYAVQLLYGNGSRNFWIHGTGALGCLPQKLSIPRKNDSDLDQNGCLNTYNRAAVAFNTALGSLCDQLNVELKNATVVYTDLXAIKYDLVANHTKYGXDNPMMTCCGYGGPPYNY

SEQ ID NO: 162881 - protein, 72 aa, Triticum aestivum
  Clone ID: PAT_TA_57299.pep
NPGPEFYFGGPFKKIFPCQPGVVNFGSFKRAPLFFFFFFFFFFFFFFFFFFFFFFFFFFFFFFFFFFFFFFF

SEQ ID NO: 162882 - protein, 134 aa, Triticum aestivum
  Clone ID: PAT_TA_57300.pep
GAAKGRKDNGRGPLTHPPQCKKREARPQETKRGSAPGCYPRQGGGTPRHNDRKVEGPKKKKAEYDGERHGKWQSQEGTPPFQFILFFVSLYNIFFFFFFFFFFFFFFFIFFFFFFFFFFFFFFFFFFFFFGQRG

SEQ ID NO: 162883 - protein, 61 aa, Triticum aestivum
  Clone ID: PAT_TA_57301.pep
TNWSLQNHELVWCASPLLPWLTNDSQSFWACLIMICADRFIILEIKTVLTTKTKLGEYDIS

SEQ ID NO: 162884 - protein, 82 aa, Triticum aestivum
  Clone ID: PAT_TA_57302.pep
AGVINYQAFTNSEGIYSVAETMPESDRWDSCLARPISSFHHHCTRRGDAHSGVKFTYNKQSGNSHNVKAFLYKPANVPLYCS

SEQ ID NO: 162885 - protein, 167 aa, Triticum aestivum
  unsure (1)..(167): unsure at all Xaa locations
  Clone ID: PAT_TA_57303.pep
KDLHGIRTSDVCNYTVTKLDRLLRSXKIPPAXVCQMEMRAGCFNDSMFKACGMRGIHVSXYVTIGFFRDSLFHDPGVEKPGSNLIKTPGQVLLFCPLQKWTRVPPKSPXHKRIKANMQMVTRHIPEDYSQGLCSINDEKPVLXAEDLAXNISHVSLSFASEVWDFPN

SEQ ID NO: 162886 - protein, 69 aa, Triticum aestivum
  Clone ID: PAT_TA_57304.pep
CCNICPTYKFNSSRKLSKNYFDWLKYAHVYNMLSFFLQLTTCEAEAKPMCFSRRRPRHINPTPTHLLWN

SEQ ID NO: 162887 - protein, 103 aa, Triticum aestivum
  unsure (1)..(103): unsure at all Xaa locations
  Clone ID: PAT_TA_57305.pep
CPIILAIAVSVSADECQGDRHAVINECAEHNXWPADPKLDTEDACCADRQKAHIPCLCATVAKEKENIYCMHNAGYXANFCKRRGPHGYKGRCYTFSTLAQRL

SEQ ID NO: 162888 - protein, 117 aa, Triticum aestivum
  unsure (1)..(117): unsure at all Xaa locations
  Clone ID: PAT_TA_57306.pep
RKKQQGLIKQLKLHTEQVAIRAIIYSIILQEQQQVQGSIQSQQQQPQQLGQCVSPXGPKLALESNSDEPDTIEYCNLGCRSSVCDYMVNAAADDEEMKLYVENGGCCCENGGWLLLR

SEQ ID NO: 162889 - protein, 89 aa, Triticum aestivum
  unsure (1)..(89): unsure at all Xaa locations
  Clone ID: PAT_TA_57307.pep
PPPPPKKNKNPPPPPRHPATSPPPGFFFFXRSPASPTHTTPTHKTGAAGPXVAHPPHTAAPRPPQKKMPPPARTGPAHQRTRSYDKRAA

SEQ ID NO: 162890 - protein, 107 aa, Triticum aestivum
  Clone ID: PAT_TA_57308.pep
EPCRLVGGEQDMMQQALIDVMHTTLGTALYIRSRATGLLPPFVVATRIKGSKATPDPYHGTADFQEPRLLAPTAQHLAPQLSALSRLAGLTSCRPGMDKPCCNSHEA

SEQ ID NO: 162891 - protein, 170 aa, Triticum aestivum
  Clone ID: PAT_TA_57309.pep
QYPGQQQPFPPQQPYPQPQPFPSQQPLPQPQPFLPQLPYPQPQPFPPQQPYPQPQPQYPQPQQPISQQQAQQAQQQQQQQQQQQQQQQQQQQQQQQQQQQQILQQILQQQQLIPCRDVVLQQHNIAHASSQVLQQSSYQLLQQLCCQRLWQIPEQSRCQASIRNGQQSQS

SEQ ID NO: 162892 - protein, 81 aa, Triticum aestivum
  Clone ID: PAT_TA_57310.pep
AIYIKDPDKALTFGMGDPGPNNSFATGRRSTEPTRSGGKHPSANAPIIRPYRPLSVILATSSMSNTAVWSPSSPAWERGKG

SEQ ID NO: 162893 - protein, 69 aa, Triticum aestivum
  Clone ID: PAT_TA_57311.pep
NLMCQGHCDGTIHVSCECSTSRSPKEEGSKVGQQASLDESISLLKQSAADMNAQVSLDTKMVMELLDLC

SEQ ID NO: 162894 - protein, 72 aa, Triticum aestivum
  Clone ID: PAT_TA_57312.pep
RQFTRHSILFAFNRLTKTQKEDYSRSRNSFRPHDTRVTEPHRNSSTHSIRQALQQASFQLQEFKHPRPCRPR

SEQ ID NO: 162895 - protein, 138 aa, Triticum aestivum
  Clone ID: PAT_TA_57313.pep
GRVGTQRPTSLPTPRPTSPPAPPHFPSHLRSGAPLPNPSSPAAPPTTTSGCVPRAPPSTPAATLLFLPHHPADMAGSGRPRPPARPQPPDPATAGPSARKPPRSRSSSPNPARSVWVPLSRAAETAPVLRPSDGRMEE

SEQ ID NO: 162896 - protein, 138 aa, Triticum aestivum
  Clone ID: PAT_TA_57314.pep
YACSAVHSWSQGRAIFGSGSPFDPVKYNEKLFVPAQANNAYIFPGFGLGVVISGAIRVKDDMVLAAAEALAEQVMAEHFDKGLIYPPFSSIRKISTNIAARVAAKAYDLGLASHLPRPKDLVKYAESCMYSPIYRSYR

SEQ ID NO: 162897 - protein, 132 aa, Triticum aestivum
  Clone ID: PAT_TA_57315.pep
ASWPSSSSPSSSRSPSTSASTWWSQRRRLPVASATVELREAAAGGGDSVMTPQPNSSVKFSVEAALQELQSSGLHSDDVGIGAAEAWKAYLMAKKAKLDETLAAARQFRALLRQQLQKAFASQVRDQKAAQN

SEQ ID NO: 162898 - protein, 64 aa, Triticum aestivum
  Clone ID: PAT_TA_57316.pep
ANKSSHGTPLHPTTWNLYIARAKYKFQVVGWSGVPRISLVTGTRILVQTFFVLFCGSKSRNCIY

SEQ ID NO: 162899 - protein, 101 aa, Triticum aestivum
  Clone ID: PAT_TA_57317.pep
TFAVYLVDVCPVNRKLTRCTCTCVFVTLLSYITLPDQNIQISPFYINNRDCSHTIWHFKNIAATQAKGSGSLGKEKFLLTKMVVWISPYSHCHWYFIFLIF

SEQ ID NO: 162900 - protein, 218 aa, Triticum aestivum
  Clone ID: PAT_TA_57318.pep
AAPRADDEEFADAGETGYSESPSQGVDGASPSSSTGTSSNVPVKQPAAAAAAVAAPIPDLLGDLMGLDNALVPVDEPKASSGPPLPVVLPSTTGQGLQISAQLVRRDGQIYYDISFENGTHGVLDGFMIQFNKNTFGLAAGGPLQVPPLQPGSSARTLLAMVFSQNVSPGAPNSLLQVAVKNNQQPVWCLSDKGLLRVFFGEDGSLVRTSFSCGPGNS

SEQ ID NO: 162901 - protein, 152 aa, Triticum aestivum
  Clone ID: PAT_TA_57319.pep
YLTLSLQIEVCLPNQYRVVGILNCYNLQYNVALVDIMGFWRPRTIKIHGHPVTSSMDVIAVGSLFACRKLMAVEGKVLIGKQSKLDCKELCVSTCKITKAGIGGPLIDNDGNFVGMNFYDEEETPFLPRDVIHHLLLNFNKKRYVLKKKEAL

SEQ ID NO: 162902 - protein, 122 aa, Triticum aestivum
  unsure (1)..(122): unsure at all Xaa locations
  Clone ID: PAT_TA_57320.pep
MYGRGFLTCRVINGSGPWGRSLLYGCLEWSAYSIGRMHSLDSDLEAFMHNSGDCIFELLVFQPSAISIGVIDRFLXSCVYLLLLHWNLFGITKLSYDGILSGDVXFCWVIYXLLGDVCLTMI

SEQ ID NO: 162903 - protein, 46 aa, Triticum aestivum
  Clone ID: PAT_TA_57321.pep
SPTYSCWLSGLYQSLTLAWLQLWLQTSLKPADAACLLSAYRTCCCL

SEQ ID NO: 162904 - protein, 47 aa, Triticum aestivum
  Clone ID: PAT_TA_57322.pep
VALRSYIKDLEARRCRRTGALPPSAAYAPKFCRSPMTNGYYWRWRYH

SEQ ID NO: 162905 - protein, 150 aa, Triticum aestivum
  Clone ID: PAT_TA_57323.pep
MGSDTETEKKKTPVALAPIAKPLAGKKLSKKTLKLVRRASEAKCLKRGVKEVVKSIRRGSKGLCVIAGNISPIDVITHLPILCEEANVPYIYVSSKEELATAGTTKRPTCCVLVMTKPAKGEITEEVKEKLESEYKQVVTEVTEATSALF

SEQ ID NO: 162906 - protein, 168 aa, Triticum aestivum
  Clone ID: PAT_TA_57324.pep
VNSSSEKLGGAVVATAVVPDEVDKIKEILVKWSDIDRVNLILTLGGTGFTPRDVTPEATKSVIEKEAPGLAFVMIQESLKVTPFAMLSRAACGIRGSTLIINMPGNPNAVAECMEALLPALKHAMKQLKGDKREKNPRHIPHAEATPVDQWERSFRAASSGGGCSCDP

SEQ ID NO: 162907 - protein, 87 aa, Triticum aestivum
  Clone ID: PAT_TA_57325.pep
MGALMNCLYVFFLEEFFFLFFCFFFFFFFFFFFFFFFFFFFFFFFFFFTSLDRVLFTRTSPGSLFDRCEMKEDSSYKTSLSQNSPLA

SEQ ID NO: 162908 - protein, 124 aa, Triticum aestivum
  unsure (1)..(124): unsure at all Xaa locations
  Clone ID: PAT_TA_57326.pep
PRPDRHAATRSRAESSSSNPPTGDGXGAETSEPSPQSQYFXSRSDGSVWPTCLVDIGPLARGCXPWRPDEGMRTTVRERYSDLPILMGRRRRTGHRATCGGILPTGAYLRVNRFQGWQDVKHKR

SEQ ID NO: 162909 - protein, 80 aa, Triticum aestivum
  Clone ID: PAT_TA_57327.pep
MNPTHHDRPRACNNNLVIDTVDTAATNGLLKPRVPVKEARKEPKFSCPVCMNELVDASSTICGHIFCQNCIEASIQAQSK

SEQ ID NO: 162910 - protein, 57 aa, Triticum aestivum
  Clone ID: PAT_TA_57328.pep
PVIISMHLDLSIACRFIPRGVLIKSHVIYAPSAFCFISTTALSTGKGVVDPGIFRPR

SEQ ID NO: 162911 - protein, 121 aa, Triticum aestivum
  unsure (1)..(121): unsure at all Xaa locations
  Clone ID: PAT_TA_57329.pep
MLRRIVESRKSQTSDLNMSNAVAGRPDDERLDVMRIFVHCSAGSALRYLIICDXALDDKGVRAFTELVTSXDDLEELYXLRNDGXSPEAAKGLCELIPXTEKLNGLHYLNNMTGDESAMGI

SEQ ID NO: 162912 - protein, 68 aa, Triticum aestivum
  Clone ID: PAT_TA_57330.pep
SQLHMSHTVLNLGRSTRPRQAAAREAFAIHVFTTSTVHVFTVMHCTFMVFVVLLHLQHLQLNAIRNWL

SEQ ID NO: 162913 - protein, 76 aa, Triticum aestivum
  Clone ID: PAT_TA_57331.pep
PHPGPQFYNTIKSWIIDAGATKHMTGASNIFTSYTPCSGKDKVRVPDGSMAHIVVWTSPSNVESYPLIPLIRVLVD

SEQ ID NO: 162914 - protein, 47 aa, Triticum aestivum
  Clone ID: PAT_TA_57332.pep
QSFSCRVPYYSWRLQHLRYSGYFTSGVGTTTKLTESALDAALLARSS

SEQ ID NO: 162915 - protein, 102 aa, Triticum aestivum
  Clone ID: PAT_TA_57333.pep
LYPLLSFSSSSAFSLVEVFLVLLAWLKSSLLKLFVKMYNNSTAKKKKKKKKKKKKKKKKKKKKKKKKKKKKKKKKKKKKKKKKKKKKKKKKKKKKKKKGGAV

SEQ ID NO: 162916 - protein, 120 aa, Triticum aestivum
  unsure (1)..(120): unsure at all Xaa locations
  Clone ID: PAT_TA_57334.pep
LLLLCLLDAPKTVDXHLYTLVQLACFNTNYYLRCDPAFXQQVGHVLGRTLAPINGDNTINHXRSILGQYTADKHVVXVLFMTRCSGPNRACYSFPILLDDAPHLVGALSVFGSVTTGADT

SEQ ID NO: 162917 - protein, 111 aa, Triticum aestivum
  unsure (1)..(111): unsure at all Xaa locations
  Clone ID: PAT_TA_57335.pep
GASTKSGHYGRHLRSHSNDTRETALALKKMSLNKAKRYLDAEXPHTQIIHFRRHWRDDGRTAQAXTFSTNAQGLWPAKPDELALDLLNNAESNAEAKGIDDDALYISHIQG

SEQ ID NO: 162918 - protein, 233 aa, Triticum aestivum
  Clone ID: PAT_TA_57336.pep
PPPSAPRRCATSPPPAGARRNLTGPQEPRRLALSPASRRAPPPPHKLVAPSRKPRRWSPRPRDSSPPWERSIELLCTPPASPRRRRRPTLPRARIQPWEVRPLRIRPPPRWTFYLGTLLMTEERRRAIWAIYVWCRRTDELVDGPNASHITPQALDRWERRLEDLFTGHPYDMLDAALSDTIAMFPIDIQVPDSRCIIVQSTLYDSGRTEWWWIFPVSIRFPRTSQSQCKMTS

SEQ ID NO: 162919 - protein, 184 aa, Triticum aestivum
  unsure (1)..(184): unsure at all Xaa locations
  Clone ID: PAT_TA_57337.pep
GGGGGWRPPGERERKELQPWCSSTVYRNYGLTFKKPRRAYVKEPCDAELXLVGECGLTCKRELWRVHVCLEHDPLCACDTLLTLDEKNPRRIFAGAAXLLRPVNRYGLLAEGRHKLDYVLALTGENLLAWRLHTLVLKAGMAKALHPARVLIRPRHIRVGGQIVNAPSLMARVESDKHICFSLT

SEQ ID NO: 162920 - protein, 88 aa, Triticum aestivum
  Clone ID: PAT_TA_57338.pep
FLPQNSIIHINRCCKASKNVLESDICWQRLIGLFQINITSTSRKWFKHTYPNLIILMGENIVKEFRLNGQLTRIGWICVWWMIVYRER

SEQ ID NO: 162921 - protein, 64 aa, Triticum aestivum
  Clone ID: PAT_TA_57339.pep
PRIIGRFRASTIPHSGRAFFGKADRTGLFQFQQSRERGTVSHAIKLGDGQVLPFPFDVIDRARD

SEQ ID NO: 162922 - protein, 128 aa, Triticum aestivum
  unsure (1)..(128): unsure at all Xaa locations
  Clone ID: PAT_TA_57340.pep
SFQPTLPTLPHPDSPKSPCRCRSPRPRSCRPPGRPCRRRMGSSRWRRRPSAAATSPPPPPAWSRRSARPTPPRSSRSPRPARGCASPACCSPAPRXSPTPRPTSSARCSFSTRSPPRXRASSCWRTPS

SEQ ID NO: 162923 - protein, 170 aa, Triticum aestivum
  Clone ID: PAT_TA_57341.pep
EEPACPKVLGDIVESCVAAVLLDSGFNLNYVWTLVLMLLKPVLSFSDMHMNPMREIRELCQCHELELGLPEPMKADGEYHVKVEVNINSQVISSAAANRNSKVARKFAAQETLSKLKNYGYTHKNKSLEEIRDARKKEPELLGYNEEPIKVEADISAEMNNLKIGKRKGC

SEQ ID NO: 162924 - protein, 59 aa, Triticum aestivum
  unsure (1)..(59): unsure at all Xaa locations
  Clone ID: PAT_TA_57342.pep
MNLSYATQKKSHCMAGQGKLDSLQRTAPPFFFFFFFFFFFFFFFFFFFFFFFFFXVFFF

SEQ ID NO: 162925 - protein, 71 aa, Triticum aestivum
  unsure (1)..(71): unsure at all Xaa locations
  Clone ID: PAT_TA_57343.pep
MRSEAKLSPPPPKMPILVKTLTGKSITLXGRMPCDTIDNVKANIQHKEGIPPDQXRLIFAEKQXLEDGRTL

SEQ ID NO: 162926 - protein, 195 aa, Triticum aestivum
  unsure (1)..(195): unsure at all Xaa locations
  Clone ID: PAT_TA_57344.pep
RKSLNFSSPNRNTRGHRNPSGLRRRLALKFTRAAISCILTPRRPPLFLLARFSRLARTRRPPLVAASPLRYLQGSVGPNNLPSSVMERAQGASNNAAKHRKTNPPLQTWRPVSTQASPREAHLDEISNSRRKQMAGTSITDSENSVLDETTNVGIEVTTNNTFLSESSSTFSSSATKVAAENTMXGNQRXIFLFC

SEQ ID NO: 162927 - protein, 100 aa, Triticum aestivum
  Clone ID: PAT_TA_57345.pep
MPPTPVSHPTERRALATQHWWSLLQRGKELLNVACPNQDMQGGRPLCRVKISTMTVKDNLLAAGGFHGEQICNASHRRSISRSAASPVPVLHIGQHALFI

SEQ ID NO: 162928 - protein, 40 aa, Triticum aestivum
  Clone ID: PAT_TA_57346.pep
RFRARSREGARGKTDYRDSLRLTDQHKNKYVTLKGTFVVR

SEQ ID NO: 162929 - protein, 114 aa, Triticum aestivum
  Clone ID: PAT_TA_57347.pep
LDRRSVPFFLRFTPRGQGGFSPGLLSGVPPGFFPLGPCRVSPGPPLFCPPPRKLFRGPPGEVRLGPLRGRPGGSCFPSLGFLFSAFWFFSFFRFWFSFFGFLFFCLGSQILFYL

SEQ ID NO: 162930 - protein, 136 aa, Triticum aestivum
  unsure (1)..(136): unsure at all Xaa locations
  Clone ID: PAT_TA_57348.pep
MTRRCSHCSNNGHNARTCPARSGGGGGGGGVRLFGVHLTSPPVAAMKKSASMSCIASSLGGGGSGGSSPAAGPGGGAARGGAEGXPXYVSDDPMHASCSTNGRAERKKGTPWTEEEHRLFLLGLQKLGKGDWRGIS

SEQ ID NO: 162931 - protein, 87 aa, Triticum aestivum
  Clone ID: PAT_TA_57349.pep
KRAIGAGRGGKRSAPKRGAPPRSFLVGLRQGFRTSRLLFIFRSVNFFFFFFIFFFFFFFFFFFFFFFFFFFFFFFFFFLNMTSECSI

SEQ ID NO: 162932 - protein, 101 aa, Triticum aestivum
  unsure (1)..(101): unsure at all Xaa locations
  Clone ID: PAT_TA_57350.pep
KEYKQLQKGGKEADQXVVHTIANQVQTMLGITLMEILWKHSYDKGHLGQRDAPEXTRDAEALKAYKRFGTPLMEIETRILNMNMDPALKNCTGPMKMPYML

SEQ ID NO: 162933 - protein, 71 aa, Triticum aestivum
  Clone ID: PAT_TA_57351.pep
CWDDQLSYEDGLRSLSRIIRNDHGVDKALTPMHQATTLLRGVTNYRLTMMSMNPSAFVTARHSRTETASIY

SEQ ID NO: 162934 - protein, 157 aa, Triticum aestivum
  unsure (1)..(157): unsure at all Xaa locations
  Clone ID: PAT_TA_57352.pep
LFXXVATSPQHTHTHTHTHTHTLSLYLLRPPILFVPITGARYRRLALSPIFSAPPHRVCRRSAQGSARARHGCWARDSSPSDWGQWQSCVATSAPGASISISLVGGWSLQVQAGAIRQSIPHFNFHICPLPTSSNPHYPLLLIPNCYSFLYSTYVAQ

SEQ ID NO: 162935 - protein, 161 aa, Triticum aestivum
  unsure (1)..(161): unsure at all Xaa locations
  Clone ID: PAT_TA_57353.pep
MSDMAHDSWDADEILDVYMHDYLVKRNLHNTADALHSVSNLSSDTAAIDAPGGFLFXWWSVFCDILISRTFDKHSDVATLYIETHSIKAREHDTSLLRPQQHTDSQQSAQLIQLQQLMLLRQXQEQQQEQTHLLQQHPQEQQQEQERRQQQHHQRNESRYL

SEQ ID NO: 162936 - protein, 95 aa, Triticum aestivum
  Clone ID: PAT_TA_57354.pep
GRAPHQASLRRPYNDARIALPACTLRVTAGRMHTLALFGHLSTLLAPPGPITRTHAVLAQAARSPSAHQRQTQPWRIEEWLHAESGEAWLYPSDR

SEQ ID NO: 162937 - protein, 174 aa, Triticum aestivum
  unsure (1)..(174): unsure at all Xaa locations
  Clone ID: PAT_TA_57355.pep
IATMLEEEEVEVPVSSTSEVPKDATRMETDDAPQDPASSAGDHTQEPKGAADPAEGAAENGAQDSEEKTVPMDTDTKVEPSKKKVKKTNVPVAEMVYGAMGTVELEKAVEKEYEMALQDRVMEETKDKKNSVEAYVYDMRNKIHEKYNDFVMLEXXKGWMAKLQEVEDWLYEDG

SEQ ID NO: 162938 - protein, 108 aa, Triticum aestivum
  Clone ID: PAT_TA_57356.pep
GRVGDSSAPLAPPSPRSRRRDSPHSPAPSAPPASAAPPSTPSARAAPPSAPPPVRVLQSSWGPPSAPPAPPTSSIAETPTRRPTPRSAVATWLPPRSLISCSSGDPTL

SEQ ID NO: 162939 - protein, 47 aa, Triticum aestivum
  Clone ID: PAT_TA_57357.pep
NGPPLFFFFFFFFFFFFFFFFFFFFFFFFFFFFFFFFFFFFFFFFFF

SEQ ID NO: 162940 - protein, 186 aa, Triticum aestivum
  Clone ID: PAT_TA_57358.pep
SSTSIVFDLRRPGLIDVNQLKEDKFYAKVNLRICLEGGYHVLDESTQYCSDLRPTMKQLWKPPIGLLEVGILSANGLNPTKTRQERGSCDPYCVAKYGHKWVRTRTIVDNLNPRFNEQYTWDVFDHGTVLTIGLFDNCHIGGDNNNHSHSHNQSHSHSSSSPSHMDKPIGKVRIRISTLRLGGCTR

SEQ ID NO: 162941 - protein, 63 aa, Triticum aestivum
  Clone ID: PAT_TA_57359.pep
VVVPHSPAPVACVSRWTPFAGPSPLAAVSRALGHAEALPLRVCVFLSGAAATPRGVAALEGVV

SEQ ID NO: 162942 - protein, 40 aa, Triticum aestivum
  Clone ID: PAT_TA_57360.pep
IFFSLYFFPFFFFFFFFFFFFFFFFFFFFFFFFFFFFGRV

SEQ ID NO: 162943 - protein, 43 aa, Triticum aestivum
  Clone ID: PAT_TA_57361.pep
AKRTTREAERCRRSKLQRMQAKLLAAKNMKPPWSSIFEDDEPN

SEQ ID NO: 162944 - protein, 75 aa, Triticum aestivum
  unsure (1)..(75): unsure at all Xaa locations
  Clone ID: PAT_TA_57362.pep
DESLSFTSSSILEWLMTAIEELELLAIXTGHSHRSLCILIELKLFDLAXLHGTAVEDIAQDEATASLLLKEVALQ

SEQ ID NO: 162945 - protein, 209 aa, Triticum aestivum
  unsure (1)..(209): unsure at all Xaa locations
  Clone ID: PAT_TA_57363.pep
MGDVLLWGKGVGDGTLAYSSHLSGNLYGPRIDASLPKALESTVLLDIHNIACGSKHSVLVTKQGEMYSWGEESGGRLGHGVDTNLTHPKLISTLSGINIESVACGEFHTCAVSFCGDLYTWGDGMHNFGLLGHGNDTAHWIPKKVCGPLEGLHVSSVSCGPWHTAVVTSTGQLFTFGDGVFGALXHXGDRQSTNVARGSELSKSLRTVH

SEQ ID NO: 162946 - protein, 136 aa, Triticum aestivum
  unsure (1)..(136): unsure at all Xaa locations
  Clone ID: PAT_TA_57364.pep
MGRARAKDAGYGGVKSFPSPASSSASSSEFEFTVTQSPGSXQRSAAQLCPADDLFYKGQLLPLHLSPRISMVRTLLLASAXTSXASASDSTSTFNSSRDSNGSTSSSFSTDCAALLLADSXPSSSRPSSATDDDRH

SEQ ID NO: 162947 - protein, 48 aa, Triticum aestivum
  unsure (1)..(48): unsure at all Xaa locations
  Clone ID: PAT_TA_57365.pep
RERGAGFFYQPWVEEAVFKYFNCXPPGGNNGPGFGGFLGKKFCCSLWG

SEQ ID NO: 162948 - protein, 106 aa, Triticum aestivum
  Clone ID: PAT_TA_57366.pep
SDGSLTGALVAGTVGIALASFVHVSVLERGGHLGERLAHDSGVVAGVQLPSLISWYIMHPQAGSFRKYIRIRSCRGLGSPTGSGWLNDRPWRALRRSCSCACVSLS

SEQ ID NO: 162949 - protein, 105 aa, Triticum aestivum
  Clone ID: PAT_TA_57367.pep
RFINLVFDEVRNSALAIVTRRIDWKKLATMETIDIFFNYVQRIFKNIFDHAEQISKAMVARGYRGDPSKHKIYFLAESSFGIVDALSLLCLLAVMGLASFSERLV

SEQ ID NO: 162950 - protein, 78 aa, Triticum aestivum
  Clone ID: PAT_TA_57368.pep
HGGSETSQGRRRGHLSLCFSLWNDVIQAPESMWQHDMYSNASARSGGGGMVSAVETVTKLFITNLYFGVSTKDVKIHI

SEQ ID NO: 162951 - protein, 79 aa, Triticum aestivum
  Clone ID: PAT_TA_57369.pep
RDWHHPPVISLTTLACMLRRAAAYLSHLLEIALHLGELLRCEGSVGGHVAVGCLHLSVQVDLMIVHIGLLIVKGRLSPL

SEQ ID NO: 162952 - protein, 158 aa, Triticum aestivum
  Clone ID: PAT_TA_57370.pep
ACCDSSRLSHEATIRWDMGQGEHERGIVEPGSTCPGRSSTPARLSMHQWWTGATKNILGGSQRNRRGDGFLWFDIQNYRCANDSSPLFLDAYAPAPVPQHSQRHRRRCCRSSHSGGLGSRYCCSSTRHRCCALQNHGRTPCECLRECVDAHQMFDGFP

SEQ ID NO: 162953 - protein, 155 aa, Triticum aestivum
  unsure (1)..(155): unsure at all Xaa locations
  Clone ID: PAT_TA_57371.pep
PSSSSSPPPLRHPPSPAMSXHKPPKAPKPSHPPKAKAPAHPPKSRVPCPPVYGPPKGHLPRTPVVGPPKGNAPHTPTPVVGPPKGHVPRPPVYSPPKGPITRPPVTAPPVVVGPPVTYPPITNPPPKGPTPRPPVTTPPVGVGPPVTYPPPPVIA

SEQ ID NO: 162954 - protein, 93 aa, Triticum aestivum
  Clone ID: PAT_TA_57372.pep
MEAAGSPYACWAESAPKRAPRSSPPPPPPQDRGERRHDAADPEDDREKPTHLRFLVSTTAAGCVIGGGGSTINDFQSQSVARIRLSRSHEFFP

SEQ ID NO: 162955 - protein, 56 aa, Triticum aestivum
  Clone ID: PAT_TA_57373.pep
PSPSSRVFWSSAGTEVNEKIYSPEAVETVFRVVLDRLLKEVEVLPVYHLELPHGDL

SEQ ID NO: 162956 - protein, 97 aa, Triticum aestivum
  unsure (1)..(97): unsure at all Xaa locations
  Clone ID: PAT_TA_57374.pep
VEGESFFGVGVWNIQRIGKKAMEQIAKGLEVDVSSXRKGNCGRKPKDINLEQIPTIPPNRRSTIRSLAWQLQCSPTTLHRKFMLKLIKRHTNSSHAS

SEQ ID NO: 162957 - protein, 106 aa, Triticum aestivum
  Clone ID: PAT_TA_57375.pep
QSLVFSWLTLDPGSGFPHTSRRRPDSLPSSDLWIGSTVPRIPTPFADSCSNTDALTPPPPGRHARPHAQQLPWPMMEQPRDPPCVAVLGEEARRLGRPEKTPSPTT

SEQ ID NO: 162958 - protein, 66 aa, Triticum aestivum
  Clone ID: PAT_TA_57376.pep
EYIYSSTFGTTWTSQSLRRNLSMLSNDLVRSVGGTVNRIDGSCLIDYEYTVLLPVHSRRCMGQGLA

SEQ ID NO: 162959 - protein, 158 aa, Triticum aestivum
  Clone ID: PAT_TA_57377.pep
PRLQACAASARFASSAATRPLGASLHARAVRSGFAAADLFVRTALVEMYAKSGRAELARAAFDEAPRRDVFLCNVMLAAYVARGEVAEARQVFDGMRDRDLVSWNTMIHGYAVRGDVGMAREIFDATSDRDAFSWSSMISAYAKGRRSKEALELGRYS

SEQ ID NO: 162960 - protein, 87 aa, Triticum aestivum
  Clone ID: PAT_TA_57378.pep
HSNRTWPQAFTNWEDLGERPLDAYLNLSTHYAASIPTLRAARAKIAERRHSAPCIDHCSQQLWNRPRSGRSGYDAPAIQAQLELRAG

SEQ ID NO: 162961 - protein, 170 aa, Triticum aestivum
  Clone ID: PAT_TA_57379.pep
APKRPVASLPIAMAEASRSSPPAYELQRRPLLPHGPFPLRSKAGDAKFLGVLFLCFISFTVQRNAKFLLVVFIFFIYGRCSSPVNFVAFHRPRARSTPPSPSISGNIAIVRIRSTTLVHLLHGFGLLPSGISVAGTGFAMIMTRERCYLFGVLLLLLLRSGDRFPVGSLG

SEQ ID NO: 162962 - protein, 91 aa, Triticum aestivum
  Clone ID: PAT_TA_57380.pep
RPFQFILSEMPIACLSGCLDLRHILNTTIYCVFTVFISSIIFSLICSQLKACFLSAQQPVRGTDMFISAKLPTSSRANVRKLKPAHHSISF

SEQ ID NO: 162963 - protein, 86 aa, Triticum aestivum
  Clone ID: PAT_TA_57381.pep
THKIYFPKYAQFNLNKSMLLYSRKNTPASTKIQKCKIRVTIQIGDTIECKTCQHRTLCPGVVFRNSSQIHHIVMGSNTINPWYLFY

SEQ ID NO: 162964 - protein, 135 aa, Triticum aestivum
  Clone ID: PAT_TA_57382.pep
IALKLSSSHLCSPPPYTSPTNTPPHAPQLRFQWSSSILVGMIWQQDSPSCSTVVTRKWKACWHQSPPIWIWSQSPDPKLSTVPLPIRLGVTRKRPRYPSSDRTRRILRHGSQLEVGNAGMQLSWELSLDDSWVRS

SEQ ID NO: 162965 - protein, 91 aa, Triticum aestivum
  unsure (1)..(91): unsure at all Xaa locations
  Clone ID: PAT_TA_57383.pep
LSASDLLSELASAVSDIXLASLSIQNLVPYQIDTISATNVLRCLNGHLDRVQTCVKIAADQETWDPISPQQLHGXSIVELSIYIDSEPGGI

SEQ ID NO: 162966 - protein, 90 aa, Triticum aestivum
  Clone ID: PAT_TA_57384.pep
GGGGGRMPGANQGKDRRGAKQQASDAPPPGGRREQKTEAGHARLEAEAGPGARRPATPQPLSTGSMHFLRGPCSTPQAGTGMVGEVDADA

SEQ ID NO: 162967 - protein, 128 aa, Triticum aestivum
  unsure (1)..(128): unsure at all Xaa locations
  Clone ID: PAT_TA_57385.pep
DEEEEEEEEDEEGAMRDRRHQHQHPHHHRHHYTTAPATAAPPHHLHLHGQAPQVLGSPAAAGCSPPSLMEAAAFSRPLLPPNSSLVSSPPPPXQAPPGFLLPQHQHPHRRRVDREREKERTLEAPGEA

SEQ ID NO: 162968 - protein, 135 aa, Triticum aestivum
  unsure (1)..(135): unsure at all Xaa locations
  Clone ID: PAT_TA_57386.pep
KKKKKKKKKKKKKKKKKKKKKKGRAVLKRSRFTNGGWRRKSFFLGYPNLISLAVFLKGGDGKNLGVPKINGFGENPLFARWXIFEKARPFRLSQHLPTFTGNWPPPCMGPLSGGGGGVPYRGIVTFGRALSPPPF

SEQ ID NO: 162969 - protein, 77 aa, Triticum aestivum
  Clone ID: PAT_TA_57387.pep
DKISRLARRDRRRAPAKPYREQGRDELLQGDRQQEDDTDRRTRGRSVPSPTATRDACGLPGAGGSGGESDEPQEYYT

SEQ ID NO: 162970 - protein, 165 aa, Triticum aestivum
  unsure (1)..(165): unsure at all Xaa locations
  Clone ID: PAT_TA_57388.pep
RYIEMKPVNQESNFEYTNKSGVDRRFCRAWFKEFPWIEYSVTKKSAFCFVCYLFKDKTKYPGGDAFVKNGFRNWNMXSRLKKHEGEVSSAHAEAQEKYDMFTTPQASFRESFASNTSQYKALYKQRLTWTLKCLRFLLHQGLXFXGHDEXXNLLXKGNFLWPFNW

SEQ ID NO: 162971 - protein, 57 aa, Triticum aestivum
  Clone ID: PAT_TA_57389.pep
GEPPREILLETLVILVRQAAPDSESAMFFCMYGSGGHNFTQVCSTVSLMTYMAIGYS

SEQ ID NO: 162972 - protein, 107 aa, Triticum aestivum
  Clone ID: PAT_TA_57390.pep
SSASISLSGPKFSAGYGMSLDEGSKISSTRILDASILHDSPSRFQKACYSEQSQQTSDTHLSLNLAPPRNRPGRSGSRGPYYPFPSAPPVRLSPRRHSRAIFAAPAR

SEQ ID NO: 162973 - protein, 63 aa, Triticum aestivum
  Clone ID: PAT_TA_57391.pep
LPLPERWRHDAPTVQLVPTKDLCLLLQLIRRGDLTLRVGLVRDLVPSKSESQKPTSLVNSFSA

SEQ ID NO: 162974 - protein, 57 aa, Triticum aestivum
  unsure (1)..(57): unsure at all Xaa locations
  Clone ID: PAT_TA_57392.pep
RPRGRAAIPLLLLLGTSLLFAGADAASHDEDEDRRGGRXLQRCVQRCQQDRPRYSHC

SEQ ID NO: 162975 - protein, 137 aa, Triticum aestivum
  Clone ID: PAT_TA_57393.pep
GDSAGAERPREPDPERDAGGSGAARRHRDGRAAGEIQRQAAAGTAALDISPSRPLHGSIEGQIGNRVGAAIDLRCSSVIRHHAVRLLGCMGRAKVQVGTGTSFVTGEIQRRGTARTAWQDTPRRRPLDGFNTELQQA

SEQ ID NO: 162976 - protein, 68 aa, Triticum aestivum
  Clone ID: PAT_TA_57394.pep
TSTPRGDPIAVHQSKLKIRDEEEELGRNERTIAPNLAPGPPAHRTSPPPRPTTSAEIPYIRRINHLRA

SEQ ID NO: 162977 - protein, 52 aa, Triticum aestivum
  Clone ID: PAT_TA_57395.pep
RAVTAGHALPPRAVQPVCPCHVPARRSDTRGIGAVFEVMMAIVSARFKARKL

SEQ ID NO: 162978 - protein, 224 aa, Triticum aestivum
  unsure (1)..(224): unsure at all Xaa locations
  Clone ID: PAT_TA_57396.pep
RIILARGGIVEGRGFPGENGTVTAKDCPKGLYGTFCKECPVGTYKNITGSSNSLCSPCPAYELPHRAIYMHIRGGVAETPCPYKCVSDRYRMPHCFTALEELIYTFGGPWFFGLLLSGLLVLLALVLSIARMKFAGTDEFPGPAPTQHGSQIDHSFPFLESLNEVLETNRAEESHCHVHRMFFMGPNTFSEPWHLPHTPXEQITDIVXRDAFNKFVDEINALPA

SEQ ID NO: 162979 - protein, 141 aa, Triticum aestivum
  unsure (1)..(141): unsure at all Xaa locations
  Clone ID: PAT_TA_57397.pep
YRRITLTLVRKMEDHPGHPISNYDFLSGNGCHTKKLVHKNYDQDSSSAKSGRSQQEASATSDSNLNEQHTSRPPSQSDNDNDHGKPDQHMIKPXLSLGNPETVAPPPMIDCSQSFAYVPYAADAYXGIFPGYASHAIXHXQ

SEQ ID NO: 162980 - protein, 59 aa, Triticum aestivum
  Clone ID: PAT_TA_57398.pep
VSPGPDTNPLVSSDYGEVMHDPGHRSSLRVHGSSMMKQGLRVRRRRSAYGISKHSAARG

SEQ ID NO: 162981 - protein, 46 aa, Triticum aestivum
  Clone ID: PAT_TA_57399.pep
CDDERRGQLERAGPAGARSDVAVPVPGHRRRRHEYGSCRGTPPSPP

SEQ ID NO: 162982 - protein, 85 aa, Triticum aestivum
  Clone ID: PAT_TA_57400.pep
EGSRISLVRILVASIVHDSPSPFRMLVITNLLSKQLIHISSLELAPSGDRHGRSGSRGPSSPFPSPPPFWPSPWRPCLPSSPAPA

SEQ ID NO: 162983 - protein, 49 aa, Triticum aestivum
  unsure (1)..(49): unsure at all Xaa locations
  Clone ID: PAT_TA_57401.pep
VYVHPFLVQIYKKYDICYDIFQNSWPLILXHSCVLLFFLEKYMSIDYYW

SEQ ID NO: 162984 - protein, 53 aa, Triticum aestivum
  Clone ID: PAT_TA_57402.pep
DLSPVLSICALARPKVMTLLLLWQLASGSKLMNYLSFTVFWGYVSALLLFVAF

SEQ ID NO: 162985 - protein, 193 aa, Triticum aestivum
  Clone ID: PAT_TA_57403.pep
LYELSADGNMLSGPLPSSLGSLAELGRLVLHNNSLSGQLLRGIRSWKQLSELNLADNGFTGAIPPELGDLPVLNYLDLSGNRLTGQVPAQLENLKLNQFNVSNNQLSGQLPPQYATEAYRSSFLGNPGLCGDIAGLCSASQGSSGNHSAIIWMMRSIFIFAAVVLVAGVAWFYWRYRSFNKAKLKAERSKWTL

SEQ ID NO: 162986 - protein, 50 aa, Triticum aestivum
  unsure (1)..(50): unsure at all Xaa locations
  Clone ID: PAT_TA_57404.pep
GRDFEAPDGERLPLAAKELSRYDLYPQNLKPNHNGRXVVECRDGEHIIYI

SEQ ID NO: 162987 - protein, 77 aa, Triticum aestivum
  Clone ID: PAT_TA_57405.pep
LPDQNGALVLMNVQAAGASWRGHSRETERVRDANLPNDPRTMAEAACATTIREPYGRGGRQGCCVAPPLCGSQPRQS

SEQ ID NO: 162988 - protein, 73 aa, Triticum aestivum
  Clone ID: PAT_TA_57406.pep
FGACSKFIELSGAVLQNLRLANWQLAQANSQMLAVSYPQTICKKLHCPRFITVDLIVFITRLISVSKCLLRRS

SEQ ID NO: 162989 - protein, 157 aa, Triticum aestivum
  Clone ID: PAT_TA_57407.pep
MELNNDAHDRVYITLPKKHHVLRKVGDCRHCGALRFQYEGPAFCCRKGKVDVFTPDVCEELKQLFTSLDDEDAKYFRENIRYFNSHFSFTSLGVTLDRRVSTAAGTGVYTFRACGGLYHALDDLESGDNGPRHLQLYIYDTDENLFHRVKRSPNHRL

SEQ ID NO: 162990 - protein, 85 aa, Triticum aestivum
  Clone ID: PAT_TA_57408.pep
VLSIESKDEQSQAQILSAALEIAEDDAQDADSKYRALVAIGSLMLNGLVKSIALDLDVKSVTSSAKASMDSKIAEVGADIELLTR

SEQ ID NO: 162991 - protein, 72 aa, Triticum aestivum
  Clone ID: PAT_TA_57409.pep
TPAREFNFGGPFKKILRCLPGFVNFGSFKRPPLFFFFFFFFFFFFFFFFFFFFFFFFFFFFFFFFFFFFFFF

SEQ ID NO: 162992 - protein, 64 aa, Triticum aestivum
  Clone ID: PAT_TA_57410.pep
DARPARELLMLMLGRSDYDVDMISEDTGYVRRWAMAGIEMERTGLGPTLRRVRMDRRRWRREAG

SEQ ID NO: 162993 - protein, 61 aa, Triticum aestivum
  Clone ID: PAT_TA_57411.pep
HAYQFRQPVSRSYHTGSYGSCRSAIRIRSVSLVRHLSRSCPCHSVCDRAEASAPLCPSSYS

SEQ ID NO: 162994 - protein, 69 aa, Triticum aestivum
  unsure (1)..(69): unsure at all Xaa locations
  Clone ID: PAT_TA_57412.pep
MFYAGYGYHASNFEQTYRCYPASFFDKPHLEGGDXVIMPPSALDRLASLHIEYPMLFELHNGVTDRIYT

SEQ ID NO: 162995 - protein, 75 aa, Triticum aestivum
  Clone ID: PAT_TA_57413.pep
KKKKKKKKKKKKKKKKKKKKKKKKKKKKKKKKKKKKKKKKKKGGGRLKGPNFTPPAWQSKIFFKGPPKLNSWAGF

SEQ ID NO: 162996 - protein, 177 aa, Triticum aestivum
  unsure (1)..(177): unsure at all Xaa locations
  Clone ID: PAT_TA_57414.pep
ILSCAKTERSXPFLRPTLLLLTPAPWTTVVARAPPEVAAARVEMEAGCSLPCIAPEPQPPRSSQSRNGSSRRQPPGRARPRRRRPTPADDPLPSAATPPSPLSSLFLPPLLSFLLSPSHLLSLLGFVREEGIEEAGDDETPPRMKRRGGGAEGERGRRGGGAEGKKRDEDEAAAAGE

SEQ ID NO: 162997 - protein, 188 aa, Triticum aestivum
  unsure (1)..(188): unsure at all Xaa locations
  Clone ID: PAT_TA_57415.pep
IGVIEEEGLLDEEDQRRPMPKRCKYCLIFVGGFAVLFTFFALVLWGASRSQKPQIAMKSITFENFIIQAGTDASLVPTDMATTNATVKFTYKNTGTFFGIHVTADPFTLSYSQLNLAAGDLKKFYQGRSGRRTASVNVKGNKVPLYGSGPTLMAQPAXGKGGAGKVIPVPMVLRTTVRSQAYVLGALV

SEQ ID NO: 162998 - protein, 87 aa, Triticum aestivum
  unsure (1)..(87): unsure at all Xaa locations
  Clone ID: PAT_TA_57416.pep
YKCTAAVACEARKPLSMXEVEVAPPQALXVRVKILFTSLCHTDVYFWEAKGQTPMFPRIFGHEAGGIVESVAEGVTAACPCWPCPSC

SEQ ID NO: 162999 - protein, 106 aa, Triticum aestivum
  Clone ID: PAT_TA_57417.pep
LVSLCQSFSKELSWTANSFLPVVVSPLRKANKVNMDIERDNIPGSFMELLNMVEQPMSNFNQENTMNSVPEESSCFSDRPYCSEDTDVLSRPNLRVDTYDYVDDSN

SEQ ID NO: 163000 - protein, 33 aa, Triticum aestivum
  Clone ID: PAT_TA_57418.pep
KVALRQALPSTHAVNSRPGSLLRGIIEELSRRS

SEQ ID NO: 163001 - protein, 75 aa, Triticum aestivum
  Clone ID: PAT_TA_57419.pep
FWGPQKKKKNFPPPGRKIGFFKRGPPFFFFFFFFFFFFFFFFFFFFFFFFFFFFFFFFFFFFFFFFFFFPKLEIF

SEQ ID NO: 163002 - protein, 109 aa, Triticum aestivum
  Clone ID: PAT_TA_57420.pep
EIASSRGSSNLQVVCFEINAERNERVWLAGRNNVIAKLDSPAQELTFGRPAREVQEVFRAKDQQDEGFVAGPEQQSHEQEQERGDRRRGDRGRGDDAVGAFLRMATGAF

SEQ ID NO: 163003 - protein, 191 aa, Triticum aestivum
  unsure (1)..(191): unsure at all Xaa locations
  Clone ID: PAT_TA_57421.pep
VDGQSKTLTRIGVEENPKEITQEQEKEFDNDTVESLKNSINSLLCSPAIIQSKEGQKEVPVEGMTEKHCLQDVGLINERESLSVGAAMEIQGVDDHRTLDMHEEVSIKQIDECGIIFTNKETQILEDSHMVGDGSNDLVLMEXDETWSTIEIQNQEALDLDKQQTTEERQDLGPTIENKKMAMLGRCHYAW

SEQ ID NO: 163004 - protein, 196 aa, Triticum aestivum
  unsure (1)..(196): unsure at all Xaa locations
  Clone ID: PAT_TA_57422.pep
RRWGRSKKKSLFPAKKXAGPSXDESQPWPSQHGYHRFQHFXCWLQLHRPTVVAPPHRGSSISTANTHRWLVVAAPLVAPSSAACSTPRSPSPTQKRRASAGGAVATVKNDDVHDMATSSPGRPIVTSASWLCNSSLCSSSEGCGAGAVNSLFSSGGRGGRSRERKEMSKIGAAAPMADDGKRSGGREMREEEIRMG

SEQ ID NO: 163005 - protein, 85 aa, Triticum aestivum
  unsure (1)..(85): unsure at all Xaa locations
  Clone ID: PAT_TA_57423.pep
GRSNEALESLXQIGPDPLERIASDALRHVALXCTRLRRLHLSDRTEADCDAIGALARYCPLLEDGDLLDCGTEDEANLDDNHSLE

SEQ ID NO: 163006 - protein, 144 aa, Triticum aestivum
  unsure (1)..(144): unsure at all Xaa locations
  Clone ID: PAT_TA_57424.pep
PSVRLVFSAPPVGAGPAVDVELCNAMSSLSGSMCCKMAKKXKDPLSSVGLAISQKPLDFSCYEKRXEERPPFFFDADDADAAWSVPLQACVPPLPVGPPVRGSEWPETVPLWLVKTPLWVGGXRAGVYGKPADEDFEADYAHCK

SEQ ID NO: 163007 - protein, 65 aa, Triticum aestivum
  unsure (1)..(65): unsure at all Xaa locations
  Clone ID: PAT_TA_57425.pep
VTRGSXXRPHKKKKQQTLPPPAWSGREATTMSMDQSPRTLSIVSEDTTSRVMVLPARVLTNICIX

SEQ ID NO: 163008 - protein, 192 aa, Triticum aestivum
  Clone ID: PAT_TA_57426.pep
MATPRTMRAVQYDKYGGGAEGLKHVEVPVPSPKKGEVLLKMEAASINPIDWKIQKGMLRPFLPGKFPFTPVGDLAGEVVELGSGVTNFKPGDKVISISFPSGGGLAEYAVAPASLTVARPPEVSAVEGACLPAAGGSALQLLKLAGVSFDGTSGTTGPKNVLVTAAFGGVGHYAVQLAKLAGLHVTATCGAR

SEQ ID NO: 163009 - protein, 41 aa, Triticum aestivum
  Clone ID: PAT_TA_57427.pep
ASIIWTSCSRYPSARTPPPSVSHRARLGCRTLASAERAIVK

SEQ ID NO: 163010 - protein, 149 aa, Triticum aestivum
  Clone ID: PAT_TA_57428.pep
AIFFYGALIRQMKQMVEIYIRLAELETRKEDTNKKISLPREFRSICQLELAKVPVVTATIPVDPNCRYEEGTFPHFSGLVDSITIMNGINAPKVIQCIGSDGNRYRQLAKSGNDDLRQDAVMEQFFSLVNMFLQNHRDTSERRLRIRTY

SEQ ID NO: 163011 - protein, 175 aa, Triticum aestivum
  unsure (1)..(175): unsure at all Xaa locations
  Clone ID: PAT_TA_57429.pep
KVYAAKLKEEEDISKSIMDREKRLSILYQKQGRATQFKNEAARDEWLRKEIHDLERVLLSNRKQESLLQDESQKLKDEINKLTNHIESRRSESSKLEAVLADKQKNHNDFTKQKNALQDERKSXWKEETSVTAEIDRLKEDLVKAQKSLDPCTPGGYQEXGLISVSPIIRDHGIG

SEQ ID NO: 163012 - protein, 129 aa, Triticum aestivum
  Clone ID: PAT_TA_57430.pep
GIKSAVPKTIMQLMNVEGLTRENVASHLQKYRLYVKRMQGLSNEGPSASDHIFASTPVPPSLREPQVPHAAAMAPAMYHHHPAPMGGVAAGHGGYYQQQHSGHAVYNGYGGHGHGGGVSTYPHYHHGDQ

SEQ ID NO: 163013 - protein, 42 aa, Triticum aestivum
  Clone ID: PAT_TA_57431.pep
VPQPQHFLDRFQFAKATRSVLTTKKPTKRWQSSTTRTTTYTC

SEQ ID NO: 163014 - protein, 82 aa, Triticum aestivum
  Clone ID: PAT_TA_57432.pep
MSILSWAIAKNYGAFLEKDGAGFRGQVKLTGLPNGDIDLTHSVWTYQVKHWNFQPHFYLVHTLMQACRLCIEYHRCYFQGLP

SEQ ID NO: 163015 - protein, 214 aa, Triticum aestivum
  unsure (1)..(214): unsure at all Xaa locations
  Clone ID: PAT_TA_57433.pep
LVKVEDIIEAIEDAGFDAEILQISAVXQXKSQKTLSAQFRIGGMTCANCVNSVEGIXRKXPGIKGAVVALATSLGEVEYDPSTISKDEIVQAIEDAGFEAAFLQSSEQDKILLGLTGVHTERDADVLHDILKKMDGLRQFAVNTTLSEVEIVFDPEAVGLRSIVDAIEMGSNGRFKSHVQNPYSRGASNDAHEASKMLHLLRSSLFLSIPVVHL

SEQ ID NO: 163016 - protein, 46 aa, Triticum aestivum
  Clone ID: PAT_TA_57434.pep
PRVRGHIVKHKQPCNHKPCRLLFSYPNFANISFMFLNLFYVYFSAP

SEQ ID NO: 163017 - protein, 51 aa, Triticum aestivum
  Clone ID: PAT_TA_57435.pep
DGHDSLGGCCTARTGAAGAVRRVRHQAGGNSLWQVWPWRRGVQSVRRRRWV

SEQ ID NO: 163018 - protein, 54 aa, Triticum aestivum
  Clone ID: PAT_TA_57436.pep
HQSRLHSPIISALPVCLFSACHNLLMGVRAFPWLISLHGSMLPFNFSHTARIRE

SEQ ID NO: 163019 - protein, 59 aa, Triticum aestivum
  Clone ID: PAT_TA_57437.pep
PWNPYFLGSFLKIFMFIPLEFYCLDFRDATYTKCDNVFSAMILSALLMISTFKVGSCVH

SEQ ID NO: 163020 - protein, 43 aa, Triticum aestivum
  Clone ID: PAT_TA_57438.pep
CLVGQLLSVPFVYGRSRMTFTPSSRRVHSLASLAMAPGCPVSA

SEQ ID NO: 163021 - protein, 42 aa, Triticum aestivum
  Clone ID: PAT_TA_57439.pep
VPQPQHFLDRFQFAKATRSVLTTKKPTKRWQSSTTRTTTSTC

SEQ ID NO: 163022 - protein, 148 aa, Triticum aestivum
  unsure (1)..(148): unsure at all Xaa locations
  Clone ID: PAT_TA_57440.pep
WKNDQNVFMGSNKYNYHGMSNTGERFLAGVYHHLPSILAFTAPHPHSYDRIQPNTFTGAYLCWGKENREAPLRTSCPPGVPPDFVSNFEIRSFDGCANPHLGLAAIVAAGIDGLRRGLKLPPPSDLVPXDCASHERPPHDLLGSVEAL

SEQ ID NO: 163023 - protein, 136 aa, Triticum aestivum
  Clone ID: PAT_TA_57441.pep
TENRRGYYRAKAQCTPGNGDAENGDVRATKLVFRELYGHPEVPIAVPEEGTTVLFNRSPRSQAFGLLQGQRRILAINAAHCSHNLSELLLTAVAVAHFCLSKIYWNGWRPSYNLNMNLKSQVLGHQGSEFLHKSFV

SEQ ID NO: 163024 - protein, 94 aa, Triticum aestivum
  unsure (1)..(94): unsure at all Xaa locations
  Clone ID: PAT_TA_57442.pep
MADVEYRCFVGGLAWATDDQXSLQNAFSKYGDVIGSKIITDRGTGRSPGLGGAPLGSPYALRRAIAAFFRQGLGGAGLPRSVSPSGRSGGGWGG

SEQ ID NO: 163025 - protein, 87 aa, Triticum aestivum
  Clone ID: PAT_TA_57443.pep
SSTAWELAELFVLRPVLAISFALSFILLSWYVAWRTVLVHVPLVQEVAGLRPKKKPAKPKPPNRGRIGRFYQSQAEAQRDTKLEGTS

SEQ ID NO: 163026 - protein, 86 aa, Triticum aestivum
  Clone ID: PAT_TA_57444.pep
DSTPSRKKLKKKKKKKKKKKKKKKKKKKKKKKKKKKKKKKKKKKKKKKKKKKKRGAPFKGPIFPPPGWEGLVFFLGPLILFSGPGF

SEQ ID NO: 163027 - protein, 88 aa, Triticum aestivum
  Clone ID: PAT_TA_57445.pep
MTGKKRKAEAARLDETDRAMYGAFRGAANSLSQLYTLAMGGQKLSFQAGERHALEKLSEWILRQPENGLRLSVGDIASPVQPEIPFGG

SEQ ID NO: 163028 - protein, 81 aa, Triticum aestivum
  Clone ID: PAT_TA_57446.pep
SHILLEKKKKKKKKKKKKKKKKKKKKKKKKKKKKKKKKKKKKKKKKKKKAPPFKDPNFTPPSLQGKIFFMGPPNLIPWPAF

SEQ ID NO: 163029 - protein, 209 aa, Triticum aestivum
  unsure (1)..(209): unsure at all Xaa locations
  Clone ID: PAT_TA_57447.pep
ALESEYVSSNLHTGLTYIWFKQRGKPAVEAANIFYYLTYEGAVDLENMDDMLQKSAIEDQIANFGQTPIQIFRKKHPRRGPPIPIAHPLYFAPQSITVTSVVPSAISSSSSVLFIGLLDSNIVLMGEELILSVKLWLTTQLQSGGNFTFSGSLEPFFGIGSDVISPRKVATFLAENVELGRQCLAAVPIPGDDYLIXCGXWENSFQIIF

SEQ ID NO: 163030 - protein, 27 aa, Triticum aestivum
  Clone ID: PAT_TA_57448.pep
RVSTAVQFSSNFAEQSFNVDSSCVSRF

SEQ ID NO: 163031 - protein, 117 aa, Triticum aestivum
  unsure (1)..(117): unsure at all Xaa locations
  Clone ID: PAT_TA_57449.pep
GRPRQARQGERPARGTRPPPRGPHGPARGPPPPQAGNTDGKRGPTGRPPRXERPPPKEGRPPPRKKAGPHRDPPPPPPGTPAGPTKPKGATPQNSERPRQPPKARHANPPNPPSLIF

SEQ ID NO: 163032 - protein, 100 aa, Triticum aestivum
  Clone ID: PAT_TA_57450.pep
MSLRQLLGWSDGEVMRPESKPCSRLMRHTAGIFSVGGGLAFWVLCRLHYGPRITVPRSLMWASCGAIGTIATAAMLVRLFSPECEPQNISAFDRPEYKPA

SEQ ID NO: 163033 - protein, 78 aa, Triticum aestivum
  unsure (1)..(78): unsure at all Xaa locations
  Clone ID: PAT_TA_57451.pep
MARTIHTARKSTGGKAPMKHLATKAARKSAPAIGGVKIPXMFRPGTVALREIXKYHMITELLIXKLXXHRLXRDIAHD

SEQ ID NO: 163034 - protein, 190 aa, Triticum aestivum
  Clone ID: PAT_TA_57452.pep
MGPSRGSLVATVAVLHLLLLAPSMAAAFNYADALAKSIIFFEGQRSGKLPPGNRMPWRADSGLADGAQYNVDLVGGYYDAGDNLKFGLPMAFSTTMLAWSVADFGAGDDDYSFSWDDKRVGTKVLLSGGSCGASCRGCSSTRLTPTATSARSPGRAAFRLASTRRGGLILQEGESNMQYVTRGTFLLLAY

SEQ ID NO: 163035 - protein, 64 aa, Triticum aestivum
  Clone ID: PAT_TA_57453.pep
KNGRPFLFFFFFFFFFFLFFFFFYFFFFFFFKLNCSPCRKFLMRCLRAARITKVYQPDCTIRVT

SEQ ID NO: 163036 - protein, 45 aa, Triticum aestivum
  unsure (1)..(45): unsure at all Xaa locations
  Clone ID: PAT_TA_57454.pep
RVXMXLRVCPQSRRAWLXDRLWNLPYWVRSQRRRAQCSSCAXVWA

SEQ ID NO: 163037 - protein, 35 aa, Triticum aestivum
  unsure (1)..(35): unsure at all Xaa locations
  Clone ID: PAT_TA_57455.pep
YIYLKARAXXDHSSACIACRHNSIIYLTLDSSXWI

SEQ ID NO: 163038 - protein, 129 aa, Triticum aestivum
  unsure (1)..(129): unsure at all Xaa locations
  Clone ID: PAT_TA_57456.pep
MADVEYRCFVGGLAWATDDQSLQNAFSKYGDVIDSKIITDRETGRSRGFGFVTFASDEAMRQAIEAXIGQDLDGRIISGLEAQSRRSGGGGGGGFGGGGGGFGGLRRVGGGGGGXGGGGGGSGAGGAGG

SEQ ID NO: 163039 - protein, 66 aa, Triticum aestivum
  unsure (1)..(66): unsure at all Xaa locations
  Clone ID: PAT_TA_57457.pep
MAARGLRGVRDDLSELGRHLLDIACLLHPLLNPAHTDSPPSTPTHARPHRRXSPXXXPXXPAXPXP

SEQ ID NO: 163040 - protein, 54 aa, Triticum aestivum
  Clone ID: PAT_TA_57458.pep
PLSFYFPTPPANPIPARLRPPPRSPWRGLLPSRWCCFPLRTGRSRWGPYSPSTR

SEQ ID NO: 163041 - protein, 50 aa, Triticum aestivum
  Clone ID: PAT_TA_57459.pep
PSARASGTPRPPPRTAPAPPPPPPHEAPPLSVRPWRLSSESAADDAPDAW

SEQ ID NO: 163042 - protein, 80 aa, Triticum aestivum
  unsure (1)..(80): unsure at all Xaa locations
  Clone ID: PAT_TA_57460.pep
MPAGXGLRSRTRDLFARPFRXMGFLPLPSCLRXXXVGEHVGVGXVGAVXLGXPRLFFLGRSGRVCVAPVRAVGGGVLLPG

SEQ ID NO: 163043 - protein, 125 aa, Triticum aestivum
  Clone ID: PAT_TA_57461.pep
MASTTISSCAYQAVQGAHRLKICQFSHGIVGMDVNADGFIRSSTFRVGGFDWAILYYPEGYGDDSEGFISVFVEFMSKYGQAPAVVDIRLIDQVTGKPKSLLSSVFFELDEEPFRFESDSFAERS

SEQ ID NO: 163044 - protein, 110 aa, Triticum aestivum
  Clone ID: PAT_TA_57462.pep
RPRAAGRHQVGRVKQRDRPLATGHIGRLNGRERPDHRPWALGQHAAKAVMVGAVTGASRQGVACSAFCTASRQLQQDRPPYRDTEASPCIASSPRMLCTAPGGGLGQGVV

SEQ ID NO: 163045 - protein, 82 aa, Triticum aestivum
  unsure (1)..(82): unsure at all Xaa locations
  Clone ID: PAT_TA_57463.pep
MSGAHGAHPVGETMPTTYGSVGGGDIRTRTDLMSRDDQGIIHIEMVQDXVEDAASRMVDDSAFAAMIDPGQAGDAGASGTGA

SEQ ID NO: 163046 - protein, 71 aa, Triticum aestivum
  Clone ID: PAT_TA_57464.pep
MASRSCTFLEILLAIILPPLGVFLHYGCCSMEFCICLLLTILGYIPGIIYAVYMLVALGSEERDRDYNTLA

SEQ ID NO: 163047 - protein, 58 aa, Triticum aestivum
  unsure (1)..(58): unsure at all Xaa locations
  Clone ID: PAT_TA_57465.pep
RARSRLLLPEKLTLHIHYIRENSSLHCIAIRXHHRRHHXHCIILCTHEHFVLVSVVES

SEQ ID NO: 163048 - protein, 60 aa, Triticum aestivum
  Clone ID: PAT_TA_57466.pep
GTPPPPHKTNTETHTTARTTTQQARQAPSPEHAKAAARHQQLGTPRAKGTAPGTICSCDL

SEQ ID NO: 163049 - protein, 176 aa, Triticum aestivum
  unsure (1)..(176): unsure at all Xaa locations
  Clone ID: PAT_TA_57467.pep
GREPGPPSTPLPYPPPPPRACDTTCPXPSPSPPRPHSSARPPRXRSPHPSPPAPTCAPHRRSTPSTSRAASRPXPCPRAPITKPRPRAKSLPPPRPSTPAFGWIRRPLQIAPRCAPPPPPPRAESAAPSAPRFLTVWQRAGLGSRPGAEEGTSERHSDLCPCGVPRWELRLVLLEL

SEQ ID NO: 163050 - protein, 163 aa, Triticum aestivum
  Clone ID: PAT_TA_57468.pep
GGEIEEPERPHLPPQRHLALRPLPTLREVPAERFPAAFREAAGVPMTVPAAAATCPPLAHGQPASREPELLQASDVMAEQPAWAAPAQQAFNFDITSEEANAGLSLLDLRGNNPASEAEPMDGIEWPSTEHSLSLIDAVEQIENSARGDHEMPDVVEVRITTG

SEQ ID NO: 163051 - protein, 242 aa, Triticum aestivum
  unsure (1)..(242): unsure at all Xaa locations
  Clone ID: PAT_TA_57469.pep
KKKKKKKKKKKKKKKKKKKKKKKKKKKKKKKKKRGGPPFFFFLNKKPPWKKAFTGIKPPPGDRKGPFLPTKWKFGPKTPPNPFKAKGSVLYWPNPPRGQGPPPLLKPPGGPPGPKTPPPPPRGPRXGNPPPKPQKGGPTQKPRVKKEPXGLWGGPPPGIKTPHSLPRGNPSAGGAPGSPGKKAPPGGGPPPPKIPKGKTPPPGGARVKRPAGGGANTSFEKGGGPRGGGPGGGPPPLWGGPG

SEQ ID NO: 163052 - protein, 215 aa, Triticum aestivum
  Clone ID: PAT_TA_57470.pep
ASYTYSQGSFPELPELELELSPAAQEPGCGSRHIRRAVSPGKTNNPATEQSLHMAATNLIKSSEQHIGEGSICFSHRGNDRHLLTIISALGSPGASTVAVAGTAAAAMMPLLPMRSMTRAVVCFSRGSTSSGTAILRARRHLSWLSDLPPLVMTAAVVFGWASMPAVAAGISKLSAFSSLAATGIVFSWASPPTVAPPDISRLSASSSLAVMTAV

SEQ ID NO: 163053 - protein, 73 aa, Triticum aestivum
  Clone ID: PAT_TA_57471.pep
NPAHEIKFGGPKKKVLPCQPRDVKLGPLKRPPLFFFFFFFFFFFFFFFFFFFFFFFFFFFFFFFFFFFFFFFF

SEQ ID NO: 163054 - protein, 34 aa, Triticum aestivum
  Clone ID: PAT_TA_57472.pep
PCSPQAPRIWHHIRKQRSKPRVLVRRTRITISLN

SEQ ID NO: 163055 - protein, 72 aa, Triticum aestivum
  unsure (1)..(72): unsure at all Xaa locations
  Clone ID: PAT_TA_57473.pep
RPRGGRXRRPGEXRRRRGRSRRRRAGRRRHLPRGRCPAPEAELELGLLPLCLAPKNGGRRSLSAFEVVRSEK

SEQ ID NO: 163056 - protein, 43 aa, Triticum aestivum
  Clone ID: PAT_TA_57474.pep
RTDNSLGWLYKHPSHGVLATIQNIGGKINIKTLPQKCSKSSKF

SEQ ID NO: 163057 - protein, 96 aa, Triticum aestivum
  Clone ID: PAT_TA_57475.pep
RGWATFGIISCIFIVFSSLLCCGGFIYRSRVEHQDGLHALPGMTTVSAFLDAVGRPRCYLRAGDPSGNHSSQVSWENTSVTTPAAQRTNDGRYGTL

SEQ ID NO: 163058 - protein, 128 aa, Triticum aestivum
  unsure (1)..(128): unsure at all Xaa locations
  Clone ID: PAT_TA_57476.pep
HPRPRRESAGRVHGRPPSFGSPAYSPTLSLRVAGLGCSASRDFFRSSSGVLWCRSARVSWFFFGCSAIWSAITLSHILLCSRFDVGFASDRTSTLRSCCHCRHYLDSLACVWNRPMXLSRWGLESPPP

SEQ ID NO: 163059 - protein, 59 aa, Triticum aestivum
  unsure (1)..(59): unsure at all Xaa locations
  Clone ID: PAT_TA_57477.pep
EKDKEIILRPLNMADLKEAKNQVAASFAAEGXIMGELKQWNDLYGEGGSRKKEQLTYFL

SEQ ID NO: 163060 - protein, 41 aa, Triticum aestivum
  Clone ID: PAT_TA_57478.pep
ADVNSFFLLGGHLYIHIHLGPVVLHTVGDLGNNPWALSQSL

SEQ ID NO: 163061 - protein, 61 aa, Triticum aestivum
  Clone ID: PAT_TA_57479.pep
KENNLCAKKKKKKKKKKKKKKKKKKKKKKKKKKKKKKKKFKKNKNKKKKKKKRGPLLKAQL

SEQ ID NO: 163062 - protein, 102 aa, Triticum aestivum
  unsure (1)..(102): unsure at all Xaa locations
  Clone ID: PAT_TA_57480.pep
NGGDGSDGTRPPGGGATKGAXSSSGGXXXXDAHPCHLRASPVPRADASTRRLLVHVVPPVDADTEQCRQYKHRQHQPRQTQPRSRHGQRVQQTRLGKLQEAG

SEQ ID NO: 163063 - protein, 130 aa, Triticum aestivum
  unsure (1)..(130): unsure at all Xaa locations
  Clone ID: PAT_TA_57481.pep
KRGNGKNPGVPKLNRFEKNPLLPSGGIRKKARPDPPSKNLPTLNGKWNPPFRGPLSPGGGGVTPRGTVKFARALTPALLVFFPFFLKNLAGFPRKVLNGGPPLRSQLRVLRPLAPKKLVXGDGPRKGPPP

SEQ ID NO: 163064 - protein, 50 aa, Triticum aestivum
  Clone ID: PAT_TA_57482.pep
KSTIISHHITHLPSLHNTKKSSQEYISLHRNIAGTKGIYNKKMTKHLLLS

SEQ ID NO: 163065 - protein, 46 aa, Triticum aestivum
  Clone ID: PAT_TA_57483.pep
KRRPNKMTSLFLYIRSFFIAFSIFFIFFFFFSFFPFFFFFFFFLNF

SEQ ID NO: 163066 - protein, 98 aa, Triticum aestivum
  Clone ID: PAT_TA_57484.pep
SHYVAAWSPDEPPAACCRLFRRRTVISWRRSRSGEPKQLRSCWSWITQSKHCCILYVGFVCFLFRTRRLCMADSVCDVPFANVNMHGMFKFHVVFLMT

SEQ ID NO: 163067 - protein, 84 aa, Triticum aestivum
  Clone ID: PAT_TA_57485.pep
SFFSLPGRLSVRGRRGSAPHRPGGGLLLRITPPYLASKKGPRASRPCNPQHKRTSILIRAARCCGAYVFDLCHQAVPCPYLSSI

SEQ ID NO: 163068 - protein, 87 aa, Triticum aestivum
  unsure (1)..(87): unsure at all Xaa locations
  Clone ID: PAT_TA_57486.pep
GLFVSDXDLFTNATTRPIVERFARSQRDFFDQFGVSMVKMGQIKVLTGDQGQVRRNCSARNPGTADGLQWSSLVQTVVDATAESLGL

SEQ ID NO: 163069 - protein, 178 aa, Triticum aestivum
  unsure (1)..(178): unsure at all Xaa locations
  Clone ID: PAT_TA_57487.pep
MGNVVHESTLKAVFYAQEEVTHEIISATKKVDALGFGNRLVCLDAHPTETWILTCKFFGDVHMWDLVSQEKKALCSFHVYENGTRGVSATVKFLKFIARKQWFLAGADDGFIHVCTYRTEIVQQITSFRAGSSSVTALTIHPTQPYVAXSXAYDSPIRLWDWXEEAWQCTRTFDDEHS

SEQ ID NO: 163070 - protein, 115 aa, Triticum aestivum
  Clone ID: PAT_TA_57488.pep
AAASGRGPPPAGSSSILVHNQAPPPPARPPGRLPTAPQVKSAGSPPKASDSDVQFDETIPSPSHLLVSRTPWKRFMNQFNFCLCCRQRHPISSACVKDRGPGGAAPLRVQWLLRH

SEQ ID NO: 163071 - protein, 60 aa, Triticum aestivum
  Clone ID: PAT_TA_57489.pep
SPIIQRLISDCYCVNFCKMFSKFCQILLCHDPTESDDFWICEVYNQSAVFTIWNADDHFS

SEQ ID NO: 163072 - protein, 125 aa, Triticum aestivum
  unsure (1)..(125): unsure at all Xaa locations
  Clone ID: PAT_TA_57490.pep
IEEGLKIFKYDWTSVWKFVVPXRDPSLLQRQWRVANGVQRSYSKSEALKAKRRTYEAKRRQLKASMADSQVGRQQETDNDAFEDVENDDDDXMMVMADDPYVNEAFLADTENRSMIMMHTCASPQ

SEQ ID NO: 163073 - protein, 135 aa, Triticum aestivum
  unsure (1)..(135): unsure at all Xaa locations
  Clone ID: PAT_TA_57491.pep
MAVGKNKRISKGRKGSKKKAVDPFTKKQWYDIKAPLLFTSRNVGKTLVSRTQGTKIASEGLKHRVFEVSLADLQIDEDQAYRKIRLRAEDVQGMNVLTNFWGMDFTTDKLRSLVRKWXTLXEAHVXVVTTGXFLL

SEQ ID NO: 163074 - protein, 112 aa, Triticum aestivum
  Clone ID: PAT_TA_57492.pep
KKKKKKKKKKKKKRKERFKKNKNLTTLHCASRPPFFGGPLVSLSLARGVPPLCWGNPGASPGVSVWVALPLFPPGGLILMAPPGPPFLPLGPPCGRWGPPLPAPVYAAWRGG

SEQ ID NO: 163075 - protein, 100 aa, Triticum aestivum
  Clone ID: PAT_TA_57493.pep
FRAVLRRPVSGGPRCRWSTPWDFPIHHARCRQGQEGTLASSTSSPRMMPLLHQDRASNPHLLSISPISTSPFLNKILLLRQIVHEQIYFLFVNWYPSKHK

SEQ ID NO: 163076 - protein, 91 aa, Triticum aestivum
  Clone ID: PAT_TA_57494.pep
KKKKKKKKKKKKKKKKKKKKKKKKKKKKKKKKKKKKKKKKKKGRPFKKTKPNKPGNEKKNLFKRAPKIKLTARVLKTAKRKKPGRTQIKSP

SEQ ID NO: 163077 - protein, 71 aa, Triticum aestivum
  Clone ID: PAT_TA_57495.pep
HNRTHKWHSTGESARGGTHATKLGKVRIDDNYVEDSSPSPPIILIGVFDLQSDYIWLPPRQSATRSAISEF

SEQ ID NO: 163078 - protein, 145 aa, Triticum aestivum
  Clone ID: PAT_TA_57496.pep
ASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPMMPAGRCEHDDEEDKQASTITTSSPPPSVSSPAAACARGRAR

SEQ ID NO: 163079 - protein, 141 aa, Triticum aestivum
  unsure (1)..(141): unsure at all Xaa locations
  Clone ID: PAT_TA_57497.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVGVKTPGXYLLRVFAVG

SEQ ID NO: 163080 - protein, 199 aa, Triticum aestivum
  Clone ID: PAT_TA_57498.pep
GSHFFFPGLARYFFFFGAPYFNFRGRVLKRGGGENPGGPPFYSLGKNSPFPRGGFWEKAPPGSPFQNLGPPFGEWDPPLLGPFWPGGGGVSPRGARFFCRALSPRPFGFFPFFFARVGGFSPGCFIWGPPFGAPFLGFWALFPQKFFWGGGPPWGPPPPVKRCFPPLRGGAPLLFLGALFSLWGPPPPPFLGFFFLFFW

SEQ ID NO: 163081 - protein, 56 aa, Triticum aestivum
  Clone ID: PAT_TA_57499.pep
WDALFCGELSPVSAAITTQVTAFIASTLWSTAFGFLNFFLATFVTFPRKALNGGLP

SEQ ID NO: 163082 - protein, 94 aa, Triticum aestivum
  Clone ID: PAT_TA_57500.pep
MATEKKKKKKKKKKKKKKKKKKKKKKKKKKKKKKKKKKKKKKKKKGGPFKKTKFKYPGNEKKNFFKRAPKFNLMARVLKTGEWKKPGGTQIKCL

SEQ ID NO: 163083 - protein, 78 aa, Triticum aestivum
  unsure (1)..(78): unsure at all Xaa locations
  Clone ID: PAT_TA_57501.pep
AMTLSPATPEPLPIGLVMGGPVSTKRLPGPTIVAKTSLHGDRYQKFNNXAHKVMSAYLIRVSMPITFPSGRHRGEARH

SEQ ID NO: 163084 - protein, 89 aa, Triticum aestivum
  Clone ID: PAT_TA_57502.pep
PRVRGRVGLFTNDATRPIVERFARSQRYFFHQFGVSMVKMGQIRVLTGGQGQVRRICSARNPGTTDDGLGWSSLVQTVVDAAAESYSTS

SEQ ID NO: 163085 - protein, 66 aa, Triticum aestivum
  Clone ID: PAT_TA_57503.pep
IVPICENAGGIPTSHMRTVSRGSYSANGRRGTLWAVLRVLSTPERIAQSDPNIINWLGCPSKETSA

SEQ ID NO: 163086 - protein, 157 aa, Triticum aestivum
  unsure (1)..(157): unsure at all Xaa locations
  Clone ID: PAT_TA_57504.pep
KDGQTREHALLAFTLGVKQMICCCNKMDATTPKYSKARYEEIVKEVSSYLKKVGYNPDKVPFVPISGFEGDNMIERSTNLDWYKGPTLLEGLGQINEPKRPSDKPLRLPLHDVDKIGGIGTVPVGXAETGVIKPGLGVTFGATVLTLRGSALRCAMS

SEQ ID NO: 163087 - protein, 53 aa, Triticum aestivum
  Clone ID: PAT_TA_57505.pep
APARAARTAMITYHHHHRPMHRIRRHEGRRFDPYSSITSLPWILGKQLPMDIE

SEQ ID NO: 163088 - protein, 61 aa, Triticum aestivum
  Clone ID: PAT_TA_57506.pep
LCFGIEVEQTRWSNHSALKLHVQGFRPICFSEALLQQLQITRYVSEKNSVSKQTLKIHMAM

SEQ ID NO: 163089 - protein, 57 aa, Triticum aestivum
  Clone ID: PAT_TA_57507.pep
KYYFIIFMANTDTAREKIPQGKIPLKKAAFNQGFSDVCARPGALGAAFNQGFSDVCA

SEQ ID NO: 163090 - protein, 121 aa, Triticum aestivum
  unsure (1)..(121): unsure at all Xaa locations
  Clone ID: PAT_TA_57508.pep
RRHRRRRPYERACPARSTPSAPRSSSGSTSTNPRAAAGSAPRRPASRRASPPEAKTPPLTXKSPASASPRPGAXMRQXRPAAREPPPRRRRARQPPGRGPRWASPAPRRPPPRRARXPARP

SEQ ID NO: 163091 - protein, 101 aa, Triticum aestivum
  Clone ID: PAT_TA_57509.pep
LGVSFPLIHIQQTDRQTHASLGVGSGSPQPADSASFARSLRAPSGGRGPREGLLPPMPPREPPPPMPPPREPPPPMPPREPPPPMPPPREPPPPIATIESL

SEQ ID NO: 163092 - protein, 37 aa, Triticum aestivum
  unsure (1)..(37): unsure at all Xaa locations
  Clone ID: PAT_TA_57510.pep
GNIELATXCCGYMCPLTIPHIWHCNFSFHPVWPAIWA

SEQ ID NO: 163093 - protein, 144 aa, Triticum aestivum
  Clone ID: PAT_TA_57511.pep
ALVSAGQLPNLCPAVALKASLSSINSSLEGNLARSWSYSACSSFPLICCSCRRSCSPVLMRLLSLQKKTLPTSLLLFSSSHACLNPAGSSLGRGRGSCCKLPLHGVGSNMVGGARVRHHLSRSSSRPWWSSMPAGDGGRRPAAH

SEQ ID NO: 163094 - protein, 240 aa, Triticum aestivum
  Clone ID: PAT_TA_57512.pep
MTFKQVFCALREVFPQVDLRILKAVASQYSSDVDAAVGFVLSDVIPAVSEPTETVFTLQDVDYAEHGPADCRKSNLHSGGISLVDLVGAKEDASALFATSAESSGTVGECDPFSDYDGPFQSNNTVEKCSQIEDKVVINETRIPTTVMNSLLQEHYALLGSSSTSATEPHMIEYEQSDSGGCNDHCAAEKNEVTPETEIGNHKHLYDNYELSDLLASSGMLPLFMESPSDCAVNMEGQCL

SEQ ID NO: 163095 - protein, 94 aa, Triticum aestivum
  Clone ID: PAT_TA_57513.pep
GILDPAFCKPRKPVTGCSCLEKARLVAKPMPATFTAIADILLLIKDVEQAVSGRRGRSGTVAGDGAFPKGKENLASVLKRYKRRLSSNKPPAGP

SEQ ID NO: 163096 - protein, 215 aa, Triticum aestivum
  unsure (1)..(215): unsure at all Xaa locations
  Clone ID: PAT_TA_57514.pep
VEHIILLRAKPNISYAEEKDMLDYLYTSQYQMRGILTVSLGRIEGPNSESFTHAVFMRFQQKEDIAKFQSSSYYSKVLDEHVKPVSYXFESEVEDDIIPLFRRGEDFNYGVEFMLLISFLETASRESVEDALAHLQKLIIHYSSFIVQATSGCCLDHMDSLYSHASVIRFPSIDDFKLFKESTEYKDMWTSKFHPVTERCLELHFVVDPVGNQLM

SEQ ID NO: 163097 - protein, 49 aa, Triticum aestivum
  Clone ID: PAT_TA_57515.pep
CRAKHGVKIRRSGPFGAAAGEPPPLPATASNTMAPGVEGCLFLILIDCL

SEQ ID NO: 163098 - protein, 73 aa, Triticum aestivum
  unsure (1)..(73): unsure at all Xaa locations
  Clone ID: PAT_TA_57516.pep
MADRGGYVHVHHGQYGGGHHGGHHQHGRQMGDQMKGMFQDIAPXSGSHALTVGSLFPLGXLLLVLSGLALAAP

SEQ ID NO: 163099 - protein, 41 aa, Triticum aestivum
  Clone ID: PAT_TA_57517.pep
MSVDLAALDARHPSDPLDRFLADADDRLRAAADDAVVALVR

SEQ ID NO: 163100 - protein, 71 aa, Triticum aestivum
  Clone ID: PAT_TA_57518.pep
LLQLHVTSSGKGLLDAVHVGLQPSFGVPGEIVRFTHHSVNLFLTQPPMMITIAGIGRLAGGLIRRLGVDRA

SEQ ID NO: 163101 - protein, 70 aa, Triticum aestivum
  Clone ID: PAT_TA_57519.pep
TMPCPTQFTCTRSHSPLLQCSKDDRPDPPALTMQLPIVNGNAHLPCSLTSARVVCTVTRDRYPCTCHSPS

SEQ ID NO: 163102 - protein, 146 aa, Triticum aestivum
  unsure (1)..(146): unsure at all Xaa locations
  Clone ID: PAT_TA_57520.pep
REKARGGDGNRKKTHKPPHPFGTWGGPTANPNWPPPPTLLGXPNPAPGGGPPPRGGPPPPPLEAPPPGPEPKGPGPAPQXLPNGGGNFLFPFGGRPPYGGAPPLPKKERGSGRGPRKEGPPNLGAPGPKVSQPGVPPRGPQKPPRG

SEQ ID NO: 163103 - protein, 128 aa, Triticum aestivum
  unsure (1)..(128): unsure at all Xaa locations
  Clone ID: PAT_TA_57521.pep
PKNGFFIFLFFYTFXFFFFFFFFFFFFFFFFFFFFTEKGFPPLCIPKQPTPSTKIAVASSTTHQKKRKKKQMPTTAARQSADDPPPRRPPDTNHHRPRFRTAAYQAAPPRRNATPTTLLPGRVLGFPL

SEQ ID NO: 163104 - protein, 116 aa, Triticum aestivum
  Clone ID: PAT_TA_57522.pep
LGGRGPKTLNWDPKRGPPIKNLPGKPAKRAKKEREKTKRNGAKGLAKVTGPLGGTPPPPRVKRPLQGGVPFPIRVGQILERGTGGGFFLITPPGKRGIFSKGIKWGTPRVFPPPPF

SEQ ID NO: 163105 - protein, 76 aa, Triticum aestivum
  Clone ID: PAT_TA_57523.pep
TPAQEIKFGGPKKKILPCQPRVVKLGPLKGAPLFFFFFFFFFFFFFFFFFFFFFFFFFFFFFFFFFFFFFFFLFFF

SEQ ID NO: 163106 - protein, 68 aa, Triticum aestivum
  Clone ID: PAT_TA_57524.pep
SKMKGRALYLTRFLLGRPGSYPSFLGGTKFHLRARVLNRGGREKPRFPPLVQPGGQLVFALGGRCKRG

SEQ ID NO: 163107 - protein, 218 aa, Triticum aestivum
  unsure (1)..(218): unsure at all Xaa locations
  Clone ID: PAT_TA_57525.pep
PPLVPLPHHHGLPPCRRHESGPRHRLRRGGLPHLCLADSPPAPLLPTVSDELPSYSGSSSSYSVTSARSCVSDAARRIRPIDPLRVLAVIASLRRIDPKVLAQATSKLFQGEPANKRKGVWIEVLNGDEDDGEDIERAIVVAIEGSTITGAACSRSTXTSGRCRRPPLAIGGCESLVRIADSIMKWLSRPKAAPATETVIRAAVGDNAVTSKALRWVL

SEQ ID NO: 163108 - protein, 58 aa, Triticum aestivum
  Clone ID: PAT_TA_57526.pep
HTSTTKRCKLGRTLLRYETTHYRCRLQSELLPSNTTIKTWPPLQPTYLTSLRSPLRCC

SEQ ID NO: 163109 - protein, 94 aa, Triticum aestivum
  Clone ID: PAT_TA_57527.pep
KKGGKNQKRGGRGLGQKKRGPPGGNPPPPPLKRPKKGGKVPYTEAALLGITEWKPPFYNLQRIAKKAIIKIPVMVGPARIHRFFWFKRPLQNLP

SEQ ID NO: 163110 - protein, 71 aa, Triticum aestivum
  Clone ID: PAT_TA_57528.pep
GTFVYLCFHYRFRIFIYILFFLMEGGFSLHFYVCGLGRTGELKIVSQVHYMCLYIFSILLKGNSRQSSSIQ

SEQ ID NO: 163111 - protein, 85 aa, Triticum aestivum
  Clone ID: PAT_TA_57529.pep
TLNPQNGPPFFFFFFEVSFFFFFFFFFFFFFFFFFFFFFFLPKGTFFVIHQRLFSKIQIFSNIHDLLDWTMTTLLLVNHIKHDYD

SEQ ID NO: 163112 - protein, 101 aa, Triticum aestivum
  Clone ID: PAT_TA_57530.pep
IGGCLAAPELLGAPPPVSAATDAAGARCPPTCRPPADPHPWPCPQPPTRGAPRGYRRPGIPHLETAPPARAVPREVAPAAAASDPAPKTTARISKPDDQDD

SEQ ID NO: 163113 - protein, 63 aa, Triticum aestivum
  Clone ID: PAT_TA_57531.pep
IWGPQKKNITLPARGSKIWSFKTAPPFFFFFFFFFFFFFFFFFFFFFFFFFFFFFFFFFFFFF

SEQ ID NO: 163114 - protein, 40 aa, Triticum aestivum
  Clone ID: PAT_TA_57532.pep
RTSNFIARVSWHLLALHCASVYRGLTANTRSTYFIIALVL

SEQ ID NO: 163115 - protein, 94 aa, Triticum aestivum
  unsure (1)..(94): unsure at all Xaa locations
  Clone ID: PAT_TA_57533.pep
MATRGRATIPLLXLLGTSXLLFAAAVSASHDEEEDRRGGRSXLHRSEQRSQXDXPRYSHARSXEDSRDDQXXHGRDDXEEXXRGXXRXGEGERE

SEQ ID NO: 163116 - protein, 131 aa, Triticum aestivum
  Clone ID: PAT_TA_57534.pep
GASQSNRPDGGNPPGGRNLSHQAGRLSSSASRVGYLLGRAPRGRPGLFSPRAKERGDSKQNPHNGGVRQGVSPVKKDWGPTAQVNLFWPPQGKRYCLRKRRSVRICFYRTALPFFFFFFFFFFFFFFFLKF

SEQ ID NO: 163117 - protein, 87 aa, Triticum aestivum
  unsure (1)..(87): unsure at all Xaa locations
  Clone ID: PAT_TA_57535.pep
GXGSASSVRLXMRSGGAARGXRGSSRDAQRDEPEGXRGEEPSVPEGYGGLQGKEIRPPGRAARVPSGTTADGMDVRDGRDAVESCPG

SEQ ID NO: 163118 - protein, 106 aa, Triticum aestivum
  Clone ID: PAT_TA_57536.pep
DMRRDVQEIFKMTPHDKQVMMFSATLSKEIRPICKKFMQDVMPLPNVLSQLHSASYLSRVLHWLSVINRFVLVFCNLTCIEFSRQVVFFFCFPLLPCIGQYRGSHL

SEQ ID NO: 163119 - protein, 142 aa, Triticum aestivum
  Clone ID: PAT_TA_57537.pep
KTFIGRKTRVSPRCRGHGTKGRTTTCRRIVECKKKAKSGRFRTTGPDHAEEEEGNRTSLTKSTSPSRRRGGREQGLTDEIHLAWVCRSSGRSSEGFAGEQRETSLMHLPPRADLTGRGSDGEWKERMQRCRSPHLGRHWRTW

SEQ ID NO: 163120 - protein, 102 aa, Triticum aestivum
  unsure (1)..(102): unsure at all Xaa locations
  Clone ID: PAT_TA_57538.pep
LRLIHYCFAQLVVVQVNKVRLDEDLEQTWEVLAEPIQTVMRRYGIPEPYEKLKEMTXGQAVTKDSIRKFIEGLDLPEDAQXSLLKLTPHSYTGEAENLAANI

SEQ ID NO: 163121 - protein, 58 aa, Triticum aestivum
  Clone ID: PAT_TA_57539.pep
SHHIYWALSREFSVLTLINHEHLHFLRSHYRRSISSHPREYKHDSCYPPVLQVVHLAS

SEQ ID NO: 163122 - protein, 79 aa, Triticum aestivum
  Clone ID: PAT_TA_57540.pep
PGLRLHCAPKKKKNKKKKKKKKKKKKKKKKKKKKKKKKKKKKKKKKKKKKKKKGGPLLKNPILLPRAGKVIFFFWGPQI

SEQ ID NO: 163123 - protein, 85 aa, Triticum aestivum
  Clone ID: PAT_TA_57541.pep
KQTHASMIYLLVAASVHDLISSKFHQISPQRKEEISQIICRHQGHVELKLPEVTFGKHKDYAPCSKANTCIYDLSSGGNVSARSN

SEQ ID NO: 163124 - protein, 47 aa, Triticum aestivum
  Clone ID: PAT_TA_57542.pep
HASGGFLFVFGYKSGLCALVWPMQDVIFGVLLINNCVVTDSQLMANW

SEQ ID NO: 163125 - protein, 91 aa, Triticum aestivum
  Clone ID: PAT_TA_57543.pep
NLYVNQRKGQLQFTDHSTNTFSSSINLTEPYYDHQQSRNMALAIAVHRSFNHYLLGFYKPKGLTVAYYTGLIIKRHNIGSVAIHTSEMIQS

SEQ ID NO: 163126 - protein, 62 aa, Triticum aestivum
  Clone ID: PAT_TA_57544.pep
DSHANILPQMMNILVVHLFCTTCKLHDAKLQHLARLTKTTWYKHSSRRSQQKCLERQRLCTT

SEQ ID NO: 163127 - protein, 76 aa, Triticum aestivum
  Clone ID: PAT_TA_57545.pep
VLKKKKKKKKKKKKKKKKKKKKKKKKKKKKKKKKKKKKKKKKKRGARFKEPKFTSPAWQRKIFFLGPPNLISGAGV

SEQ ID NO: 163128 - protein, 79 aa, Triticum aestivum
  unsure (1)..(79): unsure at all Xaa locations
  Clone ID: PAT_TA_57546.pep
SKKLWYSQKMLCYQTGQVQISLNIVYFTIVLPTRFLFYHHKIVLGAHIKFSGVYGVIVXPXFGGSACIFSIIXADILSQ

SEQ ID NO: 163129 - protein, 216 aa, Triticum aestivum
  Clone ID: PAT_TA_57547.pep
GEDHTLALATGHKRFSASLSKLVENYAELLASQGLLKTAMEYLKLMGADENSDELTILRDRIAFSTEENDATRSSVPESSANSSSYLPNQQSYTPDPSQNLYQVPQQYNNVQSYPEVYPQPPNSRANVPSNTYPEVYPQSHNAAYSGYAGYQPQHQTQMFVPQNTPVDTQVFCFVGTFILGQVSCATISDLNCTLPCCCPFWPSMEYLNKCKITMW

SEQ ID NO: 163130 - protein, 67 aa, Triticum aestivum
  Clone ID: PAT_TA_57548.pep
VPVPGRVPYAFQNAPWLGSPSGAGLSEMAPSGKREKLGKAINLGSPRVLTAGPLKTPARTNKIQVPL

SEQ ID NO: 163131 - protein, 73 aa, Triticum aestivum
  Clone ID: PAT_TA_57549.pep
DAWADAWADVDLMKISFSRRHDYEDIDIETGGSGSDEMEGTAFVSRHTANTDGQVPAVKRSGMTLEPGPKTLL

SEQ ID NO: 163132 - protein, 43 aa, Triticum aestivum
  Clone ID: PAT_TA_57550.pep
TSPHQASPVWSPRLSNIWRAFSVWIHSADGWSRVTGAGSLDGR

SEQ ID NO: 163133 - protein, 45 aa, Triticum aestivum
  Clone ID: PAT_TA_57551.pep
VCGVTPRSSRSATLVIMALAIALISLLYSISISFIGIRGLLIIGY

SEQ ID NO: 163134 - protein, 110 aa, Triticum aestivum
  Clone ID: PAT_TA_57552.pep
ISEPHQFSDLSPDGRRRSVQSVSFATHVQVLQFIRPDGRRRSVQPTHLKRHMQSHLPEEPPLSVLASCAPPLPGDPTRCRSSDSAPRLLGCICVNLAHVAHVNQYMYCTD

SEQ ID NO: 163135 - protein, 110 aa, Triticum aestivum
  Clone ID: PAT_TA_57553.pep
RAEPFGNAEGEGVLKNTPNGQKGKSAKGEKGGEHRGFPDRQVKKKGRPTPVKRRQKKRKKLQARGSKTGTFKATEPFFFLFFFFFFFFFFFFFFFFFFFFFFFFFPTRPP

SEQ ID NO: 163136 - protein, 88 aa, Triticum aestivum
  Clone ID: PAT_TA_57554.pep
HWSSSDNFDSFRTSRSLAMLFVLVITISVNRVSLYMSITSSTYSVHLCNVDPGLTIIPLNERKKSVLGEINHLVVDWCLKARLYCPHH

SEQ ID NO: 163137 - protein, 62 aa, Triticum aestivum
  Clone ID: PAT_TA_57555.pep
LPPVTGACQRGILSKATQVFTQWVLPTSDGKKVGQVSLLGNTKVELWRGLREKKKKRPALAI

SEQ ID NO: 163138 - protein, 74 aa, Triticum aestivum
  Clone ID: PAT_TA_57556.pep
SISSVIVANSDISCVPSGVSPLFGGCAKPVCHPRVQCLWCVAAYVCCALRRPTIGLDRPEAGALLFGRLVAFGE

SEQ ID NO: 163139 - protein, 205 aa, Triticum aestivum
  unsure (1)..(205): unsure at all Xaa locations
  Clone ID: PAT_TA_57557.pep
MASQKFPPQQQDCQPGKEHAMDPRPETLIKNYKSANKLQGKVALVTGGDSGIGRAVCLCFALEGATVNFTYVKGHEDKDAEETLQALRDIKSRTGAGEPKALAGDLGYEENCRRVVEEXVASAHAGRVDILVNNAAEQYVRPCITEISEQDLXERVFRTNIFSYFLWPXSRXKHMXPXSSIINTTSVNAYRGNATLLDYTXTKGA

SEQ ID NO: 163140 - protein, 193 aa, Triticum aestivum
  unsure (1)..(193): unsure at all Xaa locations
  Clone ID: PAT_TA_57558.pep
GDFTGFLANCAALEDLEMIECSGLTNLIIPQQLDKLQHLLIDGMEVEMVEFYAADLSHFEYKGQVVPIVHHGCSIKEGNNNVXVGKKGLAKAFTAVPSILPVKILNVRSVALSKYSQLQKLPTRPDGMFMHLRHMTCRIIVHSRXKKPITNIEVLQLAYCLDAAPQLETLQLNMFYVSSSGVSSAEGGGHAPA

SEQ ID NO: 163141 - protein, 89 aa, Triticum aestivum
  Clone ID: PAT_TA_57559.pep
PKWTDKVQLTLYQTKLRTNNRSTNATTDPAHKRQEQKICRHMRSKINQLLLFSLFISHAAKLPQPGRPIQCANLLHIKQKRHQGHEKAW

SEQ ID NO: 163142 - protein, 180 aa, Triticum aestivum
  unsure (1)..(180): unsure at all Xaa locations
  Clone ID: PAT_TA_57560.pep
LTPTKPGTGMGVAVKKLIQESYQGHREWLAEVIYLGQLSHPNLXXLVGYCVEDEQRLLVYEWVPRGSLENHLFRRSTHFQPLSWNLRLKIAHGAAKGLAFLLCVLALVIYRDFKXSFILLXDATTTHXLSDFGLALDGPAGGLSPVSXWVMGTYGYAAPEYLGXSFGVVLLXMLSGPAAV

SEQ ID NO: 163143 - protein, 147 aa, Triticum aestivum
  unsure (1)..(147): unsure at all Xaa locations
  Clone ID: PAT_TA_57561.pep
EGLLDVRCSDVWDKSFHVISLAFDTLGKSSSDLLPEALKNLADMQNMSDDDFSFRKQLNACLGSAISAMGPKNVLDILHIQSISVENEWILPILXRHIVGASLQFFLRDILGIVRAVEMSLPKLLKDDXLFSAXRXEGSVXSLWALL

SEQ ID NO: 163144 - protein, 126 aa, Triticum aestivum
  Clone ID: PAT_TA_57562.pep
PPGKKAPPQGGSQSPTRRNKGGKGRLGGPHSGKPPLGKGELFATPLKWGPPGNSQAHRGKTPAREKEFGAPKEREKTAQARERKRGTLKTAPLFFFFFFFFFFYFLFFFFFFFFFFFFFFFFFTRP

SEQ ID NO: 163145 - protein, 94 aa, Triticum aestivum
  unsure (1)..(94): unsure at all Xaa locations
  Clone ID: PAT_TA_57563.pep
RVPMIMLQYMPLENHGQCCFHRTGSSLRCSDLMSTVCRWLSMHKVLPAALGTTWEAEGGAASLHXCSGHCHRKFRASRCCSLSPALXSPVVRPV

SEQ ID NO: 163146 - protein, 120 aa, Triticum aestivum
  unsure (1)..(120): unsure at all Xaa locations
  Clone ID: PAT_TA_57564.pep
PGPPRSCSPPTVPAPVRGHALLLAALVDAXAPRSSRLALVDHRALPASALALALARAPARAPGVQNGRTRHFEVAPSPSNVGVDPGRRGSGLQGCHPAARSCLARVTATRASAGGGTGRR

SEQ ID NO: 163147 - protein, 149 aa, Triticum aestivum
  unsure (1)..(149): unsure at all Xaa locations
  Clone ID: PAT_TA_57565.pep
APGGMQIRQLHRWVLRCHACYKVTQEIGKIFCPKCGNGGTLRKVSVTVGENGITMASRRPRVTLRGTKFSLPMPQGGRDAVIKNPILREDQLPRGLHLNEESSKXGEILGVGNSATARKGGAKPPXRKALAMFSGKRNPNDNHFSRKKK

SEQ ID NO: 163148 - protein, 79 aa, Triticum aestivum
  Clone ID: PAT_TA_57566.pep
LEPNNDLQQGWSSKSKINTISEFPQACDAQQPTMVEQSELYLNSARPKRLSLRFRSHNHGKRARPHHERERAPKLFWLK

SEQ ID NO: 163149 - protein, 81 aa, Triticum aestivum
  Clone ID: PAT_TA_57567.pep
CPSGWSPAAPARHHPFPTPGSAIRPRSGSSRRRALSSWRSPARPSSAPPVGTRVPPHHVQLGRGPRADRSRRRRRPSAAPP

SEQ ID NO: 163150 - protein, 223 aa, Triticum aestivum
  unsure (1)..(223): unsure at all Xaa locations
  Clone ID: PAT_TA_57568.pep
LTSFEAGCSTSTSTQSPSPRLPAHRHHPSMAAAAKRGGTGSRGLLMGRYELGRVLGKGTFAKVYHARHLQTGESVAIKVLDREKAVRSGLVSHIKREIAVLRRVRHPNIVHXLFEVMATKTKIYFVMELVRGGELFSRVSKGRLKEDIARRYFQHLISAVGFCHTRGVFHRDLKPENLLVDEAGNLKVSDFGLSAVAEPFQPEGLLHTFCGTPAYVAPRCPRP

SEQ ID NO: 163151 - protein, 139 aa, Triticum aestivum
  unsure (1)..(139): unsure at all Xaa locations
  Clone ID: PAT_TA_57569.pep
PPPSPTRPPPRSPSWWRSRPPRXSSPPHRRTQAAAPSRVPVAPPLEPPLRSESPSHLPCCPSLNGGGSLHWGGLRRSHLPRRRFPVELACHVVRGGKLALLFSEECVVAPSTGGGQAGRREEVKSTIATGWRVDGRRQG

SEQ ID NO: 163152 - protein, 218 aa, Triticum aestivum
  unsure (1)..(218): unsure at all Xaa locations
  Clone ID: PAT_TA_57570.pep
EMFDQLNGPLVLICGQNILEAAPKDKDPKELVFHNLSRLSPLTSLKRLVGGLQGRKPSKSNGIAKLFGNKFYIPFPKDDEQLREFNNQIAEDKKIIVSRHNLVELHKVLEDHGLSCENLSHVKLEGIILTKQRAEKVIGWARSHYLSSAISPSIKGDKLVIPCESLDLSLERLRELEASTKSLSXNMKMLAKDEFERNFYQQLYLPMNLELKFEDIGA

SEQ ID NO: 163153 - protein, 160 aa, Triticum aestivum
  unsure (1)..(160): unsure at all Xaa locations
  Clone ID: PAT_TA_57571.pep
SRTPALAHPSSSPTPPPPIPXPSCXPTPPPSPSPIRPPRTLPATPPPLLAFATPQHLLPTPSALSRRSAGAARDGPHERGLCSRSTLPASITTHRQEAPATPPSAPSRGHHRGLSAVLRLRSRMGQDDTTPWRCEMAANAEHFPSHKDLGSQLQEMIPEK

SEQ ID NO: 163154 - protein, 104 aa, Triticum aestivum
  Clone ID: PAT_TA_57572.pep
EPHAKQGEPKMGKPNGTGPVAKTPTGEKGKGRQANKVGPPPGDHKRGAAKRRPGHRKKGALKKRLPHSRLRVFKLGFLYIFLPFFFFFFFFFFPFFFFFFLYFF

SEQ ID NO: 163155 - protein, 81 aa, Triticum aestivum
  Clone ID: PAT_TA_57573.pep
VDAHYSLHIPMVLLPHHIFVYIKSQKIHELAWLLWRRAFFQGAVGFLNMLPIGHFFLVCTRFVENGCEKIDHPVDLYARYV

SEQ ID NO: 163156 - protein, 112 aa, Triticum aestivum
  unsure (1)..(112): unsure at all Xaa locations
  Clone ID: PAT_TA_57574.pep
MDVDGHLPRSQGDVDDDGRERRTGTVGTXAAAHIISAVIGSGVLSLAWAMAHLGWVAGPLTLVLFAVITFYTCGLLADCYRVGDPVTGKRNYTYTEAVRSYLCGWYVWLCGF

SEQ ID NO: 163157 - protein, 109 aa, Triticum aestivum
  Clone ID: PAT_TA_57575.pep
IHIGPYPCLASSSCSLPGAPFPCLLFAGVISDGFWGRTRKPRRIKKELAPMRTAGRRRPDDGQAECECVRWPAVGVVTALGRRRSGVQPLIFREETYLISGLHVSYSGI

SEQ ID NO: 163158 - protein, 184 aa, Triticum aestivum
  Clone ID: PAT_TA_57576.pep
TRIWTGDPSGPGSLLPPGPNPRTSPAARGHRPGSRAADAPGRRSSGPAPPAAPARASARRPLGAAAGAGGVRGRAGCWCPWCAPVEGLVGPARDLSCRPWISRSLAAFRFGSGTVPRSLSLSLSQTLTRHARVEFTPVNPKPNQPGSRCRLSSPALLRCRQPPAFHFPWLGFGCGVGWGPFDDV

SEQ ID NO: 163159 - protein, 53 aa, Triticum aestivum
  Clone ID: PAT_TA_57577.pep
VLTAEGVIITVTCTGPAIACTYQEPANAFACNCNVLTAEGEFKLVQKKGGLHQ

SEQ ID NO: 163160 - protein, 76 aa, Triticum aestivum
  Clone ID: PAT_TA_57578.pep
PGYDSTRPEKKKKKKKKKKKKKKKKKKKKKKKKKKKKKKKKKKKKKKKKKKKKKKKKKKGGPLLKRSNFYYPGGGK

SEQ ID NO: 163161 - protein, 109 aa, Triticum aestivum
  Clone ID: PAT_TA_57579.pep
SEEHRAARVRTKNEWTNEATLSIPGQNTDRPHTLITTGANTAATAHWRLAPNRPARFVDRIPDLEKLQLPDDATHYYEPPSDAAPASEPQAAPAAAAIREAQPPLDTGP

SEQ ID NO: 163162 - protein, 61 aa, Triticum aestivum
  unsure (1)..(61): unsure at all Xaa locations
  Clone ID: PAT_TA_57580.pep
KKLLRCHARGSLNLDFFKTGPPLFFFFFFFFFFFFFFFFFFFFFFFFFFFFFFFFFFFFXG

SEQ ID NO: 163163 - protein, 33 aa, Triticum aestivum
  Clone ID: PAT_TA_57581.pep
LEICCFPNCNCRRELQNCVQLIVNLVDVCKYSK

SEQ ID NO: 163164 - protein, 112 aa, Triticum aestivum
  unsure (1)..(112): unsure at all Xaa locations
  Clone ID: PAT_TA_57582.pep
RETKGTGGHRKXXDSRGEGNGKPDAGXENGPPSDEXARSXGQPXXDXXESPKRTXRXGGGXXGXXTQXGXKHKRAXANKXNXGTXEAETREASXSXXGGHGXAKXSPXXGGH

SEQ ID NO: 163165 - protein, 99 aa, Triticum aestivum
  unsure (1)..(99): unsure at all Xaa locations
  Clone ID: PAT_TA_57583.pep
IDALINIYYIFSSGCTLLDLYLPMPXXLXHRAGSWSXEFPPASPRXWVVRGLGRWLASLRSGCVWCRGVGXPSPPXRALGXLVAALGRRGLPEVPAAGS

SEQ ID NO: 163166 - protein, 36 aa, Triticum aestivum
  Clone ID: PAT_TA_57584.pep
VDVRELNTTSIGGATALHDNKLTDTHMQRLGVYYSV

SEQ ID NO: 163167 - protein, 238 aa, Triticum aestivum
  unsure (1)..(238): unsure at all Xaa locations
  Clone ID: PAT_TA_57585.pep
MKTFLILALLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGFFQSSQXNPQAQGSVQPQQ

SEQ ID NO: 163168 - protein, 204 aa, Triticum aestivum
  unsure (1)..(204): unsure at all Xaa locations
  Clone ID: PAT_TA_57586.pep
PRVRPRVRAEAAAPEPVFIWGVPLVGDDERTDAVLLKFLRAREFKVKEAMAMLRSAVLWRKRFGIESLLEADLAFPELEKVVFYRGADREGHPVCYNVYGEFQDKEVYEKAFGDEEKRERFLKWRIQLLERGILSQLDFAPSGICSMVQVTDLKNSPPMLGKHRAVTRQAVALLQDNYPEFIAKKVFINVPWWXYLAANKMMSP

SEQ ID NO: 163169 - protein, 161 aa, Triticum aestivum
  unsure (1)..(161): unsure at all Xaa locations
  Clone ID: PAT_TA_57587.pep
PSPCPLPPPPPPLVLPSTLPPAMPSSRFSPRPPPPLPACSCPFPPPPPSLSPFGCRPSPSCGPPFPYHCCAPHGCASPIWLFRLRIWLFRLPNGLHLLIWLLSCNWSXLKXWXPPPPWLLLPWXLLLLSPWPLLLWLLLCWFLWLPLWXWXSXCXCAAGCF

SEQ ID NO: 163170 - protein, 57 aa, Triticum aestivum
  Clone ID: PAT_TA_57588.pep
GRVGCSGLGLFAGGWIVGSLVVPVILPAFIFPRTWCLELLTSLVAYVFLFLGCTLVK

SEQ ID NO: 163171 - protein, 199 aa, Triticum aestivum
  Clone ID: PAT_TA_57589.pep
QQQQQPILPQQPSFSQQQQQLVLPQQQIPFVHPSILQQLNPCKVFLQQQCSPVAMPQSLARSQMLQQSSCHVMQQQCCQQLPQIPQQSRYEAIRAIIYSIVLQEQQQVRGSIQTQQQQPQQLGQCVSQPQQQSQQQLGQQPQQQQLAQGTFLQPHQIAQLEVMTSIALRTLPMMCRVNVPLYRTTTSVPFGVGTGVGAY

SEQ ID NO: 163172 - protein, 210 aa, Triticum aestivum
  unsure (1)..(210): unsure at all Xaa locations
  Clone ID: PAT_TA_57590.pep
MSDAHANPPRQGKQQWWLPDDHHSSKAMHQGSQQQWVQPEQQHPTSANVDASHFSNPGYPVEQQYNSRVFQDQRRAPLSGGACSADQHQQRYYPQSRQDTPGGSSERYPTTPSMGAGSYGQWHQTPTPPPQQHDGRTYRWGFQDFGRQAQINNLPPMQAGRSVLLSXLHPTGSPQTTSPTTGSDGSVTSTFLVPPSSYHQCPPPPPHGIC

SEQ ID NO: 163173 - protein, 230 aa, Triticum aestivum
  unsure (1)..(230): unsure at all Xaa locations
  Clone ID: PAT_TA_57591.pep
AGARGKVWAVGARNVGKSTLLNAIARCSGAESGQTLTEAPVPGTTLGVIRVDGVLGAQAKLFDTPGLLHGHQLTSRLTPEEQKLVQVRKEMRPRTYRIKAGQSIHIGGLVRLDVEDLTVGSIYVTVWASPLVPLHMGKTENAESMMKDHFGLQLQPPIGQKRVKELGKWVRKQFKVSGNSWDANTMDIAISSLGWYGIGLKGEAVLGLWTYDGVDVVXRSSLVHERASIF

SEQ ID NO: 163174 - protein, 72 aa, Triticum aestivum
  unsure (1)..(72): unsure at all Xaa locations
  Clone ID: PAT_TA_57592.pep
LGSGQGFPSPCRCKARAIKLGYGNPKEELCSRTHANVGLEHRDPPSLFFFFFFLCVFXFFFXLDTTIATEVQ

SEQ ID NO: 163175 - protein, 119 aa, Triticum aestivum
  unsure (1)..(119): unsure at all Xaa locations
  Clone ID: PAT_TA_57593.pep
PLMMACCGNSLNCMKLLTEAGAEVNGNXNSGPTPLTAAADDGSSEFTQALAGGXGYPHIPKQHGGIAIKRGEHRGPRVLDELVFTNTNAIPSVPDWTVDWIITNMISAHTIGYDRTSAE

SEQ ID NO: 163176 - protein, 94 aa, Triticum aestivum
  Clone ID: PAT_TA_57594.pep
GRLGGGLIEGIADYVRLKAGFAPGHWVKPGQGDRWDQGYDVTARFLDYCDSLKPGFVAQLNAEMKSGYTDDFFARILGKNVQQLWKDYKAKFRG

SEQ ID NO: 163177 - protein, 88 aa, Triticum aestivum
  Clone ID: PAT_TA_57595.pep
GKESYARRLRTLVANLMRLTMETLLRLAVLRAITMTSASATRREGMEDHYRSGDDVRYYSSGLLGYKFALDHCVLYDGGNRLWSLCVP

SEQ ID NO: 163178 - protein, 71 aa, Triticum aestivum
  Clone ID: PAT_TA_57596.pep
GKVDSVSLLATRCLGRWTMTMQAVTDSSVSQVTRCDHSHTTVFKILNEDQRKAHPHQASCSGPHPGWLGVL

SEQ ID NO: 163179 - protein, 170 aa, Triticum aestivum
  Clone ID: PAT_TA_57597.pep
GWAYYLLKGEQEGERPIRVAAGAPPPQPRENPSTKKKKTATQGGEGKPNSGGRPPESQGTGPPKGNPRPGKWHPGQRENPGKTQPNPREKPSPSPPRGTSEKTPNKPPCQNGPNPNGNRNPPGAGPKTPEEPRGYPELNPHTSQGPNPPPMPLFPPLYAHVFRVFPLNPQ

SEQ ID NO: 163180 - protein, 184 aa, Triticum aestivum
  unsure (1)..(184): unsure at all Xaa locations
  Clone ID: PAT_TA_57598.pep
NPPFFATNIQRNVYTHHPPFSQQQQQXNLPHQQIPYAHPXSILQQLNPCKVFLQQQCSPVAMPQXLARTQMLKHSTCHVMQQQCSQQLPNMPQQSRYEAIRAIIYCIILQEQQQGQGYIQTPQXQPQQLGQCVCQPQQQLQQLLGLQPQQQQLAQGTXFLHPHQIAQLEVMTSIALRTLPTMCR

SEQ ID NO: 163181 - protein, 131 aa, Triticum aestivum
  Clone ID: PAT_TA_57599.pep
MVVVLKIELHCEDCSEEMKKRILKIKGVEEAVPHIKSSQLMVKGMVEPATLVGFIHKCTGRKAAIIRAEPLNEDTPAAAMAEETPAADANAEKQEPSDNLENKDELGVEEETKQAVNREEETETEKPSKGD

SEQ ID NO: 163182 - protein, 92 aa, Triticum aestivum
  unsure (1)..(92): unsure at all Xaa locations
  Clone ID: PAT_TA_57600.pep
WXWFLXXXGXXAALLXXXFLFFLLGXXAPPPWXVRLLXXXXXRLXWVXLWLCWPXRXLAXLLXXVLSVXLAFXGXLGXCPGAPAXXXXLSFA

SEQ ID NO: 163183 - protein, 212 aa, Triticum aestivum
  Clone ID: PAT_TA_57601.pep
CGSVYMHCDNNVLVILRPSKGTYDMVQLPGEPSSARSGLSLPQKSVIASYERGVHYVATNISQLRVWMLTELTDGQLGWTLSHDTNLNLHGDMIRTLKIQLKLTWRIVGSRGGPVSLTDEDAEDDWAISYDSEHSWNSDEDNFINMVGGANHDQSVERGAYCSIMGFHPHNNALVLILNSAVVVYHLDTSRMQYLGDTDELDKDHTLATWCR

SEQ ID NO: 163184 - protein, 103 aa, Triticum aestivum
  Clone ID: PAT_TA_57602.pep
NQKCLIGSRHSQVPGKTCVHSSMLRIHKHADLFMQHREKHHLMLRNDCWKRVHDRSINSNYKSAVAQTQKQPRRLSNRRFRGTLQTSPSPSACSTSQSGSVGP

SEQ ID NO: 163185 - protein, 55 aa, Triticum aestivum
  Clone ID: PAT_TA_57603.pep
MGNAGFSAVKTWYIKGQPLFFSFFLYYIYFFCIFFFFYFVFFYIVLPFFFFFFFF

SEQ ID NO: 163186 - protein, 75 aa, Triticum aestivum
  unsure (1)..(75): unsure at all Xaa locations
  Clone ID: PAT_TA_57604.pep
PKGFSSQXGFKNTANEFNLGGTKKKFRPSASLQYLNFDFLKRAPLFPPHPTFFYLYFNIFFFIFFFLFFFFFFFX

SEQ ID NO: 163187 - protein, 74 aa, Triticum aestivum
  Clone ID: PAT_TA_57605.pep
MKLLVCATIIQCELLCVMSSSYFLLCHLTFQHMYLRLQQELQSDVAGRLRTRCAAFSAGSRTAPPLPGSRPSLL

SEQ ID NO: 163188 - protein, 50 aa, Triticum aestivum
  Clone ID: PAT_TA_57606.pep
IQTYNSTFLPACLQSKVNQCTAIPPKYRSRYTATRKRPNVHCYFSSRHRQ

SEQ ID NO: 163189 - protein, 70 aa, Triticum aestivum
  Clone ID: PAT_TA_57607.pep
VQTHQQQPQQQHQCEGEPQQQQQQQLVQQRYQQQSAQGPLVQWHQIHQVEEMTLIELRGCQDLVVTVIAA

SEQ ID NO: 163190 - protein, 79 aa, Triticum aestivum
  Clone ID: PAT_TA_57608.pep
VVYWSVVSFRVDGGLLVSLFSCDPVVSCKLEIFCRCEMQTRDQGAPQAQNHLNKTRDPWQMLLLMTPSPRAVTSPKLLE

SEQ ID NO: 163191 - protein, 95 aa, Triticum aestivum
  Clone ID: PAT_TA_57609.pep
AGRHHHHVASSAPVRVPEWPAARFPPGSGEHGYGVSCREEDGEWMAPHEYLQAQARSSGRGTAAPSVFEGVGRTLKGRDLSRVRDAVWSNTGFFG

SEQ ID NO: 163192 - protein, 69 aa, Triticum aestivum
  Clone ID: PAT_TA_57610.pep
HASAKAWRGVYQPNDDKLQFFYDGQGFMSLQLNQDQADFIFYDVSGKVLYKWSSRKTNYFQPSIYVTAE

SEQ ID NO: 163193 - protein, 125 aa, Triticum aestivum
  Clone ID: PAT_TA_57611.pep
GTPHGVGCFTVVQEGYGTSASNRGTFQGGRVFITNVVVVIVQGSIHHKYYLNFDQDYVGNDHFCGASWDGVTIGHGYSNLVVQVNPDFDYHQDFKLVKECRMQWDPGGSRWCRLGVKPHFKEGGC

SEQ ID NO: 163194 - protein, 121 aa, Triticum aestivum
  Clone ID: PAT_TA_57612.pep
MGQVTGRPVGQTKKGKGFKGRPKGDSHWFFKVGKGEKGRKGVNLGVPKEFPRKPPRPARDKRREFRRAPTQERRCCTQARGSMVGSHYRRPFFFVFFFFFIFFFFFFFFPFFFFFFFFYFF

SEQ ID NO: 163195 - protein, 133 aa, Triticum aestivum
  Clone ID: PAT_TA_57613.pep
MAELLFAPAVAGLVHLPEVLERLAAADADHDHAHHHTAHGHGHGHPRAQIGGVGGGAPVDIVETPAEYAFLLDVPGLSKSDIQQVTLEEDNVLVMKSASNGGGGANGKRKREEEEADCRYIRLERRASPRSFV

SEQ ID NO: 163196 - protein, 83 aa, Triticum aestivum
  unsure (1)..(83): unsure at all Xaa locations
  Clone ID: PAT_TA_57614.pep
KKFQFNQDPDVLHTRVSCGLFXLTGLGWPDDTXDLTDISTLPHILETGLDILFLWVTRMAMMRTQLCGDVPTREQVMAHTPCP

SEQ ID NO: 163197 - protein, 87 aa, Triticum aestivum
  unsure (1)..(87): unsure at all Xaa locations
  Clone ID: PAT_TA_57615.pep
TEDHRLIVFKEPPXVNYLHLVSQDTEWGKPCICPIKSPRKPSGFIELLRSLRWLFAWPXTPFPLPEWLMLRAFLKLXKRDIRSLHIL

SEQ ID NO: 163198 - protein, 91 aa, Triticum aestivum
  unsure (1)..(91): unsure at all Xaa locations
  Clone ID: PAT_TA_57616.pep
DAWGLDAVLGQCSICLMSTLGGNCYNRXRASGDQMLCAYVCRCKLTXSGLGCPRDFTKLVLECGGVEPYILRDWNLGCRCTLCDYMDYEGC

SEQ ID NO: 163199 - protein, 76 aa, Triticum aestivum
  unsure (1)..(76): unsure at all Xaa locations
  Clone ID: PAT_TA_57617.pep
RFXKCYNEXXXPPPPAKELDLLQCLHLRLQCIKCLHQVQGHAHAHELEIHSTVELPNEQRLASPPPPPRCSSLPYC

SEQ ID NO: 163200 - protein, 170 aa, Triticum aestivum
  unsure (1)..(170): unsure at all Xaa locations
  Clone ID: PAT_TA_57618.pep
QQQQQQQQQQQQQQQQILQQILQQQLIPCMDVVLQQHNIAHGRSQVLQQSTYQLLQELCGQHLWHIPEQSQCQAIHNVDHAIILHQQQKQQLQPSSXQVFFQQALQQYTLGQGSLRPFXQNTQGHGFVQPQQLPQFEEIKNLALQTLPAMCNVYIPPYCTIAPFGIFRTN

SEQ ID NO: 163201 - protein, 195 aa, Triticum aestivum
  Clone ID: PAT_TA_57619.pep
MRDQPSPTSVPDASLEDSNTNEPESSRSTSACNERVALRSRAIESVPRSLSWEETYSHSPLHTHHLNSSNAEDNESECYALVKKILSSAGLGNLQVSMVFTGWHSADCPLDPALCDKFLDRKEEAAKSRERRSNQKLLFDCVNMALVETGQEALIRTYPWSKACLGARSEALSQDIGERSMEPCKGLALGGEARG

SEQ ID NO: 163202 - protein, 143 aa, Triticum aestivum
  Clone ID: PAT_TA_57620.pep
KGRRLGTADSPPAIGHGHHPDASVLRLFFGGTQPSKVCRAPSPWPSGTTTSSSSRASVHFACNSWVQTTGELPGNSKSIFYSYKAGLLFYFRFMETCTCEKLLALQVMVLTLCPTAGHVAIRFNILYYDSNNVTFCGTCELRN

SEQ ID NO: 163203 - protein, 100 aa, Triticum aestivum
  unsure (1)..(100): unsure at all Xaa locations
  Clone ID: PAT_TA_57621.pep
MLYHLPVAAAQKASEAQPQEQVPLVQQQQFLGQQPPFPPIGSGQPFXFPSQQPYLQLQPFPQPHLSHSQPQPFXPQQPYPQPRPQNSQPQQPISQQQQEH

SEQ ID NO: 163204 - protein, 75 aa, Triticum aestivum
  Clone ID: PAT_TA_57622.pep
RDSKGDLSVDFSTINPKKPNSALRKVARVRLTSGFEITAYIPGIGHNLQEHSVVLVRGGRVKDLPGVRYRIIRGT

SEQ ID NO: 163205 - protein, 101 aa, Triticum aestivum
  unsure (1)..(101): unsure at all Xaa locations
  Clone ID: PAT_TA_57623.pep
GRREAPTARGQARGPRGARAKGRDXARQRAAKACNHLPQARGTPAPHTQGVDRAXTGYDPTNTFACTTHEAAPLTSCLSGESPQEPDTCRRMPDRNTCRTT

SEQ ID NO: 163206 - protein, 85 aa, Triticum aestivum
  unsure (1)..(85): unsure at all Xaa locations
  Clone ID: PAT_TA_57624.pep
EDDYSVDMWSLGCMFAGMIFRKEPFFYGHDNHDQLVKIAKVLGTDGLNAYLNKYRIELEXXVEALFFRHSRKPWXKVYFNADNQH

SEQ ID NO: 163207 - protein, 60 aa, Triticum aestivum
  unsure (1)..(60): unsure at all Xaa locations
  Clone ID: PAT_TA_57625.pep
ASGRSKRTKLIYPWLPRHCCSIVXPKFKSLAGRLQPPYWGNPWASQPNSLGAHSPFAACV

SEQ ID NO: 163208 - protein, 137 aa, Triticum aestivum
  Clone ID: PAT_TA_57626.pep
PALKGDFVRYGKRSARGILNDLQYSLARYYLNNFADGTKQDAMDLLQGRYITSVSRDMAPPTKAGFVESYASARLAFALVSGAFMFMMMSLRHARHDARHLLLSLLWAGLCIGITHFVRSNGRVFTNRPRAHKSSHP

SEQ ID NO: 163209 - protein, 52 aa, Triticum aestivum
  unsure (1)..(52): unsure at all Xaa locations
  Clone ID: PAT_TA_57627.pep
YKSSSMNKGQQFVKDAXHVLSGDRPAKKPLVKGFCFEMRYRSILELRRKSFY

SEQ ID NO: 163210 - protein, 75 aa, Triticum aestivum
  Clone ID: PAT_TA_57628.pep
GNEVQDHQFSTIYMIGDNPKVDINGVLKAGPPWSSVLTRTGVFRGNDNDPKFPADLVVDTVDDAISCILEKECIR

SEQ ID NO: 163211 - protein, 103 aa, Triticum aestivum
  unsure (1)..(103): unsure at all Xaa locations
  Clone ID: PAT_TA_57629.pep
RTLFGRPRQADGGRRAAGAGSGAGNQTGTTXGTGKDEGRHAXAEQGAQXGRADAXGNGGPXEGVGEGGTPDAKRGXKPXDQEKGEXKDKAETQXEDRQTKAAE

SEQ ID NO: 163212 - protein, 232 aa, Triticum aestivum
  unsure (1)..(232): unsure at all Xaa locations
  Clone ID: PAT_TA_57630.pep
KTFIILALLAIVATTATIAXVELQCXQLQPQNASKEQPQKQVCLIQXKQQISGQQHPFPPQQHTMTKXQPFPSQTYHLCSCNHFSRRNYPYTQTQLPYTMPEPFGPQQLYPQPQXQYSQPQQPILQHQQQQEQHQQQQQILQQILQQQLIPCRDVVLQQXIAHGSSQVLQQSTYQLVQQXCCQQLWQIPEQSRCQAIHNVAHAIILHQQQQQQHQQQPLSQVCLRQSQQQYP

SEQ ID NO: 163213 - protein, 97 aa, Triticum aestivum
  unsure (1)..(97): unsure at all Xaa locations
  Clone ID: PAT_TA_57631.pep
WLTRSSTWLIGEANRILNGIHSLLNQNVVDFXDTVDNLWHKLKGWNCSVGAKKENLSCMHLHEVIDGLNKERCLMGLGLITNEFCHERDKMQTMMQV

SEQ ID NO: 163214 - protein, 79 aa, Triticum aestivum
  unsure (1)..(79): unsure at all Xaa locations
  Clone ID: PAT_TA_57632.pep
MFADSTNPESVLLDQNFIEDMRTMPIYIKGKTKXFMERAXWNDTSFLCNMNVMDYSLFVGVDKQKKELVFGIIDYLRQY

SEQ ID NO: 163215 - protein, 156 aa, Triticum aestivum
  Clone ID: PAT_TA_57633.pep
MKVFILALLALTATTAIAQLESTCSQGFGQCQHQQPGQQQLLEQMKPCVAFLQQQCSPVRMPFLQIQVQQLSSCQIMQYQCCQQLAQIPERIRCHAIHSVVEAIMQQQPQQQWQEPQQQAQHKSIRMLLENLSLMCSISVPVQCQQQQQLGQQQQQ

SEQ ID NO: 163216 - protein, 116 aa, Triticum aestivum
  unsure (1)..(116): unsure at all Xaa locations
  Clone ID: PAT_TA_57634.pep
MKTCLSXALLAIVATSAIAQMENSHIPGLERPSQQQPLPPQQTLSHHQQQQPIQQRRQPFFYFLPCSQQQQQPLSQQQQPPFSQQQPPFSQQQQPLSQQQQPPFSQGKVVSHLCVQ

SEQ ID NO: 163217 - protein, 126 aa, Triticum aestivum
  Clone ID: PAT_TA_57635.pep
KIIRNTLVSGGVRGTLPWMAPELLNGSSSKVSEKVDVFSFGIVLWEILTGEEPYANMHYGAIVGGIVNNTLRPPVPANCGPEWRRLMEQCWSPDPAQRPAFTEIAARLRSMSAAANQQAKAAAAAK

SEQ ID NO: 163218 - protein, 70 aa, Triticum aestivum
  Clone ID: PAT_TA_57636.pep
CDQVPVERLVEHWVNNVTPALPQGATQAETAMPGGSPELPGEGELAKTATPEGSLELPGEGELAKKASVI

SEQ ID NO: 163219 - protein, 214 aa, Triticum aestivum
  Clone ID: PAT_TA_57637.pep
RILGAHHGLISTYALETLVLYIFHLFHESLDGPLAVLYRFLDYYSKFDWDNRAISLHGPISLSSLPELVTDSPGIHDDCFLEREKFLRECAQMFTAPPRNNERNTRPFPRKFLNIVDPLKQSNNLGRSVSKGNFYRIRSAFDLGARKLGKILQVPANSIVDEVNQFFRSTLKRNLGRARPDVQGTAVNLNIERDTRVHLYTVIPVRIYLISLVV

SEQ ID NO: 163220 - protein, 120 aa, Triticum aestivum
  Clone ID: PAT_TA_57638.pep
YQQLQQLCCQQLFQIPEQSRCQAIHNVVHAIILHHHQQQQQQPSSQVSYQQPQEQYPSGQGSFQSSQQNPQAQGSVQPQQLPQFQEIRNLALQTLPAMCNVYIPPYCSTTIAPFGIFGTN

SEQ ID NO: 163221 - protein, 85 aa, Triticum aestivum
  unsure (1)..(85): unsure at all Xaa locations
  Clone ID: PAT_TA_57639.pep
GVSSSADSEDDPDWEGYRATRSRSRQNSLTRNSSNSKEPGDGKNKPRDVTTTGSGNDDSNIPDGNNDGVNQCSEEHENVAEXQHS

SEQ ID NO: 163222 - protein, 159 aa, Triticum aestivum
  unsure (1)..(159): unsure at all Xaa locations
  Clone ID: PAT_TA_57640.pep
TIVLQQPPISQQQQQQQQQQXPFTQQQQPPFSQQPPISQQQQPPFSQQQQPPFSQQQQIPVIHASVLQQLNPCKVFLQQQCIPVAMQRCLARSQMLQQSICHVMQQQCCQQLRQIPEQSRHESIRAIIYSIILQQQQXAQQQQQQGQSIIQYQQQQPQQ

SEQ ID NO: 163223 - protein, 91 aa, Triticum aestivum
  unsure (1)..(91): unsure at all Xaa locations
  Clone ID: PAT_TA_57641.pep
PXXVXXSXXXXCLSXXXLXPPPPPLCCXXPPXCLLVXFXCXGXXXXXXXGWXFSLSRXXSXXPFXCXXPFXPGGPPPXLLXKPASXRWVGP

SEQ ID NO: 163224 - protein, 76 aa, Triticum aestivum
  Clone ID: PAT_TA_57642.pep
QASSAQYKSTMKTFLILALLAIVATTATIAVRVQCHNCSPKSLEQPQEQFHWSTQISGRTPFHHTHIERTFIHTFE

SEQ ID NO: 163225 - protein, 40 aa, Triticum aestivum
  Clone ID: PAT_TA_57643.pep
FQQPVLPRHPSFSQQPLPPFSQHQSPFSQPREPFFLFLLF

SEQ ID NO: 163226 - protein, 56 aa, Triticum aestivum
  Clone ID: PAT_TA_57644.pep
KHIDIRYHFIRDCVENGKIGVNYVPTGDQLADLLTKPLGRLKFLELRRRIGMVVVK

SEQ ID NO: 163227 - protein, 147 aa, Triticum aestivum
  unsure (1)..(147): unsure at all Xaa locations
  Clone ID: PAT_TA_57645.pep
RLLYACPALAARRTCGVYLSAARDKRPCCDELAKVPNFCRSEALHILMDGRVTNEGEVNASLLHEDMHRGKKXTRELIADIVRREECNLETVLGTSTNYGAATCNIPRTRLSVTLYNSRLEQRIILWCLLSINSHGPYVFTNGAARV

SEQ ID NO: 163228 - protein, 126 aa, Triticum aestivum
  Clone ID: PAT_TA_57646.pep
SQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 163229 - protein, 234 aa, Triticum aestivum
  Clone ID: PAT_TA_57647.pep
FSQQQQPVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPLYRTTTSVPF

SEQ ID NO: 163230 - protein, 74 aa, Triticum aestivum
  Clone ID: PAT_TA_57648.pep
NDKMKSCSRVIPFYATPMACSFVLRACLVIECPFGSIGTHQERHGGPRDCVVQLCDELDVYFVSADTEQRQWLK

SEQ ID NO: 163231 - protein, 81 aa, Triticum aestivum
  Clone ID: PAT_TA_57649.pep
SCLICAGLYFDRKKRTTKRDFVFLSLARNVYPELCYKVWQGTAIPQGRKISSKISPLGTQNKMVHYQNFVLCLRHVSPTDR

SEQ ID NO: 163232 - protein, 64 aa, Triticum aestivum
  Clone ID: PAT_TA_57650.pep
GNNILQNYRRHAPLDYQLPELVRISCQQCSSTKDNMHKAAVLHHQRTPAPRRRARCAARSVTPF

SEQ ID NO: 163233 - protein, 66 aa, Triticum aestivum
  unsure (1)..(66): unsure at all Xaa locations
  Clone ID: PAT_TA_57651.pep
DGNAARDSKKTRIEPRAIQLVVRTDXELSRLLGMDTMVSGGVLHNIHKPCVPNRPEAQARAGDDYS

SEQ ID NO: 163234 - protein, 102 aa, Triticum aestivum
  unsure (1)..(102): unsure at all Xaa locations
  Clone ID: PAT_TA_57652.pep
MSALEPTHQRQQQPESHLRYQQPMQRYTLCQGSVQPSYLNPXAQGSVQSEQLPQFLEIMNLMLXTLPGLGTGYIPPSSLTTIAPFAPPRNDIDKGISLVLYI

SEQ ID NO: 163235 - protein, 82 aa, Triticum aestivum
  Clone ID: PAT_TA_57653.pep
WSSVYALLVYLKISSLLRSCRNLSFFLKKHATNGRQMFQHRKVGDHAWVFQTSYKKHLFFTFRDCSILQFIIRLDNYDFTYI

SEQ ID NO: 163236 - protein, 235 aa, Triticum aestivum
  unsure (1)..(235): unsure at all Xaa locations
  Clone ID: PAT_TA_57654.pep
DPFGDFSTSSAPPPPVHSSTGNISTSSQNLEAASDFGAFESNTVDTAKDPFDFSSTGNFGKADVAPLAAPKTGASDFGAFIANTQEAAKDPFDLSSSINGRADQTPLAAPKPNTKKENFQVKSGIWADSLSRGLIDLNITGPKKVNLADVGVVGGLSDGFDDKAQSSWTGGSSQPSWNMGAGGSGQPSWNMGAGGXWPRNVWNSSVYARRWHRELGKLQQVSVWWLQMSSIGEHF

SEQ ID NO: 163237 - protein, 97 aa, Triticum aestivum
  Clone ID: PAT_TA_57655.pep
VNTRHLRDYTHKSQLFLVSQPSSPLHHEQHLSFIQRLHPSGHVLLPSSFLSSRWHPEGQACPPLYPSRASKYDCAHHVDHKSDPRLQDAKWRNAHAS

SEQ ID NO: 163238 - protein, 58 aa, Triticum aestivum
  Clone ID: PAT_TA_57656.pep
SDLELSVLLWLCRYAQGLWSKVIQEAKNLPTRVERSAPPVIHAYVLLPITGDVSYIDD

SEQ ID NO: 163239 - protein, 113 aa, Triticum aestivum
  Clone ID: PAT_TA_57657.pep
GGTERQKGGKNEGKGERGGPHGHYAKGRKGERGKGEKGGKPRGLRVTQAQTTDRGVNLGDPKEEIKTSQARGRKVGTFKTAAPFFFFFFFFFFFFFFFFFFFFFFFFFFFFFF

SEQ ID NO: 163240 - protein, 254 aa, Triticum aestivum
  Clone ID: PAT_TA_57658.pep
RTRGFSQQQPPFSQQQQPVLPQQPSFSQQQLPPFSQQQSPFSQQQQIVLQQQPPFLQQQQPSLPQQPPFSQQQQQLVLPQQQIPFVHPSILQQLNPCRVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPLYRTTTSVPFGVGTGVGSY

SEQ ID NO: 163241 - protein, 44 aa, Triticum aestivum
  Clone ID: PAT_TA_57659.pep
LYHRSMGSRLSPAMVFIHQQSSRVTAPQGHPRYVMRKQSNKHEI

SEQ ID NO: 163242 - protein, 64 aa, Triticum aestivum
  Clone ID: PAT_TA_57660.pep
HAIRSLYCISATQVVYQLCLTRWSALRAVKYIDCSYNFRRAHACVSFAYSMERTVACTSAPYRS

SEQ ID NO: 163243 - protein, 166 aa, Triticum aestivum
  unsure (1)..(166): unsure at all Xaa locations
  Clone ID: PAT_TA_57661.pep
NQRAQQPXPRRTEXTAAXKAXTXXPHQHSXXAXGGGTXXRXXKXRNTXXGXXREGGDTGSQXXNXAXXKXXXEXAXTXGXPQNQXXXXKXPXXPKGAXRXGHTXXXXXXATPPXGQTXATGAGDETRRNRNSXPXRKAQXPXXDXGXPXXPRSHXREAEGPTKAEE

SEQ ID NO: 163244 - protein, 198 aa, Triticum aestivum
  unsure (1)..(198): unsure at all Xaa locations
  Clone ID: PAT_TA_57662.pep
TYKYLTFVVPLASFTNKKEVRGCACYPQPQQPISQQQAQQQXILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGSFQSSQQNPQAQGXSVQPQQLPQFQEIRNLALQTXASMCNVYIPSYCSTTICAFGIFRTN

SEQ ID NO: 163245 - protein, 47 aa, Triticum aestivum
  unsure (1)..(47): unsure at all Xaa locations
  Clone ID: PAT_TA_57663.pep
WLRSAHTNAGPATAESTKIMYGGSVNGAYCKELADXPDLDVFLAGGA

SEQ ID NO: 163246 - protein, 249 aa, Triticum aestivum
  unsure (1)..(249): unsure at all Xaa locations
  Clone ID: PAT_TA_57664.pep
QQQQPPFSQQQPPFSQQQQPVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVHVPLYXTTTSVPFGV

SEQ ID NO: 163247 - protein, 200 aa, Triticum aestivum
  Clone ID: PAT_TA_57665.pep
RPGRRALGRVASGATCVQRLDGSRDSAIHTRYRISQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFL

SEQ ID NO: 163248 - protein, 108 aa, Triticum aestivum
  unsure (1)..(108): unsure at all Xaa locations
  Clone ID: PAT_TA_57666.pep
MKQFREMQQQCCQRLPQIPQLFRCDAIRAFIYYIILQXQQQVQGSIQTAQRQPQQVGQCGFRPQRRSPQQLGQRPLLQPLGQGSFLSPLPITQLEVVTFLALRSLPPL

SEQ ID NO: 163249 - protein, 109 aa, Triticum aestivum
  Clone ID: PAT_TA_57667.pep
VRACWTGRMSPQLWVLTYTIWASLLLSSSKAMVMTVSVLVWICSFPPRPRVCSMGAILDNEEVWQCLTVVCSIAVLHMVMVVRQNEVPMVVLGRTQQRWGLCYHQQRSR

SEQ ID NO: 163250 - protein, 86 aa, Triticum aestivum
  Clone ID: PAT_TA_57668.pep
DYYLELVSKGVGKPKEELAEFLRGPRYFRAQEAIDYGLADTILHSLDGSFKPKDLTAQLAKAQEMRQSGKRAPAGAGRWSTPTAPR

SEQ ID NO: 163251 - protein, 170 aa, Triticum aestivum
  unsure (1)..(170): unsure at all Xaa locations
  Clone ID: PAT_TA_57669.pep
PFSQQQQLDIPTQQQQQQLAQQQXIPIAQPSVQQQLNPCKVFLQQQRSPEAMPQRLARSQMWQQSSCHAMQQRCCQQLRQIPENMXYEANRAIIYYIMLDEQQQELCTNLMRNNPEQADKVAXHSQQQAEQQFGQWSLQQPXQNMGQQPPQQPQQVLEGTFLQTHQIANL

SEQ ID NO: 163252 - protein, 125 aa, Triticum aestivum
  unsure (1)..(125): unsure at all Xaa locations
  Clone ID: PAT_TA_57670.pep
YVPVSYHGAKFIGXNMEENQDXQKKTMXGYEAYTGVIXRGALHRLSSQWKLLIGSNQATAGQQIVELVWVNSPRCDKKVRTTXPAHFXYSHSPFYTLRCIKXPAANSGNGGSGTSAKLLPLSSTQ

SEQ ID NO: 163253 - protein, 167 aa, Triticum aestivum
  unsure (1)..(167): unsure at all Xaa locations
  Clone ID: PAT_TA_57671.pep
GQGQPGQRQQPGQGQHPEQGQQPGQGQQGYYPTSPQQPGQGQQLGQGQQGYYPTSPQQPGQGQQPGQGQQGHCPMSPQQTGQAQQLGQGQQIGQGQQPGQGQQGGHGHQPGQGQQXRQEKQGYHSPYRVTAEQGADRPQEKQGHHTAKHVTTERQTDGRDALTASQR

SEQ ID NO: 163254 - protein, 150 aa, Triticum aestivum
  unsure (1)..(150): unsure at all Xaa locations
  Clone ID: PAT_TA_57672.pep
GRVGQSQCEGLLHPGDPFVLLASELLKQEVQKLKEEVTVTTVVNTAPKSSLARGTASFQDANELLKQEVQKLKEEVKEMSERLPPGDPNLKPPRVGFLLNWGEKARRDMSQYPFIHYFQTLTCVVSAWSNGLPPQALDNSGSTRXTCLRT

SEQ ID NO: 163255 - protein, 177 aa, Triticum aestivum
  unsure (1)..(177): unsure at all Xaa locations
  Clone ID: PAT_TA_57673.pep
SETQRGVRPDQTTCVNSDILTHIDACRECLYRHCVPVELTDMLARSXMWLYCTCHVMQQRWCXSRASQAYSNRRCEAIRAIIVVHYICMNSTRFNGSIQCDNHEPKQLSQCASHPHLHRRQQLEQEPKQQHLAQGTFLQAHQIRSLEVMTNIARRTADTKCHXMLAQYTTTSSVPFG

SEQ ID NO: 163256 - protein, 242 aa, Triticum aestivum
  unsure (1)..(242): unsure at all Xaa locations
  Clone ID: PAT_TA_57674.pep
MKTFLILGLLAIVATTATAAIVALELXLQPQNPSQQQPQEQVPLVQQQQFLGQQQPFPPQQPYPQPQPFPSQQPYLQLQPFPQPQLPYSQPQPFRPQQPYPQPQPQYSQPQQPISQQQQQQQQQQQQQQQQEQQILQQILQQQLIPCMDVVLQQHNLAHGRSQVLQQSTYQLLQELCCQHLWQIPEQSQCQAIHNVVHAIILHQQQKQQQPLSSQVXFQQPQQQYPLXPGXFPPSQQTHRPR

SEQ ID NO: 163257 - protein, 140 aa, Triticum aestivum
  Clone ID: PAT_TA_57675.pep
GRFGNGEDIKIWCDPWIPRGSTRRIISPKGNNLLSKVFELINPITNQWDEDLIRQTFWAEDAKVILQIPLQDDTEGEMSDFKWKKLWALPLPNKVLHFLWRLATNSLLVRTKLKRKGKKRRATTKQRKQTKSGRRHQQES

SEQ ID NO: 163258 - protein, 65 aa, Triticum aestivum
  Clone ID: PAT_TA_57676.pep
LGVRRWSVCLQGCGRIPRRLVKQMSSYYVVSCTYLLICGSAHKLNKMVYVPMRNALVMNKSEVPC

SEQ ID NO: 163259 - protein, 199 aa, Triticum aestivum
  unsure (1)..(199): unsure at all Xaa locations
  Clone ID: PAT_TA_57677.pep
GDVATSGIAEMETSCFLGXERPWYLQTLQLKETFPQQPPCSQQQQPCPQQPPFWQQQPSFWQXTHYFAQNHRPVVPQQPXYSLHYQQTVLPQQPAFXEQQHQQLYXQQIPIVHAYILHQLIPCRVLLQQQRCPVAMPHHLARSQMWEQSRSNVMQQRWCLQLPRMPXQFRYEAIRAIIFYIMLKTTQVLDRPHQQQPQQ

SEQ ID NO: 163260 - protein, 91 aa, Triticum aestivum
  Clone ID: PAT_TA_57678.pep
AVSADECKGDRQDMIKECGQYTKWPAEPKLDPSKACCAVWQKANIPCLCAGLTKEKEKIWCMEKVGYVANFCKKPFPHGYKCGSYTFPPLA

SEQ ID NO: 163261 - protein, 107 aa, Triticum aestivum
  Clone ID: PAT_TA_57679.pep
KFRSSKLHQTQHIATSCTHQASPHRCSPPPSWTEGSGSTWAARMRGERPLLRTKHQMGNPHWLPPGHKEKYQNTSAQNFRTNDFTYRYKIISGSNGDVHGDHKFLQT

SEQ ID NO: 163262 - protein, 99 aa, Triticum aestivum
  Clone ID: PAT_TA_57680.pep
PPIHTLLIFVLLRDATTRALVHIGESIRPCIEETGQPAGRYLTKKELSARTTITTLITTTASIYTWIAMAATPSSTSADTYLPHQPLLLNYTNSNVAYV

SEQ ID NO: 163263 - protein, 79 aa, Triticum aestivum
  unsure (1)..(79): unsure at all Xaa locations
  Clone ID: PAT_TA_57681.pep
CLMRGHGSGLVCRAVCCARITXLECQCYEATYVRPVFHRFGDRYANVRLLTTCSLRCTTCVLEGDAPVMVVRCNAERMV

SEQ ID NO: 163264 - protein, 92 aa, Triticum aestivum
  Clone ID: PAT_TA_57682.pep
SDHGQKDMTLQEQKPFSVVSTNHPLPSFNRNESCLEQFPEKVKLGSQKELPVQVKLEQSIGRGKENEPLSILPATLPHSSLNRNSLHIEKIP

SEQ ID NO: 163265 - protein, 48 aa, Triticum aestivum
  unsure (1)..(48): unsure at all Xaa locations
  Clone ID: PAT_TA_57683.pep
PPSTATIALSIAHKSRYCPRQNQSSPYIPKXCMRETFAIITGISIIGT

SEQ ID NO: 163266 - protein, 157 aa, Triticum aestivum
  Clone ID: PAT_TA_57684.pep
SSYVVGRQTSTTSSKGLHRFPLSHRAVPIISASASLYMSSRDYIICDLVAHSVYTSLDGVHALETVSRDHSRSTSRPCFYSTACHHGENVWVPPLGHVDVRVDTGQAQYGVRPWPRLERHRIRRRGHRSQSHWMALAPLQCIRSRQLSARSPGSPWP

SEQ ID NO: 163267 - protein, 163 aa, Triticum aestivum
  Clone ID: PAT_TA_57685.pep
RTRGLGSGDPVFEGWMRSTESSYKDKFRGWVGFSVPVSHRITAGCDILLMPSRFEPCGLNQLYAMQYGTVPVVHGTGGLRDTVETFNPFGAKGEEGTGWAFSPLTVDKMLWALRTAMSTFREHKPSWEGLMKRGMTKDHTWDHAAEQYEQIFEWAFVDQPYVM

SEQ ID NO: 163268 - protein, 248 aa, Triticum aestivum
  unsure (1)..(248): unsure at all Xaa locations
  Clone ID: PAT_TA_57686.pep
PASQQEPGQGQQGQIPASQQQPGQGQQGHYPASLQQPGQQGHYPTSLQQLGQGQQIGQPGQKQQPGQGQQTGQGQQPEQEQQPGQGQQGYYPTSLQQPGQGQQQGQGQQGYYPTSLQQPGQGQQGHYPASLQQPGQGQPGQRQQPGQGQHPEQGQQPGQGQQGYYPTSPQQPGQGQQPGQGQQGHYPASLQQPGQGHPGQRQQPGQGQQPEQGQQPGQGQQGYYPTSPQQPGQGKQLGQGXXRGTTQL

SEQ ID NO: 163269 - protein, 241 aa, Triticum aestivum
  unsure (1)..(241): unsure at all Xaa locations
  Clone ID: PAT_TA_57687.pep
SATFSIVKQCHALGCFPRVKIVHTSRWIHGQIYIPEINWILMVLCVAVTVAFGDTTLIGNAYGIACMTVMLVTTFLMSFIVIFVWQKNIIFALLFLLFFGSIETVYLSSSLMKVHQGGWVPLVLAFIFMSVMFVWHYGTKKKYQFDLQNKVSMRSILSLGPNLXXVRVPGIGLIYTELVTGVPAIFTHFVTNLPAFHEVLVFLCVKSVPVXPYVQPDERYLXVGRIGPXAYXRMYRCIVRV

SEQ ID NO: 163270 - protein, 148 aa, Triticum aestivum
  Clone ID: PAT_TA_57688.pep
LQQQLIPCMDVVLQQHNLAHGRSQVLQQSTYQLLQELCCQHLWQIPEQSQCQAIHNVVHAIILHQQQKQQQQLSSQVSFQQPQQQYPLGQGSFRPSQQNSQAQGSVQPQQLPQFEEIRNLALQTLPAMCNVYIPPYCTIAPFGIFGTK

SEQ ID NO: 163271 - protein, 257 aa, Triticum aestivum
  unsure (1)..(257): unsure at all Xaa locations
  Clone ID: PAT_TA_57689.pep
QSGYFPTSRQQSGQGQQPGQGQQSGQGQQGQQPGQGQQAYYPTSSQQSRQRQQAGQWQRPGQGQPGYYPTSPQQPGQEQQSGQAQQSGQWQLVYYPTSPQQPGQLQQPAQGQQPAQGQQSAQEQQPGQAQQSGQWQLVYYPTSPQQPGQLQQPAQGQQGYYPTSPQQSGQGQQGYYPTSPQQSGQGQQGYYPTSPQQSGQGQQPGQGQQPRQGQTGYYPISPQQSGQGQQTRQGAQGYYPTFSQQSGQGQXTRHEXQ

SEQ ID NO: 163272 - protein, 110 aa, Triticum aestivum
  unsure (1)..(110): unsure at all Xaa locations
  Clone ID: PAT_TA_57690.pep
FLQERFTYPALREFSPLPESTFIATAREAMPVGRVTIEMARGRVRSQQAPPANGEEATQSSQQAAAATRPKKKQARGGGSAGRGATNAARGGRTAGRGERDGARGXKKCW

SEQ ID NO: 163273 - protein, 209 aa, Triticum aestivum
  unsure (1)..(209): unsure at all Xaa locations
  Clone ID: PAT_TA_57691.pep
HYLDAGSEAKITSVVEKEMIANHMHRLVHMENSGLVNMLIDDKYEDLGRMYTLFRRVPDGLSTIRDMMTSYLRETGKHLVTDPERLKDPVEFVQCLLNEKDKHDKIINVAFGNDKTFQNALNSSXFEFFINLNNRSPEFIITVXVDDKLRKGLKGATEKDVGGYTGQSIMLXFRYLRRKDRCXEKYYKQHLAKGLLSAKMVXDDAEKGF

SEQ ID NO: 163274 - protein, 81 aa, Triticum aestivum
  unsure (1)..(81): unsure at all Xaa locations
  Clone ID: PAT_TA_57692.pep
QQSGXISIRYNKHNRSDISVSRNNSGIYTQLVFVTAKLPNFTAIWKKYGVICDTIISQIYTNHATEKIHSNDNLTTCFWIS

SEQ ID NO: 163275 - protein, 111 aa, Triticum aestivum
  Clone ID: PAT_TA_57693.pep
FEIHDISFTIIFIFLLLFQPYEPKGALAFFFLLAYPILLYKAQKIFSPFQRHCLGTLVYGFFLNIDIILLHLFDIYSAKINIHRNKPFVLLCATYVQGRTIISMHLSLCKT

SEQ ID NO: 163276 - protein, 221 aa, Triticum aestivum
  unsure (1)..(221): unsure at all Xaa locations
  Clone ID: PAT_TA_57694.pep
RPRQPPPASLPFAEILSRVPYRSLCRFRCVSKAWRVLCSHRAIQRRVPQTLSGFFHTHHSDGGLRFSNLSGGGAPLVDASLPFLRRRYASVKLEQCSSSLLLCRCRESEDDEECDYVVCNPMTRQWTVLPPIVWQDEEDGXTCVFQSGAALPGSHPGRSARXGXVFALVEVSNDVAIYSSETGRWTRNSEWGGQQRVSCFFCRMCLPEWYDAFSAFGDRGT

SEQ ID NO: 163277 - protein, 228 aa, Triticum aestivum
  unsure (1)..(228): unsure at all Xaa locations
  Clone ID: PAT_TA_57695.pep
QGHQGQQLGQGQQGQQPGQGQQPAQGQQGQQPGQGQQGQQPGQGQQPGQGQPWYYPTSPQESGQGQQPGQWQQPGQWQQPGQGQPGYYLTSPLQLGQGQQGYYPTSLQQPGQGQQPGQWQQSGQGQHGYYPTSPQLSGQGQRPGQWLQPGQGQQGYYPTSPQQSGQGQQLGQWLQPGQGQQGYYPTSLQQTGQGQQSGQGQQGYYSSYHXXSVEHQAASXLKVAKAQQ

SEQ ID NO: 163278 - protein, 267 aa, Triticum aestivum
  unsure (1)..(267): unsure at all Xaa locations
  Clone ID: PAT_TA_57696.pep
PGQGQSGYFPTSRQQSGQGQQPGQGQQSGQGQQGQQPGQGQQAYYPTSSQQSRQRQQAGQWQRPGQGQPGYYPTSPQQPGQEQQSGQAQQSGQWQLVYYPTSPQQPGQLQQPAQGQQPAQGQQSAQEQQPGQAQQSGQWQLVYYPTSPQQPGQLQQPAQGQQGYYPTSPQQSGQGQQGYYPTSPQQSGQGQQGYYPTSPQQSGQGQQPGQGQQPRQGQQGYYPIXSQQSGQGQXPGQGAQGYYPTFSQQSGQGXTPGHEQQPGTWLH

SEQ ID NO: 163279 - protein, 104 aa, Triticum aestivum
  Clone ID: PAT_TA_57697.pep
EQILQLLYYYQLLPWAVLIFVTCFQTTTDAIKIHTPQVHKSHTNHVTLCHQWNESSCEHLAPEYNHSSSVAVLFIRRRLRPEQAGHHPEHTAQRSVLITRLFYR

SEQ ID NO: 163280 - protein, 62 aa, Triticum aestivum
  Clone ID: PAT_TA_57698.pep
IHLLVTYTLKFLHLKNPEAAHSIQKHTCNHYCPCCISGGHELSKSTGNAGARVACGIIGLQA

SEQ ID NO: 163281 - protein, 272 aa, Triticum aestivum
  unsure (1)..(272): unsure at all Xaa locations
  Clone ID: PAT_TA_57699.pep
GQVQQPGQGQQLGQGRQIGQGQQSGQGQQGYYPTSPQQLGQGQQPGQWQQSGQGQQGYYPTSQQQPGQGQQGQYPASQQQPGQGQQGQYPASQQQPGQGQQGQYPASQQQPGQGQQGHYLASQQQPGQGQQRHYPASLQQPGQGQQGHYTASLQQPGQGQQGHYPASLQQVGQGQQIGQLGQRQQPGQGQQTRQGQQLEQGQQPGQGQQTRQGQQLEQGQQPGQRAQGYYPTSPQQSGQGXNTXTSXTPGQXXQQGYYSSSLQTARQGLQGH

SEQ ID NO: 163282 - protein, 256 aa, Triticum aestivum
  unsure (1)..(256): unsure at all Xaa locations
  Clone ID: PAT_TA_57700.pep
GRVGSQQQQPPFSQQQPPFSQQQQPVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPXYRTTTSVPFSCWH

SEQ ID NO: 163283 - protein, 71 aa, Triticum aestivum
  Clone ID: PAT_TA_57701.pep
YIDIEEVFCLLAHIGYSKAYNQEFQHILHELIELVLLLIDPLASKHWWLFPWWQTKSFLHQRHAFLLEFWH

SEQ ID NO: 163284 - protein, 62 aa, Triticum aestivum
  unsure (1)..(62): unsure at all Xaa locations
  Clone ID: PAT_TA_57702.pep
ISHLTPIPCTNAWNSCKCHTRITKSGYEDKXFVRTMYDLTVWXGGNYFLKKKLLSLGSKFAX

SEQ ID NO: 163285 - protein, 147 aa, Triticum aestivum
  unsure (1)..(147): unsure at all Xaa locations
  Clone ID: PAT_TA_57703.pep
FLLALLALVASTTFAQYSEVGGWYNEVGGGGGSQQCPQERPKLSSCKDYVMERCFTMKDFPVTWPTKCGRSGCEHEVRAKXCKQLSQIAPQCRCDSIRRVIQGRLGGFLGIWRGEVFKQLQRAQSLPSKCNMGADCKFSSGYXLVMI

SEQ ID NO: 163286 - protein, 179 aa, Triticum aestivum
  unsure (1)..(179): unsure at all Xaa locations
  Clone ID: PAT_TA_57704.pep
TRATRDTDPTLFSGSTRRIGSTPQTTGSQRTTTGNKAQQPGLGQQXGQGQQGYYPTSLYQPXQGQQLGQGQPEYYPTSQRLGTRPAAXQGKQPRRGQQGYYPTSPYQSXLGHQSRQGQRGYYPSYVWEPGQGQQGYASPYHVIAEHLAALLKVAEAHQLAAQLPAMCLLEGSDSLMTTQ

SEQ ID NO: 163287 - protein, 205 aa, Triticum aestivum
  unsure (1)..(205): unsure at all Xaa locations
  Clone ID: PAT_TA_57705.pep
AQYLDILLPPLLENRLQLPNSDMDLFAHLDCLHIYGTSTLLPAICVILLISSLGCVXFLSKLSSWQRLILLQQVRCMIMXYIACSLNLLSXGLTDGLGGGIESLAAQSILRDLLVKCCVDDAPDVXQSALVLLGDIFRVWPIHIQPRLQELLTAAERAIDFTICKRCCVSLLTTACWTIAELTIMIGKDISPVAIICRYMPWFLF

SEQ ID NO: 163288 - protein, 239 aa, Triticum aestivum
  unsure (1)..(239): unsure at all Xaa locations
  Clone ID: PAT_TA_57706.pep
GPSRAEETQSHVHRMYFMGPNTFREPWHLPYSPPESIIGIVYEDAFNRFIDEINLVAAFEWWEGSVHSILAVLAYPCAWSWKQWRRRKKIHRLQEYVKSEYDHSCLRSCRSRALYKGLKXVGSTPDLMVAYIDFFLXGDEKRLDVAATIRKRFPXCLXFGGEGSYMSPYHLHSDTLLSNLLGXQYVSTAIWNRLVAGLNTQXXGSVKQGSIRSXLXPGXVSWIKSHGNPQLDDXGGSSK

SEQ ID NO: 163289 - protein, 67 aa, Triticum aestivum
  Clone ID: PAT_TA_57707.pep
ERAPTRKRRATPWKTPAPNIVNLRASELFFVFLYLIFFFFFFFFFFIFFFFFFFFFFFFFFFFFFFF

SEQ ID NO: 163290 - protein, 242 aa, Triticum aestivum
  unsure (1)..(242): unsure at all Xaa locations
  Clone ID: PAT_TA_57708.pep
ATSTIAQMETSCIPGLERPWQQQPLPPQQTLFPQQQPFPQQQPPFSQQQPSFSQQQPPFSQQQPILPQPPFSLQQQPVLPQQSPFSQQQLVLPPQQQYQQLLQQQIPIVQPSVLQQLNPCKVFLQQQCXQRLARSQMWQQSSCHVMQQQCCQQLPQIPEQSRYDAIRAITYSIILQEQQQXFVQAQQQQPQQLGQGXVSQSQQQSQQQLGQCSFQQPQQQLGQQPQQQQILQGTFLQPHQIA

SEQ ID NO: 163291 - protein, 259 aa, Triticum aestivum
  unsure (1)..(259): unsure at all Xaa locations
  Clone ID: PAT_TA_57709.pep
TTATIAVRVPVPQLQPQNPSQQQPQEQVPLVQQQQFPGQQQPFPPQQPYPQPQPFPSQQPYLQLQPFPQPQLPYPQPQLPYPQPQPFRPQQSYPQPQPQYSQPQQPISQQQQQQQQQQQQQQILQQILQQQLIXCRDVVLQQHSIAHGSSQVLQQSTYQLVQQLXCCQQLWQIPEQSRCQAIHNVVHAIILHQQQQQQQQQQPLSQVCFQQSQQQYPSGQGSFQPSQXNPQAQGXSVQPQHWPQFXEEIRNLALETLPA

SEQ ID NO: 163292 - protein, 111 aa, Triticum aestivum
  unsure (1)..(111): unsure at all Xaa locations
  Clone ID: PAT_TA_57710.pep
QQHPFSTLQSDDKTIQQXTTILTLQSDDKTIMQHHSGPCNQRLSHASSKYLMNLNHVLSFDVTVHSHRVMSSLPLLYISQSSRHRCAYGSRRTTAVHLGTATKPRLFWPIE

SEQ ID NO: 163293 - protein, 223 aa, Triticum aestivum
  unsure (1)..(223): unsure at all Xaa locations
  Clone ID: PAT_TA_57711.pep
MKTFLILALLAIVATTATTAVRVPVPQLQPQNPSQQQPQEQVPLVQQQQFLGQQQPFPPQQPYPQPQPFPSQQPYLQLQPFSQPQLPYSQPQPFRPQQPYPQPQPQYSQPQQPISQQQQQQQQQQQQQQQQQEQQILQQILQQQLTPCMXXVVLQQHNIARGRSQVLQQSTYQLLQELCCQHLWQIPEKLQCQAXHNVXHAIILHHPXNHXHTIEPGSLQQPQ

SEQ ID NO: 163294 - protein, 231 aa, Triticum aestivum
  Clone ID: PAT_TA_57712.pep
FPSQQPYLQLQPFPQPQLPYLQPQPFRPQQPYPQPQPQYSQPQQPISQQQQQQQQQQQQQQQQQQQQQQQQQQQQQQQILQQILQQQLIPCMDVVLQQHNIAHGRSQVLQQSTYQLLQELCCQHLWQIPEQSQCQAIHNVVHAIILHQQQKQQQQPSSQVSFQQPLQQYPLGQGSFRLSQQNPLAQGSVQPQQLPQFEEIRNLALQTLPAMCNVYIPPYCTIAPFGIFSTN

SEQ ID NO: 163295 - protein, 217 aa, Triticum aestivum
  unsure (1)..(217): unsure at all Xaa locations
  Clone ID: PAT_TA_57713.pep
QPGQGQQGHYPASLQQPGQQGHYPTSLQQLGQGQQIGQPGQKQQPGQGQQTGQGQQPEQEQQPGQGQQGYYPTSLQQPGQGQQIGKGKQGYYPTSLQQPGQGQQIGQGQQGYYPTSPQHTGQRQQPVQGQQIGQGQQGHYPTSLQQPGQGQQGHYLASQQQPAQGQQGHYPASQQQPGQGQQGHYPASQQQPGQGGTGHYPASQQEPGXGAQGSCCS

SEQ ID NO: 163296 - protein, 99 aa, Triticum aestivum
  Clone ID: PAT_TA_57714.pep
GAAPWVYTGYMRPGFPCSRLQVKSSCSFVRCARLGLRLGGLYNSLCHVIASTACFIGSKWTRRVLIDAYLQACYLLMPNSNSYCIHSYSYHDYLMDTLL

SEQ ID NO: 163297 - protein, 244 aa, Triticum aestivum
  unsure (1)..(244): unsure at all Xaa locations
  Clone ID: PAT_TA_57715.pep
KDRMFITATEWATEWGGAKNREAIAPFQRLPFYCCALTFLPFEDPVCTADGSVFDLMSIIPYIKKFGKHPVTGGALKQEDLIPLTFHKNTDGEFQCPVLNKVFTEFTHIVAVKTTGNVFCYEAIQELNVKPKNWKELLTDEPFARKDLITIQNPNALDTKVLGQFDHVRQGLKLXDEELQRMKDDPTYNINVXGDLKQMMKELXTEKGKLAFLMGGGXGQKAQKERAAALXCPFSXRRKSDSKS

SEQ ID NO: 163298 - protein, 232 aa, Triticum aestivum
  Clone ID: PAT_TA_57716.pep
GQQPGQGQQGYYPTSPQQSGQGQQPGQSQQPGQGQQGYYSSSLQQPGQGLQGQYPASQQQPGQGQQGHYLASQQQPGQGQQRHYPASLQQPGQGQQGHYTASLQQPGQGQQGHYPASLQQVGQGQQIGQLGQRQQPGQGQQTRQGQQLEQGQQPGQGQQTRQGQQSGQGQQGYYPTSPQQLGQGQQPGQGQQGQYPASQQQPGQGQQGQYPASQQQPGQGAQGQYPASQTQP

SEQ ID NO: 163299 - protein, 61 aa, Triticum aestivum
  unsure (1)..(61): unsure at all Xaa locations
  Clone ID: PAT_TA_57717.pep
HCLDTTLFYFISEFKQLVWAGPHDIXXHFLCRRCVAVSVACPAAIPLXFLATFPCLRAPRG

SEQ ID NO: 163300 - protein, 66 aa, Triticum aestivum
  Clone ID: PAT_TA_57718.pep
PGPMIRATSRSNRKLRCSTMWRCRSFVLWYLARRYYATTTTIVTSYLHPTLAHGTSRAPHLQGTEI

SEQ ID NO: 163301 - protein, 63 aa, Triticum aestivum
  Clone ID: PAT_TA_57719.pep
FSNQSPDVRKSVVFCLVDIYIMLGKAFVPYLEGLSSTQLRLVTIYANRISQARSGTAIDSANQ

SEQ ID NO: 163302 - protein, 94 aa, Triticum aestivum
  unsure (1)..(94): unsure at all Xaa locations
  Clone ID: PAT_TA_57720.pep
MVASPYLTKTQCCGELVNIWHECRCQALLYLXSSLSRSDYSSLLLLSSSPSXEETVSVRILRTPEDCDLTTAYPLSHRLAKAEPHRHWKQSSLS

SEQ ID NO: 163303 - protein, 248 aa, Triticum aestivum
  unsure (1)..(248): unsure at all Xaa locations
  Clone ID: PAT_TA_57721.pep
PGQGQQGQQPGQGQPGYYPTSPQQSGQGQQPGQWQQPGQGQPGYYPTSPLQPGQGQPGYDPTSPQQPGQGQQPGQLQQPAQGQQGQQLAQGQQGQQPAQVQQGQQPAQGQQGQQLGQGQQGQQPGQGQQPAQGQQGQQPGQGQQGQQPGQGQQPGQGQPWYYPTSPQESGQGQQPGQWQQPGQWQQPGQGQPXYYLTSPLQLGQGQQGYYPTSLXQPGQGQXPGQWXTSGQGAHGYYPTFSQLSGQGA

SEQ ID NO: 163304 - protein, 83 aa, Triticum aestivum
  Clone ID: PAT_TA_57722.pep
KSNHAKGPKKGGKETSRKATPPNTKSQPPKKTNRQKHSKEQGSSQVSHQSTNQREQQLCGHQLCQIPKQSRCQAIHNVVHAIF

SEQ ID NO: 163305 - protein, 107 aa, Triticum aestivum
  Clone ID: PAT_TA_57723.pep
NREILGRRIRFMPAKLKTGGGGAWTDHNGIELTRTHPPSLPCESSALAWETLNGMASKLNSSTANNRTAAVKPDTDEDTILAVTDTVRLSMIKVSLSYIFLGNTFSR

SEQ ID NO: 163306 - protein, 240 aa, Triticum aestivum
  unsure (1)..(240): unsure at all Xaa locations
  Clone ID: PAT_TA_57724.pep
QPFPPQQPYPQPQPFPSQQPYLQLQPFPQPQLPYPQPHLPYPQPQPFRPQQPYPQPQPQYSQPQQPISQQQQQQQQQQQQQILQQILQQQLIPCRDVVLQQHSIAHGSSQVLQQSTYQLVQQLCCQQLWQIPEQSRCQAIHNVVHAIILHQQQQQQQQQQQQQPLSQVSFQQPQQQYPSGQGSFQPSQQNPQAQGXSVQPQQLPQFEEIRNLVLQXATCMXHVYIPPYCTIAPXGIFGTN

SEQ ID NO: 163307 - protein, 116 aa, Triticum aestivum
  Clone ID: PAT_TA_57725.pep
REPGGNSPSSVVRTRWQATQNSFSLCRVGGLYSRDINGCVHEVAFYRIAKVQASISLTRATDNSIAESGTVRPRPSSGESTASVPRAAAHNRRRGAAEISQLCIEAEPVVQGIKPP

SEQ ID NO: 163308 - protein, 77 aa, Triticum aestivum
  unsure (1)..(77): unsure at all Xaa locations
  Clone ID: PAT_TA_57726.pep
GARVRPPVPVRGFRGXXGVRPPXVRXPXPGPRXXHXRWHWWPMKKCKIHHCLADAPIVVAMTNKVVCTIMCDPDQAK

SEQ ID NO: 163309 - protein, 55 aa, Triticum aestivum
  Clone ID: PAT_TA_57727.pep
ENQGFNICPLRNWKKEYYILPLKFDCSDVDWNQFQKDKGDAITSQLFDGTTCCHV

SEQ ID NO: 163310 - protein, 81 aa, Triticum aestivum
  Clone ID: PAT_TA_57728.pep
GILALPPRLMKAKFGMEFAKPIGRIIHVESDADGRCWGAYMRVRVEIDVQEPVIRYVTVTSAKLKTTEMYSVMYEKLPFYC

SEQ ID NO: 163311 - protein, 58 aa, Triticum aestivum
  Clone ID: PAT_TA_57729.pep
QRNAVSSHNNNVREPEIPTQLSPGAAALFEFLPPLIRRELLLHQEADDYVQRAHRCPE

SEQ ID NO: 163312 - protein, 75 aa, Triticum aestivum
  Clone ID: PAT_TA_57730.pep
HIAGSGERRTPDDGREKRGNAVEEHGRDERGRSEHGHGGEQEKSRGYRQVRGQIKEGPVIGLPAGDPETEAAGNE

SEQ ID NO: 163313 - protein, 140 aa, Triticum aestivum
  Clone ID: PAT_TA_57731.pep
VHLYYNIISQPCLVCKNITDAELLHKYSVLHSLPLDKSCKIVRDFLISATAKDCSLMMCFRPRECERTDPEYDSVFLQSVNRTYDYKAYFVDLDVKPLDKMTHYFKLDQKIVNFYTKTGSRFSEGGLAPVMTQRFSHNIE

SEQ ID NO: 163314 - protein, 147 aa, Triticum aestivum
  unsure (1)..(147): unsure at all Xaa locations
  Clone ID: PAT_TA_57732.pep
RFKTLPITXSRLPRNEALVGYIAVXDIETMPEDLKTXLFGSAATSPDSDPSITPGIPLVLYHDTSHEPPEEIAGDRTGGSNIDLPAGEXNKWTGECTYPAQVXIRIQRLCRAFYDDAFTPVLHXHYDAPKEPLVLSIAXTLSLLDLC

SEQ ID NO: 163315 - protein, 65 aa, Triticum aestivum
  Clone ID: PAT_TA_57733.pep
PIVGTSSYTEEKEVGIWEYVVAASFILSLMFKPEQQKLVQTCEGTNLYKLSHALVFSRRDILRNI

SEQ ID NO: 163316 - protein, 251 aa, Triticum aestivum
  Clone ID: PAT_TA_57734.pep
PFLQQQQPVLPQQPSFSQQQLPPFSQQQSPFSQQQQIVLQQQPPFLQQQQPSLPQQPPFSQQQQQLVLPQQQIPFVHPSILQQLNPCKVFLQQQCIPVAMQRCLARSQMLQQSICHVMQQQCCQQLRQIPEQSRHESIRAIIYSIILQQQQQQQQQQQQGQSIIQYQQQQPQQLGQCVSQPQQQLQQQLGQQPQQQQLAHGTFLQPHQIAQLEVMTSIALRTLPTMCRVNVPLYRTTTSVPFGVCTGVGSY

SEQ ID NO: 163317 - protein, 114 aa, Triticum aestivum
  Clone ID: PAT_TA_57735.pep
DPATGYKVSALTGCRAMVKLQCVGSQVPEAVLRDCCQQLADINNEWCRCGDLSSMLRSVYQELGVREGKEVLPGCRKEVMKLTAASVPEVCKVPIPNPSGDRAGVCYWAAYPDV

SEQ ID NO: 163318 - protein, 221 aa, Triticum aestivum
  unsure (1)..(221): unsure at all Xaa locations
  Clone ID: PAT_TA_57736.pep
FSQQQPPFSQQQQPSFSQQQQPPFSQQQPPFSQQQQPVIPQQPSFSQQQLPPFSQQQPPFSQQQQPVLPQQPPFSQQQQXQLLPQQPPFSQQQQQPVLPQQQIPFVHPSILQQLNPCKVLLQQQCRPVAMPQRLARXQMLQESSSHVMQQQCCQQVTLIPQHWRYEAMRAIIYYIILQEQQQVEGCIQSQQQQPQQLVQXATQPQQXAQQQLVQQPQLQQL

SEQ ID NO: 163319 - protein, 284 aa, Triticum aestivum
  unsure (1)..(284): unsure at all Xaa locations
  Clone ID: PAT_TA_57737.pep
IPXGRXPRXPXKQPGQGQQGYYPTSPQQSGQGQQLGQGQPGYYPTSPQQSGQGQQSGQGQQGYYPTSPQQSGQGQQPGQGQSGYFPTSRQQSGQGQQPGQGQQSGQGQQGQQPGQGQQAYYPTSSQQSRQRQQAGQWQRPGQGQPGYYPTSPQQPGQEQQSGQAQQSGQWQLVYYPTSPQQPGQLQQPAQGQQPAQGQQSAQEQQPGQAQQSGQWQXVYYPTSPQQPGQLQQPAQGQQGYYPTSPQQSGQGQXGYYPNXXPHSQDRGXXGYYPTSXAQSGTGQQ

SEQ ID NO: 163320 - protein, 149 aa, Triticum aestivum
  Clone ID: PAT_TA_57738.pep
VFATDVSEVAVEVARLNVQRYGVQDKVEIRHGSWFEPLEDVKGKLMGVISNPPYIPTDDLPGLQPEVGWHEPKLALDGGKDGLDHLLHLCEGLSSALMPGGFFVFETNGNKQSEFLVDFISTKWSSSFCDVEAVLDFADIKRFVRGYRR

SEQ ID NO: 163321 - protein, 259 aa, Triticum aestivum
  unsure (1)..(259): unsure at all Xaa locations
  Clone ID: PAT_TA_57739.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPVLPPQQSPFPQQQQHQQLVQQQIPVVQPSILQQLNPCKLFLQQQCSPVAMPQRLARSQMLQQSSCHVMQQQCCQQLPXIPQQSRYEAXRAIIYSIILQEXQQVQGSIQSQQQQPQQLGPMXVSPPQQQSQQQLGQQPQQQQLAPGYLFC

SEQ ID NO: 163322 - protein, 248 aa, Triticum aestivum
  unsure (1)..(248): unsure at all Xaa locations
  Clone ID: PAT_TA_57740.pep
QQPPFSQQQQPVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCXQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVXPLYRTTTSVPFGVGTGVGSY

SEQ ID NO: 163323 - protein, 139 aa, Triticum aestivum
  Clone ID: PAT_TA_57741.pep
KLPEVWRSIDMDKHEVVLLKGDGVLCQMAKAAVDRSDGQLREFAGRLFVTDELIKYIVESKQLANVIKESPLLELHSLELENIDLIVRKLTAVLESCPVLEVLGLQYCFLIGSNDEHALRAEFTRIKITTLKWDNECRD

SEQ ID NO: 163324 - protein, 124 aa, Triticum aestivum
  Clone ID: PAT_TA_57742.pep
MVWLGKKKMSDLKQQGDEAFKKQDYQNASVFYTQALKMDNFNAKLLSNRSLCLLRMGEGRRAYEDAAECTKLHPKWAKAHYRKGAALMFMKEYDAAYSSLSRALELDPESEEIEKLFWEAMELK

SEQ ID NO: 163325 - protein, 151 aa, Triticum aestivum
  Clone ID: PAT_TA_57743.pep
PHVVPTADVADLAGELAAYDVVFLAALVGMAAEDKAKVIAHLGAHMADGAALVVRSAHGARGFLYPIVDPQDIGRGGFEVLAVCHPDDDVVNSVIIAQKSKDMHANEHRNGRGGQYARGTVPVVSPPCRFGEMVADAAQKREEFANAEVAF

SEQ ID NO: 163326 - protein, 66 aa, Triticum aestivum
  unsure (1)..(66): unsure at all Xaa locations
  Clone ID: PAT_TA_57744.pep
RTRGGSLNLARAIGDMEFKQNKFLPPEKQIVTSNPDINVVELCNEDDXLVLACDGIXDCMSSQQLV

SEQ ID NO: 163327 - protein, 72 aa, Triticum aestivum
  Clone ID: PAT_TA_57745.pep
KLEKHGHQLLQMFEQSRCQAIHNVAHDIILHQQQKQQQQPSSQVSFQQPLQQYPLGQGSFRPSQQNPQVQGY

SEQ ID NO: 163328 - protein, 88 aa, Triticum aestivum
  unsure (1)..(88): unsure at all Xaa locations
  Clone ID: PAT_TA_57746.pep
LVGLLYPIAFSSGTVCHLCILNSHSSSSAFYSCDLRQLRSHERPLAVLLPLCLPTQLLSRDDPNRVCRIAPGSSISCSDCGARNYSXG

SEQ ID NO: 163329 - protein, 64 aa, Triticum aestivum
  Clone ID: PAT_TA_57747.pep
LLVLALLRKNTCCLEFSSVLNILIYYIISCSSSTLTILFSGLQDAPAAADTDLTYPERSWGSRI

SEQ ID NO: 163330 - protein, 200 aa, Triticum aestivum
  unsure (1)..(200): unsure at all Xaa locations
  Clone ID: PAT_TA_57748.pep
PFRPQQPYPQPQPQYSQPQQPISQQQQQQQQQQQQQQQQQQQQQEQQILQQILQQQLIPCMDVVLQQHNIARGRSQVLQQSTYQLLQELCCQHLWQIPEKLQCQAIHNVVHAIILHQQQKQQQQLSSQVSFQQPQQQYPLGQGSFRPSQQNPQAQXSVQPQQLPQFEEIRNLALQTLPAMCNVYIPPYCTIAPFGIFGTN

SEQ ID NO: 163331 - protein, 146 aa, Triticum aestivum
  unsure (1)..(146): unsure at all Xaa locations
  Clone ID: PAT_TA_57749.pep
FQLLGTEPEDYSVNWNSSKGPARAKGLSAPGKLVRHSDSCGKKVPTKKVSFAERPVSFVSSGTMAETATEAVAVGSTAGDVSCEKGXGSDSKLGTFETHTKGFWFQDDGRRWGFIEGTGLGKDGQGILQPVQAIQRPKFLGLGGRI

SEQ ID NO: 163332 - protein, 80 aa, Triticum aestivum
  Clone ID: PAT_TA_57750.pep
LGRGSKAQGVSEHNYYARTSSMLQNLGLEKYEKNFRKGLLTDHTLPLLTDSALKDVKIPPGPRLIILDQIKRDPWLAKAQ

SEQ ID NO: 163333 - protein, 119 aa, Triticum aestivum
  unsure (1)..(119): unsure at all Xaa locations
  Clone ID: PAT_TA_57751.pep
LPGPWLPACRXMLRLQRTVNWVPDGVLRDXCTNVQTHHRVWQVAKHLYSTVGRGCXEHGAHDATGSDRIVSPRCRREVGKLYGVIITAGCRLPIANDAPGDGAMGCHAECAYRHSYASA

SEQ ID NO: 163334 - protein, 69 aa, Triticum aestivum
  Clone ID: PAT_TA_57752.pep
AFLVVSPTISMIYPHHDDNFPYDYSGLSAMSYIIVDSTSSVAAAFVPHNHLMEHRSGPVSCRQDFSSAL

SEQ ID NO: 163335 - protein, 152 aa, Triticum aestivum
  Clone ID: PAT_TA_57753.pep
EAGLVEGGGGFSWKEAEMEEEEGEEYEGIAEESVEEVMRWLELEISSSPGKGGDDGFVTINGNEESCGPSFSAAASSVMASVDTRAGAPPPPTAIPWPWPEPDDDTKAAAAAAHGDADADADMAELVDEEWLVELVTGGGPALEVEYEYGMA

SEQ ID NO: 163336 - protein, 88 aa, Triticum aestivum
  unsure (1)..(88): unsure at all Xaa locations
  Clone ID: PAT_TA_57754.pep
REMSRRSNTDPNDTSVXDLMILVFKTXLLTFGSRLDDPIIFATXIHRMXKLGLSIDEDEEADVADTDMPTMEEDAGESRMEEVDYASA

SEQ ID NO: 163337 - protein, 221 aa, Triticum aestivum
  unsure (1)..(221): unsure at all Xaa locations
  Clone ID: PAT_TA_57755.pep
KPKDHIFIYYADHGGPGVLGMPNRPYIYAGDFIKVLREKHASKSYSKMIIYVEACESGSIFEGLLPEDLNIYVTTASNAVENSWGAYCPGMKSSPPAEYDTCLGDIYSVSWMEDSETHNLKKETLKQQYEVVKTRTSKSKEFDKGSHVMEYGDKTFKDEKLFLYQGXFDPANSNVANRLLLPELEGAINQRDADILFMRKRMAEVKWGIRKRAXGFLREIK

SEQ ID NO: 163338 - protein, 134 aa, Triticum aestivum
  unsure (1)..(134): unsure at all Xaa locations
  Clone ID: PAT_TA_57756.pep
SNQLDVIDLVMYFASNLWDLTQHLHCHRPPVNLIVTLAHWDSCSITVGRLVFESSCMHALLYYPLAEPPIFFCFVLDEIRTTPAGGTLGKAKASLRKRNWRERPCGASQGGGCLRPRXXAVDQGVRKHGCGCGQ

SEQ ID NO: 163339 - protein, 71 aa, Triticum aestivum
  Clone ID: PAT_TA_57757.pep
NPRQTRGLHHSMFCVRFLSICSHPFIISYRVIIKSSALPANLAVSRSVGRSSSHIGIQSFIPFTFGSRQRG

SEQ ID NO: 163340 - protein, 129 aa, Triticum aestivum
  unsure (1)..(129): unsure at all Xaa locations
  Clone ID: PAT_TA_57758.pep
GRTSQARLYPGCQPHAGQSHASXSTYGGWXGLEENFCDXHKLSVXIHHPSYADIYNPRAGTIPRLYSHTLPILNIGQMSATRVHLYQTALISPLWYITAHSVMCLSQRHIWVQRXNDHGRDVLHDLVSP

SEQ ID NO: 163341 - protein, 139 aa, Triticum aestivum
  Clone ID: PAT_TA_57759.pep
RQQQGQGQQGYYPASLQQPGQGQPGQRQQPGQGQHPEQGQQPGQGQQGYYPTSPQQPGQGQQLGQGQQGYYPTSPQQPGQGQQPGQGQQGHCPMSPQQTGQAQQLGPGQQIGQGQQGYYPTSLQQPGQRQQSGQGQQSG

SEQ ID NO: 163342 - protein, 181 aa, Triticum aestivum
  unsure (1)..(181): unsure at all Xaa locations
  Clone ID: PAT_TA_57760.pep
GTLLVYRDKLFGERLVWDSFPYRELKNGVLXEVDGHWVDEGASDVDIGANPYAEGGGDDXGVXDDQXIKVNVIVDTLRLQEQPAFDKKQFISHMKRYIKNLSXRLECDDLDAFKKNGESDTYYIVSRSRTFSXFVDESMHDEAVVVPAXYKEGAVDLSLLDFAHGMPEVKCLSHCMLKCML

SEQ ID NO: 163343 - protein, 239 aa, Triticum aestivum
  unsure (1)..(239): unsure at all Xaa locations
  Clone ID: PAT_TA_57761.pep
AAQTVTVLVRNIPPDPDESIGELAEHFFLVNILTLSTHQVVYNANKLAKLVKEKKKMQNWLDYYQLKYERNTSKRPTVKTGFXLGCFGSKVDAVEHCASEIERIEKEEAEEREKIXEGXKLVVPAAFVSFRTRWGAXVCAQTQQTSNPTXWLTEWAPEPRDVYWDXNLSIPIVHLTVRKVDXFAVAFFFLNFFXVIPIAXXVQSLAILKGIEKGSSXFLKPIIEMPTIKIVIXKGSFPG

SEQ ID NO: 163344 - protein, 147 aa, Triticum aestivum
  unsure (1)..(147): unsure at all Xaa locations
  Clone ID: PAT_TA_57762.pep
QEHQLVLPHQPPLSQDQQPVIPPQLSPICTXQQHQQLAQQQIPVVQPSILQQLNPCQLFLQQQRSPVAMPQRLAXRSCMVEERSCHVMQHRXXQELPQIPQQLRYEAXRAIIYSIISCRQQQGHGSIRSHXQQAQQSGQCVSQPQQH

SEQ ID NO: 163345 - protein, 234 aa, Triticum aestivum
  unsure (1)..(234): unsure at all Xaa locations
  Clone ID: PAT_TA_57763.pep
EERWSLAGKTALVTGGTKGIGRAIVEELAGFGVRVHTCARSDADVQERLRGWAADADAGRLSGRVTASXCDVSVRGDREALMATARAELGGKLDILVNNAGQTFFXAGHAETAEDYARLMATNLESCFHLAQLAHPLLVAAGGGSVVNISSVASAIAYPXLSVYSATKAAMNQLSRNLAVEWASDGIRVNCVAPGGIRSDILQSSGIXRLTWRALLAMGKERRTSRVALGRMGE

SEQ ID NO: 163346 - protein, 217 aa, Triticum aestivum
  unsure (1)..(217): unsure at all Xaa locations
  Clone ID: PAT_TA_57764.pep
FRDREDSEIFGSKLLKEKHPGSTGNSEKQSGKPPLPNNVLAELRKGSYYASLELVQSLCDTSYGLVDIFPVEDRKIALRESLTEINSHIASSEKNGGVCFPMGRGIYRVVHIPEDESVLLNSREKAPYLICVEVLKAETPSHSKGSSDVNKLSKGGIPLANGDVQLPKPPPWAYPLWSRHEPXXYXTDRMLNSTSQXIDQAMAQLWEXKVKIXNVSF

SEQ ID NO: 163347 - protein, 187 aa, Triticum aestivum
  unsure (1)..(187): unsure at all Xaa locations
  Clone ID: PAT_TA_57765.pep
AIRAGAENDALSRSLQERADLLMKIDEEKAQAEAEIEVLKSTIQSGEREINSLKYEVHVVTKELEIRNEEKNMSVRSADVATKQHLEDVKKITKLEAECQRLRGLVRKKLPALLHYSDEMEVESLGMGRDYAFDNLQHMQKENEFLTARFVXTMEEETKMLKEALTKRXNSELQTSRSMYAKIAGKL

SEQ ID NO: 163348 - protein, 227 aa, Triticum aestivum
  Clone ID: PAT_TA_57766.pep
EEAIEAENRAKEEAIEAENRAKEEALEAENRAKAEAIEVENRAKEEALEAENRAKEEAIEAENRAKEEALEAENRAKEEEAAARNRAAEEENERKNHAIQEESGQTTKVTDEEAAGRKEINGDQMDMDSADVAGELVGPIPPLPDTVDNDGASIEQSTSNAQSGDTVTVNEGAIDKVDSSKLDGQDNTSCSMDIDAGSQEEGKNVLAAAASVRCREHTCIFQIKLSR

SEQ ID NO: 163349 - protein, 240 aa, Triticum aestivum
  unsure (1)..(240): unsure at all Xaa locations
  Clone ID: PAT_TA_57767.pep
QQPFPPQQPYPQPQPFPSQQPYLQLQPFLQPQLPYSQPQPFRPQQPYPQPQPQYSQPQQPISQQQQQQQQQQQQQQQQQQIIQQILQQQLIPCMDVVLQQHNIVHGKSQVLQQSTYQLLQELCCQHLWQIPEQSQCQAIHNVVHAIILHQQQKQQQQPSSQFSFQQPLQQYPLGQGSFRPSQQNPQAXQGSVQPQQLPXXFEEIRNLALQTLPGMXCNVYIPPYCTIAPFGIFGTNWRRK

SEQ ID NO: 163350 - protein, 132 aa, Triticum aestivum
  Clone ID: PAT_TA_57768.pep
RGWYEHMALPVSLPLQIRTHNNSITAKCMLLAARLWRSQLVIPPLSVAPVVSELRHLCEIHTLCCGDTSHHPYMASRSCCSLSVTLIWSCTCAYANERRAVGIGGAVLSIMLISCRIDAFPHKHPVANSIQP

SEQ ID NO: 163351 - protein, 136 aa, Triticum aestivum
  Clone ID: PAT_TA_57769.pep
YLEAGRRLLGFPRSKRGAAFPSPAPRAHVFTLCDKICENIFICLRQKFIIIVFCHRCLYFQIPMVVFLRAVISNPTLLRGFSRQPRSCSWWRCASALRHLLLRTGAPSRCLSSAHGALQAVLLLHHHSDDGDAANF

SEQ ID NO: 163352 - protein, 150 aa, Triticum aestivum
  unsure (1)..(150): unsure at all Xaa locations
  Clone ID: PAT_TA_57770.pep
MASSALTKNGPALAKLAETYRDYDDTIETIHNALTEHRNPDTLNRLNDAERATNELEXQEDYDPKLADXERETGXNFFKXSQYPLAEQLYTEPLRRHPQDPNVYTLRAACYSKLPAMPVGLKDAHKRIELDPTVLQRIHRRRVPSQFFMT

SEQ ID NO: 163353 - protein, 128 aa, Triticum aestivum
  Clone ID: PAT_TA_57771.pep
CTEVSTRRTQVRSIIICSIKHLSGWLAACAHSIATCFITNGSLSFPPFSFSGNDDERGSGQSTWTWSWRKLMSRFIGGELNKKSDKTVRAPEPYNLFDHEPSFRNTYGWSISVDKHDYHPLDHSDIGV

SEQ ID NO: 163354 - protein, 63 aa, Triticum aestivum
  Clone ID: PAT_TA_57772.pep
EANPDGMNQFILGTVRHRGGGAELELIWLEKLRRKTARMMVVWLRSDQLAQDGGGEGWLIIYL

SEQ ID NO: 163355 - protein, 272 aa, Triticum aestivum
  Clone ID: PAT_TA_57773.pep
GVTFCNPGLFSTGLHNKEYILKFGFFPLPQELVEKSKDHRRSNSRVARPEAYRTMGTTLQTWWRKFPPFYNVRFVSIDGFLEPIDLKDRAVTVWWLCQKGLEWKLEYKISLEALWEFNGFGDLPRNLTPMYPLLSPNDHEMVYFALAEWRENQSNWLFIPTCARYLLAINPQHKTVVASVCLADYFGNPNIPPDIISSDFQRHIHTVSLDLHIMLMETMKQMSLTSLDPAEYDEEEAKKLMKEEPWTWKLRKQKASSSLQLVLQQPSLARLI

SEQ ID NO: 163356 - protein, 86 aa, Triticum aestivum
  unsure (1)..(86): unsure at all Xaa locations
  Clone ID: PAT_TA_57774.pep
GRVGDEKLELKLGLPGLVQEEPAASSREKRVHQESPALYLGYPPRHSTATTTTTTTGAKRGFLDTVEAKAQGYEKEXARASTCGKE

SEQ ID NO: 163357 - protein, 115 aa, Triticum aestivum
  unsure (1)..(115): unsure at all Xaa locations
  Clone ID: PAT_TA_57775.pep
KGGHAAXPQHTMGGGGDASNVIESLQQLDTQEADPLDSQEVTVGKYQGGGAFKGIPDSVTIGGTXFRAFVKESFNQXKQRIEEVIGTQASXVQRCNSRCGLSLTKISPFFPPTIN

SEQ ID NO: 163358 - protein, 93 aa, Triticum aestivum
  unsure (1)..(93): unsure at all Xaa locations
  Clone ID: PAT_TA_57776.pep
CLLSLHQQLPQPQQRRPLSPVCFXQQSTQTYTSCQGFLQPSDYKPEGQGSVQPHKLWQIEGIGNLXLQTVAGMGKVYTPAYCSKAAFGILATN

SEQ ID NO: 163359 - protein, 73 aa, Triticum aestivum
  Clone ID: PAT_TA_57777.pep
EEAEKHALECNRQHEMCPSDHGEPSVDEGIPLGQDMGISLPAWVEADQSNTTEGGESRTCEGGTPPEHGSLPK

SEQ ID NO: 163360 - protein, 97 aa, Triticum aestivum
  unsure (1)..(97): unsure at all Xaa locations
  Clone ID: PAT_TA_57778.pep
QCHSTTQMLKDQQRKHLQQHLLMIQQNLQQQLIPAWMLYCRQHNILHGKLQVLQQSTYQLLHEWGSXHLWYIPETSXCQSIHNDXHAIIQHQLQKHL

SEQ ID NO: 163361 - protein, 181 aa, Triticum aestivum
  unsure (1)..(181): unsure at all Xaa locations
  Clone ID: PAT_TA_57779.pep
GRVGADDDDEEDDQDDESSPVLAPKQTDQPKDEPVDNSPAKPTPSSGHARSTPPASKSKQKRKSGGDDAKASSGAALKKAKVESDTKTSSIKEETPSSSKPTPKASASSRSANVSPVTEDEIRTVLLAVAPVTTQDLVSRFKSRLRGPEDKNAFAEILKKISKIQKTNGHNYXVVLREDKK

SEQ ID NO: 163362 - protein, 111 aa, Triticum aestivum
  unsure (1)..(111): unsure at all Xaa locations
  Clone ID: PAT_TA_57780.pep
MMGLRNIADRHPWRRSSITLLHGGPAGRCILIYMLSXQDHLTEFLDALVIEHIVLMLVPTVEMTFPYYLCTHVWTFRYVAELICYDPTLHTDYMSALLNGGHSQRLYHFYV

SEQ ID NO: 163363 - protein, 157 aa, Triticum aestivum
  unsure (1)..(157): unsure at all Xaa locations
  Clone ID: PAT_TA_57781.pep
LTVSYDPCTERYSTAYYNRRDVQMALHANVTGAMNYTWATCSDTINTHWHDAPRSMLTIYRELIGADLRIWVCSGDTDAEGPLTATRYFIGGLGLXTTTSWCPWYDDQXEVGGCSQEYNGLTLVSVRGAGHEVPLHSPRQALGLFTXFLQGEPMPGQ

SEQ ID NO: 163364 - protein, 82 aa, Triticum aestivum
  Clone ID: PAT_TA_57782.pep
DCSIKLLKIYVCCIAHSSRLQWYMGERRICQHNHRGQAMMPVTLWMFMHINLPLKSEGPLGLRLPRLLSHVHQSYIRQQALH

SEQ ID NO: 163365 - protein, 59 aa, Triticum aestivum
  unsure (1)..(59): unsure at all Xaa locations
  Clone ID: PAT_TA_57783.pep
SSFRPSQQNPQAQGSVPXLQQLPQFEEIKNLALQTLPAMCNDYIPAYCTIAPFGIFGTN

SEQ ID NO: 163366 - protein, 215 aa, Triticum aestivum
  unsure (1)..(215): unsure at all Xaa locations
  Clone ID: PAT_TA_57784.pep
QPFPQPQLPYPQPHLPYPQPQPFRPQQPYPQPQPQYSQPQQPISQQQQQQQQQQQQQILQQILQQQLIPCRDVVLQQHSIAHGSSQVLQQSTYQLVQQLCCQQLWQIPEQSRCQAIHNGGHAIILHQQQQQQQQQQQQQPVSQVSFQQPQQQYPSGQGSFQPSQQNPQAQGSVQPQQLAQFEEIRNLALETLPAMCNVYIPPXCTIASVGFFGTN

SEQ ID NO: 163367 - protein, 100 aa, Triticum aestivum
  Clone ID: PAT_TA_57785.pep
RTRGGAPECLWLGAVAASRRISGEVALVVAEQATLPESPGGFSCTAKIEWECGGGERASIHAACDVSRLQCEYRHYLFAWRFRAADASSPADSHRAGGEA

SEQ ID NO: 163368 - protein, 175 aa, Triticum aestivum
  unsure (1)..(175): unsure at all Xaa locations
  Clone ID: PAT_TA_57786.pep
ILELRWSGVGIEDWWXNEQFWVIGGTSAHLFAVFQGLLKVLAGIDTNFTVTSKATDDDGDFAELYVFKWTTLLIPPTTVLVINLVGIVAGVSYAINSGYQSWGPLFGKLFFAIWVILHLYPFLKGLMGKQNRTPTIVIVWSVLLASIFSLLWVKIDPFISPTQKALSRGQCGVNC

SEQ ID NO: 163369 - protein, 56 aa, Triticum aestivum
  Clone ID: PAT_TA_57787.pep
TLTRRWELLQPSTKLLHEDSQRHKLVTECHQCMRLQGGWADHADCALRAKGYPRVI

SEQ ID NO: 163370 - protein, 197 aa, Triticum aestivum
  unsure (1)..(197): unsure at all Xaa locations
  Clone ID: PAT_TA_57788.pep
GGYSTDQFELNSAEVLDPANGVWQPIASMGTNMASSDSAVIGGRLYVTEGCAWPFFSSPRGQVYDPRADRWEAMPAGMREGWTGQSVVIDGRLFVISEYERMKXKVYDPETDSWDPVDGPPMPERIMKPLSVSCLDSKIVVVGRGLMWVIGHVKKQSGGNNGGGGRVLVTTWVRWQDVGRPGAFSDDAFKQSRFYML

SEQ ID NO: 163371 - protein, 88 aa, Triticum aestivum
  Clone ID: PAT_TA_57789.pep
QFTCCKSSLVVISSGCPDTTQHYEGIKSFITSQRSHMLPLCMREHQQSRIRSTIFRVTCRHYGSQVAYEALLPCMLSCWPMPCVNCAR

SEQ ID NO: 163372 - protein, 94 aa, Triticum aestivum
  unsure (1)..(94): unsure at all Xaa locations
  Clone ID: PAT_TA_57790.pep
MNEHAMISASRTTTLLVACGPLSVRQALEECRLGQGSLLPSLQHRTGRGXSVQPGQLTLLEEIXNLALRTLAALCNAYISPYCIIVPFGIFGTN

SEQ ID NO: 163373 - protein, 144 aa, Triticum aestivum
  Clone ID: PAT_TA_57791.pep
EGGFNQRAENAEAALKPVADELTSVKRQIHSMTAAIFGTRIGHLGNDVRKKLKAAYTLVEQLYTGAQRIITTASHNNPAPSLIQDTLNMLSMLPARMEELKKSTARTGAINALDPGKGHGCQISTLWEASQGYPSLEEDGSEFN

SEQ ID NO: 163374 - protein, 100 aa, Triticum aestivum; identical to SEQ ID NO: 143758
  Clone ID: PAT_TA_57792.pep

SEQ ID NO: 163375 - protein, 126 aa, Triticum aestivum
  unsure (1)..(126): unsure at all Xaa locations
  Clone ID: PAT_TA_57793.pep
VLSLGQPSEALSAPCEEVVFHVPPQKTKYQILCLHRQQNIRKAMPRDGKLLPSTSLKKYFQVHYTERKLKDYIDPNYDTLKVRLANSDLYANCCVMLGTGKRATVTTNWSEFRHLAKIHEGDNCXL

SEQ ID NO: 163376 - protein, 67 aa, Triticum aestivum
  unsure (1)..(67): unsure at all Xaa locations
  Clone ID: PAT_TA_57794.pep
GKTTSRCRCTAMWTSIQGDLSGLQGALSTQCLIARTVHTAKSLPTQGNIDPXFCNIPMTSWYITLVA

SEQ ID NO: 163377 - protein, 62 aa, Triticum aestivum
  unsure (1)..(62): unsure at all Xaa locations
  Clone ID: PAT_TA_57795.pep
MACAFFFDAEPVGEPGVHALDACALCTKPLARDSDIFMYRGDTPFCSDECRQEQMQXDACAR

SEQ ID NO: 163378 - protein, 67 aa, Triticum aestivum
  Clone ID: PAT_TA_57796.pep
DAHLSAASSWAPFASLIAWRLVANEKSKIYTNEIDGFIVTLGRCTKSMLAMTNNSGCARIIVLIPRP

SEQ ID NO: 163379 - protein, 73 aa, Triticum aestivum
  Clone ID: PAT_TA_57797.pep
TARERVTPYLISDIGALPPYSQDHRRSKQGHIRTPFPPIARPKWPRGPPLELGCIKRWRKRRIHANRHNDYIG

SEQ ID NO: 163380 - protein, 66 aa, Triticum aestivum
  unsure (1)..(66): unsure at all Xaa locations
  Clone ID: PAT_TA_57798.pep
MDCQLENTTELSAFTTFPCGWQMCLIVSCTLVGPYHPCITVTAIKMSVGFASXKKKKKKKKXXXXX

SEQ ID NO: 163381 - protein, 96 aa, Triticum aestivum
  Clone ID: PAT_TA_57799.pep
GDTELMPTSCYMIMATEFIKCTEVAPWKARGSTSSLKKSDTEGVAYTRCCISIPKYQEPKHKTGGQSDRSSDGVDSTILQQCTVNLTSRPREISED

SEQ ID NO: 163382 - protein, 158 aa, Triticum aestivum
  Clone ID: PAT_TA_57800.pep
EEYRLGLFDMIMIKDNHISVAGGITNAMTSVDQFLEKENLAVPVEVETRTLEEVRDLLKYTDENKTSLTRIMLDNMVVPLPSGDLDVSMLKDAVQLINGRFETEASGNVTIDTVKKIGETGVTYISSGALTHSVKALDISLKIDTELALQVGRRTNRA

SEQ ID NO: 163383 - protein, 116 aa, Triticum aestivum
  Clone ID: PAT_TA_57801.pep
GGKRGARPKKQRGKTKKGAKKGRQRERATGGRAQAKEAGTPRVKRAPRRGESTAPGGGAFRRGAGRLLGRGSRRGPSSQRGQEGEREGVPQRVKMGNARRMFPPPPVQKEGPKKWN

SEQ ID NO: 163384 - protein, 66 aa, Triticum aestivum
  unsure (1)..(66): unsure at all Xaa locations
  Clone ID: PAT_TA_57802.pep
YAPPPEGVAVSRSLVGPQGQLNECFGRGLGWGSASPRVGQRSGCHHGFVVVRXQSPPGLRKRDAGA

SEQ ID NO: 163385 - protein, 50 aa, Triticum aestivum
  Clone ID: PAT_TA_57803.pep
RFHYIKLFIFFFFFFFIFLSFISFLLFFFFFFFFFFFFFFFFFGRVGGRV

SEQ ID NO: 163386 - protein, 79 aa, Triticum aestivum
  Clone ID: PAT_TA_57804.pep
NSSPSESEVRVTSVSYMMYKLLFYAHLDCFSINDWDLKYKFLFSSGCSRVTSFLLSVLQYGGASCHLNSKVHLSKFMLY

SEQ ID NO: 163387 - protein, 127 aa, Triticum aestivum
  Clone ID: PAT_TA_57805.pep
SSCNRGLHIYFEALTDQKGSDTSPMNAGLVEHVERTVKSESSRAPDRPVYLVGESVGACIALAVAARNRDVDLVLVLVNPGLASHHSVLSFGDSNLLLTSLRFGIHFAGTSFHRSQLQSLSALLDLV

SEQ ID NO: 163388 - protein, 165 aa, Triticum aestivum
  Clone ID: PAT_TA_57806.pep
GQGQPWYYPTSPQESGQGQQPGQWQQPGQWQQPGQGQPGYYLTSPLQLGQGQQGYYPTSLQQPGQGQQPGQWQQSGQGQHGYYPTSPQLSGQGQRPGQWLQPGQGQQGYYPTSPQQSGQGQQLGQWLQPGQGQQGYYPTSLQQTGEEPYADLHYGVIIGGIVSNT

SEQ ID NO: 163389 - protein, 117 aa, Triticum aestivum
  Clone ID: PAT_TA_57807.pep
GKRSILLWMDRSYLGREAAFAFAQHYTTMPAEMRTTERVASPRAVGRREKRRGPHSTPCRLWTGARRSRVHWEQRSDGVDDERARLSIPCEASDGSARASRTLVELLVGLYVRYELL

SEQ ID NO: 163390 - protein, 227 aa, Triticum aestivum
  unsure (1)..(227): unsure at all Xaa locations
  Clone ID: PAT_TA_57808.pep
WAVHGQPAYYPGSSHEPAHRSPNHGQSAPIIDTAYLVLLLAACVRSSQAYSNHSAHRQQPAQGLHSTHEQQPVQAHQSRHWRLVNYPTSPQQPVQWHQPARGPQGYYPTSXRQSGQGQLGYYPTSPQQSGQGQRGYXYPTSPHQSRQGQQPGQGQQARQGQQGYYPISPQQSGQGQQPGQGQQGYYPTSPQQSGQGQQPGHEQQPGQWLQPGQGQQGYYPTSSQQSG

SEQ ID NO: 163391 - protein, 125 aa, Triticum aestivum
  Clone ID: PAT_TA_57809.pep
QVLQQSTYQLLQELCCQHLWQIPEQSQCQAIHNVVHAIILHQQQKQQQQPSSQVSFQQPLQQYPLGQGSFRPSQQNPQAQGSVQPQQLPQYEEIRNLALQTLPAMCNVYIPPYCTIAPFGIFGTN

SEQ ID NO: 163392 - protein, 230 aa, Triticum aestivum
  unsure (1)..(230): unsure at all Xaa locations
  Clone ID: PAT_TA_57810.pep
QQPVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTFIALRTLPTMCRVNVPXYRTTTSVPF

SEQ ID NO: 163393 - protein, 77 aa, Triticum aestivum
  unsure (1)..(77): unsure at all Xaa locations
  Clone ID: PAT_TA_57811.pep
AYKSDLSKNATRLYHPLGSYILKQSFTQVCCDDVLVDDVCFIADGLRSVIDETLKDREIPTSRWLEVFGXXKKKKXK

SEQ ID NO: 163394 - protein, 47 aa, Triticum aestivum
  unsure (1)..(47): unsure at all Xaa locations
  Clone ID: PAT_TA_57812.pep
STPRPPEPAEGAXEASSAKTSWPEVVGMSAKKAKEIILRDKPDAQIE

SEQ ID NO: 163395 - protein, 75 aa, Triticum aestivum
  Clone ID: PAT_TA_57813.pep
DSRDQVHGSRQTQWTPCKQLWIDMCNGLTANKAHVIYLRPQSDIRSDPASLGHDQVNIETTPMQLKLTSCTRSKK

SEQ ID NO: 163396 - protein, 159 aa, Triticum aestivum
  Clone ID: PAT_TA_57814.pep
KELLQDLKGRVVRAIPGSKIEQGVCGSIQKQREKMLDLNELPPDLNELPHDMDQQQPSIQQGNWTENGRSVYYTQASRDGNPTSHDNVAGQSSAPGAPVVVSLQSESHTLDDTGTEANVPGPTRTELGARAVDGAVQVEEGEDEAGSQPMEPYVGMRFD

SEQ ID NO: 163397 - protein, 77 aa, Triticum aestivum
  Clone ID: PAT_TA_57815.pep
LKDKKKVLQDPGECEKEFEHPSACPSFLVIRRTTCVTKYKMFLQFKFELQKHLIFSYGGSTIVHAVMCVVDSGLCLH

SEQ ID NO: 163398 - protein, 232 aa, Triticum aestivum
  unsure (1)..(232): unsure at all Xaa locations
  Clone ID: PAT_TA_57816.pep
NPFPPQQPYPQPQPFPSQQPYLQLQPFPQPQLPYSQPQPFRPQQPYPQPQPQYSQPQQPISQQQQQQQQQQQQQQQEQQILQQILQQQLIPCMDVVLQQHNIAHGRSQVLQQSTYQLLQELCCQHLWQIPEQSQCQAIHNVVHAIILHQQQKQQQQPSSQFSFQQPLQQYPLGQGSFRPSQQNPQAQGSVQPQQLPQFEEIRNLALQTLPXMCNVYIPPYCTIAPFGIXRTN

SEQ ID NO: 163399 - protein, 61 aa, Triticum aestivum
  Clone ID: PAT_TA_57817.pep
VIHTTGWINPDVTQGRSPLEDIRLSTACMQRDKVFYRATFPKFTDPECTTARPLKPCINPA

SEQ ID NO: 163400 - protein, 182 aa, Triticum aestivum
  unsure (1)..(182): unsure at all Xaa locations
  Clone ID: PAT_TA_57818.pep
KTLSYHSQKRRLLVYEFISNGTLSEALYGMKGVQLDWSMRLQIALDSARGLAYLHDHANPPIIHRDIKSTNILLDSKMTAKXVADFGLSLLVSDSEEGELCTNVKGTLGYLDPEYYMTQQLTAKSDVYSFGVVLLELIVANPPIYEKKYIVREVKTALDMEDTMYCGLKDVMDPVLYKMGGE

SEQ ID NO: 163401 - protein, 92 aa, Triticum aestivum
  unsure (1)..(92): unsure at all Xaa locations
  Clone ID: PAT_TA_57819.pep
GRRGPVRIPVDPASAHASEGGRQGLEVRKVLDSHDEVICHPLSLGVKTGLSYLWRSRACNPFVSLKKEYXGIFWLEEVVPFFQNAALSLECV

SEQ ID NO: 163402 - protein, 46 aa, Triticum aestivum
  unsure (1)..(46): unsure at all Xaa locations
  Clone ID: PAT_TA_57820.pep
RNGTMNLIWTHRVSTYYLLHTFGSLDVEPTFFVSYFESNFPXRVVD

SEQ ID NO: 163403 - protein, 121 aa, Triticum aestivum
  unsure (1)..(121): unsure at all Xaa locations
  Clone ID: PAT_TA_57821.pep
LRKSADDKRSARSKERESGSRPGMKWFEFESRSADPDRWKHSISVADGDGXWRXGSAPPTFIAGPENTGLPRIWHPRGAGFRDDVGVRRSPCPLAHLSGVEQRTPSANIEQRLCGGRVVDR

SEQ ID NO: 163404 - protein, 66 aa, Triticum aestivum
  unsure (1)..(66): unsure at all Xaa locations
  Clone ID: PAT_TA_57822.pep
RPRASRAPGVVGGGGVRAGSGHQDREGGGRRRLHGAVRGAGLVEDGRAGCHXSFWXYFNDVFFVGG

SEQ ID NO: 163405 - protein, 54 aa, Triticum aestivum
  unsure (1)..(54): unsure at all Xaa locations
  Clone ID: PAT_TA_57823.pep
SAQRXRTRGRTRGLQLKNGSGATKLCLSCFRLNSFTKMYIQYMLPWRIYTSFVL

SEQ ID NO: 163406 - protein, 161 aa, Triticum aestivum
  unsure (1)..(161): unsure at all Xaa locations
  Clone ID: PAT_TA_57824.pep
APCTRGALGLTLIAELVGVLQVTTTNDKALCTLCKNLKDPTPALNSWDPSVVMLCTWVXVTCDRGNRASCVHXANLTYVPSEPELGNSXLQYLELYKNTIEGTIXRDIGDLNNLNNLDLHKINASGTIPPTLRELKCLEFLQLSGNRLTGPIPRXELAGIS

SEQ ID NO: 163407 - protein, 50 aa, Triticum aestivum
  Clone ID: PAT_TA_57825.pep
STKSTSVEEGSSLVPKGFANGARRALSSGPGGVPCRRVERHRTRGDQESD

SEQ ID NO: 163408 - protein, 54 aa, Triticum aestivum
  Clone ID: PAT_TA_57826.pep
PGSHPRRADTTRLQQHYILRVLSYPIVTTGAAASFCSRPRQQAYHWNRAAVRSL

SEQ ID NO: 163409 - protein, 275 aa, Triticum aestivum
  unsure (1)..(275): unsure at all Xaa locations
  Clone ID: PAT_TA_57827.pep
PGQGQQSGQGQPGYYPTSLRQPGQWQQPGQGQQPGQGQQGQQPGQGQQSGQGQQGYYPTSLQQPGQGQQLGQGQPGYYPTSQQSEQGQQPGQGKQPGQGQQGYYPTSPQQSGQGQQLGQGQPGYYPTSPQQSGQGQQSGQGQQGYYPTSPQQSGQGQQPGQGQSGYFPTSRQQSGQGQQPGQGQQSGQGQQGQQPGQGQQAYYPTSSQQSRQRQQAGQWQRPGQGQPGYYPTSPQQPGQEQQSGQSAQSGQWALVYYPTSXAQPGQLQXPAQGQQ

SEQ ID NO: 163410 - protein, 57 aa, Triticum aestivum
  Clone ID: PAT_TA_57828.pep
GCFALLYYLEYLPISFTRSTQIYFCNIREKEIAMIGQVSSPIRFRQLDQVKLHKFMT

SEQ ID NO: 163411 - protein, 137 aa, Triticum aestivum
  Clone ID: PAT_TA_57829.pep
AASSLLLSLGVHRSNTFVVCMLCVRHHTSLYHLRSKNSACEYVSTIVSPVVLIWPISIEAVASIKIMSFCRYSSSLSSALICFHASASWPSSQFAQAIHAIQTLAIVMLIESMVCAFARSIIQSIPPTHTYRSAHIG

SEQ ID NO: 163412 - protein, 84 aa, Triticum aestivum
  Clone ID: PAT_TA_57830.pep
VHHRRTYHLKDGEQVKNVMSAAGGAGPSVNLNMPAFLCHPMTEHPCTIIQLLSLYTFNWQSGQATEVLEYQDSILERLHRLLVS

SEQ ID NO: 163413 - protein, 37 aa, Triticum aestivum
  unsure (1)..(37): unsure at all Xaa locations
  Clone ID: PAT_TA_57831.pep
QQQPPFSXQQQPPFSQQXQPFSQQQQPVLPQQLLLSQ

SEQ ID NO: 163414 - protein, 150 aa, Triticum aestivum
  unsure (1)..(150): unsure at all Xaa locations
  Clone ID: PAT_TA_57832.pep
RYLLQQQCMPEAMQRCLARTQMLQQSIXHVMQKHCSQQLRQMPEQSRHEXIRAIIYYIILQQQQQQQRQQQQGQSMMQYQQQQPQQLGQCDCQSQQQLQHELVQETKQQRLGHGTFLQPRHIAELEVMTCIALRTLTTMCSVQVPLDETT

SEQ ID NO: 163415 - protein, 106 aa, Triticum aestivum
  Clone ID: PAT_TA_57833.pep
LEHKWEQLQHMSDGGADQVSQVFEKSQAYVKRFSRYKNPDAVRQVRETLSRYSLVEFELCTLGNLCPDTADEAKALVPSLVPGGRFDSDDRVDKMLNDLSLIKKFE

SEQ ID NO: 163416 - protein, 251 aa, Triticum aestivum
  unsure (1)..(251): unsure at all Xaa locations
  Clone ID: PAT_TA_57834.pep
GAYSHSQGIKGLRDAIASGIASRDGFPANADDIFLTDGASPGVHLMMQLLIRNEKDGILVPIPEYKGYXASIALXGGSLVPYYLNESTGWGLEISDVKKQLEDARSRGIDVRXALVVINPGNPTGQVLAEENQYDIXEVLQNEGLVLLADEVYQENIYADNKKFHSFKKIXRSLGYXRDDLPLVSYQSVSKGYYGGSVVKEGGYMXEITGFSAPVREQIYKXASVNLCSNITGQILAXLGMNPPRLMMNHM

SEQ ID NO: 163417 - protein, 225 aa, Triticum aestivum
  unsure (1)..(225): unsure at all Xaa locations
  Clone ID: PAT_TA_57835.pep
PKSPPAAKAAVVPLKSPATDKANLVPLKSPSAGKSSVVVPITLPSAKDAGTPSRSLQVDKSIPAPQXLPQVDKAAPLPSASPQTSSTTYSEAREETTPXKGYIHQSSEVAVTTSRPSSAPVFPTPRTTVPATPQVQVSTLLPRSASEAAGRSGNDPSPSAPAYVPQTYRNAILGKPGLGTSSSILSYQSTTLGQGTALSQPLSTYASTASLMMPPAGRNRSVVVS

SEQ ID NO: 163418 - protein, 268 aa, Triticum aestivum
  unsure (1)..(268): unsure at all Xaa locations
  Clone ID: PAT_TA_57836.pep
QEQQSGQAQQSGQWQLVYYPTSPQQPGQLQQPAQGQQPAQGQQSAQEQQPGQAQQSGQWQLVYYPTSPQQPGQLQQPAQGQQGYYPTSPQQSGQGQQGYYPTSPQQSGQGQQGYYPTSPQQSGQGQQPGQGQQPRQGQQGYYPISPQQSGQGQQPGQGQQGYYPTSPQQSGQGQQPGHEQQSGQWLQPGQGQQGYYPTSSQQSGQGHQSGQXXTGYYPTSLWQPGQGQQGYASXPYHVSAEYQAXRLKVAKAQQLAAQLXGNVGWRAA

SEQ ID NO: 163419 - protein, 214 aa, Triticum aestivum
  unsure (1)..(214): unsure at all Xaa locations
  Clone ID: PAT_TA_57837.pep
GRVGSNAVEIERKFVKDLKKQTLWMKKMEHVVEKLVCVVHFLRLEIKNVFKKYEDESMEVKGTIQLTLGSADLALHYANIIFKIKSLASFVPSIPKSGVDSLYQALPPYVRSAIQTKLKCHEYKEKRTVEQLTYDMNKTMKWLLPMAESTIRMXASXLGEWQDQGEPNGTNGRKALKIQTLYHADKEKTEHYILDMVLALPISYVRSMRGSTSS

SEQ ID NO: 163420 - protein, 75 aa, Triticum aestivum
  Clone ID: PAT_TA_57838.pep
EPARYSRRITLEHRTVCWKGLVSITAGSTWLPTATQISGPCRCQGSTLSLASSVFSTLNYTPKLQLHMAAGWCYL

SEQ ID NO: 163421 - protein, 221 aa, Triticum aestivum
  unsure (1)..(221): unsure at all Xaa locations
  Clone ID: PAT_TA_57839.pep
FSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPVVXTTTSVHFGVGTGVGFY

SEQ ID NO: 163422 - protein, 91 aa, Triticum aestivum
  Clone ID: PAT_TA_57840.pep
KKVMRDCWHHIEKKLGDQYPPLHSACCNTIRDAKDIHCICDRFTAHELTLLSLAKFAMATHVCGNGLHTDTHCAGYHVPEIKLPPPPTAST

SEQ ID NO: 163423 - protein, 83 aa, Triticum aestivum
  Clone ID: PAT_TA_57841.pep
MKVHSLNLPLFPAFMDIICPFPGFFILPLVVFLLATLCHSINRSCYFSKIHSCSMLTRTEKQILSAYFSVAFRSRYSWSQIKQ

SEQ ID NO: 163424 - protein, 169 aa, Triticum aestivum
  Clone ID: PAT_TA_57842.pep
QQQQQQQQQQQQQEQQILQQILQQQLIPCMDVVLQQHNIAHGRSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 163425 - protein, 233 aa, Triticum aestivum
  unsure (1)..(233): unsure at all Xaa locations
  Clone ID: PAT_TA_57843.pep
QQQFPGQQEQFPPQQPYPHQQPFPSQQPYPQPQPFPPQLPYPQTQPFPPQQPYPQPQPQYPQPQQPISQQQAQQQQILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGSFQSSQQNPQAXQGSVQPQQLXPQFQEIRNLALQTLPAMCNVYIPPYCSTTIAPFGIFGTN

SEQ ID NO: 163426 - protein, 71 aa, Triticum aestivum
  Clone ID: PAT_TA_57844.pep
QPRTRLMLFIFINLFRLIIGGVEGEYILVVGSKKYLVASQKRQIRQVALKSSGYVEEALEISGLSSPSDIS

SEQ ID NO: 163427 - protein, 215 aa, Triticum aestivum
  unsure (1)..(215): unsure at all Xaa locations
  Clone ID: PAT_TA_57845.pep
FSQQQQPTIPKQPSXFSQQQLXPFSQQQPPFSQQQQPQQQQPILPQQPPFSQQQQQPVLPQQQIPFVYPSILQQLNPCKVFLQXXCSPVAMPQSLARSQMLQQSSCHVMQQQCCQQLPHIPQQSRYEAIRAIIYYIILQEQQQVQGSIQSHEQQPQQLGQCVXPPQQQSQHXLVQQPQQQQLAQGXTFVQPHQIAQLEVMTSIVLRTLPTMCRVN

SEQ ID NO: 163428 - protein, 220 aa, Triticum aestivum
  unsure (1)..(220): unsure at all Xaa locations
  Clone ID: PAT_TA_57846.pep
RLLDVASGGGEEALPTKRLFFLYFGLELGRTQQQGKGGRKTLLILALLAIVATTATTAVRVPVPQLQPQNPSQQQPQEQVPLVQQQQFLGQQQPFPPQQPYPQPQPFPSQQPYLQLQPFPQPQLSYSQPQPFRPQQPYPQPQPQYSQPQQPISQQQQQQQQQQQQQQQQQQQQQEQQILQQILQQQLIPCMXXVVLQQHNIAHGXESQVLQQSTYQLXQE

SEQ ID NO: 163429 - protein, 239 aa, Triticum aestivum
  unsure (1)..(239): unsure at all Xaa locations
  Clone ID: PAT_TA_57847.pep
LSQQQQPPFSQQQPPFSQQQQPVLPQQPSFSQQQLPPFSQQQPPFSQQQQPVLPQQPPFSQQQQQQPFVPQQPLFSQQQQQLVLPQQQIPCVHASILXKLNPCQVYLQQECSPVGMPQRLARSQMLRXSNCHAMQQQCCQQXPNIPQRSRYDAMRAIIYSIXLQEQQQDRGSIQTQQQQPQQLGQSVSQPQQQXQHQLEQQTQQQQLAQGTLLQPHQIAQLEVMTVIVLRTLPMMCRVN

SEQ ID NO: 163430 - protein, 240 aa, Triticum aestivum
  Clone ID: PAT_TA_57848.pep
HYPASLQQPGQGQPGQRQQPGQGQHPEQGQQPGQGQQGYYPTSPQQPGQGQQLGQGQQGYYPTSPQQPGQGQQPGQGQQGHCPMSPQQTGQAQQLGQGQQIGQVQQPGQGQQGYYPTSLQQPGQGQQSGQGQQSGQGHQPGQGQQSGQEKQGYDSPYPQPQPFPSQQPYPQPQPFPSQLPYPQPQPFSQQQPPFSQQQQPVLPQQPSSQQQLPPFSQQITVFATTIVLQQQPPFLQQQHN

SEQ ID NO: 163431 - protein, 70 aa, Triticum aestivum
  Clone ID: PAT_TA_57849.pep
GPCLRSQYPMSTLLRSSRRTSQYMLSVEAPVRLIRMALSKHVLRSRAGHARPCPEKSTRAAASRSRRTGP

SEQ ID NO: 163432 - protein, 262 aa, Triticum aestivum
  unsure (1)..(262): unsure at all Xaa locations
  Clone ID: PAT_TA_57850.pep
GQQGQQPGQGQPGYYPTSPQQSGQGQQPGQWQQPGQGQPGYYPTSPLQPGQGQPGYDPTSPQQPGQGQQPGQLQQPAQGQQGQQLAQGQQGQQPAQVQQGQQPAQGQQGQQLGQGQQGQQPGQGQQPAQGQQGQQPGQGQQGQQPGQGQQPGQGQPWYYPTSPQESGQGQQPGQWQQPGQWQQPGQGQPGYYLTSPLQLGQGQQGYYPTSLQQPGQGQQPGQWQQSGQGAHGYYPTSPQLSGQGARXRQWLXTRQGQQGTTQ

SEQ ID NO: 163433 - protein, 28 aa, Triticum aestivum
  Clone ID: PAT_TA_57851.pep
LDVCKSLPTQCNIDPKFCNIPITSGYYL

SEQ ID NO: 163434 - protein, 246 aa, Triticum aestivum
  unsure (1)..(246): unsure at all Xaa locations
  Clone ID: PAT_TA_57852.pep
GQSGYFPTSRQQSGQGQQPGQGQQSGQGQQGQQPGQGQQAYYPTSSQQSRQRQQAGQWQRPGQGQPGYYPTSPQQPGQEQQSGQAQQSGQWQLVYYPTSPQQPGQLQQPAQGQQPAQGQQSAQEQQPGQAQQSGQWQLVYYPTSPQQPGQLQQPAQGQQGYYPTSPQQSGQGQQGYYPTSPQQSGQGQQGYYPTSPQQSGQGQQPGQGQQPRQGAQGYYPXFSQQSGQGQNTRQGAQGYYPTFSQQ

SEQ ID NO: 163435 - protein, 177 aa, Triticum aestivum
  unsure (1)..(177): unsure at all Xaa locations
  Clone ID: PAT_TA_57853.pep
HASGKKKFERLLKSVEEKFPSKVXRAVVRFNAPLAHQMMAGADVLAVTSRFEPCGLIQLQGMRYGTPCACASTGGLVDTIMEGKTGFHMGHLSVDCNVVEPADVKKVVTTLKRAVKVVGTPAYHEMVKNCMIQDLSWKGPAKNWXDVLLELGVEGSEPGVIGEXEIAPLAMENVAAP

SEQ ID NO: 163436 - protein, 172 aa, Triticum aestivum
  unsure (1)..(172): unsure at all Xaa locations
  Clone ID: PAT_TA_57854.pep
MKTFLILALLAIEATTDTSAFRVPXPKSQPQDTSXLQPQDQVPLEPQQRAVGQQQPXPALQPYPQPQPXPSQQTIXLQLKPLSQPQLPYSHPQPFRPQHAYPRPQPQYSHPQQPISQQQHQQGLPRLQQQQQHQEXILQRILPQQLTPCMDVVLQRHNIARGRSQVLQQRTY

SEQ ID NO: 163437 - protein, 239 aa, Triticum aestivum
  unsure (1)..(239): unsure at all Xaa locations
  Clone ID: PAT_TA_57855.pep
RRDRRLHQEEQGDCWAGGCGGHREGGGTGCHRASEGRALSIGLSSSRQVEEGETCLGKFELSGIPPAPRGVPQITVCFDIDANGILNVSAEDKTTGQKNKITITNDKGRLSKEEIEKMVQEAEKYKSEDEEHKKKAESKNALENYSYNMRNTIKXDEKIASKLPADDXKKIEDAIDAAIQWLDTNQLAEAXMKFEDKMKELEALCNPIIAKMYQGXAGADMXGGMDDDTPAASGGPGPR

SEQ ID NO: 163438 - protein, 99 aa, Triticum aestivum
  Clone ID: PAT_TA_57856.pep
KTAATIFAATTTNHYLSHDLLTSVSHQAPIAEQEPEPQQQQQPFTQQQQPQCSQVGQQRQYLGHRVWFILHAPVPRQQHLPSNHPSCRQHHNPSRCCHI

SEQ ID NO: 163439 - protein, 120 aa, Triticum aestivum
  unsure (1)..(120): unsure at all Xaa locations
  Clone ID: PAT_TA_57857.pep
MEMCRIWVQSLGVDCPGIQLTSNTVDSLLCKFGDDWKSAFGLFQWAQLSGNYKHTAYACSRMIDLLXKMRQIXXMWDLLSDMHCRGLVTVETAAKSIRRLAGARRWKDAVMLFDKLEDMG

SEQ ID NO: 163440 - protein, 91 aa, Triticum aestivum
  unsure (1)..(91): unsure at all Xaa locations
  Clone ID: PAT_TA_57858.pep
GRGEGTHPLCPNQCLNAMHIMRSXYTPAVELFYTCDGACSFACILSFAHILWALILCAXEIEQNVSYVAYRATSAIHNGWLCCLDYPALLA

SEQ ID NO: 163441 - protein, 100 aa, Triticum aestivum
  Clone ID: PAT_TA_57859.pep
YTSQALLDYTLCAITSLTELWRMLYSVKNDGLRSIWRNGDSLTTIPFTDSKVMIMFSMTKPTRRCSLETPSRLKFILVWSWNWLSIRRISRGKLYLLARM

SEQ ID NO: 163442 - protein, 57 aa, Triticum aestivum
  Clone ID: PAT_TA_57860.pep
APIPVLASNGTLLVVLCVGDTSSAHRCQHTEPNGSHHLKFSHAGMVTRTGPCANCYC

SEQ ID NO: 163443 - protein, 165 aa, Triticum aestivum
  unsure (1)..(165): unsure at all Xaa locations
  Clone ID: PAT_TA_57861.pep
PAFHTPMVIGTWHLACFAWFVSTVCLFFMATWEDQVCDQVSCSGLSSAVGVDRLFLGGPRIVIGRSCVAHYGCVGHTCRTQRATLFHLAESPFCDPTVVLPLLSIXAELLAFPSCQQSCLFRPQWPTFGKDPFGFPLTSSCCFFSATGVGAYSVPQVASYLLRFI

SEQ ID NO: 163444 - protein, 129 aa, Triticum aestivum
  unsure (1)..(129): unsure at all Xaa locations
  Clone ID: PAT_TA_57862.pep
VREDELTALGEGAPVTARRAAQANVDKHIPEPYLARALVAPDVYHTGGSKEGGHQHQRRXVLDQNVDFFDMDGDGVIYTXKTYXGLRALDFNMNEAMLNAIGIHTTLSYTALTRWVPCVLYHSYIDNIH

SEQ ID NO: 163445 - protein, 105 aa, Triticum aestivum
  unsure (1)..(105): unsure at all Xaa locations
  Clone ID: PAT_TA_57863.pep
MTTRVTRQAHWRQPXQGHHGYYPTSVPQTGLGQQSGQGPQGYYSSYHASVEHQAASLTEAYAQELAAQLSAMRRLEGGDSIGGQPTIELSVSRMELRHACTLAIQ

SEQ ID NO: 163446 - protein, 54 aa, Triticum aestivum
  Clone ID: PAT_TA_57864.pep
ARGAHICIHAHHTPYPHQQPFPSQQPYPQPQPFPPQLPYPQTQPFPCRDVVLQQ

SEQ ID NO: 163447 - protein, 168 aa, Triticum aestivum
  unsure (1)..(168): unsure at all Xaa locations
  Clone ID: PAT_TA_57865.pep
ASLSSRPQEQAPLXQQQQFLGQEQPFPPQQAYPQPEPFPSQHPYLQLQPFPQPQLPYAQPQPFRPHQPYPQPXPQYSQPQQPISQQQQQQQHQQHQEQQEQQSLQQILQQQLITCMDVELHQHNIAHGTSQVLQQSTYQLLQDLCCQHLWQTPEQSQCHAIHNAADAI

SEQ ID NO: 163448 - protein, 64 aa, Triticum aestivum
  Clone ID: PAT_TA_57866.pep
LELQKIQYVLLKLEEEHEYTRLKVSDKRTRVLLKDYLYGRKDHRGKKKRSPFCGCVRSKSRTEP

SEQ ID NO: 163449 - protein, 81 aa, Triticum aestivum
  Clone ID: PAT_TA_57867.pep
MEPKPREGPMLCGNNCGFFERAATMSMCSKCHREMAMKQEQAKLDDSSFDRIEDGGDAAKEHCAADNTRVAGAHGEGNTLI

SEQ ID NO: 163450 - protein, 129 aa, Triticum aestivum
  unsure (1)..(129): unsure at all Xaa locations
  Clone ID: PAT_TA_57868.pep
LSLLQKQIPCREGEVQLQLIQPGKSRGLEQRTYQLLEELWWQHLWQIPEQSQCQAIHNGGHAIILPQQQKQQQQPSSQVSFQQPLQQYPLSQGFLRPSXQNPQAQGXSVQPQQLPQFEEIRNLALQTLP

SEQ ID NO: 163451 - protein, 217 aa, Triticum aestivum
  unsure (1)..(217): unsure at all Xaa locations
  Clone ID: PAT_TA_57869.pep
QLPYPQPQLPYPQPQPFRPQQPYPQSQPQYSQPQQPISQQQQQQQQQQQKQQQQQQQQQILQQILQQQLIPCRDGGLEQHSITDGSSQGLQQRTYQLVQQLGWQQLGENPEQARGQAIHNGGHAIILDXQEPPPPPPPPKQPLGQGFFQQAQQQYSLRQGFFQPSXQNPQGQGSGQAQQLAQVEEIRNLTLETLPAMCNGYIPSYWTIASGGIFGTN

SEQ ID NO: 163452 - protein, 57 aa, Triticum aestivum
  Clone ID: PAT_TA_57870.pep
SVRTVESLTQSSCELMLRDEHLNATIATRRDTLMTSMRQLACANITLANYGRDRKLN

SEQ ID NO: 163453 - protein, 215 aa, Triticum aestivum
  unsure (1)..(215): unsure at all Xaa locations
  Clone ID: PAT_TA_57871.pep
GRATGRGFVVQHKSFAENYRLYARSHFIKAIELGIILTVYAAHSVIARNTLVYIVMMISSWFLVVSWIMAPFAFNPSGFDWLKTVYDFEDFMTWIWFPGGIFSKAEHSWEVWWYEEQDHLRTTGLWGKILEILLDLRYFFFQYGGVYQLKIADGSRSIAVYLLSWICVAVIFGXFVLMSYTRDTYAAKQHLYYRVVQTAIIILGVLVLILFLKLL

SEQ ID NO: 163454 - protein, 84 aa, Triticum aestivum
  unsure (1)..(84): unsure at all Xaa locations
  Clone ID: PAT_TA_57872.pep
RATYRERREQNANARYGLGGMRKTRCRAHSKPNLCTMACGTCSVKGKRVPPGSFWNTXLCGTCYTEMNTHGNKTKCPYRNKQLH

SEQ ID NO: 163455 - protein, 160 aa, Triticum aestivum
  Clone ID: PAT_TA_57873.pep
QQQPSVEENQQLNLCKEFLLQQCNPEEKVSLLQSMIPFLRPKTSQQNNCQLKRQQCCRQLAHISEPSRCPAIHNIVHAIIMQQQQQQQQQQQQQQQQQHVDRGFVQPQPQQLGQGMPMQPQHQLGQGLSLPQQLAQFKLVRLLVIQTLPMLCNVHVPSDC

SEQ ID NO: 163456 - protein, 65 aa, Triticum aestivum
  unsure (1)..(65): unsure at all Xaa locations
  Clone ID: PAT_TA_57874.pep
SRRYILCILPATKFSAAAVAAHPDFQLQNIIQETLYSTLPPXXIPQGTCNXMYTNKRIISQKAQH

SEQ ID NO: 163457 - protein, 64 aa, Triticum aestivum
  Clone ID: PAT_TA_57875.pep
PLDGQLHTGVSIHSVCNIRLLLPSYLISRLLVRGRYPLLSMVVSIVSLRKGALLISCVICNHSI

SEQ ID NO: 163458 - protein, 249 aa, Triticum aestivum
  unsure (1)..(249): unsure at all Xaa locations
  Clone ID: PAT_TA_57876.pep
VWYSLIAVSCGYYPTFPQQPGPDHQSGXQSQQSGQWQLVYYPTSPQQPGQLQQPEQGQQPRQGQQSAQEPQPGQAQQCGQWPLVDXPTFPQQPRQLPQPAQGQQGVYPTSSQQARPGRQGYYPTFSQQSGQGPQGDXPTFSQQSRQGQQPGQGQQPRPGPQGYYPISSEQSRQGPQPRQGPQGYYPTSSQQSGQGQQPGHEQQPRQWLQPGQGQQGYYPTSSQQSGQGHQSGQGQQGYYPTSLWQPGQG

SEQ ID NO: 163459 - protein, 82 aa, Triticum aestivum
  Clone ID: PAT_TA_57877.pep
LNHPCVVASLEWSYHGIRLRLRSSTAQCPHCLGSRLSHKRRRSALLFWIRCMLRISSSVLHVVRASTWWYAGESARLKCAVV

SEQ ID NO: 163460 - protein, 266 aa, Triticum aestivum
  unsure (1)..(266): unsure at all Xaa locations
  Clone ID: PAT_TA_57878.pep
QGQPGYYPTSLRQPGQWQQPGQGQQPGQGQQGQQPGQGQQSGQGQQGYYPTSLQQPGQGQQLGQGQPGYYPTSQQSEQGQQPGQGKQPGQGQQGYYPTSPQQSGQGQQLGQGQPGYYPTSPQQSGQGQQSGQGQQGYYPTSPQQSGQGQQPGQGQSXYFPTSRQQSGQGQQPGQGQQSGQGQQGQQPGQGQQAYYPTSSQQSRQRQQAGQWQTTGQGQPXYYPTSPQQPGQRGTSGXXRTSXTWALVYYPTFSAQXGQLRQPAQGA

SEQ ID NO: 163461 - protein, 107 aa, Triticum aestivum
  Clone ID: PAT_TA_57879.pep
CTEFKQAKYPFKWRKYMCARCGVHRSEHGVSKAKAKVDDDMENVREELLPPRKRLILRFKRSQALAAAAVAASREKENKEGELEEGEITWSPGSTITKGKRAPRRKP

SEQ ID NO: 163462 - protein, 236 aa, Triticum aestivum
  unsure (1)..(236): unsure at all Xaa locations
  Clone ID: PAT_TA_57880.pep
PQQPYPQPQPFPSQQPYLQLQPFSQPQLPYSQPQPFRPQQPYPQPQPQYSQPQQPISQQQQQQQQQQQQQQQQQQEQQILQQILQQQLIPCMDVVLQQHNIARGRSQVLQQSTYQLLQELCCQHLWQIPEKLQCQAIHNVVHAIILHQQQKQQQQLSSQVSFQQPQQQYPLGQGSFRPSQQNPQAXQGSVQPQQLXPQFEEIRNLXALQTLPGMXCNVYIPPYCTIAPFXXIFGTN

SEQ ID NO: 163463 - protein, 100 aa, Triticum aestivum
  Clone ID: PAT_TA_57881.pep
PLDRSPKRRYVQDLLTHGTLTDERTVETHRQSTSTFVTPQAAYRFGCASFPCSRALQALSRSHITCSLYVFVHKRSLKTPRMVSSSSDSRREPALCGGTR

SEQ ID NO: 163464 - protein, 149 aa, Triticum aestivum
  unsure (1)..(149): unsure at all Xaa locations
  Clone ID: PAT_TA_57882.pep
YPTSPQQSGQGQQPGHEQQPGQWLQPGQGQQGYYPTSSQQSGQGHQSGQGQQGYYPTSLWQPGQGQQGYXQPGQGQQPRQGQQGYYPISSQQSRQGPQPRQGPQGYYSSYHGNGEHQAGRLKGGKGQQLAGQLAAMCPLEGGEPLSGHQ

SEQ ID NO: 163465 - protein, 72 aa, Triticum aestivum
  Clone ID: PAT_TA_57883.pep
KRSHLFFFFFFFIIYFFFFFLNWFFFFFQQSMYSRIQVLISHVNPTNQINLRAQPLDLLTLTERLNCPMFRC

SEQ ID NO: 163466 - protein, 93 aa, Triticum aestivum
  Clone ID: PAT_TA_57884.pep
EGSWFPSFCQFCFFLDVDAEMASAEYKEYSCFYIQQCLSLFTHQSCDIFLALDHILHDVLFLLKCSVTLVMLLCCQFLDVSLSMWNLFLRYVM

SEQ ID NO: 163467 - protein, 140 aa, Triticum aestivum
  Clone ID: PAT_TA_57885.pep
RLQLAHRSVPALVAMVATSLRHRQRLRSSPSFSSKHLVLGKNTNFISLRVVAKSHAGCSKKIIESSKKEPPLRRPLAKILVYIPSKSSYGFQHFFCRFQQNTSRRRPVASPSNRGCNLFSVRFQQKKLYGSSTVPRRLHP

SEQ ID NO: 163468 - protein, 238 aa, Triticum aestivum
  unsure (1)..(238): unsure at all Xaa locations
  Clone ID: PAT_TA_57886.pep
RTRGRRRARPGDRVSPPGDWGEWRERGVVAQGDQPASLERVFADQRVPSWREQLTVRAFVASFFLAVMFNIIVMKLNLTIGVIPSLNVSAGLLGFFFVRLWTSAIERMGLLKQPFTRQENTVIQTCVVAAYGIPYSGGFGNYLLAMSGRIASQATEANNPQNIKNPHLGWIIGFLFLVSFIGLFGLVPLRKIMIIDYKLTYPSGTATAYLINGFHTPQGAKIAEKQVKKLGKXLGSQL

SEQ ID NO: 163469 - protein, 159 aa, Triticum aestivum
  unsure (1)..(159): unsure at all Xaa locations
  Clone ID: PAT_TA_57887.pep
PFSQQQQQPLSQQQQPPFSQQQPSFSQQQQPPFSQQQPPFSQQQQPAFPQQPSLLXQQLPPVVQQQPSFSQQQLPPFSQQQPSLLQQQQPVLPQQPPLLVHPHLPELPEQQQAFVHPSMLPEVKPXRLVLQQKWQPVGMPQRLDQXGKLEENICHVMQQ

SEQ ID NO: 163470 - protein, 160 aa, Triticum aestivum
  Clone ID: PAT_TA_57888.pep
MSLELSMALAAPPGGGLLAPPPPAPPGKEQQVAGVGILLQISMLVLSFVLGHVLRRHRFYYLPEASASLLIGLVVGGLANISNTETNTRTWFNFHEEFFFLFLLPPIILYPFSSVFFLSPKPFFANFGAIVTFAILGTFIASIVTGMLVYLGGLTFLMYK

SEQ ID NO: 163471 - protein, 157 aa, Triticum aestivum
  unsure (1)..(157): unsure at all Xaa locations
  Clone ID: PAT_TA_57889.pep
DSDLQALNHHPIHCMFAPLALSTXATTNMTEINEQLXTYQAEALFATLSSYGKXTSVVHEPLHPHYGSYCXLNNPPLRELLPSMLGXFHLDGSQCTLGLNSLLPYDSYPLGHCSDHSKHLEQEAGGVSLALQTLPAMGSAYMTTYCNIRPFGMLNTN

SEQ ID NO: 163472 - protein, 233 aa, Triticum aestivum
  unsure (1)..(233): unsure at all Xaa locations
  Clone ID: PAT_TA_57890.pep
DPRPSGKRKAKDGNEGKTREKRSAIDEQKHRELDGDGASNNYIHDLMYLAHLNGNKFTSDDVKKRKGLNANSSLHDHHSMPLTKMPRTSPANHLCVNGEILKHSHGTAPTLPVGTNPREAGRLEDSKDCTKNGMTGLLYLEEHNSAVSPSSYGSSEVSLAPAHPDTKYLSQVYSVPAADDRSEYIDQDWXFSGDRVHQKTTMFEAAEAPHVWAEAQLIDSADVVALPYVVPLQ

SEQ ID NO: 163473 - protein, 141 aa, Triticum aestivum
  Clone ID: PAT_TA_57891.pep
KKKKKKKKKKKKKKKKKKKKKKKKKKKKRGATRPLFFFLIFLGQMPPPNILSFFFFAPGKGGASAPFFFGSWGRKNRFFWLPAAHFVPHPLISPPVTLNPFFPPPVYRPPLALWGRSHPLWVFAPPCERANAVSFYPRPFP

SEQ ID NO: 163474 - protein, 191 aa, Triticum aestivum
  unsure (1)..(191): unsure at all Xaa locations
  Clone ID: PAT_TA_57892.pep
FLHRLWRALSGVRECSSSLDLGLSWGAGWTRKTRXLDVAYTTPNTELARTHTLVKNAIVQVDAAPFTQRYLTHYGVLIGLKKKAAASATKEPAEGQEADVAAAATEEAKNIIIVQRKLEKRQQGPTLDSHIEEQFSGGRLLACISXSRPVQRRIADGYILXGKELELYMMKLLKKKAMVPQLTLNSCCMLL

SEQ ID NO: 163475 - protein, 102 aa, Triticum aestivum
  Clone ID: PAT_TA_57893.pep
SSTTHGACTGHLGCAIRSWASIGPALPDCDSLLMLKANGLQLPKAGLKDVLTDIIPHHGPEHVRDPSTVCGTAWMTSKPRTRARHRHERSQLPDGGHEDDGA

SEQ ID NO: 163476 - protein, 185 aa, Triticum aestivum
  Clone ID: PAT_TA_57894.pep
GNRGERQQRLEVIPEVIPDAEEGSKETEIESAARSPFQGSRGVIQTVVDPLEVGIDESLEGASLRHDAACEVVFEAAGKALCNGGTPGPGLHTQLNKAAGKALCSGGTPGPGLHTPLNTAAGKALCNGGTPGPGLHTQLNTAAGKTLCNGGTPVPGLHTPLNAVTGVIDIDNEDDGNGPSHHTGW

SEQ ID NO: 163477 - protein, 194 aa, Triticum aestivum
  Clone ID: PAT_TA_57895.pep
HQPENMYHQMHQKDSKKPQYNTTGKTNRIMDRLQGSLILKFIKASAHQQKFADTNDNTASQYMVYKQRQFRHQRTQTRLHWRTPRTTRLVNPENMYHQMHQKDSKKPQYNTTGKTNRIMDRLQGSLILKFIKASAHQQKFADTNDNTASQYMVYKQRQFRHQRTQTRLLLGRLVLVQPLERLLRASSTFSFSHA

SEQ ID NO: 163478 - protein, 244 aa, Triticum aestivum
  Clone ID: PAT_TA_57896.pep
GQGQPGYYPTSQQPGQKQQAGQGQQSGQGQQGYYPTSPQQSGQGQQPGQGQPGYYPTSPQQSGQWQQPGQGQQPGQGQQSGQGQQGQQPGQGQRPGQGQQGYYPISPQQPGQGQQSGQGQPGYYPTSLRQPGQWQQPGQGQQPGQGQQGQQPGQGQQSGQGQQGYYPTSSQQSGQGHQSGQGQQGYYPTSLWQPGQGQQGYASPYHVSAEYQAARLKVAKAQQLAAQLPAMCRLEGSDALSTRQ

SEQ ID NO: 163479 - protein, 55 aa, Triticum aestivum
  Clone ID: PAT_TA_57897.pep
TLARFTQQSFSFLIHRQLCTLQTTHHVQAAYNPRTFGPASRHIHHSSSSNTTCTH

SEQ ID NO: 163480 - protein, 73 aa, Triticum aestivum
  Clone ID: PAT_TA_57898.pep
IICPKAQRGCAQNMLFWLCQGFTHHGVVQFRPATDVRILHTDHYIYDEIGRNIGAFRWCPRFGAHGSSCLSAS

SEQ ID NO: 163481 - protein, 165 aa, Triticum aestivum
  unsure (1)..(165): unsure at all Xaa locations
  Clone ID: PAT_TA_57899.pep
MKTFLILALLAIGGTTATTAVRVPVPQLQPQNPSQQQPQEQVPLVQQQQFLGQEQPFSPQQPYSQAEPFSLQQPYLEVEPFLEAELPYLQAQPFXPQQPFSQPQPQDLQAQQPISQEEEEEXPPPPPQPPQPPQQILXQILQQQLIPCLDGGLEQHNIAHGRSQV

SEQ ID NO: 163482 - protein, 244 aa, Triticum aestivum
  Clone ID: PAT_TA_57900.pep
MKTFLILALLAIVATTATSAVRVPVPQLQPQNPSQQQPQEQVPLMQQQQQFPGQQEQFPPQQPISQQQQQQQQQQQQQQQQQQQQQQQEQQSLQQILQQQLIPCMDVVLQQHNIAHGRSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 163483 - protein, 194 aa, Triticum aestivum
  unsure (1)..(194): unsure at all Xaa locations
  Clone ID: PAT_TA_57901.pep
ERMTRDQDPLXRYGGVYALALALIXTGNNKSIHQLLLLAGSXVSDDVRRTXTVGLGFVLYTEXLSTTPILECLLSESCNPHARHGXAALAGGISCACTGXSEAISLXEPVTSDGGDCLRQGALIAVAVGMMHTYECFDXSSTGTFMRHLLXIILDKHYDTMSXMGAILACGILDAGGRNVTLKPRSRNKHDKLT

SEQ ID NO: 163484 - protein, 202 aa, Triticum aestivum
  unsure (1)..(202): unsure at all Xaa locations
  Clone ID: PAT_TA_57902.pep
LVVLHKKKKKKKRAGLGLSLGIDILEAPGATGDYRTLLTSKAKAIAKALSAPLDTPPRVFVPGEDEYKAGRENGYDFGFLHIKAIDDAGHDKAVKLKVRGLEAVDRAIGQLARLLWEAEKSGHYQYFLCVTGDHSTPVEYGDHSFEPVPFAICRLRDFVGAIGEGNVMNTPLDDFPLPSVKXGEDLTDDSEPAGHKPEERKA

SEQ ID NO: 163485 - protein, 127 aa, Triticum aestivum
  Clone ID: PAT_TA_57903.pep
GPTTVTGSVTGLKEGLHGFHVHALGDTTNGCMSTGPHFNPAGHVHGAPEDEIRHAGDLGNVTAGVDGVASINITDCHIPLTGPNSIVGRAVVVHGDADDLGKGGHELSKSTGNAGARVACGIIGLQG

SEQ ID NO: 163486 - protein, 224 aa, Triticum aestivum
  unsure (1)..(224): unsure at all Xaa locations
  Clone ID: PAT_TA_57904.pep
ILLQQPYPHQXQPFPSQQPYPQPQXPFPPQLPYPQTQPFPPQQPYPQPQPQYPQPQQPISQQQAQQQQILQQILQQQLIPCRDVVLQQHNIAHASSQVLQQSSYQQLQQLCCQQLFQIPEQSRCQAIHNVVHAIILHHHQQQXQQQPSSQVSYQQPQEQYPSGQGSFQSSQQNPQAQGSVQPQQLPQXQEIKKLALQTLPAMCNVYIPXYCSTTIAPFCIFGTN

SEQ ID NO: 163487 - protein, 84 aa, Triticum aestivum
  Clone ID: PAT_TA_57905.pep
EAVTDAIAGLLGPVGLLLLPVGLLLLIHLLSCDRSPDVFDFAGSPDAVHHVGGSPVGVALMLVLMLALLYYRSALFGGGGGDDE

SEQ ID NO: 163488 - protein, 63 aa, Triticum aestivum
  Clone ID: PAT_TA_57906.pep
MEVGHLRAFLVFLLVQVCLFLKMAASAKVHGRAVPGVPACCSYRPECCECLTADAPLAAAVTP

SEQ ID NO: 163489 - protein, 161 aa, Triticum aestivum
  unsure (1)..(161): unsure at all Xaa locations
  Clone ID: PAT_TA_57907.pep
SISPAPGQRTEHMGVAIELLGQIELHFDRGNFYDFTXMVREFHAPVEVYEQXTYPFAFSTVELPYDYYIGTHVRLRHLLKVTSCVETCERHYLMDSSVHFLCAETYPPLTSINNSIXMDVGIDDCLRIDFDYSNNNYHLTDVTARKIYFLLHRVKINFLAS

SEQ ID NO: 163490 - protein, 128 aa, Triticum aestivum
  Clone ID: PAT_TA_57908.pep
STEDRHLCFCLWWARRRSDLSTVGTHCSYCRSMSNPRCQDHRAISYNFALLAVRPLFGSEADFATLPLRFSVHGIIVWIFFPVPKYVDTPSVQESARCFPVVCPFCPVQVLFEISYRCLTNICSLIVY

SEQ ID NO: 163491 - protein, 158 aa, Triticum aestivum
  unsure (1)..(158): unsure at all Xaa locations
  Clone ID: PAT_TA_57909.pep
PGQRXQGYYPTSPQQPGQGQQLGQGQPGYYPTSQQPGQKQQAGQGQQSGQGQQGYYPTSPQQSGQGQQPGQGQPGYYPTSPQQSGQWQQPGQGQQPGQGQQSGQGQQPGQGQQGYASPYHVSVEHQAASLKVAKAQQLAAQLPAMCRLEGGDALSASQ

SEQ ID NO: 163492 - protein, 83 aa, Triticum aestivum
  unsure (1)..(83): unsure at all Xaa locations
  Clone ID: PAT_TA_57910.pep
FKRCINGNTIMMVGSAPGFPHGLIDPIEELGELASQYGICLHVDLCLGGFVLPFARKLGYPIPPFDFSVKXXLPVHSRMFIKV

SEQ ID NO: 163493 - protein, 68 aa, Triticum aestivum
  Clone ID: PAT_TA_57911.pep
ISCSQYMSPCSGCYILNASILTSCKDKLFPAIYSVIFIYNRNWCRVSTCSAWRFFLLIAYGAQHLVIL

SEQ ID NO: 163494 - protein, 111 aa, Triticum aestivum
  Clone ID: PAT_TA_57912.pep
TFWLSLLFTWLVQVLDLVQKFDCHLSNENTDSEIHEELHDILTAATKLPKAPWEEGVCKVCGLDRDDESVLLCDECDSEYHTYCLNPPLARIPQGDWFCPSCILKPKKNHV

SEQ ID NO: 163495 - protein, 252 aa, Triticum aestivum
  unsure (1)..(252): unsure at all Xaa locations
  Clone ID: PAT_TA_57913.pep
QVQLIVKGASERGAKRIRLHILTDGRDVLDGSSVGFVETIEKDLAQLREQGVDARIASGGGRMYVTMDRYENDWSVVKRGWDAQVLGEAPYKFPNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWXGNRSGYFDETREEXVEIPXDSGITFM

SEQ ID NO: 163496 - protein, 61 aa, Triticum aestivum
  Clone ID: PAT_TA_57914.pep
EVRHLSDPRQDTTSYSWKEPSPCYGRLKALSHDPGNQHMRHGHSHRHVPPLSSLDQDPLYI

SEQ ID NO: 163497 - protein, 229 aa, Triticum aestivum
  unsure (1)..(229): unsure at all Xaa locations
  Clone ID: PAT_TA_57915.pep
GLFNRVSEQDLRDQFYAHGEIESIRMVIQRACAFVTYTTREGAERAAEELANKLVIKGVRLKLMWGKPQAPRQDDDEAGRQGHVSHGGLLPRAVISQQHSSDQPQPPGMEGQQQVAPQGSGYFNIPPPPAVDQRMYPSMDPQRMGAVVRSQEGDGSKAGPQHAGQAQASSSSXQGYPMRPPLPPYYQGAQYPPYYPPPPYGGGYMAPPRMPYPPQYPPYRPMLAAPSAA

SEQ ID NO: 163498 - protein, 138 aa, Triticum aestivum
  Clone ID: PAT_TA_57916.pep
FGSDGTSRLYHLDPISLEVTKTVTVKYQDNDVSYINELEYINGEVWANVWQTDCIARVSHEDGQVASWIFLHELRQQLWKSGNTDIDVLNGIAWDEENDRLFVTGKLWPKLYEIKLRQVDGPPDGSVEKLCPRASFYR

SEQ ID NO: 163499 - protein, 190 aa, Triticum aestivum
  Clone ID: PAT_TA_57917.pep
MYSKVQILLEWSKAQMLLEWCKEQTLLEWRKVQILLEWCKAANQAGMVQGPNPSGMVQDQLYKGSLTLVHQTAIATMSTFYDAIHLIDQQWDMGLEIDGMTYEELLSLQEHIGDVNTGLSEKYICQNMRVHWYVVPTGNRGSDQSVEKDACIICQEEVEARDLVRTLDCGHKCHEVCIRQRLMEKNLYPI

SEQ ID NO: 163500 - protein, 114 aa, Triticum aestivum
  Clone ID: PAT_TA_57918.pep
VPVPQLQPQNPSQQQPQEQVPLVQQQQFPGQQQQFPPQQPYPQPQPFPSQQPYLQLQPFPQPQPFPPQLPYPQPQSFPPQQPYPQQQPQYLQPQQPISQQQAQQQQQQQQQQQP

SEQ ID NO: 163501 - protein, 91 aa, Triticum aestivum
  unsure (1)..(91): unsure at all Xaa locations
  Clone ID: PAT_TA_57919.pep
DPAXRLFXXEXPGEGKXXASSRXXXSXXSXXXXXXXXKXXXXTLGRXGRXAXRRAPTYXTLRPAGGGEXXXGRXXXPAXXPRRXXXXQSKP

SEQ ID NO: 163502 - protein, 89 aa, Triticum aestivum
  Clone ID: PAT_TA_57920.pep
MHCPVLTMDYNVNSVDQIGYNECVNSFMMNVGVNKYAGHYNGNEANGTHMRGNNIIVGNSYNNSVDKRFKTLPTRKMLPTNEYLGGYIF

SEQ ID NO: 163503 - protein, 201 aa, Triticum aestivum
  Clone ID: PAT_TA_57921.pep
ETVLLTLLAGAQEKGAVCLDGTPPGYHLQRGSGDGSNRWLIHLEGGGWCSTIKDCSNRRMYALGSSNFMKPMRFAGAGILGSDQLQNPDFYNWNKVFVRYCDGASFSGDAEGRAQDGSTLHFRGLRIYQAVIDELMEKGLNNATQALLTGCSAGGLATILHCDDFSARFSRDVSVKCLADAGFFLDVKDISGKRSFWSVYD

SEQ ID NO: 163504 - protein, 57 aa, Triticum aestivum
  Clone ID: PAT_TA_57922.pep
PILPGLYCARRSGRCRPTGTSGCFMGAWKDYDSVDGASHWDRSETGGHFEPNTLGLL

SEQ ID NO: 163505 - protein, 102 aa, Triticum aestivum
  Clone ID: PAT_TA_57923.pep
LKVRPGYEHLDDPLHILIEAEFPANVIDARLSKAQEILEELLKPVDESQDYYKRQQLRELAMLNSPLREESPRLSPHPSPHPSPHQGGASPFSNGGMKRSKQ

SEQ ID NO: 163506 - protein, 91 aa, Triticum aestivum
  Clone ID: PAT_TA_57924.pep
SDCIGSYTTGVLQLTALKNNMFYCCTTYTSKKDRHSITLSAFQFQPSHRFIPRQPCQLFQVYITTDPSIMSQTQHLSILIQSFPFPWGGPS

SEQ ID NO: 163507 - protein, 219 aa, Triticum aestivum
  unsure (1)..(219): unsure at all Xaa locations
  Clone ID: PAT_TA_57925.pep
RAASQSQIAPLGARSISTQIVRNRMKSVKNIQKITKAMKMVAASKLRAVQTRTDNSRGLWHPFTALLGDAPSVNVKKNVIVAITSDKGLCGGINSTSVKVSKALQKMTSGNLAHEKESKYVILGEKGKVQLIRDSRKHIEMTVSELQKNPINYTQVXAVLADDILKNVEYDAIRVXVVYKFQSVISFRPTLATILSPDVMGEXQNLAGRVGQLDSYEIE

SEQ ID NO: 163508 - protein, 94 aa, Triticum aestivum
  unsure (1)..(94): unsure at all Xaa locations
  Clone ID: PAT_TA_57926.pep
QVRGSMETEGKXPQQVSTCVSHPEHHSRRHVGQETEQQHLAQGTFLYXHHIAEVEVMTSIERRALPMMRRANEPMDRTTTSVPLLVGTGVGAYW

SEQ ID NO: 163509 - protein, 68 aa, Triticum aestivum
  Clone ID: PAT_TA_57927.pep
ALVGSMSAAWSWCSTCVVFAILLLHPSSLALISTVVVRILTAEGCFCISSQRSPGHRSLEEASTPMAP

SEQ ID NO: 163510 - protein, 97 aa, Triticum aestivum
  Clone ID: PAT_TA_57928.pep
GFDVLDEFLSLMFSSSKIDYTTAPIASKQNCQCCLLLATSGLGDFSHVESYSATVSTYRGALPSPQVSFTPAAILRMGFKASIFSYGPHGFVYAPSV

SEQ ID NO: 163511 - protein, 48 aa, Triticum aestivum
  Clone ID: PAT_TA_57929.pep
VTPARGERLANRDLEPGAQLQNQLTLDTLQQEVARLMGQNTHMLASAN

SEQ ID NO: 163512 - protein, 84 aa, Triticum aestivum
  Clone ID: PAT_TA_57930.pep
LQQNTTTVNCCVRPLALQLKTIIPWQKRTSPVQTDLRGQHRTISLLRSGSHLVNANVKRHLLGCPRTNQISRRHHQERRQLLNG

SEQ ID NO: 163513 - protein, 164 aa, Triticum aestivum
  unsure (1)..(164): unsure at all Xaa locations
  Clone ID: PAT_TA_57931.pep
QQQQQQQQEQQILNKFCXQQLIPCMDVVLQQHNLAHGRSQVLQQSTYQLLQELCCQHLWQIPEQSQCQAIHNVVHAIILHQQQKQQQQLSSQVSFQQPQQQYPLGQGSFRPSQQNSQAQGSVQPQQLPQFEEIRNLALQTLPAMCNVYIPPYCTIAPFGIFGTK

SEQ ID NO: 163514 - protein, 140 aa, Triticum aestivum
  unsure (1)..(140): unsure at all Xaa locations
  Clone ID: PAT_TA_57932.pep
MXXXXXXXXXPPPPPPPXPPPPPPSAGGGPPFFFXPXXXXXXRXPPRPPRPPPPAPPPPPXPPPPPPPPPPPPPAPPPPPPPPPPPPPPPPPPPPAAPAPXPPPPPPPPPPPPARPPPPPPPPPPAPPPPPXRXPPPPPP

SEQ ID NO: 163515 - protein, 179 aa, Triticum aestivum
  unsure (1)..(179): unsure at all Xaa locations
  Clone ID: PAT_TA_57933.pep
GVQCIGVCSGVFAYNLPPSREVEQLYRCKGITIMRIYCVQLQALDALRGCGIRLMLGTTNNDVGVLGGSLYGDTCWVHVHVKPYHSTGETIRXIADGIDVTGGAVQNMLAAMRNLNKGLAVAGLGGAIKVCTAVXRFDVLTNSYPPXXPVLAEPYMVDIVRKLASSSAPLVGNVYRYFA

SEQ ID NO: 163516 - protein, 228 aa, Triticum aestivum
  Clone ID: PAT_TA_57934.pep
MVGHSRSGDGPRKLLGGGDQGGAVAFGSGSDPSKRFHVALTATDALYSQWQSRIMYYWYKQMRVRPDSDMGGFTRILHSGKPDGLMDEIPTLVVDPLPEGADRGYIVLNRPWAFVQWLQKANIKEDYILMAEPDHIFVKPLPNLAHGEEPAAFPFFYIKPTDNEKILRKFFPEEKGPVSNIDPIGNSPVIIQKVHLFSCEKISSRILSCAKYTSVTMTGSAILDAKMA

SEQ ID NO: 163517 - protein, 131 aa, Triticum aestivum
  Clone ID: PAT_TA_57935.pep
NTRRKQQILQQILQQQLIPCMDVVLQQHNIAHGRSQVLQQSTYQLLQELCCQHLWQIPEQSQCQAIHNVVHAIILHQQQKQQQQPSSQVSFQQPLQQYPLGQGSFQPSQQNPEAQGSLFPRTGAVVEAEQN

SEQ ID NO: 163518 - protein, 230 aa, Triticum aestivum
  Clone ID: PAT_TA_57936.pep
GNGKTMLAKAVASESEATFFNVSASSLTSKWVGEAEKLVRTLFMVAVERQPSVIFMDEIDSVMSTRLASENDASRRLKSEFLIQFDGVTSNPDDLVIVIGATNKPQELDDAVLRRLVKRIYVPLPDPNVRRLLLKNQLKGQAFKLSNHDLERLAVETEGYSGSDLRALCEEAAMMPIRELGPQNILTIKANQLRPLRYEDFRSAMTAIRPSLQKSKWDELEKWNEEFGAS

SEQ ID NO: 163519 - protein, 56 aa, Triticum aestivum
  unsure (1)..(56): unsure at all Xaa locations
  Clone ID: PAT_TA_57937.pep
GAXACLCXGSPPQFLLFGFVSGAGACPVFSCAVGAXVVAAALFPVSSGGGAPASGG

SEQ ID NO: 163520 - protein, 68 aa, Triticum aestivum
  Clone ID: PAT_TA_57938.pep
ASAHEMVGEVDGGVVVTILVALASTAEGRHILLILVACCRHHARRPIHPSHSALRLGLQVRHGVTRAR

SEQ ID NO: 163521 - protein, 68 aa, Triticum aestivum
  Clone ID: PAT_TA_57939.pep
RRHTHGRRRGRPPHVNVDLTNVVVLIHRQWHPWQHVVLLILVVLEEDEATGADGCERRDAMASIPGFS

SEQ ID NO: 163522 - protein, 74 aa, Triticum aestivum
  Clone ID: PAT_TA_57940.pep
KARGSKVPCALLGVTASRSGTDVACSVCGWWAPRSSLRGRAPARGGLMTEPVRPECFVRPPACSLPYERVVLFL

SEQ ID NO: 163523 - protein, 40 aa, Triticum aestivum
  Clone ID: PAT_TA_57941.pep
VSSLSIVLDFLQHPLTVTSCRNKASRQRLPEICRAAFSRA

SEQ ID NO: 163524 - protein, 96 aa, Triticum aestivum
  Clone ID: PAT_TA_57942.pep
SQPYVLAIYSSNMYTHACSSTNCTWLARDARSHVENAPLLLRAGEEHGLRMRTNDPVPQLPSMMVERQRLAASSTCFRTLFPPVTNTYLVVVDAHA

SEQ ID NO: 163525 - protein, 89 aa, Triticum aestivum
  Clone ID: PAT_TA_57943.pep
KNRTLLMPSAKSPSAELAPPSASVCAWISSSSSVQGVARASLSTPLSWWCQRPAACPSLCSRWSGRRWEEEGGIQDGQGRVGGVSPTRP

SEQ ID NO: 163526 - protein, 110 aa, Triticum aestivum
  unsure (1)..(110): unsure at all Xaa locations
  Clone ID: PAT_TA_57944.pep
MAQQVKKAPEPEVQDSEIQTQQVKKAPELQDPEIRAELDRRAREEGETVIKSGAGGKTLEAQERLAEGRKKGGLSRATGSGNERAEGEGXVVIEPDEKKLEEVKKDLGRE

SEQ ID NO: 163527 - protein, 110 aa, Triticum aestivum
  Clone ID: PAT_TA_57945.pep
NDPRDRSVRLLRPGSLTVRLLPSIWSCCCSQRYWGISQVCTVIRSSTPPKSQSTLAGLAGGRLYALHRRYWGLSSPRALDKVVPRSGAMSAARSLSNLPCRRAMYAYPLH

SEQ ID NO: 163528 - protein, 111 aa, Triticum aestivum
  unsure (1)..(111): unsure at all Xaa locations
  Clone ID: PAT_TA_57946.pep
MVAVMDRGGGCGGGEKKRRLSAEQVRALERSFEVENKLEPERKARLARDLGLQPRQVAVWFQKPPARWKTKQLERDYNALRHSYDALRVDHDALXRDKEAXLAEIKDLKGX

SEQ ID NO: 163529 - protein, 114 aa, Triticum aestivum
  Clone ID: PAT_TA_57947.pep
HSCHLGDPSYVSPREAFPVSYGSIVTSSCVCGSIVRADGGIRVGPNKMFCAAVLRSRLPGVRRRRSPLRLKTTAYSVVSSAFRNLYPGVILSQDRRIPTLSAFSSQSPSLPSQV

SEQ ID NO: 163530 - protein, 85 aa, Triticum aestivum
  Clone ID: PAT_TA_57948.pep
AAEALAEQVTAEHFDKGLIYPPFSSIRKISANIAARVAAKAYDLGKIFFPRPLGLFLFSSTRKTRSPNPYACLYEQDWQAIFLAQ

SEQ ID NO: 163531 - protein, 83 aa, Triticum aestivum
  unsure (1)..(83): unsure at all Xaa locations
  Clone ID: PAT_TA_57949.pep
LQVLWSXXFPXVDXTPVRVRTHSEVPGRCRSAGCQRGRGVSCVRPPPHSGGWETAPLWRGGKDATLTVWSCVGTIRPQSSEHS

SEQ ID NO: 163532 - protein, 128 aa, Triticum aestivum
  unsure (1)..(128): unsure at all Xaa locations
  Clone ID: PAT_TA_57950.pep
QGGGAARYGDVFPAXVPSASRRKPVALAGSCATCARTENLGFGQTIKXGGPFALMQCLDMRNERMGVVGHDQATDSTTWQDALRVHNPLSCQEHLERVCRRLGRETKLVQMMPTWRAWWVSSRRNTDR

SEQ ID NO: 163533 - protein, 135 aa, Triticum aestivum
  unsure (1)..(135): unsure at all Xaa locations
  Clone ID: PAT_TA_57951.pep
MSSSDQNPAPTPASGTGGXPPPGRPTTVSSQAIDMGAQVLQPLKPVRQMKQHACSFALYAHDMHRQLEAHHFVSRLNQDVLQCAVYDSDKPSARLIGVEYIVSDKIFXDLAAEEQRLWHSHAYXVKAGLWTDVGV

SEQ ID NO: 163534 - protein, 195 aa, Triticum aestivum
  Clone ID: PAT_TA_57952.pep
KVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKF

SEQ ID NO: 163535 - protein, 84 aa, Triticum aestivum
  Clone ID: PAT_TA_57953.pep
AWGTSSRFAEEASLIASEGMLSARRNTSGMIRMWTERSVDSLPSLPCVPAPSRDIQHGPQASMWIHSLVCHTIFRTASSSKRPS

SEQ ID NO: 163536 - protein, 48 aa, Triticum aestivum
  Clone ID: PAT_TA_57954.pep
TLTAIGLRVFLVRMIHHGISIHQSSLSLLVTIHKIKSFCQKKKQKRKK

SEQ ID NO: 163537 - protein, 95 aa, Triticum aestivum
  Clone ID: PAT_TA_57955.pep
MASAAVIPSPAGGAVPVHGAAEPAGWLMDERDGFISWLRGEFAAANAIIDLLVVHLRAVGDPGEYDHVFADVQQRRHHWAPGIHMQQLFPVADVY

SEQ ID NO: 163538 - protein, 155 aa, Triticum aestivum
  unsure (1)..(155): unsure at all Xaa locations
  Clone ID: PAT_TA_57956.pep
PAPAAAPRSGGAVSVVRDLPLLRARQRGPCXREAVSFLRSGDASGESRRQRRRATGSIHRLTCEANHRSKTPPRPSPPTHSSLEATPFVWLRGRTEPSPLPLATPVAAGHMGEETRGREEKRRRERRPLRQGRRLRAWVKRSGRWRGIRRGSCRK

SEQ ID NO: 163539 - protein, 106 aa, Triticum aestivum
  Clone ID: PAT_TA_57957.pep
HADILAPLSTPSAPSSSSLVRAQKLRGDRAHCCRYRGHHRCRYSGARGRRSSTVVFVRSGRRLKLGHRVHIAHGQLPRLGRHWLGEVVADLRNHAATQFYPTTPRR

SEQ ID NO: 163540 - protein, 143 aa, Triticum aestivum
  Clone ID: PAT_TA_57958.pep
RGREREIHPWRRRSTAASWAASPGPPTTTSLQQAFSQYGEILDAKIINDRENGEVPAGSASSRSAARSRCAKRSSPGAKKGRSPSPTLRKGSPSRKGRSSSSPPKKASPARKASSPTQSVVLHVDHPSRDVNEAHLNEIFENF

SEQ ID NO: 163541 - protein, 123 aa, Triticum aestivum
  unsure (1)..(123): unsure at all Xaa locations
  Clone ID: PAT_TA_57959.pep
LRAGPTARKPVFAAQVGLALDLISFLVFLRKPRDIDRHSAWAILTERDIFEDSIDATLSKGHNRGLGTLTAGGLALAVAELAKNLGASXEAILIISIFTGGYITNLAKLHPTMKPYEYGLRVF

SEQ ID NO: 163542 - protein, 113 aa, Triticum aestivum
  Clone ID: PAT_TA_57960.pep
APQTPAKRSGGQPDHCLVTNSPPNHSPIPSPYLVQMWGGPDAAPTSDWPSLTPQIPHPGQNPSLVLTTPLHCLSPSVVPSTSCPLPSPHHVQLQQRIRQRVVLHRLGGAQGGI

SEQ ID NO: 163543 - protein, 89 aa, Triticum aestivum
  Clone ID: PAT_TA_57961.pep
KGKPGGAFSQSPPPRVAGVAGAAQRGINHHRRSYTTEQMRPECLAVSHCVCVRVRASSGLESPLKVFMCSDQMISRQAGLVPFSFTAKY

SEQ ID NO: 163544 - protein, 77 aa, Triticum aestivum
  unsure (1)..(77): unsure at all Xaa locations
  Clone ID: PAT_TA_57962.pep
PYITNSALCRRKRSSASSRSDGMAQSRIAGEDVPTLIVGRALPSSPKPAGAAFVSSTDRTGVXSTPGNXPDPSTCRR

SEQ ID NO: 163545 - protein, 63 aa, Triticum aestivum
  Clone ID: PAT_TA_57963.pep
VVLPPSGNTCINILQSIPRRVLRTFYTLPFLLLWPTATIVRPACLYVRLWGAAHSATWTPLSF

SEQ ID NO: 163546 - protein, 122 aa, Triticum aestivum
  unsure (1)..(122): unsure at all Xaa locations
  Clone ID: PAT_TA_57964.pep
TLTALPIGRTSNTGLRTSAQLRAXAPVSCDATCTSYSTLXFPTXEDQCLSISRLRFLQRLVHEQPWNLXARYLLVLAIIQQALKISPHHICATFERMVLQIMSLCSNVPEHTLIPYEKDLLP

SEQ ID NO: 163547 - protein, 59 aa, Triticum aestivum
  Clone ID: PAT_TA_57965.pep
MREAQPQDQGSLVWSKCSRGCSTLNKHGCGLLSQDSTRDGANRAPNEEFANGTTAKMML

SEQ ID NO: 163548 - protein, 108 aa, Triticum aestivum
  unsure (1)..(108): unsure at all Xaa locations
  Clone ID: PAT_TA_57966.pep
TTHSAEETAVDDGAREDVKFLKPSKEAILLQGLIAGXRKAVIVRVIEEGSRDRPYGTLLMVTGLSNDPKKVIRMDSANKTAKNEHEKCFLKLANFTHMMPTRYTLDVD

SEQ ID NO: 163549 - protein, 40 aa, Triticum aestivum
  Clone ID: PAT_TA_57967.pep
SLSGRCGMISLSLTGASIIYSVFKCSTVWHRACTVCEYRA

SEQ ID NO: 163550 - protein, 143 aa, Triticum aestivum
  Clone ID: PAT_TA_57968.pep
VVHSKPTSTCIPATCTTAPGPQLADTYIHTHILLQTYIQAQHVQLLQPQAFLLPPCYPTTPTNRRQRGRNLEAAQNGTQATDIIAELHHRADHTTVKRSLPLPLPLKRSKIQGTVDLTAAGRRHDRRPEGGRFTRPAPPPCSA

SEQ ID NO: 163551 - protein, 64 aa, Triticum aestivum
  Clone ID: PAT_TA_57969.pep
GDFPKNLCTMSRSYRCDRNGTNKDSIRLYKPPALLAAVLLGFVLAMLTRSPKSESSGLAGLLAC

SEQ ID NO: 163552 - protein, 85 aa, Triticum aestivum
  Clone ID: PAT_TA_57970.pep
LNFTILFFLRNTSSGLWRQHKEQGRGAGPRQRASCCAPVPGAGGKGRGGVGILDAAGGAGAGGDAVPPARRRSRCCWGWADRRRR

SEQ ID NO: 163553 - protein, 200 aa, Triticum aestivum
  unsure (1)..(200): unsure at all Xaa locations
  Clone ID: PAT_TA_57971.pep
MTEQMTLRGTLKGHNGWVTQXIATTPQFPXDMILSASRDQXGTMWKLTRDETNYGIPQRALRGHSHFVSDVAISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGCDKLVKVWNLANCKLKTNHIGPTGLSEHG

SEQ ID NO: 163554 - protein, 65 aa, Triticum aestivum
  unsure (1)..(65): unsure at all Xaa locations
  Clone ID: PAT_TA_57972.pep
MTEMRRIFNRDTQNCAPVYSQPSSMTKCQNHPVLYYXGELLYRHCPPPVKPTLTHHGLIPGHVHY

SEQ ID NO: 163555 - protein, 102 aa, Triticum aestivum
  Clone ID: PAT_TA_57973.pep
EVEDGRQFMEETLDTYKVSEEEVVVGGTTSASPSSRKGSVRPSDGTRRRNHQSLPIPTKRQREAGGRDQAGRTTIRLPAWPGNNVAAQVQMRGSCQIFGRSC

SEQ ID NO: 163556 - protein, 60 aa, Triticum aestivum
  Clone ID: PAT_TA_57974.pep
RFILDLGHQWCGCRDIAIDSIVLHYTSRVIRVFSVQLTSGAHYFGWSQEHSSTSVQTPDL

SEQ ID NO: 163557 - protein, 48 aa, Triticum aestivum
  Clone ID: PAT_TA_57975.pep
AMLVLYPHKCSAKCVWREGHTLCARQVSVSTSMNVQEYNQHFTFIFVR

SEQ ID NO: 163558 - protein, 159 aa, Triticum aestivum
  Clone ID: PAT_TA_57976.pep
SDRAPPRCGRRPRRPDVEEGLAAPSICMRAPPRSRGHGTRTSICAHLAMEMEGSPLSRISSAQSASSPHGVDPPSRQSHAPATGGYRTVLFIPRPPHATAHTAMLFCCSQTAAPALAHRAEARSSGGCSLLATTRSFRWVALCTLLRLSPRGLPFGPYL

SEQ ID NO: 163559 - protein, 119 aa, Triticum aestivum
  Clone ID: PAT_TA_57977.pep
SPLCVFFLACRSNPIRDVIPLLQIEVVGVGGRRAAGWCRPQSQCVSVEQIHHRCRGMEMLLRRRRELGLAIWKQGGDDETRAMLTLLPLPLISNIHLPWLVWLPIPGVLCSPLWSHSIG

SEQ ID NO: 163560 - protein, 106 aa, Triticum aestivum
  Clone ID: PAT_TA_57978.pep
RTLFIECSSAGSHASAKPIYAQNCGPRMRWFLCRVNHHKEYAYIEQRVAVCVMSELYVSHHACYAGSSSHVIASLLFVHHRCPNKDHDHIGFIAISIEQAVISSQI

SEQ ID NO: 163561 - protein, 41 aa, Triticum aestivum
  Clone ID: PAT_TA_57979.pep
ASTGSLPGRVSVCYTRTGPNKICSPTSVLRLERSLLIVAKP

SEQ ID NO: 163562 - protein, 90 aa, Triticum aestivum
  Clone ID: PAT_TA_57980.pep
PAASLARSIRAVYDLRSGLLVTRDPWIPFRFQIHRNTILRDLVPSRGADSPTHSHGARRPCPWHGSKSPEYHLSELTGTLVLGVAEQLRC

SEQ ID NO: 163563 - protein, 76 aa, Triticum aestivum
  unsure (1)..(76): unsure at all Xaa locations
  Clone ID: PAT_TA_57981.pep
GGGRNPPAGAGAQGGALSGXTSFHFFPSEGGTPSRSASGSPSVVHLRHCFFLGRADELVICSSGRRGADGSGFXPG

SEQ ID NO: 163564 - protein, 90 aa, Triticum aestivum
  Clone ID: PAT_TA_57982.pep
AELTVHTHIATSLSLPITNDSMLCLYMIYTQAAHCSLRCALPRYCSLSGARSFATPWKPVLARARSAATRLTTPRYVKASALGSSRFILR

SEQ ID NO: 163565 - protein, 109 aa, Triticum aestivum
  unsure (1)..(109): unsure at all Xaa locations
  Clone ID: PAT_TA_57983.pep
PGNPDAGAKTNKTKXAQGHTDDAGADHKQGPTTHGRKARQTRTTEGGAXPXTNKNKXAEREENXRXDHQRNPNKHRPGTKRGSPGRKKPEDRAEHTAHQKKATRRPNGH

SEQ ID NO: 163566 - protein, 112 aa, Triticum aestivum
  unsure (1)..(112): unsure at all Xaa locations
  Clone ID: PAT_TA_57984.pep
LRQSCCMSTLGRNCYNLCRARGAHNVCTYVCRCELTSGXLSFPKDFPKLVLESNXMNQTRMECCSSACTSSLCDYMGNAAADDEEMKLYXEQSGRCXVNFCNTDAGLTYIVA

SEQ ID NO: 163567 - protein, 70 aa, Triticum aestivum
  Clone ID: PAT_TA_57985.pep
PPVHVPELLVLVRVLRAVPAAPPVPQLVVLLPGRFLRRGALVGRRGVLSLPRRRHGGGFRRGSGAVAQRL

SEQ ID NO: 163568 - protein, 26 aa, Triticum aestivum
  Clone ID: PAT_TA_57986.pep
KAESMSISHVIDHCTSSFTGVCNRSK

SEQ ID NO: 163569 - protein, 161 aa, Triticum aestivum
  Clone ID: PAT_TA_57987.pep
GECAYQQLCGNVTAEFNDCSTQILEMVFLLSKPIFCRGDLANLLKDVQACERDKLQLTARIQVLKKAGRPSERLVNHEHCRSSSTSQHVCANLTEITEDAEADAEYDAALKEAIQGIQEAVTSINEHMEEVRYEIDALEADTVDSRLSEVEEAFPDALLIE

SEQ ID NO: 163570 - protein, 150 aa, Triticum aestivum
  unsure (1)..(150): unsure at all Xaa locations
  Clone ID: PAT_TA_57988.pep
PPPPPGKKNPPPPGGGGGGPSFIXGGRAPPSLKEGGGGGAPPYIRGGGPPPPGGKKQKKKNLFLPRRGFPPGGVFPPPFSPRKKKGPFPGVLVWNFVGGGPIYXGXXPNXPEASPVGVPHRRPNFTPLTTGHSQTRPRKVSLHAVKLVFL

SEQ ID NO: 163571 - protein, 47 aa, Triticum aestivum
  Clone ID: PAT_TA_57989.pep
IKMDVSRIKIHLDTSFFIHLDDKYFRTEGVHLHRMITVVPLSKKERE

SEQ ID NO: 163572 - protein, 111 aa, Triticum aestivum
  unsure (1)..(111): unsure at all Xaa locations
  Clone ID: PAT_TA_57990.pep
GLWYISVQWVFDCFIIRTFRFLLTSVCMVGSSKNERPASXASWQGLIQHEFHNICSHGSPSGQLTIHAWHPHIDRLFILIKVMYITHTIPPASLCWFEYSRWEAFVIERRV

SEQ ID NO: 163573 - protein, 99 aa, Triticum aestivum
  unsure (1)..(99): unsure at all Xaa locations
  Clone ID: PAT_TA_57991.pep
DDHAMLLHQQQQQRQQRQHDHRARVPTRSTSNNIYHGQGSFEPCXQNPQAQGSVQPQQLPQFEEIRNLAXVQTLPATCNVYIPPYRSTTIAPLGIFGTN

SEQ ID NO: 163574 - protein, 80 aa, Triticum aestivum
  Clone ID: PAT_TA_57992.pep
HLPSSKVSFQQPLHQYPLGQGSFRPSQQNPQAQGSVQPQQLPQYEEIRNLALQTLPAMCNVYIPPKFVKLHKYLISLFHV

SEQ ID NO: 163575 - protein, 156 aa, Triticum aestivum
  unsure (1)..(156): unsure at all Xaa locations
  Clone ID: PAT_TA_57993.pep
MIVAATTMSLGGTTHHVSQQQPLLPQQPPFSQEQQLVXLPQQPPFSQQHQPVLPPQQXAFPQQQQHQQLVQRQMHADQTCILQQLNPCELYLQQQSRPVVMPQRLARTQMVQPSRCHVMQQQWCQQLTQMPQESRYEGIRAIIYSIILREQQQVQG

SEQ ID NO: 163576 - protein, 87 aa, Triticum aestivum
  Clone ID: PAT_TA_57994.pep
RGEPPGVSRPRPCKNGAPEIYPPPPKKKVSPGKPRGGNLGPLKRPPLFFFFFFFFFFFFFFFFFFFFFFFFFFFFFFFFFFFFFFFF

SEQ ID NO: 163577 - protein, 97 aa, Triticum aestivum
  unsure (1)..(97): unsure at all Xaa locations
  Clone ID: PAT_TA_57995.pep
RSSVGPHPKAIHARRPRGLYPQYQVQCRVLVAKPTEGXKYSTEEDSTHYSIERSTFNIIIPLKKXGXXVXLSCLQGSATTHGSSCVGPFAIKNHKFG

SEQ ID NO: 163578 - protein, 61 aa, Triticum aestivum
  Clone ID: PAT_TA_57996.pep
RIPVDHASAGHIWWKSGCEHEVREKCCKQLSQIAPQCRCDSIRLVILGKLGGFLDIWPFEA

SEQ ID NO: 163579 - protein, 59 aa, Triticum aestivum
  Clone ID: PAT_TA_57997.pep
PKPHRIHSFKTMMTIAFHQPIPIPNHSGFFVRFNNKRINTNSSTVSPFPSLGIRLGRNR

SEQ ID NO: 163580 - protein, 103 aa, Triticum aestivum
  Clone ID: PAT_TA_57998.pep
TDSGDHHNQKTEWPELLGKSVEEAKKVILQDKTEAQIVVLSVGTVVTMEYRIDRVRLFVDSLDKIAQVSNCPIVRPAAAAAVPCVAFVQVMSRLCEVVLCLLL

SEQ ID NO: 163581 - protein, 72 aa, Triticum aestivum
  Clone ID: PAT_TA_57999.pep
MEASSGPRRSSSQEPDGPGDGPDRISALPDEMLLLVLARLPCAAAAARTEVLSRRWLGLWTGIREIVFRGVA

SEQ ID NO: 163582 - protein, 117 aa, Triticum aestivum
  unsure (1)..(117): unsure at all Xaa locations
  Clone ID: PAT_TA_58000.pep
HTITAYSQHPPYPHHHPQHPHQRIHGVQPYLMLHLNPCKGSLQHQGFHEALXHNTARSHMWXSSSCHRTHRRCXQQAPQDPERCRSEASRAVCYCILLREQQRGFCRSHNQQPRHTL

SEQ ID NO: 163583 - protein, 71 aa, Triticum aestivum
  Clone ID: PAT_TA_58001.pep
SFQQPLQQYPLGQGSFRPSQQNPQAQGSVQPQQLPQFEEIRNLALQTLPAMCNVYIPPYCTIAPFGIFGTN

SEQ ID NO: 163584 - protein, 244 aa, Triticum aestivum
  unsure (1)..(244): unsure at all Xaa locations
  Clone ID: PAT_TA_58002.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPVLPPQQSPFPQQQQHQQLVQQQIPVVQPSILQQLNPCKLFLQQQCSPVAMPQRLARSQMLQQSSCHVMQQQCCQQLPQIPQQSRYEAXIRAIIYSIILQEHNRVQGXIQSQQQQPPQLAQCXXPPQQQSQQQLG

SEQ ID NO: 163585 - protein, 41 aa, Triticum aestivum
  Clone ID: PAT_TA_58003.pep
LISRKIAITHPVYSYPSSSHMVLTIKGNRHCPLDYGRLNPQ

SEQ ID NO: 163586 - protein, 68 aa, Triticum aestivum
  Clone ID: PAT_TA_58004.pep
HSAGSAIRCKTQSRLTESYVHIVEISRGHWPSIQRAVQPSQHDESVFGLRIRRGNLSSSYLQTPSRGS

SEQ ID NO: 163587 - protein, 211 aa, Triticum aestivum
  unsure (1)..(211): unsure at all Xaa locations
  Clone ID: PAT_TA_58005.pep
PFPPQQPYPQPQPFPSQQPYLQLQPFLQPQLPYSQPQPFRPQQPYPQPQPQYSQPQQPISQQQQQQQQQQQQQQQQQQQIIQQILQQHLIPCMDGVLQQHNIVHGKSQGLEQNTYQLLREMWCQHLWQIPEQSQCQAIHKGVHAIILRQQQKQQQQPSSQVSFPQPLXQYTLSQGSFRPSQQNPHAQGSVQPQQLPQFEEIRNLALQTLPA

SEQ ID NO: 163588 - protein, 88 aa, Triticum aestivum
  unsure (1)..(88): unsure at all Xaa locations
  Clone ID: PAT_TA_58006.pep
WCSGSTKPMLGPMYGIGTHLAPANCAKTCASYSDIDENGIMRMMLCRVIMGNVEVVLPGSKQFQPTNGTFDSGVDDLQKPKHYVIWDX

SEQ ID NO: 163589 - protein, 54 aa, Triticum aestivum
  Clone ID: PAT_TA_58007.pep
WQSTVSSSSKFLIYVINGGPDVMSNKLWHIVDVREVADALVLVYEKAESDGRYI

SEQ ID NO: 163590 - protein, 177 aa, Triticum aestivum
  unsure (1)..(177): unsure at all Xaa locations
  Clone ID: PAT_TA_58008.pep
RDHHRANRHNNHLLHRNNTLQLQVRHPVPVDHASIVEQVNPCRVLLTAMEQPXACTATTVVIWTTKMRHSSCHVMQQQCCQQLPAIPQQYRYEATRAIIYSIILXEQQQVQGCMQSHQQQPEQMGQCASQPQQQSQQHLGQQPQQQQVAQGTFLQPHQIAYVEVMTPIALRILQRWA

SEQ ID NO: 163591 - protein, 52 aa, Triticum aestivum
  Clone ID: PAT_TA_58009.pep
GSTPRAASLSILVATRPGLEFAFVRTDDAPPSRATGVCAPRRRREEMPCRLG

SEQ ID NO: 163592 - protein, 193 aa, Triticum aestivum
  unsure (1)..(193): unsure at all Xaa locations
  Clone ID: PAT_TA_58010.pep
FSQQQPPLWQQQPPFSQQQPILPQQPPLSQEQQLGLPEQPPFSQEQQPGLPPQQSPFSQXQQQHQQLVEQQIPGDQPSILQQLNPCKLFLQQQCSPVAMPQRLARSQMLQQSSCHVMQQQSCQQLPQIPQQSRYEANRAIIYSIILQEQQQVQGSIQSQQQQPQQLGQCVFQPXQQSQQQLGQQPQQQQLGQG

SEQ ID NO: 163593 - protein, 116 aa, Triticum aestivum
  Clone ID: PAT_TA_58011.pep
IHSTRIIYQQKQTIPGLQVKLQNLLATPFKQAKATTEAGHYRYASQSVHSLIPKSSLLPSKHCTNSRNDLTIRNLRQRKGGRCGGHQLHGSCSSMVERGIVYQLQIAVKCSCIYPP

SEQ ID NO: 163594 - protein, 47 aa, Triticum aestivum
  Clone ID: PAT_TA_58012.pep
GYSGHGGGGAGGYPGHGGCGGSGGCSPGAQVSGGGPQLSAGCGSVHA

SEQ ID NO: 163595 - protein, 51 aa, Triticum aestivum
  Clone ID: PAT_TA_58013.pep
HILFILSQALLFPSQPYCLLSLCLSPGHEINQDLIYSVVMVLLLIRSKCCS

SEQ ID NO: 163596 - protein, 188 aa, Triticum aestivum
  unsure (1)..(188): unsure at all Xaa locations
  Clone ID: PAT_TA_58014.pep
GKTVVSPARSGSVENGTYRDDHHQALPEAHANGSSVEKLIPKLSQADYFTEPSLEELAAKERAESGYCSRVRDFVVGRQGYGSIKFLGETDVRGLDLESIVEFNNREVIVYKDDNEKPLVGEGLNKAAVVTLLNIKCVNRKTGEAYTEGPRVDKYKEMLVKKAEEXGVEFISFDAAKGEWKFKVKERG

SEQ ID NO: 163597 - protein, 190 aa, Triticum aestivum
  unsure (1)..(190): unsure at all Xaa locations
  Clone ID: PAT_TA_58015.pep
QQQQQQQQQQQXQQQQQQLQQQILQQILQQQLIPCRDVIVLQQHNIVREISQVLQQSSYQVLQQLCCQQLWQIPEQSRCQAIHNVVHAIILHHHHQQQQQEEEQQQPSSQVSYQQPQQQYPSGXGSFQPSQQNPXAQGFVQPQHLPHLEEIRNLALQTLPAMCNVYIPPYCSTTIVPFGIFGPHKEDYAW

SEQ ID NO: 163598 - protein, 89 aa, Triticum aestivum
  Clone ID: PAT_TA_58016.pep
AYRISCAYAKQNHLGRGAIQPGQACCGYEHTLSLQEADDARIHAIGSNTTDHPTEHNPTDARGGHSKGDITNQLSMSWLTHITRCCLAN

SEQ ID NO: 163599 - protein, 98 aa, Triticum aestivum
  unsure (1)..(98): unsure at all Xaa locations
  Clone ID: PAT_TA_58017.pep
RALALCALWTAFESRLGPSVAAGSGGHADRVTRADRCWGRPXSGSGHSQISVSESSGSLLKTITHVLASTSLRVFDKYVGTIYVGLIHIEATYAQQRR

SEQ ID NO: 163600 - protein, 77 aa, Triticum aestivum
  Clone ID: PAT_TA_58018.pep
HFSLLRIDAYAWTAHFTGPGYCITFALNRRGFHREHTNHRVCLHYISRFPFLVRTIGRNDCCPRETQKRACGLYDPS

SEQ ID NO: 163601 - protein, 80 aa, Triticum aestivum
  Clone ID: PAT_TA_58019.pep
GPCFPSSQVSFQQPLQQYPLGQGSFRPSQQNPQAQGSVQPQQLPQFEEIRNLALQTLPAMCNVYIPPYCTIAPFGIFGTN

SEQ ID NO: 163602 - protein, 73 aa, Triticum aestivum
  Clone ID: PAT_TA_58020.pep
GGVLKWPVVLFLGTLELIFLCACPFFFFFFFFFFFFFFFFFFFFFFFFFFFYTRVILFIDHHSALLFATCYDM

SEQ ID NO: 163603 - protein, 152 aa, Triticum aestivum
  Clone ID: PAT_TA_58021.pep
GDTLVLFLCCSVELLLFFSSCMISELIPHSSEVLLRHPIQYASSPLFFHLLSWSSTSFFAPFHASKPPDVERDAEEVIAVTELAPYLYTAQFAPWSPPHQERKGEHSTYERGEYTLPPGHPSGTGAIVFVAATSAIVREEGCRAQPPLVVHP

SEQ ID NO: 163604 - protein, 169 aa, Triticum aestivum
  unsure (1)..(169): unsure at all Xaa locations
  Clone ID: PAT_TA_58022.pep
GEDPTQIVLIDHGHSGTSSSTRQLCYKLAGIDNRITERMTKEAAAINTRSLTYAXLLDKLKGERDRGITIDIAVWKFDTTKHSCTVIDATGHRELIKNMITGTSHADCAVLIIDSTTGGFEAGIFKDGQTREHALLAFTLGVKXMICCCNKMDATTPKYSKARYEEIVK

SEQ ID NO: 163605 - protein, 74 aa, Triticum aestivum
  unsure (1)..(74): unsure at all Xaa locations
  Clone ID: PAT_TA_58023.pep
LHLLFFXQFTIHFYFFPLPPPNLPXRPPLSPISVCFHXPFTLILVFCLYLSCAMLLLLILSSPSLILFXGFSPL

SEQ ID NO: 163606 - protein, 103 aa, Triticum aestivum
  Clone ID: PAT_TA_58024.pep
LGLRIRGPKKNPTKKGVKRKEGLGPQGFKIKAGTLLAGKRNCPLVQGQLGGGATRKGPLPEAFSVPSKFFWGKKKNKKNFFLEKGSLHQKGGGVPIFGPPTRG

SEQ ID NO: 163607 - protein, 55 aa, Triticum aestivum
  unsure (1)..(55): unsure at all Xaa locations
  Clone ID: PAT_TA_58025.pep
VRYSRAFVHWYVSEGMEEGEFSEAXVEDLAALKKDYEEVGAEFDEGEDCDEGDEY

SEQ ID NO: 163608 - protein, 87 aa, Triticum aestivum
  Clone ID: PAT_TA_58026.pep
KTGEKQKSRASRNTDERRPRREFFSLCGSEIYYILARFVVEFARRCFASAAMVKKEGPCCHCGIMGKHLHLVSSLLCFSASGFQGSG

SEQ ID NO: 163609 - protein, 113 aa, Triticum aestivum
  unsure (1)..(113): unsure at all Xaa locations
  Clone ID: PAT_TA_58027.pep
RCDDLSEQPVTFCDGVTCVCFLWSRISCLLYDCRGLLLARIKCSIMLFCHTRDGLYSGPFCSRTDNSHLSWTCLNDSANSNSYFFLPIPTADNWYWYFAXKKKKKKKKXXXXX

SEQ ID NO: 163610 - protein, 100 aa, Triticum aestivum
  Clone ID: PAT_TA_58028.pep
VDDTLQVRISAGAQSFSVSSESDSQSGGTSIILFLCLMHGKQSVDRFQVGLTVADLSFLLRFPRFWRWPSNPTSSCSVRPGGHGKSQIHAWMDSVKQSLP

SEQ ID NO: 163611 - protein, 104 aa, Triticum aestivum
  Clone ID: PAT_TA_58029.pep
VRMKLADARAAVEEKLREVADAGQRAADATAAAEGCSCRSGSPIGGKASPASVGQQSPASSRHGQQSPASGQHSQSHRREVTGGENPHIRRGIKGSVEFPRAVR

SEQ ID NO: 163612 - protein, 152 aa, Triticum aestivum
  unsure (1)..(152): unsure at all Xaa locations
  Clone ID: PAT_TA_58030.pep
RRPWVPRRLPRHQDPPPERGCAACRARRGRAPAADAPTDAAGGGLRGGGGGADVRRRAGGRGAAGGGGQRGEGDRLVPARGRRAQAPAGPAPARRPSPRQPRVDPSAQRHDAARGEQPPRAVRGARRNGDLEHGDGPLGAAPRAXRRPRRRR

SEQ ID NO: 163613 - protein, 56 aa, Triticum aestivum
  Clone ID: PAT_TA_58031.pep
SLILTCVLQDMKYESVESVYNTKHAVPRRESPWKVDVESSGDPAKLRQLEQELINL

SEQ ID NO: 163614 - protein, 49 aa, Triticum aestivum
  Clone ID: PAT_TA_58032.pep
NEDTYCCHEPEYRRGFCNEDHCLKAQKMTTNHSRRNMLGLSSTPCGPKH

SEQ ID NO: 163615 - protein, 127 aa, Triticum aestivum
  Clone ID: PAT_TA_58033.pep
SSNQLYLISSLQKHSYFFSMQSTVSSSNVSCICCLCCPAGWMSFTFPWTRIEEPHGGSSCNSQTHCGLFAQSPMRKVQCTVATTKSCSLCICLSRCPSVVPPFHNPFPHTLGIGVAWLMMLLVCARH

SEQ ID NO: 163616 - protein, 166 aa, Triticum aestivum
  unsure (1)..(166): unsure at all Xaa locations
  Clone ID: PAT_TA_58034.pep
CWGGXSVRPSLLFRRLPXVXCAAGLFRWVAPWFSPCRRCFXXGWVVXXAVAFVGLCCRVLAXVXLAPLVRVSRSSSXLGLALPLXPGCGSRAWVAILVRGWFLGXGSLXPPLXRXSXFACXGCAVLLAPPPVVGCWLARGWAPLAGLGVLQCRGLWFXSCPPWGGG

SEQ ID NO: 163617 - protein, 94 aa, Triticum aestivum
  unsure (1)..(94): unsure at all Xaa locations
  Clone ID: PAT_TA_58035.pep
TKSRGEGQISEGSEEQIRELSRSCSRGGRGGGGGSGSEKEDIQPRSLTGEKPRYSNKHGRFHQITGDQCHHLRXDMDVTLVNITRVKHPRRTYR

SEQ ID NO: 163618 - protein, 181 aa, Triticum aestivum
  Clone ID: PAT_TA_58036.pep
MCGGAILKGLKVPAPARKVTAAVLWPEKNKPKRADGGARRLAGLGRRGGLGLDDGEADFEADFEEFEADSGDSGQELGRGGVAEKDGDDEVVETKPFAAVKRSLSQDDLSTMTTAGFDGPAQRSVKRKRKNEFRGIRQRPWGKWAAEIRDPSKGVRVWLGTFNSAEEAARAYDVEARRIRG

SEQ ID NO: 163619 - protein, 91 aa, Triticum aestivum
  Clone ID: PAT_TA_58037.pep
IQLECIGFSRVTAGGRCFKSGTIMGTSGSLASWSGRPDCKFISRCTRKNNLAGIVGTLSNMHGEVIRMNFYFKEIGTPLLLWNEIANILAY

SEQ ID NO: 163620 - protein, 135 aa, Triticum aestivum
  unsure (1)..(135): unsure at all Xaa locations
  Clone ID: PAT_TA_58038.pep
KVFPWAKLLPAGYISRLEKLIMNDMCGLLVAPICNXVALYMHTLEFCYDAEHXELLSTGGSTEIRRYRVLTFLQNLREKRCCYLAXLPQGIHPFSCLKELREVGCREILPMSKEGNCGLSDTLEMNFSRAEIDDL

SEQ ID NO: 163621 - protein, 80 aa, Triticum aestivum
  Clone ID: PAT_TA_58039.pep
MATMKAKVKDAIFFDKGGIDMAKVTAGEKVKKATTTDPLNKHEADEKKEDRLYKVHFNQRDEKGDHSDYRDGRGPLITGA

SEQ ID NO: 163622 - protein, 83 aa, Triticum aestivum
  Clone ID: PAT_TA_58040.pep
TKRLLRYLGRRGISQRRFPQAPTWGQVGSEEGRGVNDLTREPAATQDTETGSTRPIRPRRERRPNHKFSGPQWVSYMFEPKAV

SEQ ID NO: 163623 - protein, 166 aa, Triticum aestivum
  unsure (1)..(166): unsure at all Xaa locations
  Clone ID: PAT_TA_58041.pep
LGLPDEQALRLGSTRERAGIEWEQKTAXQGLLTLTNKALYFEAIGLAGMKKPLRLDLTDHNSKIEKAKVGPFGSRLFDSAVSVSSGSVSNEWTLEFVDFGGEMRRDVWLAFINEIISVYKFIREYGPSDDDPTIHHVYGARRGKKRAVSSATNSIAGLQSLHSYVD

SEQ ID NO: 163624 - protein, 93 aa, Triticum aestivum
  Clone ID: PAT_TA_58042.pep
GPAGQRASGGPTGHMRGEGRVRVQPDTAAPTGRAKSERAGVPRDRPGTRPLCDEHTYRVIVPCMTITPQHVRRTLTITARWSPAQPSVSSVFY

SEQ ID NO: 163625 - protein, 127 aa, Triticum aestivum
  Clone ID: PAT_TA_58043.pep
HRTVQCTSFVREVYSNHFSSPPLYNLFLRAGHQSHQQSPNKYSYMTVRASSTKAQKELRALRIYFLTPDSSSRSCCAKSFWARVEERMIACGRALETAITGSISERRLRALHNLHGLLIRRVFLSAC

SEQ ID NO: 163626 - protein, 81 aa, Triticum aestivum
  unsure (1)..(81): unsure at all Xaa locations
  Clone ID: PAT_TA_58044.pep
PTPPPSPSFSFYFPSPQDLAPYPSPVHDGGGGWSDQGRXTYGYGAVDDRRRRFVTYVLCAAVALAFLSLILLFASIVGRFP

SEQ ID NO: 163627 - protein, 76 aa, Triticum aestivum
  Clone ID: PAT_TA_58045.pep
CGLQGADARPPRRVRQRGHQEVRRLATVMDVLEVGGVEGAVRKLTEKGVDFLDEFVQWIMVGSEERGRDLHCGYAS

SEQ ID NO: 163628 - protein, 133 aa, Triticum aestivum
  Clone ID: PAT_TA_58046.pep
KSQYFRITIEFKILRIKWAATAHPCPAIRSQLYGKNRTTFEPIPRCRLGHHASVSISSVNDSSTIGFCALSVSYLPRFLTHPRNIHSRRPPLMKCTVSNWWAVFQFQFFLCLKLSNHIFFKECKRYEYFLFFC

SEQ ID NO: 163629 - protein, 61 aa, Triticum aestivum
  Clone ID: PAT_TA_58047.pep
SELRLSVPGHTSNELSIIPCICRPTLKLSLIATYTYVILLKGQITAYQTVVLSSSAETLSV

SEQ ID NO: 163630 - protein, 102 aa, Triticum aestivum
  Clone ID: PAT_TA_58048.pep
MIPCIRKMFCLLSLLYIRKWMVDAVLIFRNHDACLEESDSVCGGFETVFNAKKKKKKKKKKKKKKKKKKKKKKKKKKKKKKKKKKKKKKKKKKKKKKRGGPF

SEQ ID NO: 163631 - protein, 80 aa, Triticum aestivum
  Clone ID: PAT_TA_58049.pep
RSILPCEDLTYRAGYQAESLIMEGNKKGLYLILLNVTRVHLDLDTAGRLMNGLITPNIFMLTMKEEEFSNYYDDPPAALI

SEQ ID NO: 163632 - protein, 125 aa, Triticum aestivum
  unsure (1)..(125): unsure at all Xaa locations
  Clone ID: PAT_TA_58050.pep
ATSHNPAHGXSFTPLVFSPTSMTNRVNHRVLWHYVDLLWQDWHEXGKTNLTNDGITPVHFDYWRMNNASLGDICLTVIRGADLEGTDSNDTMNAWLAHAGYPCGNFYDSSYFELQRSRGSIGHAF

SEQ ID NO: 163633 - protein, 73 aa, Triticum aestivum
  Clone ID: PAT_TA_58051.pep
SEFSEGLMILPPKNPGKGGWSVTVNKKNLSDAGNCMLFNRVQIILFQGLSEKETSMAVEACLSHGCIKNTTSI

SEQ ID NO: 163634 - protein, 181 aa, Triticum aestivum
  unsure (1)..(181): unsure at all Xaa locations
  Clone ID: PAT_TA_58052.pep
PPDLXPRRAKGARSERGGKQERWDGRRRREELQRPARTKKRRQIGRRGAAMDAAFLDEGQHLLAILTPRATAAPVTKRGRVRTRDRNGGARPHQHRPTLAGDPLPYAAAPPSPLRRRPSLTGHRRRRSAAWVDGAGRRHRRERRKRRRGSEGGRGGGWDACGWGGRGGGRRGGGGRGGDAG

SEQ ID NO: 163635 - protein, 129 aa, Triticum aestivum
  Clone ID: PAT_TA_58053.pep
QKIETTTSAYTRVDGEQWRITHARKQSQPLKLQAPTTNLQQHGGYKHQSRTHKEITAAIHLDLESHTPRNNQKSCAGGRMTRPTNRRRHESKRKGERNQTRQVGGGGSQNRHEQHESPGLLLLRSSAPS

SEQ ID NO: 163636 - protein, 78 aa, Triticum aestivum
  Clone ID: PAT_TA_58054.pep
YRSVALTGSIMHLANTDGRRKLVIAKILHTISVPGKFQYFSAKPLLASLSIRVLTASLKTSDERMFILLGSRLGKEEE

SEQ ID NO: 163637 - protein, 93 aa, Triticum aestivum
  unsure (1)..(93): unsure at all Xaa locations
  Clone ID: PAT_TA_58055.pep
MSNLAFDWMQGSSHMRRYIKNLSVKXLEGDDLDVFKKNGETATXYRLSMLTDLQXFAGESMHXDGGGAIGYYREGAADPTFLHFGHGLIEDKR

SEQ ID NO: 163638 - protein, 93 aa, Triticum aestivum
  unsure (1)..(93): unsure at all Xaa locations
  Clone ID: PAT_TA_58056.pep
QGSXLHSGRHLQVGIAPEARTELLPAVTRGLSAPHLVVQATHRGHTSLSYSQSFSISSLAIVVWYHLGVEDLLRTCSRSRARWPGRDSWARPL

SEQ ID NO: 163639 - protein, 102 aa, Triticum aestivum
  Clone ID: PAT_TA_58057.pep
SVSAVFQYPQAAEDSSLYGPREVRGPLHRAARGSPYSRVLTTPPTAWVRANTEGARPMRSALSEGSLSSPVVVVGESGAGGRGAATRGLERRRGLAPASPGA

SEQ ID NO: 163640 - protein, 172 aa, Triticum aestivum
  Clone ID: PAT_TA_58058.pep
MVFRKKSEGGSVVRRPRKPRDTTLAPVKRSARLKKKQMYALDLLATVAESLSSDEDDYSTESDQDGAEASHNSYRIAVKSEQFDEAPQLNSTALENDCSRGYTVGCDGICASLGQTSIRKTEDLSTQNVADTVEGSLIEKADADNLLTQNIADAAAEPLIEKKPDVFAEGSL

SEQ ID NO: 163641 - protein, 94 aa, Triticum aestivum
  Clone ID: PAT_TA_58059.pep
KYIFPIPDITLIFIRCNAKIAWKSLHRAQFSRRSPLCENRVVQEDNLCEVQLGQTPPLFLLECWMIETRTLIRCNKAPFNPLINGIVVELIFGP

SEQ ID NO: 163642 - protein, 69 aa, Triticum aestivum
  unsure (1)..(69): unsure at all Xaa locations
  Clone ID: PAT_TA_58060.pep
GRPNKXCMSMKQYSRTMYFPFNYVLQDRKLKSRTRLPFDVRLDRALKNYXCMSYCLLSLRVKKVFWLCG

SEQ ID NO: 163643 - protein, 117 aa, Triticum aestivum
  unsure (1)..(117): unsure at all Xaa locations
  Clone ID: PAT_TA_58061.pep
LSLVLHPLQIPPPPTLPPFPSTASHLYHPGESHSPNPLPPSSRCSTSPHHATQQAPSLFCRTNIGEIQGDGDVDIGINLAKLDPGIPGPRAAVVLDVVAVSPTGGDAXLSRLTREVD

SEQ ID NO: 163644 - protein, 85 aa, Triticum aestivum
  unsure (1)..(85): unsure at all Xaa locations
  Clone ID: PAT_TA_58062.pep
CAAKLVFQFVNLDDKNYKFVCNFHLFALNTXMGVLRPXFFIQLDSVSACVKIQLELLRSLDKWILFWTVAPFIDPNFVTSFRFVA

SEQ ID NO: 163645 - protein, 91 aa, Triticum aestivum
  Clone ID: PAT_TA_58063.pep
MLQYHDKLSGHKLMFESLPYKELENGLVSEGAGHLVVKRALVVDIGGNPLVDVGGHDEGAEYQPLKEDDTVNTPPLWIISHGKKLIRNLSY

SEQ ID NO: 163646 - protein, 90 aa, Triticum aestivum
  Clone ID: PAT_TA_58064.pep
NFYRRGSSSYSIAPPLRQAPSHCCSSGVRPRRSQLPRRPPSSTSIKSPNSYAAPSPSATASSRPRLLAFAPPVLLPAPTSSSAARAPPHA

SEQ ID NO: 163647 - protein, 205 aa, Triticum aestivum
  unsure (1)..(205): unsure at all Xaa locations
  Clone ID: PAT_TA_58065.pep
MARPPNGLGKKGQPIQLLANHYKVSVKPSEEFFNHYYVNLKYEDDTPVDSKGIGRKVLDKLQHTYRSELADKDFAYDGEKSLFTIGALPQINTLLQIEAARAIPIVGKVPTIILGMDVSHGQPGQSDRPSIAAVVSSREWPLISKYRATVHTQSPKQEMMASLFKPRXTEDDGLIRESLIDFYTSSGKRKPDQVIIFRXGVSESQ

SEQ ID NO: 163648 - protein, 184 aa, Triticum aestivum
  unsure (1)..(184): unsure at all Xaa locations
  Clone ID: PAT_TA_58066.pep
MATAAPHVMVLPLAAQGHVTPLMELSHRLVEHGVEVTFVCTEPTHALVLGALRVRQATVDGIHLVSMPDGLADGDDRRDLGKVLDALARCMPGYLEELIKEKKVTWLVADANLGSLCFEVAKKLGVRVASFFPASAACLGTLSRIPQLIEDGFFDDKGVPNRREAVELAPEMPXVYTSHMLWSV

SEQ ID NO: 163649 - protein, 107 aa, Triticum aestivum
  Clone ID: PAT_TA_58067.pep
KSSSQTDGDPARAHHGQNIRERGVHHPNHTLVALVARPEITTRRVPTVMIVLLVSAYEALVLLFCGMELIVYLIGGPAECELLWGRCPALRLRCSYVGATVCRCAWR

SEQ ID NO: 163650 - protein, 68 aa, Triticum aestivum
  Clone ID: PAT_TA_58068.pep
HSVLQNFRMLRAMTSILAGCCWTVVVIEDLRYDTKEYLPAWCDACMPPGRPYVQAGVLFWYLKVNMLL

SEQ ID NO: 163651 - protein, 107 aa, Triticum aestivum
  unsure (1)..(107): unsure at all Xaa locations
  Clone ID: PAT_TA_58069.pep
SYTDVQTIFLQNRARNPMSGGYSQQGYRPPRPXGNWGAPGAPTTQQPGYGYMQPGAYPGAPPQYGQQPYGSYPPASWWLSDRVGISLQTHHSKPPPGTGYDYYYQQQ

SEQ ID NO: 163652 - protein, 143 aa, Triticum aestivum
  Clone ID: PAT_TA_58070.pep
LLPLGMRAVWGYLTRPDCSCALLPVTHQSGRAVNLLLTLGTNNVHTTTDRKHIQVQQERAQCVLRLGRAEGTPGFPYQLPENTIMSCSNKPRTLQAAERAPYLVYTCEIQERATFGTRKRFSTGLKVMKWLTSELFMMLSPWK

SEQ ID NO: 163653 - protein, 239 aa, Triticum aestivum
  Clone ID: PAT_TA_58071.pep
LSIPSASRRRRTLSLSLPSASRRRRPPSHPRRRKLPDPRTAILTGHRIPAASILTGRGIPTAGHLRPRRLLDPLPSTAAAVFSKHCRRRLHLVLPPRLHRRRLQQALPPSSPSRIPPRLDRHRLQQAVPPSSPSRIPPRLHVTGAAPPPSPRRSSTAAILCLCKFGGIKYPTLRRMAHDILAIPVTTVASESAFSTSGRILSAHRCSPAPNMTEALMCMQAWSRADMLGGLQFYSLCGL

SEQ ID NO: 163654 - protein, 71 aa, Triticum aestivum
  Clone ID: PAT_TA_58072.pep
THLPDVFPLGKWAVCYKRSDVRYAFFFDLVAGLYPVDYPLRYIVICMRLVTLLAVVYQRISLILFMPGGGG

SEQ ID NO: 163655 - protein, 74 aa, Triticum aestivum
  unsure (1)..(74): unsure at all Xaa locations
  Clone ID: PAT_TA_58073.pep
SPRGGWPAARCGAGTHHCPVPKVRAESRATLELLXQGPMITIRHGRLYEAEGQQVPRNNATRRPSLYDHISRRA

SEQ ID NO: 163656 - protein, 173 aa, Triticum aestivum
  unsure (1)..(173): unsure at all Xaa locations
  Clone ID: PAT_TA_58074.pep
GSPPAVVPRRLAPLSPLPPXPRPCSRVRLPPPPPPPPAXPAPLLPIPPPASPPPLHSPLPDLDLDEALPPVPLIASPVPAMEEGRKKGRESKEDRGGDVPTLAGRRFVNQGVPASTRDPRIAATAVTFLHTVSFEESGGAITPASVQEVIALNRPSLLGSACGGRRRHHRVPL

SEQ ID NO: 163657 - protein, 113 aa, Triticum aestivum
  unsure (1)..(113): unsure at all Xaa locations
  Clone ID: PAT_TA_58075.pep
QQAPVTVFAPAGCSAPFNNRLSSHLCEGQWTYVCHHDQRFEPPPRWTPPHCIPLAPSXPCPDIRILLSLLAWVXRCQDERDERPVVEIFWYLFFWCAPSRLSWRICRSAYMSE

SEQ ID NO: 163658 - protein, 182 aa, Triticum aestivum
  Clone ID: PAT_TA_58076.pep
EQTAICESVYAPCKSDCASCGKCPWAWEGPRCYTSHLETPDKTWNNQLGRTWCPGNSWAVEFAYADSETWISSRPSVSCGLKRTEGDQVRRNSKSPRCSLISSDPLSKMLTSSPCSVWRGFSTPCDPHGQRIKNKPSAGSVTRRIIHLTIRDVNRVDWTGLDYGRDCCVWKSNANKNESRRT

SEQ ID NO: 163659 - protein, 126 aa, Triticum aestivum
  Clone ID: PAT_TA_58077.pep
MSEKKRAPGPRKDEVVTREYTVNLHKRLHGCTFKKKAPNAMRESRKFAQKAMGTNDVRIDVKLNKHIWSNGMRSEQRRERRRIERKRNDKEDAKEEMNCVETGGEGGGEGVKGGGTRGGEDEDVGR

SEQ ID NO: 163660 - protein, 157 aa, Triticum aestivum
  unsure (1)..(157): unsure at all Xaa locations
  Clone ID: PAT_TA_58078.pep
QPPAPHGGGEPSCATRAEAWCCAPSPSTPPAQPLCWTSPRTWEACRLSRQGRRNRTWIRCAWRSRRQSSRRLWCSESNLIRTACFWFGRERPKIVRYLSRWDIQGTLRSGGLIIYRKGINSRKXLRAHVGLDEGEGSTPKYVQRKIPLFIFPFYFER

SEQ ID NO: 163661 - protein, 174 aa, Triticum aestivum
  unsure (1)..(174): unsure at all Xaa locations
  Clone ID: PAT_TA_58079.pep
MNILALSCRGCGRPKRVREISDLIRSQHPRLVFLSYTKMSDKRAQELXRRFGFEHAFGVKYGGLSGGLCLYWKNNSSVSLKSXNSHIDVMVKDDSIGDIEWRFTGFYGEPVRSISKRSXDLLEYMRREYNSPWIYAGDFNKVLEVEEKFGSLERQEWKMERFGEMMDKCRFSDL

SEQ ID NO: 163662 - protein, 76 aa, Triticum aestivum
  Clone ID: PAT_TA_58080.pep
AKSSSSALRKIAEHSDGRTYLGQSASASEDYSSRNSCRIVLLVNTCDKVLFSAVNIQPTLCTACFTNNCCLVSCLT

SEQ ID NO: 163663 - protein, 104 aa, Triticum aestivum
  unsure (1)..(104): unsure at all Xaa locations
  Clone ID: PAT_TA_58081.pep
FHELMLLDSCDIDRALHLIPTDGEFPVRNYRMNQEFKPPLRVTALSEEAGPSRAEALLENSAEFSWKGTGHTITVQRPVSSYTMRARFELGAGGVXHTTDFYEG

SEQ ID NO: 163664 - protein, 61 aa, Triticum aestivum
  Clone ID: PAT_TA_58082.pep
TTLDPDDDSVDDDRIGLASLRRWMIYKHLSSKVNSCMIKKTTSKLLPVNQTIKINVDYIEE

SEQ ID NO: 163665 - protein, 85 aa, Triticum aestivum
  Clone ID: PAT_TA_58083.pep
PLERQINNRPMKSRVAPASVPVSLSPTQMLSWSFIQYISIDNVFSEGSVMVYLLSSEVRKVIQVCNASTRFIEATLLVVWSIILP

SEQ ID NO: 163666 - protein, 52 aa, Triticum aestivum
  Clone ID: PAT_TA_58084.pep
GYKYPNLQSMKQLFHQKKKKKKKKKKKEREEKKKKKKKEEKKEKKKKKGGGR

SEQ ID NO: 163667 - protein, 162 aa, Triticum aestivum
  unsure (1)..(162): unsure at all Xaa locations
  Clone ID: PAT_TA_58085.pep
MGIDLFSRGRNKRTKCLRHKSDDVYLKLLIXCTRLLARRTNSKVIAVSLKRLLMSKSNRPSICMRRLYNLMMGKEENNIDVVRGTCTDEMRIEEVPALKVTAMRVTQTVRERIVNAGGECLSFDQFALRAPTGENTILMRGPNSAREXAVRHYLKAPGVTHR

SEQ ID NO: 163668 - protein, 198 aa, Triticum aestivum
  unsure (1)..(198): unsure at all Xaa locations
  Clone ID: PAT_TA_58086.pep
LLQVTWDEPDLLQNVKCVSPWLVELVSXSIPPIHLGPFSPPRKKLRVPQHPDFPLDGHLFNPIFHGNPLGPSNSPLCCYSDNNSPAGIQGGSRGAASRERRRRRPTLQWSYSTPQRGPTTGSARCLRRGLPRRRDFLWLVDKVRLFLARTKTMVMGNVPETPIYRWMDQYTTCSTAPFARRSPGGLTTTTNEPRTQHV

SEQ ID NO: 163669 - protein, 45 aa, Triticum aestivum
  Clone ID: PAT_TA_58087.pep
INILTRFQNLYAYFCKHKAFYNKILPIFSGLRNKLLNPIKTYTWP

SEQ ID NO: 163670 - protein, 115 aa, Triticum aestivum
  Clone ID: PAT_TA_58088.pep
FSLFFFFFFFFFFFFFFFFFFFFFFFFFFFFFFFFFFLILVMRRFFIYFLQRSPTDDVFKKITTPTSVTVVGDKAQSFRSAAPSCHHEVFKRACGESKSSYPDQGVATTKDKWLA

SEQ ID NO: 163671 - protein, 45 aa, Triticum aestivum
  Clone ID: PAT_TA_58089.pep
LDKTIVGLSKYMLFSYYSGVLALFSSFTLHGTRVLFRNTMVNLQS

SEQ ID NO: 163672 - protein, 106 aa, Triticum aestivum
  Clone ID: PAT_TA_58090.pep
VMCTGRIRTSDGQHRAPQHDLPHCSAQVLVFVPTRALSCMHRARQWPMLLLTIHLAVASMNLVPCSLLLVPSVMVLIVPAHHARNGHESTAAGPADTDARIDEKSA

SEQ ID NO: 163673 - protein, 67 aa, Triticum aestivum
  Clone ID: PAT_TA_58091.pep
NISSLRYFITRRSVFNFKKKKKKKKKKKKKKKKKKKKKKKKKKKKKKRKKKKKKKKKKKKKKRGGPF

SEQ ID NO: 163674 - protein, 78 aa, Triticum aestivum
  Clone ID: PAT_TA_58092.pep
TTVLEMVSAFEKAYGKKIPVKMCPRRPGDSEQVYASTAKAEEELGWRAKYGIEEMCRDQWNWAKKNPYGYCGDAENKD

SEQ ID NO: 163675 - protein, 181 aa, Triticum aestivum
  unsure (1)..(181): unsure at all Xaa locations
  Clone ID: PAT_TA_58093.pep
RPLPPPLLLALASHAPPSPGRPRSRTLPHLPRQQIDAAGPVHRVSPPPSSSPASAQVRPRPTARPHLSPLQTLPRRPPPPPLLLALASRAPPSLGRPRSPVGFTVTQVEQMKVEAXVADIYCVLFDAAPNAKSFMLELWCNQHVEYLTKGLDAKYCFSNVKLTRVSSLGIILLDSFHSSRP

SEQ ID NO: 163676 - protein, 57 aa, Triticum aestivum
  Clone ID: PAT_TA_58094.pep
KDHFFCRTTAIDKSAYALIESATLYKANLTSGSFKIILPPLHLDQYQSENRFSYIHN

SEQ ID NO: 163677 - protein, 90 aa, Triticum aestivum
  unsure (1)..(90): unsure at all Xaa locations
  Clone ID: PAT_TA_58095.pep
RGLWRRTERERAAEARDELNRMLNEDELRDAVLLVFANKQDLTNAMNAAEITDKLDLNSLRQXHWYIQSTCATSGEGLYEGLDWLSNNIA

SEQ ID NO: 163678 - protein, 145 aa, Triticum aestivum
  unsure (1)..(145): unsure at all Xaa locations
  Clone ID: PAT_TA_58096.pep
RTATTNRGNHRFLSNYVRSLSRHCDEWTKTNLTYDSLKPGHGPXRRTNNSALGDVWYRMIGQAEREGSQKHGXSMNSWLSQARYALXVNYDDTYTLKLRRSIGSIXTLARIVFVLEITYKRANILXTHTRYLPSPSSXLGHMRYL

SEQ ID NO: 163679 - protein, 83 aa, Triticum aestivum
  Clone ID: PAT_TA_58097.pep
CLAENSSLTACWVLRKVDRWKRRACEGSGQRRRIHQRHLDIGGAFLIIINCLSMDNPMMIHANTKLGPHCQEIVSPLPYREFF

SEQ ID NO: 163680 - protein, 162 aa, Triticum aestivum
  unsure (1)..(162): unsure at all Xaa locations
  Clone ID: PAT_TA_58098.pep
MGQCCSRATSPDSVQGGANGYGYSHQPKQAQAPPSYNNAQPPPQAEVRYTPPAMNPPVVPPVVAPSKPMPDTILGKQYEDVRSVYSLGKELGRGQFGVTYLCTEISTGRQYACKSISKRKLVSKADKEDIRREIQIMQHLSGQPNIVXEFCGAYEDKGSVHV

SEQ ID NO: 163681 - protein, 86 aa, Triticum aestivum
  Clone ID: PAT_TA_58099.pep
QLVIMKRPALLTKLTLLLLLSDQAVYSILTYDGVNPDHAPYHIKSNTLISMNYDSMDKNSKHVLIHTFYGYHIFSTPGLLFLAHLQ

SEQ ID NO: 163682 - protein, 197 aa, Triticum aestivum
  unsure (1)..(197): unsure at all Xaa locations
  Clone ID: PAT_TA_58100.pep
WSMRITGVGDGLVQGTEAFAQGLAFGVSGVLRKPVESARQYGVIGIAHGLGRAFVGCIVQPLSGALDFFSLTVDGISASFIKCVNILNNKFVPQRIRDPRAIHRDGVIREYDITNKRVILLQCLDLDKMDRKPSKILWDVPWXEVLALELAXAXYQRPSHVIVHLKXFXRSENFVGLXKCSVDEEREAQLFTLFSYE

SEQ ID NO: 163683 - protein, 68 aa, Triticum aestivum
  Clone ID: PAT_TA_58101.pep
GRARAGNQVTLCPATQYFWSLHVCVSLFWILFSELSFFFFFFFFFFFLKLKTNLLIRRSFESLQITEL

SEQ ID NO: 163684 - protein, 155 aa, Triticum aestivum
  unsure (1)..(155): unsure at all Xaa locations
  Clone ID: PAT_TA_58102.pep
LLDKIDETFGPQPSSGPHMDIECLPLILMLRNTLPYALTYREVHSILMQRHMMDDPKARTDSTYPGGPMAIIGIPKTDANYRLLCDTKGRFRLHSLTDEDAXPKLCMVLSGQIDQKGISLTXTRYDGRTGPLPTLYMMDTDTIKLDLETTRLVTS

SEQ ID NO: 163685 - protein, 52 aa, Triticum aestivum
  unsure (1)..(52): unsure at all Xaa locations
  Clone ID: PAT_TA_58103.pep
FSIANSQPRLNLXLTQRSKRRXNIVSRPTVEPFSRMAKQISGVERTTRRFPC

SEQ ID NO: 163686 - protein, 75 aa, Triticum aestivum
  Clone ID: PAT_TA_58104.pep
GYAHQLVPASTGIKRSVPTHSCVWGHTPDTSTSTRACQHATRGRQIEAHLTCLSMLVPPIHILPPTLRCSTNGEQ

SEQ ID NO: 163687 - protein, 93 aa, Triticum aestivum
  Clone ID: PAT_TA_58105.pep
NSHNKSIFSSQGNPYRHDYKNWLGFSHPSKYSHFPLQTKKDILASQKVNFDLTCLHTFLINFYYSMYFIKSYSLRCLNIGILEISMWIRYRCI

SEQ ID NO: 163688 - protein, 126 aa, Triticum aestivum
  unsure (1)..(126): unsure at all Xaa locations
  Clone ID: PAT_TA_58106.pep
MMIVRRSTCIDQGNTAKPXYVVFMVTERIIGDAFYNXMPMNPINTSPVRPRALIGRCLSGSIRTSPYMKMRPFMAVPGTNNEPLIDCTYMAEEKTLSAEEIFCMPLTRMTEIAAGLLRTTINNAVS

SEQ ID NO: 163689 - protein, 98 aa, Triticum aestivum
  Clone ID: PAT_TA_58107.pep
GLSCGVTLVQTDRHCYYGGSILYNITGNAYALHHIYISYDFASGAIYALSPHGSEPIPRHRLQWTVYVLRAFSMSTYVMSKMLWAYAVQVTFAYQGSC

SEQ ID NO: 163690 - protein, 63 aa, Triticum aestivum
  Clone ID: PAT_TA_58108.pep
RALGTVASQTASTLPAAHMWYSKYLQGSVTCSVCWTLHHVPSFLPGLIYNNKKNKCLGVLLWL

SEQ ID NO: 163691 - protein, 99 aa, Triticum aestivum
  Clone ID: PAT_TA_58109.pep
SPEAKWRYSLNSPSHRPIHQQPYHTPVYHTISAQKRLGTGGKEVRYGGKDSMGVRYTEVYFFKLSRLSGKSSGQAGEVQRLCELATERGWLLPSFASLP

SEQ ID NO: 163692 - protein, 138 aa, Triticum aestivum
  Clone ID: PAT_TA_58110.pep
RNTKHADEEVSKLLCLDEGRFHATTIMAFTRFYTLFPPSDTEIQSLPAQNMKGMVREISPVCGACIFLPVVHPSSLSIGAAGAKAETEAGEQQQQRSRRAAQPPHGSTRMELRNGERGLGWSSARHNMVERWREGGER

SEQ ID NO: 163693 - protein, 88 aa, Triticum aestivum
  Clone ID: PAT_TA_58111.pep
LLHRPVSNPRRPIDTMPRPCEIKRSCGPRSDRRRPPNPRPIPPRTAQESPRPRPPKPEESPPATTTRGRQESLDHQSARGHLDHQIWA

SEQ ID NO: 163694 - protein, 81 aa, Triticum aestivum
  Clone ID: PAT_TA_58112.pep
HSLQPCHSYAELSLVGTLSQTSTMDSSVGGDKDIIAGQRHTWSGAFGARNPVNAEFPAIHLSRYVCVHYFGHFANSSKRVG

SEQ ID NO: 163695 - protein, 148 aa, Triticum aestivum
  unsure (1)..(148): unsure at all Xaa locations
  Clone ID: PAT_TA_58113.pep
QGRGRRGEGERDEEHGDSRRSYVFSPHSLRRXIQSDHGFVKALPPLYEXCRLLRDIRNYQVAIMEVNPLAVVAPGLTDADGVSIHLLRRGVXLTAIENGKKSAYTDREGDVIRTLGVTIMHLHNTDGHKKLIMDEILHDIFVRGMFQY

SEQ ID NO: 163696 - protein, 177 aa, Triticum aestivum
  Clone ID: PAT_TA_58114.pep
MDAKKFLQMVEDKKKRLLEKKEAPLKWQQKLEAAIKATEEKEKKLKSKKHRRRSYSSSESDSESESDSDGKHRKRKDRKRHRKHGHSDSDGARRRKHRSKRRSSDSSDESDSDGYDSESEKERPRKKHSHRRKHRRHSSRSESDASDYSSDDDERRSTRKGHSRSRRRRHRSSDDES

SEQ ID NO: 163697 - protein, 59 aa, Triticum aestivum
  Clone ID: PAT_TA_58115.pep
RTFGAEAIQWLERKGIKKILLGSLLEGIPMWKLERRRSGARDPSTACRCLAGARSPTRP

SEQ ID NO: 163698 - protein, 89 aa, Triticum aestivum
  Clone ID: PAT_TA_58116.pep
HILISREGRAMQPDASHHNASRKYLDERNRHRWISFQRSRNKCSPCCSSSPYDSPHHHPRRRYNHLTIRTETQTWPWSTFALETTLGQP

SEQ ID NO: 163699 - protein, 87 aa, Triticum aestivum
  Clone ID: PAT_TA_58117.pep
QKKLASTIQFYPMLTHNCMKKKLKKVQQNAQLNLMFMRHGFAVQNAHINVLGNFYSKSDVPLQQLASTASMIHPSLSSARIRSTSRR

SEQ ID NO: 163700 - protein, 73 aa, Triticum aestivum
  unsure (1)..(73): unsure at all Xaa locations
  Clone ID: PAT_TA_58118.pep
CQNSTIYVNTYVTLCSHRCVVVKLKKKKKKKKKKKKKKKKKKKPXKKKKKKKKKKKKKXKXKKKKKKKKGGPV

SEQ ID NO: 163701 - protein, 254 aa, Triticum aestivum
  unsure (1)..(254): unsure at all Xaa locations
  Clone ID: PAT_TA_58119.pep
VSWNALIAGYVESGKVAPAVQLFVDMKREGLLPDEATFAALLTVVDESTCFLMHQLHGKIVKYGSALGLIVLNAAITAYSQCGALVNSRRIFDEIGDRRDLISWNAMLAAYASHGMEHEAMRFFASMMRTSGVQPDMYSFTSIISACAEHRDHGGTVIHGLVIKNGFEGVTPICNALIAMYTRFGENCMMEDAYKCFDSLLLKNTVSWNSMLTGYSQHSLSADALRFFRCMQSKIXTDEFAFSAVLRSCSDLAL

SEQ ID NO: 163702 - protein, 75 aa, Triticum aestivum
  Clone ID: PAT_TA_58120.pep
THESCGTGLHFAVQNPSQSKNTAPSLRSNCADSANPLNCSFNYTPSFRAHLTYVCCSTNDRLCGSGRAINHHHTR

SEQ ID NO: 163703 - protein, 91 aa, Triticum aestivum
  unsure (1)..(91): unsure at all Xaa locations
  Clone ID: PAT_TA_58121.pep
ALRVGDWHSVMLQAVITFGLMYAXYEPMIDPKRGIVGSMGPLSVGFLLGANILQDGPFYGAAMTPEWVLGQALIQWRWRQRWVYWRGPFLG

SEQ ID NO: 163704 - protein, 250 aa, Triticum aestivum
  unsure (1)..(250): unsure at all Xaa locations
  Clone ID: PAT_TA_58122.pep
GELSIGLLSMTFHLIDDIPISAIGHAVGHAMATHLVKNAKFCVRTRKDDDDEIDDDEELVIWARRFMLFFHASQVAFGGLTSLNIGNLRFGESDISSILTTCKRLKRMHLYNCDSGDSSTLQVEHANLSELCIVYCGLEQVKLNWLPHLTSIVFDGWIDFQDPLVLGHVPLLESVSLTNVALSFNKMVKLSRFLGSASPRVLKLGFRSEKIWVQPECPTQDLASVFRQLRFXNLXKLPEGYDLTWDMFIL

SEQ ID NO: 163705 - protein, 123 aa, Triticum aestivum
  Clone ID: PAT_TA_58123.pep
MMAADPIELHAYDFRGPGFSLSMYNVDESIMAFADSSMAMALSKKWPLYLNTKNTILKKYDGRFKDIFQEVYEENWKEKFEENSIWYEHRLIDDMVAYAVNSEGGYVWACKNYDGDVQSDFLA

SEQ ID NO: 163706 - protein, 221 aa, Triticum aestivum
  Clone ID: PAT_TA_58124.pep
EEDLGRGRGRHGQGEREEEEGRGRGRHGEGEREEEEGRGRGRHGEGEREEHGKHEQGRGRRGEGERDEEHGDSRRPYVFGPRNFRSIIRSDHGFVKALRPYVFGYVAQGEGVLTVIENGERRSYTVRQGDVIVAPAGSRGSAFVVPPGHPVVEIASSRGSSNLQVVCFEINAERNERVWLAGRNNVIGKLDNPAQELTFGRPAREVQEVFRAKDQQDEGFV

SEQ ID NO: 163707 - protein, 97 aa, Triticum aestivum
  unsure (1)..(97): unsure at all Xaa locations
  Clone ID: PAT_TA_58125.pep
MEGEKLSSAATFVEGGVYACDHTCSICLKAFCDSDSSTVATSVLQMXTGCKHDLHLQCILEWCQRSSQCPMCWQAINTKGPMSALEKMDMRPQPTLA

SEQ ID NO: 163708 - protein, 114 aa, Triticum aestivum
  Clone ID: PAT_TA_58126.pep
FNFGGPKKKLLRCKPGEVNFGSLKRPPLFFFFFFFFFFFFFFFGFFFFFFFFFFFFFFFFFFFFFLSMLIRTLFTATLVKAMLQTCNFLMDQMDASRSRRTEGGTSINAAGKSF

SEQ ID NO: 163709 - protein, 69 aa, Triticum aestivum
  Clone ID: PAT_TA_58127.pep
CSMDIRVRLFLHNAAASPGRYSSFLSLSACLSYYYPTCLSQLQVLAQVAFLVAPASRVKPSGSSQCLSL

SEQ ID NO: 163710 - protein, 69 aa, Triticum aestivum
  Clone ID: PAT_TA_58128.pep
KHFLLSDICTALAYIICTSHMDQEHFLLGDYIYTAFSCTCSLCYAYTLLKHLFALMFCYGTRSIYICEL

SEQ ID NO: 163711 - protein, 68 aa, Triticum aestivum
  Clone ID: PAT_TA_58129.pep
SDTQVVQMTKHNHTTLTNPDWPHTHTHSPTSRIGSPTSRTRTCKLSSTSTARIPCAMIRQHPRYKEIH

SEQ ID NO: 163712 - protein, 153 aa, Triticum aestivum
  unsure (1)..(153): unsure at all Xaa locations
  Clone ID: PAT_TA_58130.pep
KEEQPSKIWKCFCPSSSKFQVVKAIEKAIPIPRGPSIAENHPAREELKAMESQKVDIDRMATLQVRRELGXRGLAXLALQTXGFMRLTFWELSWDVMEPICFFVTSTYFMAGYAFFLRTKREPSFEGFXQSRFAVKQXRLMQAREFDVRRYSE

SEQ ID NO: 163713 - protein, 44 aa, Triticum aestivum
  Clone ID: PAT_TA_58131.pep
RRTRAMLLAKYLDSWPEAAVTLFSAAVQIPKLPNTRGKNKVQFC

SEQ ID NO: 163714 - protein, 227 aa, Triticum aestivum
  unsure (1)..(227): unsure at all Xaa locations
  Clone ID: PAT_TA_58132.pep
GKKDELSLAEKSGLLACLLWYVRTSVSEDEHGGADDGAAGVTMGRSEDATHPDTIRAAISEFLATAIFVFAAEGSILSLGTHPTQLYEHPSVRACMASFVHRTMRLCSLACLNIDGLKTYVCACVCLQXKLYHDMSTAGGLVAVALAHALALAVXAVSVAVNISGGHVNPAITFGALXGGRITLVRALXYWIAQLLGAIVXSLLLRLTTGGMVLPSFFRSSSRAPSI

SEQ ID NO: 163715 - protein, 106 aa, Triticum aestivum
  Clone ID: PAT_TA_58133.pep
SMGATCLENLGANGQTGPAGDMHWSAPFRHETPMLYNTCALNGPWLSQIHFYWLRHITSFFILRAETPDHMFEHPTGYCAILMLKLLGWHATRIVVTTTTYEDSER

SEQ ID NO: 163716 - protein, 197 aa, Triticum aestivum
  unsure (1)..(197): unsure at all Xaa locations
  Clone ID: PAT_TA_58134.pep
YVSSILQIFSGLDTRLMVDSSICPAHQLSPRCVTVSRRYILDLALNRLGLTIENTKVTDAGDGELYASISLHLNADKSRHTSEPAVFHGDYAITKEAAVESASSTVLAYLKDKSMVIADDANYHVKVCWRKLLVASSWAMLFEDQSKDLNVKMSMMSKEIDVLSNYQYANNASPLQLVTPCLXFXKXSWFIXMHHPS

SEQ ID NO: 163717 - protein, 73 aa, Triticum aestivum
  Clone ID: PAT_TA_58135.pep
QHWTLFIFASFFFFFFFFFFFFFFFFFFFFFFFFFFFFFFFFFFFGEQRKKTCGASIQGFASSIAQILHQDSQ

SEQ ID NO: 163718 - protein, 193 aa, Triticum aestivum
  unsure (1)..(193): unsure at all Xaa locations
  Clone ID: PAT_TA_58136.pep
KSCIDCRKKVQMEGDTYKCSRCITTVPMPRYKISLNAIDADAKRHEDSPFARFIFWGQQGEILTGKQVLILVAXANSRAEYTPPELTGLVGKKFTVIATPTRDSLDGEHMFYQVESTELLFEPANPENAQPPTEETQGENESQDNTLEATPPPSPSAAKEEENDSTGKRRKRNDHLLSLYKRTELSIWNFKAN

SEQ ID NO: 163719 - protein, 59 aa, Triticum aestivum
  Clone ID: PAT_TA_58137.pep
VILPPLGVFLRYGCCSMEFLICLLLTILGYIPGIIYAVYVLVAHGSASEESGRDYDALG

SEQ ID NO: 163720 - protein, 260 aa, Triticum aestivum
  unsure (1)..(260): unsure at all Xaa locations
  Clone ID: PAT_TA_58138.pep
VRPGSDMGGFTRILHSGKPDGLMDEIPTLVVDPLPEGADRGYIVLNRPWAFVQWLQKAKIKEDYILMAEPDHIFVKPLPNLAHGEEPAAFPFFYIKPTDNEKILRKFFPEEKGPVSNIDPIGNSPVIIQKAQLEKIAPTWMNVSLKMKEDVETDKAFGWVLEMYAYAVASALHGVHHSLQKDFMIQPPWDAKSDNTFIIHYTYGCDYSLKGELTYGKIXEWRFDKRSYLRSPPPRNLSLPPPGXVPEXVATLVKMVNEAT

SEQ ID NO: 163721 - protein, 150 aa, Triticum aestivum
  unsure (1)..(150): unsure at all Xaa locations
  Clone ID: PAT_TA_58139.pep
WVAERLREAWKILEYLFALRNLXWATSKRDGYRTQNYCVMHWSSLLRXGKEVLNVAAPNQDMPGGRPLLRAQISTMTAKDSLLAGGGFYGELICKYVDQPGVVFCTNLSGYKMSITNAVEIYKSSNGSIRMMAANNDCVGRTFARRSTDC

SEQ ID NO: 163722 - protein, 96 aa, Triticum aestivum
  Clone ID: PAT_TA_58140.pep
LGSGVSAPKPSPVDELLESARTAESGSTRYGGGTDRNLTLAGLSPSKATVWLTRGTAKRNRAVLIRQISCMALANANAMPCPPSACNDRVTPFCAS

SEQ ID NO: 163723 - protein, 101 aa, Triticum aestivum
  unsure (1)..(101): unsure at all Xaa locations
  Clone ID: PAT_TA_58141.pep
MVSNQIQVSYHGRLRLRPXTEENIGQVMGATKDNVGLTSEVTKLKAGQTTEATXLKAGYTVEVTXQKDGHATDARKYKVGETVEAXKHMAYDAKDKTAQTV

SEQ ID NO: 163724 - protein, 116 aa, Triticum aestivum
  unsure (1)..(116): unsure at all Xaa locations
  Clone ID: PAT_TA_58142.pep
VRLRLAGVYSAXLPPQSAAVAILRNASTASSPDPSSSRSMSAGTAVVLCQGAIILLLEAXSHGGGGYLTGSLCEGDCRGSLFFRFTSGAARSCLSILYACPRVSLLHTAVGDAYSS

SEQ ID NO: 163725 - protein, 98 aa, Triticum aestivum
  Clone ID: PAT_TA_58143.pep
AARLVGNLKRNYGLALSYTRFDEVALGGWGLTGTPRLHPYPGGKSYTENHSLVQLLLVKKRNEENCLELLGLNAAEGSPYLTAKHQAGSEDHTLTGKC

SEQ ID NO: 163726 - protein, 57 aa, Triticum aestivum
  unsure (1)..(57): unsure at all Xaa locations
  Clone ID: PAT_TA_58144.pep
QLSHSLLFXSANLTVSREHVKTYSPSSCSLQLRRSLYKFSTREEKRVRKLFTSFGGR

SEQ ID NO: 163727 - protein, 114 aa, Triticum aestivum
  Clone ID: PAT_TA_58145.pep
KCVLLFDVKHQNSLTIKCRLWSFACQRPVAFIRLNLSIPWNLLCEFKIFNAMEICCLFLNLMPIICTLLIKYLVTHHSIQNSTVIKYLLSKVSFFNIALHTEQYNDQQFAVVHC

SEQ ID NO: 163728 - protein, 85 aa, Triticum aestivum
  Clone ID: PAT_TA_58146.pep
LLICATARSSTPIWFSLPTSCFRGGLFPPCEHEQADLYLYLFRLRRALCISVEWPWCLANEGNELAFCISLHACRLCAMLFLELT

SEQ ID NO: 163729 - protein, 92 aa, Triticum aestivum
  Clone ID: PAT_TA_58147.pep
QTRTPKILWRTHSLTCTRLMHARMRPRSTPKTQTTAMGYSLHDQTDDHRYPGPDPRSPKLSTKSITPPPDEVNELLRHRKPMPNSGDCTRAM

SEQ ID NO: 163730 - protein, 56 aa, Triticum aestivum
  unsure (1)..(56): unsure at all Xaa locations
  Clone ID: PAT_TA_58148.pep
REDSSVHLRETPAAVGLWYGKFCNAGWSGYGGXDPCDDLDACCSDHDHCIKKEGTN

SEQ ID NO: 163731 - protein, 52 aa, Triticum aestivum
  unsure (1)..(52): unsure at all Xaa locations
  Clone ID: PAT_TA_58149.pep
PPPPKGKNPKPGPKVXPRSRIKSCTQNSSLVCYHQQLVPPQDAGTPQVHSRS

SEQ ID NO: 163732 - protein, 243 aa, Triticum aestivum
  unsure (1)..(243): unsure at all Xaa locations
  Clone ID: PAT_TA_58150.pep
PDSRPTPRPKHPQTPKTPIPSHHRFPAQLCSFSSLLHSRPCSSRFRCCAPHSSVPLSSSQDFTEFENRYYPGASRQAEDGSPARIVAVTFLLAFLNKEGKEEEEAVFIAFPCSHRHSVLLTAVPLVFIPLLIRAPVQSFVSSLRRSAAKAAASFPAGARGLVFSFLNCVCLKGVLGERDTLRVLPVVEKKSWRVPVRGRARCVSTGTIPDVTDSSSEDDEGCAARRVGRDGAXSFRRPRRRWC

SEQ ID NO: 163733 - protein, 34 aa, Triticum aestivum
  Clone ID: PAT_TA_58151.pep
AGPVLALIFFENVDTLLIKQQSYIVLRIQPGAAE

SEQ ID NO: 163734 - protein, 79 aa, Triticum aestivum
  unsure (1)..(79): unsure at all Xaa locations
  Clone ID: PAT_TA_58152.pep
MPARIMEQRHHMPPFHLPVESESSSPMXKKYTLISGSYWPKVGHQLGLMEPYKLMDQKTPFGERKLVGHQRHVNLPPTP

SEQ ID NO: 163735 - protein, 70 aa, Triticum aestivum
  Clone ID: PAT_TA_58153.pep
AFQLGSTRVFPTANLEKTGPSSNYVPHKKPIKGQSSGRDAGPSSVAAPIFLGLAYSSSLIMKFNPPSPFS

SEQ ID NO: 163736 - protein, 106 aa, Triticum aestivum
  Clone ID: PAT_TA_58154.pep
SRLSSKAGKVRKCRVLPFCPVVESSASVFDLAVDILVVQAPILVCDSVVPLHGWALVLRLHVQDTVGVILRSQSREHSAPNRSYRAKEANITAEIPVKVGLAWFQG

SEQ ID NO: 163737 - protein, 145 aa, Triticum aestivum
  Clone ID: PAT_TA_58155.pep
KDDHFVKLTKIIVAYNYCSGLTNSNYTELAQLYEKYKDQGFEILAFPCNQFGGQEPGTNEEIVQFACTRFKAEYPIFDKVDVNGDNVAPVYKFLKSSKGSLFGDNIKWNFSKFLVDKEGRVVDRYAPTTSPLSIEKDIKKLLASS

SEQ ID NO: 163738 - protein, 94 aa, Triticum aestivum
  Clone ID: PAT_TA_58156.pep
VRYILIFDLCYGYGFVGWEVVSLYITNVICATPSLFMKLASFLFREVVLFPQNRFCSTMYLSKAVSFTFSLRYVGFPYRAVISKEHLVNRERCL

SEQ ID NO: 163739 - protein, 101 aa, Triticum aestivum
  Clone ID: PAT_TA_58157.pep
PSPWRRLSNATSNWNQDARVLHRAILAACPSRGVHRCSLNRVAGCECSSAPSHLPCASAASRSRWQHTNDSSSVVRGEGSGGTRFGDEWKLETAAARVAVA

SEQ ID NO: 163740 - protein, 79 aa, Triticum aestivum
  Clone ID: PAT_TA_58158.pep
PQRSYESCNQHSTVERNGKATTEGCKQHLHKRQREAKLWSSRSRRVATHSQREECAVQSIYGPRALVNISIRTTGHTVS

SEQ ID NO: 163741 - protein, 61 aa, Triticum aestivum
  Clone ID: PAT_TA_58159.pep
RNTQRRGSTAAEQRAPPRGPLHRSPPFFFFFFFFFFFFFFFFFFFFFFFFFFFFKFFFRTA

SEQ ID NO: 163742 - protein, 213 aa, Triticum aestivum
  unsure (1)..(213): unsure at all Xaa locations
  Clone ID: PAT_TA_58160.pep
MPKSKRNRSVTLSKTKKKPGLERKGKVVTEIKDAIERHSSAYVFTYNNMRNQKLKDLRDQLKSSSRIFLAGKKVMQIALGRSPADEAKTGLHKLSKFLQGASGLLFTNLPRDDVERLFREFEANDFARTGSIATQTVELKEGPLEQFSHEMEPFLRKQGLPVRXNKGVVELVADHVVCEEGKPLSPEAAHXLRVLGTKWATFRLYLVCRWSSD

SEQ ID NO: 163743 - protein, 34 aa, Triticum aestivum
  Clone ID: PAT_TA_58161.pep
SLPPSAPPRRSNQSRGGGVASPPGPPDFSLTFSL

SEQ ID NO: 163744 - protein, 63 aa, Triticum aestivum
  Clone ID: PAT_TA_58162.pep
MATKVVDLRSDTVTKPSEAMRAAMAAADVDDDVLGADPTACRFEAEMARIMGKEAVLFVPSVT

SEQ ID NO: 163745 - protein, 57 aa, Triticum aestivum
  unsure (1)..(57): unsure at all Xaa locations
  Clone ID: PAT_TA_58163.pep
RRTGSXEADAQGLGEVNRPFLWYSAHNAPNDIFQVDLYKHSHARTQVAHVVQASIMN

SEQ ID NO: 163746 - protein, 103 aa, Triticum aestivum
  Clone ID: PAT_TA_58164.pep
PRKSPGRATRCATCKRTRQQNTRIEKAKYNNIADFFLYRTPKTIQLDTKHTAANDKAFLVNLSAPFIWQFFRHAQEKALPNADYMFVNETEAGNLCKAPGRYT

SEQ ID NO: 163747 - protein, 119 aa, Triticum aestivum
  Clone ID: PAT_TA_58165.pep
MAASLQAAATLMPAKIGGRASSARPSSHVARAFGVDAGARITCSLQSDIREVASKCADAAKMAGFALATSALLVSGASAEGAPKRLTFDEIQSKTYLEVKGTGTWNQCPTIDGGSKSFP

SEQ ID NO: 163748 - protein, 39 aa, Triticum aestivum
  Clone ID: PAT_TA_58166.pep
KEANKSKGEGVRAPEIGTVNLGVTHRTPPGLMRRYRASL

SEQ ID NO: 163749 - protein, 80 aa, Triticum aestivum
  Clone ID: PAT_TA_58167.pep
FQFEHVMVACCALLMTFLRSLRSSRCSACLPPLRKSVWCSEESAMMEPLEDSHFLRLLVNVLGSCDTYWRKYQREGLCFF

SEQ ID NO: 163750 - protein, 95 aa, Triticum aestivum
  Clone ID: PAT_TA_58168.pep
HALSCKNPNYTSSNLGIKDKHRSCLKKKKKKKKKKKKKKKKKKKKKKKKKKKKKKKKKKKKKKKKKKKKKKKKKKKKGWGRGQAHFKRNQTLKTA

SEQ ID NO: 163751 - protein, 45 aa, Triticum aestivum
  Clone ID: PAT_TA_58169.pep
IAVSFNIVFGYTIEFFFFFFFFFIFFFFFFFFFFFFFFFFFFFVF

SEQ ID NO: 163752 - protein, 90 aa, Triticum aestivum
  unsure (1)..(90): unsure at all Xaa locations
  Clone ID: PAT_TA_58170.pep
TKKKKNFWGGLFKGSIFSFPCLRRKSFXIGAPKLNSRAGVXQRRDGKNPGGPQLNPLEKNPPFPRGGKKKKAPTDPPSQKVPTPKGKGDP

SEQ ID NO: 163753 - protein, 239 aa, Triticum aestivum
  unsure (1)..(239): unsure at all Xaa locations
  Clone ID: PAT_TA_58171.pep
MKTFLVFALLAVAATSAIAQMETRCIPGLERPWQQQPLPPQQTFPQQPLFSQQQQLFPQQPSFSQQQPPFWQQQLVLPQQPPFSQQQQPVLPPQQSPFPQQQQHQQLVQQQIPVVQPSILQQLNPCKLFLQQQCSPVAMPQRLARSQMLQQSSCHVMQQQCCQQLPQIPQQSRYEAIRAIIYSIILQEQQQVXQGSIQSQQQQPQQLGQXVSQPQQQSQQQLGQQPHNNXLAQGTFLQP

SEQ ID NO: 163754 - protein, 84 aa, Triticum aestivum
  Clone ID: PAT_TA_58172.pep
IFTCPQVKAFDKSKVVNSELTRECPSEVDLQTMHALNFASENQWLRVLQSSRILISMTILNFYNDKIGSTSLNDDCAKWFLKRA

SEQ ID NO: 163755 - protein, 146 aa, Triticum aestivum
  Clone ID: PAT_TA_58173.pep
ALANFTVPLGVTPPPPALFLPLQGGFPFPFRVGNFFERRLVWAFFFFPPLAKRGFFSKRFNLVTPGFFPFPRFLTPARLFYFGCPFKKLFLCIPAFVNFVFFKRPPLFFFFFFFFFFFFFFFFFFFFFFFFFFFFFFFFFFFFFFF

SEQ ID NO: 163756 - protein, 154 aa, Triticum aestivum
  Clone ID: PAT_TA_58174.pep
HAQGLVGGAAAHPVLQHLLLPVLVLPTAEPSPGAAAAIFHETEDAGTPKTRSPSTPRLPRPHATAEPARSAKEDVVEDENSMSMDEAYALALAGRQRAAPTEEEAAGSEVDAKAEEFIQGFKEDLRQQRLKSIFNYTQMLKRRAAGGQPPAAPE

SEQ ID NO: 163757 - protein, 30 aa, Triticum aestivum
  Clone ID: PAT_TA_58175.pep
QLISHQQDYSCNTLVRDQRCTEATMAYART

SEQ ID NO: 163758 - protein, 75 aa, Triticum aestivum
  Clone ID: PAT_TA_58176.pep
CPECQLKNEPTNYIGGCNISLYMGLVVFFSIISLHLWVLQSPPFFFHRGSSCAIRFEGQRVDHNGGSIQDIYPRV

SEQ ID NO: 163759 - protein, 82 aa, Triticum aestivum
  Clone ID: PAT_TA_58177.pep
LALSIKLSRFFNLVRYTWFFFFFFFFFFFFFFFFFFFFFFFFVKPNTLLLFPSTENTTSLSAATAAGGGQGLFVQLQQKHRF

SEQ ID NO: 163760 - protein, 103 aa, Triticum aestivum
  unsure (1)..(103): unsure at all Xaa locations
  Clone ID: PAT_TA_58178.pep
HSCWNYLLDRCSTKQDYPCTWRXGKWCKGGCRELLGECCKRLCNAXTDVCNIIQGXIQSDLRGLFLFHRGRASRFXREAESLPPRDSQSPPCSISHGIGYYCR

SEQ ID NO: 163761 - protein, 59 aa, Triticum aestivum
  Clone ID: PAT_TA_58179.pep
QVQRILSFHLEFIVIIEENERKPLVHCEYCNIPSFLNAHCFRPGRSDRCVLSGLRLGIP

SEQ ID NO: 163762 - protein, 86 aa, Triticum aestivum
  Clone ID: PAT_TA_58180.pep
RKRKERKERALGLWQCVTVTVRVSVTPTALDVNATGHVPFPFHIEHLLVMAIGIGLFLFTTAADRENVLLVQLSLVSAGFWLSQSL

SEQ ID NO: 163763 - protein, 78 aa, Triticum aestivum
  Clone ID: PAT_TA_58181.pep
YCTFVIYGACKLNHYIRGLQYRVEQKHVVTISNDVGSYPIDDNHCIREKFPALLRSEKEEDQNALSNRPYKRLIKRIC

SEQ ID NO: 163764 - protein, 261 aa, Triticum aestivum
  unsure (1)..(261): unsure at all Xaa locations
  Clone ID: PAT_TA_58182.pep
MKTFLILALLAIVATTATTAXQVPLVQQQQFPGQQQQFPPQQPYPQPQPFPSQQPYLQLQPFPQPQPFPPQLPYPQPQSFPPQQPYPQQQPQYLQPQQPISQQQAQQQQQQQQQQQQQQQILQQILQQQLIPCRDVVLQQHNIAHASSQVLQQSTYQLLQQLCCQQLLQIPEQSRCQAIHNVAHAIIMHQQQQQQQEQKQQLQQQQQQQQQLQQQQQQQQQQPSSQVSFQQPQQQYPSSQVSFQPSQLXPQAQGSXHLNTA

SEQ ID NO: 163765 - protein, 80 aa, Triticum aestivum
  unsure (1)..(80): unsure at all Xaa locations
  Clone ID: PAT_TA_58183.pep
CIFYIVSPFFFFFXXXXXXXXFFCNMIHQINYTRYTACDRHHRKATLLLNSSPQTTEKGFRPALVNKANRHKTYNQSRST

SEQ ID NO: 163766 - protein, 92 aa, Triticum aestivum
  Clone ID: PAT_TA_58184.pep
EMVGPNNVREKQPLMGAEDFSFYTEAVPKTYYYFVGMLNETRGPQAPHHSPYFTINEDALPYGAAMQASLAARYLLEHQPATAAKVEPRDEL

SEQ ID NO: 163767 - protein, 235 aa, Triticum aestivum
  unsure (1)..(235): unsure at all Xaa locations
  Clone ID: PAT_TA_58185.pep
QQQQQFPGQQEQFPPQQPYPHQQPFPSQQPYPQPQPFPPQLPYPQTQPFPPQQPYPQPQPQYPQPQQPISQQQAQQQQILQQILQQQLIPCRDVVLQQHNIAHASSQVLQQSSYQQLQQLCCQQLFQIPEQSRCQAIHNVVHAIILHQQQQQRQQQQPSSQFPYQQPQQQYPLGQGSFQPSQQNPEAQGSVQPQQLPQFEEIRNLALQTLPAMCNVYIPPYCXTTIAPFGIIGSN

SEQ ID NO: 163768 - protein, 39 aa, Triticum aestivum
  Clone ID: PAT_TA_58186.pep
GPCAFPSCRREVEKLKAANITAVCKQPIVINESGEGAYV

SEQ ID NO: 163769 - protein, 90 aa, Triticum aestivum
  Clone ID: PAT_TA_58187.pep
TATVVGNAGKIFAVPTCVRIKNFATIQVLKYILLKKKKKKKKKKKKKKKKKKKKKKKKKKKKKKEEKIKKKKNKKKKKNKKKKKKKRKPK

SEQ ID NO: 163770 - protein, 60 aa, Triticum aestivum
  Clone ID: PAT_TA_58188.pep
PVTSCCWLMIAVQGSYHLPLCDVALCMGRWFGSCLFCCHAMLATRCYLLRGLFTFGVLPG

SEQ ID NO: 163771 - protein, 110 aa, Triticum aestivum
  Clone ID: PAT_TA_58189.pep
CDGASMSGPRVGDRLSDDDLLCEGRPAVHRVVGSASTGVRGQTSSAADLRRRHKEIRLGNVLLIAMLITRSRCVHSTFYYFVCAILYCRLSGLDLLAYSFIVLCQFDMNT

SEQ ID NO: 163772 - protein, 62 aa, Triticum aestivum
  Clone ID: PAT_TA_58190.pep
CLTRCLCINIPPLKLDTSMFPTLWPPSFSSETRSFLHQIWSWYLLHQIWFPKWGSDVLLDTF

SEQ ID NO: 163773 - protein, 66 aa, Triticum aestivum
  Clone ID: PAT_TA_58191.pep
NNRPLNLIYVFFIKYFFLFHFFFFFFFFFFFFFFFFFFFFFFFFFFFFFFFLFFFDTTLFLFYFRI

SEQ ID NO: 163774 - protein, 69 aa, Triticum aestivum
  Clone ID: PAT_TA_58192.pep
IYLPFASIGRYILYVIDKEAHRLYIMDPIQTSQLLEDNNLRHALKFKSFVRDFKEALEIKAAWLEFRYI

SEQ ID NO: 163775 - protein, 195 aa, Triticum aestivum
  Clone ID: PAT_TA_58193.pep
PQLPYPQTQPFPPQQPYPQPQPQYPQPQQPISQQQAQQQQILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGSFQSSQQNPQAQGSVQPQQLPQFQEIRNLALQTLPAMCNVYIPPYCSTTIAPFGIFGTN

SEQ ID NO: 163776 - protein, 109 aa, Triticum aestivum
  Clone ID: PAT_TA_58194.pep
THSPFFFFFFFLFFFFFFFFFFFFFFFFFFFFFFFFFFLIHTWRTYIVWGINTYKNTEGCVFSKIIVQSANRALVRIRYTYALYFFYFFAWLLTLFIRDHIYQQLTIRT

SEQ ID NO: 163777 - protein, 60 aa, Triticum aestivum
  Clone ID: PAT_TA_58195.pep
FRLTLFFFFFFFFFFFFFFFFFFFFFFFFFFFFFFFFFFGIHHDGFYFEQGMDIHTHKTG

SEQ ID NO: 163778 - protein, 51 aa, Triticum aestivum
  Clone ID: PAT_TA_58196.pep
SYASFFFVFFIFFFFFFFFLFFFFFFFFFFFFYRTSCIFLLLLKKHTHAHK

SEQ ID NO: 163779 - protein, 122 aa, Triticum aestivum
  unsure (1)..(122): unsure at all Xaa locations
  Clone ID: PAT_TA_58197.pep
VQNAEKYKSEDTEHKXKVDAKNSLEXNYAYNMRNTIQDKKIASKLPADDKKKIEDAVDAEIQRLDANQLGEXDELEDKMKELEGLCNPIIAKMYQGAGADMPGGXDEDAPSASGGTRPKKRK

SEQ ID NO: 163780 - protein, 79 aa, Triticum aestivum
  unsure (1)..(79): unsure at all Xaa locations
  Clone ID: PAT_TA_58198.pep
YQQPTQVDQCVSQPQQNMQQQLVQQPQQQQXHKEPFLQPHHIAQXEVITYIALRTLPXMCRANVXLYETTTKMPLCGDI

SEQ ID NO: 163781 - protein, 108 aa, Triticum aestivum
  Clone ID: PAT_TA_58199.pep
NSLSLPRIKAMGRTKAIDNADLQEVLSLRDDFGVLQKDNSLIRTEVAKLQNDVQSMSKKQWDIALQVGDVEQAIIYLSKQLSAISTVLKNMVQPTTSQQTDKQLPSSS

SEQ ID NO: 163782 - protein, 105 aa, Triticum aestivum
  Clone ID: PAT_TA_58200.pep
YIQEHRGVCVLQDHCAKCKPGSRTYTVYVRTLFFYFFAWLLTLFIRDHIYQQLTIRTCAEQHHVELYAHVGTYSCISCAQLRTSARYMGSGTSSARAQQRQPWYP

SEQ ID NO: 163783 - protein, 43 aa, Triticum aestivum
  Clone ID: PAT_TA_58201.pep
GIECGHGQDSRVADRIGFYKRYCDILGVGYGDNLDCYNQRPFA

SEQ ID NO: 163784 - protein, 42 aa, Triticum aestivum
  Clone ID: PAT_TA_58202.pep
NFIFFFCFALLIFLFFIFFFFFFFFFFFFFFFFFFFFSFFIL

SEQ ID NO: 163785 - protein, 157 aa, Triticum aestivum
  unsure (1)..(157): unsure at all Xaa locations
  Clone ID: PAT_TA_58203.pep
RHLVLERVRVKPAAHLLLAAGLLSSLYSLAVDCVLDWRYDREVEGMWGDSTGLDSTAKRSHFSSARGDDGQKSLDAVVKSASKEAIQWGLAAGVYSGITYGLRXKGHHDWKNSAIAGAIAGAAVALTGDNGHSDHVVHFAITGAALSSAATMLSGIF

SEQ ID NO: 163786 - protein, 122 aa, Triticum aestivum
  unsure (1)..(122): unsure at all Xaa locations
  Clone ID: PAT_TA_58204.pep
KKKKKKKKKKKKKKKKKKKKKKKKKKKKKKKKKKKKKKKKKKKKKKKKKKKKKKKKKKKKKKKKKKRGGFQKKKNFKKRGVKKIFFFFGKKKKKRRPHXKKILNKKKPGEKKKKILEKKPFF

SEQ ID NO: 163787 - protein, 181 aa, Triticum aestivum
  unsure (1)..(181): unsure at all Xaa locations
  Clone ID: PAT_TA_58205.pep
TTRPEERPSAPRGREGHNQDGATGGQGPQPGQGQQGHDPTXTRQGGQGHDPGQGQRGDYPXGRGQPGQGQQGYASPYQESAEDQAARLREAKAQQRAAQXPARGRLEGSDAGXTRQGENARKRARRGGTQAELHKKRDAAQRRGALEESPTRAQEEEPRRRATEKGPPPKKKKKKGGRARG

SEQ ID NO: 163788 - protein, 85 aa, Triticum aestivum
  Clone ID: PAT_TA_58206.pep
SGIWCTIVGRFNISRHCSKVGVLLSFVSLDSGISGHCSSLIYHRHVKGKVGNLQLVLQKISCHHPSSKCRVFLNIEHCGHEGFYA

SEQ ID NO: 163789 - protein, 109 aa, Triticum aestivum
  Clone ID: PAT_TA_58207.pep
GASAARRWLLVRRLEGLRSGRRPICCSVFGGDLLGSVTAQLHFSLYGTAMGVAVRRVANGSTVVVLVGVVGVLWSRLHGQQTRALVGGEVGLRRQRGCEAVAALWLQES

SEQ ID NO: 163790 - protein, 38 aa, Triticum aestivum
  Clone ID: PAT_TA_58208.pep
RQDMCLLYFPVELSIVRFLHISACHFYFFHRLQRPNLD

SEQ ID NO: 163791 - protein, 82 aa, Triticum aestivum
  Clone ID: PAT_TA_58209.pep
NHMERHQNEHGRQAYHISRCITIHKPFAPATFHNLRANRKKKNKVDCSAIKAVHRNLAMCHCTLCPKTTISKRRRRQTPFSI

SEQ ID NO: 163792 - protein, 127 aa, Triticum aestivum
  Clone ID: PAT_TA_58210.pep
TFIANHHHRHRHRHSQSHSHPHLHSHHIPHRHSDRSAHHHTDHPRHSYHIPHCHSSHPHHHFHDLYCLQSCFPFPFRFGVEAHHLVPFEIRLQNMMETSHLLLIALCHQSRLPLPQPKTEQQAQCLE

SEQ ID NO: 163793 - protein, 96 aa, Triticum aestivum
  unsure (1)..(96): unsure at all Xaa locations
  Clone ID: PAT_TA_58211.pep
QRGNGKNPGVTQQNRWAKNPPLARGVKKKKARTDAPPKQWPNQKGKGHPPCGGPXTPGGGGVPPRGTVTLARPQAPALLVFFPSFPPRFPGFPRKV

SEQ ID NO: 163794 - protein, 226 aa, Triticum aestivum
  Clone ID: PAT_TA_58212.pep
PPPQEPFRRGGAPNPKRGTPKKRPPGTNRGENPPNPGVKEKGTQKNLRAETQTQKKKVNPWGENPPPPGQKRSQKGGNPWPKGPRKCWKKGPGKPHHTKPTRPKKGVGPKPQKGGTPGGHPQRRGKKPPPQKRKKGQKKKKDKRAPPPKKNPTPKSEPSPPQLKEYRPPPKKNPNTASLPHTLILFPLYFFSLFFFFFFFFFFFFFFFFFFFFFFFFFFFFFFFFF

SEQ ID NO: 163795 - protein, 102 aa, Triticum aestivum
  Clone ID: PAT_TA_58213.pep
FSFSAMQLLCLEHVFFRADLFCHFLFLQVTNIMPLHPQVSRGVFGQLKRIFCWNMFLPKTESYILHFCLLCNALTYEPTNLCMCTCRPDGCPVTGLDAYVCT

SEQ ID NO: 163796 - protein, 79 aa, Triticum aestivum
  Clone ID: PAT_TA_58214.pep
CGSSQLSWRPPRVLTSRPRLYNFRLTSIEYYMSLYYLLFFFIAPLRKPVLFYFFFSFFFFFFFFFFFFCRQDMCLSFIP

SEQ ID NO: 163797 - protein, 107 aa, Triticum aestivum
  Clone ID: PAT_TA_58215.pep
WMVVSAVFEGKETSTLTSESSNGDRSTSDLPISTPLSDPINNKVNMLLPFLPFTLFSERKPRISLLIFTIFVIGPFAQDNASMGGASTPSSIGSGEKSRLADRSNSS

SEQ ID NO: 163798 - protein, 71 aa, Triticum aestivum
  Clone ID: PAT_TA_58216.pep
LTVNRPDRLPYTSGTHLMLLEPTLFRLIKHDGRGDYPQPFPLTSQPPSAMSFGLLPFIYHKVGGFSRQAEN

SEQ ID NO: 163799 - protein, 170 aa, Triticum aestivum
  unsure (1)..(170): unsure at all Xaa locations
  Clone ID: PAT_TA_58217.pep
GFSLASGVGDWHAVLLEAVMTFXXMYAYYATLIDPKRGHVGTIGPLAVGFLLGANILAGGPFDGAAMNPARVFGPALVGWRWRHHWVYWLGPFLGSGIAGLLYEYVVMPSTDTAAHAHQPARRAHVMVELPEGEDGALGGEDEDRRGEELGDGGADGVRVRRVLAAPHGN

SEQ ID NO: 163800 - protein, 76 aa, Triticum aestivum
  Clone ID: PAT_TA_58218.pep
WQAQFGWLERSELPHTNQPPKYKPYQYVLWVVALVLLLVGFTLSLVMLFKGKNGNDGCHWCHYLNCVPTSRWKCDT

SEQ ID NO: 163801 - protein, 52 aa, Triticum aestivum
  Clone ID: PAT_TA_58219.pep
HVLLLRMLIEFGPLRYVGLLTTTLDVILRAILVVSLHGFPQSCCWSCSVQCI

SEQ ID NO: 163802 - protein, 226 aa, Triticum aestivum
  unsure (1)..(226): unsure at all Xaa locations
  Clone ID: PAT_TA_58220.pep
QQPYLQXNHFQQPQLSYXQPQPFRPXQLCPQPXTQHSQPQQPITQQHXQQQQQQQQHRXSNNTQQQQQEQQMLQQILQQQLIPCMDVVLQQHNIAHGRSQVXLQQSTYQLVQDLCWQHLWQIPEQSQCQAIHNVAHAIXILHQQHKQHQLPSSQVCFQQPLQQYALRQGSFRTSQQNPQAQGSVQPQQLPQVEEIRNLALQTLPAMCNVYIPAYCTIAPFGIFGTK

SEQ ID NO: 163803 - protein, 72 aa, Triticum aestivum
  Clone ID: PAT_TA_58221.pep
QLSQDELIQKTQQQHALQNTCAHSQQIGTLDVTTHIALRMLPTLSRGNVHLQRTITSVPFVACIAFSALLIR

SEQ ID NO: 163804 - protein, 122 aa, Triticum aestivum
  unsure (1)..(122): unsure at all Xaa locations
  Clone ID: PAT_TA_58222.pep
MPQRRARAQMMQQSRCHVMQQQCCQQNAAYSPQQPQQSXPXQQHLPEIQSFLQQQMNPCKNLLLQQCNHGSLVSSLVSIILPRSDCQVMQQQCCQQLAQIPQQLQCAVSHSVAHSIMMQQEQ

SEQ ID NO: 163805 - protein, 93 aa, Triticum aestivum
  Clone ID: PAT_TA_58223.pep
EVAPVEGEKTENGLAVESTVPPPASSEEKKVEADSTINPATPPPAEVKADAPAAEAAKATENPADNAVPEEQSAANVDNNGQIHPGVSTVRCT

SEQ ID NO: 163806 - protein, 67 aa, Triticum aestivum
  Clone ID: PAT_TA_58224.pep
KHNNSKEITCSCIILPPPLQHDGALGALLLAVAGAAVGRRGEHRLPVDLVDHEDDVRRLRVRVRAAE

SEQ ID NO: 163807 - protein, 63 aa, Triticum aestivum
  unsure (1)..(63): unsure at all Xaa locations
  Clone ID: PAT_TA_58225.pep
FSVSSMTAIERLHASHTSGWYRLDRLDRPAPFFFCFXXXXXXXXHRTQQVLFITLYRQGTNIP

SEQ ID NO: 163808 - protein, 41 aa, Triticum aestivum
  unsure (1)..(41): unsure at all Xaa locations
  Clone ID: PAT_TA_58226.pep
MGSKGLKGVMVCLLILGLVLEQVQVEGKSCCKSTLXRNCYN

SEQ ID NO: 163809 - protein, 50 aa, Triticum aestivum
  unsure (1)..(50): unsure at all Xaa locations
  Clone ID: PAT_TA_58227.pep
KKXXKKXXSSTSSTTGVGTNKLLGSRKPIASTNKSYIKMLQLSRNNTKYT

SEQ ID NO: 163810 - protein, 65 aa, Triticum aestivum
  unsure (1)..(65): unsure at all Xaa locations
  Clone ID: PAT_TA_58228.pep
GSTQDMVGQTTEVTXHKAEDTTEAYKQKAGETVVATKQKVVEAXTSTAQTAQAANEKTYETAQLA

SEQ ID NO: 163811 - protein, 50 aa, Triticum aestivum
  Clone ID: PAT_TA_58229.pep
NNHQDASQTENGSTNEQSSRIMQSNRSFHRLIHSQTCRHHQLFFIPRTES

SEQ ID NO: 163812 - protein, 69 aa, Triticum aestivum
  unsure (1)..(69): unsure at all Xaa locations
  Clone ID: PAT_TA_58230.pep
PFQAPGCKLGSFKTRPPFXFFFFFFFFFFFFFFFFFFFFFFFFFFFFFFFFFFFFFFXTPSNRFLVDKI

SEQ ID NO: 163813 - protein, 77 aa, Triticum aestivum
  Clone ID: PAT_TA_58231.pep
PPTKIFSLFTEHHLTSHLRIKQNPLRSSCPRSFCIFYALFTIFCVLNQESSDDPIPHHSSRELFIIGAVRSLAVLTL

SEQ ID NO: 163814 - protein, 135 aa, Triticum aestivum
  Clone ID: PAT_TA_58232.pep
SGKYGFVHGLIKAFVDSGAKAIISSSVEPPDSQAIAYHGMDVSGSLENGKFVIGDDEADESEPEPVSPISDWEDSDAEKNGEGNKDIDEEEYLAQFICLLYDKLFREGVTVDTALQQALRAHPRLKYSCHLPNVS

SEQ ID NO: 163815 - protein, 64 aa, Triticum aestivum
  unsure (1)..(64): unsure at all Xaa locations
  Clone ID: PAT_TA_58233.pep
FQQSPFSQXQQPVLPQQPGQWQQPGQGQPGYYLTSPLQLGQGQQGYYPTSSQQSGQGHQSGQGQ

SEQ ID NO: 163816 - protein, 61 aa, Triticum aestivum
  unsure (1)..(61): unsure at all Xaa locations
  Clone ID: PAT_TA_58234.pep
QGPFMCSAILVAXFQYIKIFNFFPKASAKIGVTTFMKSYSSNDCKSMXLMCSMTSVEPSSM

SEQ ID NO: 163817 - protein, 51 aa, Triticum aestivum
  Clone ID: PAT_TA_58235.pep
TICTSQKKIAKLKKIKSCQKRNLGLKTLPEMGNGYIPPYCTIAPFGILGTK

SEQ ID NO: 163818 - protein, 57 aa, Triticum aestivum
  Clone ID: PAT_TA_58236.pep
SKKKKKKKKKKKKKKKKKKKKKKKKKKKKKKKKKKKKKKKKKIIKKKNKKKIKWKKI

SEQ ID NO: 163819 - protein, 86 aa, Triticum aestivum
  unsure (1)..(86): unsure at all Xaa locations
  Clone ID: PAT_TA_58237.pep
MTKQQTRAERTYSHIKQGKKKKKKKKKKKKKKKKKKKKKKKKKKKKKKKKKKKKKXGGGIKKKNRCEGGEKIFKKVSQKKKKRTPF

SEQ ID NO: 163820 - protein, 41 aa, Triticum aestivum
  Clone ID: PAT_TA_58238.pep
GLFFLIWSPFFFFFFFFFFFFFFFFFPQFTLYHKHSILSQI

SEQ ID NO: 163821 - protein, 37 aa, Triticum aestivum
  Clone ID: PAT_TA_58239.pep
DKLVCHFGRRLECNCHLGVSMPIPDMYSSPEEDLEDG

SEQ ID NO: 163822 - protein, 82 aa, Triticum aestivum
  Clone ID: PAT_TA_58240.pep
TPAREFNFGGPKKKILLCQPREVNFDPLKRPPPFFFFFFFFFFFFFFFFFFFFFFFFFFFFFFFFFFFFFFFFFLPKRIYIH

SEQ ID NO: 163823 - protein, 84 aa, Triticum aestivum
  Clone ID: PAT_TA_58241.pep
RGRGKLCVDGQDLNSEETTSVILKNHRCFLVGRLMPPSLRPVILPEPEDVSDAPWPWHRQPEAGQGSIRWSVPVASHMCPWQAD

SEQ ID NO: 163824 - protein, 155 aa, Triticum aestivum
  Clone ID: PAT_TA_58242.pep
VLGCTVYGISILKRKKGKKKKKKKKSNKKKKKKNLGAPPREKKLFCRGATVKTVFFFGASQIYTFGRFLPIPLVGENGGGPRLWLCETLPFSQMWELEQKGAPAYLPFKMGGVTGGERAPLVVLNNRAGGFSLPFLAPFFGLPLYPLDFGFLFPF

SEQ ID NO: 163825 - protein, 50 aa, Triticum aestivum
  Clone ID: PAT_TA_58243.pep
SLNPSLFFFFFFFFFFFFFFFFFFFFFFFFFFFFFFFFLRESEPSFTARE

SEQ ID NO: 163826 - protein, 86 aa, Triticum aestivum
  Clone ID: PAT_TA_58244.pep
AIVATTATTAVRVPVPQLQPQNPSQQQPQEQVPLVQQQQFLGQQQPFPPQHIPLYLSHGSTSGQQQCNMASNMMTFIRTRNGNTHT

SEQ ID NO: 163827 - protein, 64 aa, Triticum aestivum
  Clone ID: PAT_TA_58245.pep
LIYSGDHDMIVPSIGTQAWIRSLNFSVVDEWRPWYVDAQVAGYTRSYSNNLTFATVKGGGHTHT

SEQ ID NO: 163828 - protein, 101 aa, Triticum aestivum
  Clone ID: PAT_TA_58246.pep
KKYKKKKKKKKKKKKEKKNIKGQDDLKEPKDKNKRNKKKKILKKRNRNSIQMGGGLKPGEWEKHGFNQINPFAKQAPLKKRRKNEKAPTGPPLKQLGNLTG

SEQ ID NO: 163829 - protein, 55 aa, Triticum aestivum
  unsure (1)..(55): unsure at all Xaa locations
  Clone ID: PAT_TA_58247.pep
DAWAVVDPKWLVEXARFYKGADPTKMSKRKRQERIEPLYDRYHEPNSWRLSKRRA

SEQ ID NO: 163830 - protein, 253 aa, Triticum aestivum
  unsure (1)..(253): unsure at all Xaa locations
  Clone ID: PAT_TA_58248.pep
GRVGSKSQTEIKACNMVFYFLLGNVFFLSILSGSLLHQIGESFTHPKDIPSRLASAVSAQSDFFITYILTNGMSGFSFEVLQFGLLTWHFLKAHTVGHSDEPYLYGFPYYRVVPIASLAVLIGMVYAVVSPLLLPILVIYFLLGYAVFINQMEDVYEITYDTCGQYWPTIHHYIFLSVTLMQTTMIXLVXLKSKPGASFATIPLLVLNIMFNEYCRVRFLPTFQCRPIQICKDTMTLIKXEGGRMQLEHAVRA

SEQ ID NO: 163831 - protein, 167 aa, Triticum aestivum
  Clone ID: PAT_TA_58249.pep
PSTKRLVSALYDDSHKTANEADSSRDKKLKNKDVISGQISPLPLSICNENNEITRNQGNAALALRSELSLPSLPPMAAFNQLSSSSLAPSCHLEQASSQMVIIPSMPDSRQLRTLLLGALGQPTADPQDRLLGSQEGSGIDDLHKEAMLVKLVLGRTLVENYVRGIW

SEQ ID NO: 163832 - protein, 70 aa, Triticum aestivum
  Clone ID: PAT_TA_58250.pep
ETFLRILILQKSYEDPLNQRDDAWLKAAAGDPPPCTISVATSIGSSDWNSTQLLTSTVPQRNQVKTNNSA

SEQ ID NO: 163833 - protein, 42 aa, Triticum aestivum
  Clone ID: PAT_TA_58251.pep
IAHRFISNIMTHRHSCVYPIAGSNVVEASQLWFREIKDRTRG

SEQ ID NO: 163834 - protein, 49 aa, Triticum aestivum
  unsure (1)..(49): unsure at all Xaa locations
  Clone ID: PAT_TA_58252.pep
PGVRSPQQGPKYPGXASPQQPGQGLRPGKWQELGQGHXGHWXTSLEQXG

SEQ ID NO: 163835 - protein, 75 aa, Triticum aestivum
  Clone ID: PAT_TA_58253.pep
KKKKKKKKKKKKKKKKKKKKKKKKKKKKKKKKKKKKKKKKKKKKLNKIKKGKKKKTKGKKKELNQIKNTPISKKF

SEQ ID NO: 163836 - protein, 64 aa, Triticum aestivum
  Clone ID: PAT_TA_58254.pep
ACQSSCYLSERIILLLRIWLIQACQSSKKKKKKKKKKKKKKKRTKRARAFKSDPSLHTHAYNVI

SEQ ID NO: 163837 - protein, 103 aa, Triticum aestivum
  Clone ID: PAT_TA_58255.pep
EKTIAFIGKHGYILKWKKKKKKKKKKKKKKKKKKKKKKKKKKKKKKKKKKKKKKKKKKKKKKKKKKKKKKKKKKKKKKKKKKNKKIKKNRKRTDRPTHHPPHS

SEQ ID NO: 163838 - protein, 63 aa, Triticum aestivum
  Clone ID: PAT_TA_58256.pep
KGPLFFFFFFFPFFFFFFFFFFFFFFFFFFFFFFFFFFFFFFFFFMNIVLIQLYFILFQNLNN

SEQ ID NO: 163839 - protein, 78 aa, Triticum aestivum
  Clone ID: PAT_TA_58257.pep
NPPALVGLTVPLQRLGPISPKREGAIGFKGLFGQGPQRVNTPACPKGSIRRTGVLSLCNSQGVPQSRRVFSDVPFYFI

SEQ ID NO: 163840 - protein, 189 aa, Triticum aestivum
  Clone ID: PAT_TA_58258.pep
SQDKGKGHYPASQQEPGQGQQGQIPASQQQPGQGQQGHYPASLQQPGQQGHYPTSLQQLGQGQQIGQPGQKQQPGQGQQTGQGQQPEQEQQPGQGQQGYYPTSLQQPGQGQQQGQGQQGYYPTSLQQPGQGQQGHYPASLQQPGQGQPGQRQQPGQGQHPEQGQQPGQGQQGDYPTSPQQAGQGQQLGQ

SEQ ID NO: 163841 - protein, 37 aa, Triticum aestivum
  Clone ID: PAT_TA_58259.pep
GHVAGMAMPRNVITSRISFMIIATRGTLFITRKLESK

SEQ ID NO: 163842 - protein, 109 aa, Triticum aestivum
  Clone ID: PAT_TA_58260.pep
LSMVVTDAYWREFLPEGATRDRPAARVCGERVELAEAFPPAMVVVGGLDLLKGWQTRYVEALRGKGKPVRVVEYPDAIHGFHAFPEIADSGELVEDIKLFVDEHRPTKS

SEQ ID NO: 163843 - protein, 127 aa, Triticum aestivum
  Clone ID: PAT_TA_58261.pep
YFHNNHIRSRNHLHSTDKLNTQPLSHRSMHAWTREREERGKTEQKRSAKGTHISIKYTHSFFQPLRALSVVAALLTHHHRFCLILHKGKTGELVSVFLSSSLLLLSSHAHSHLWSRCSSPPSAIGSK

SEQ ID NO: 163844 - protein, 60 aa, Triticum aestivum
  Clone ID: PAT_TA_58262.pep
DQAYALLVIKGCQESIPLTEIDTSINAAADDEEMKLYVEQCGDACVNFCNADAGLTSLDA

SEQ ID NO: 163845 - protein, 164 aa, Triticum aestivum
  unsure (1)..(164): unsure at all Xaa locations
  Clone ID: PAT_TA_58263.pep
SQQQAQQQQILXQILQQQLIPCRDVVLQQHNIAHASSQVLQQSSYQQLQQLCCQQLFQIPEQSRGQAIHNVVHAIILHHHQQQQQQPWSQVSYQQPQEQYPSGQGSFQSSQQNPQAQGSVQTQQLSQXQEIRNLSLQTLPAMCNVYIPPYCSTTIAPFWIFGTN

SEQ ID NO: 163846 - protein, 74 aa, Triticum aestivum
  unsure (1)..(74): unsure at all Xaa locations
  Clone ID: PAT_TA_58264.pep
SEILNRKLLCRGTCGAEPSRQRTCSKRALSIESQILMFKCQKDIQAMDFPTKKKKKIFKKKKKKXNIXXPXFXX

SEQ ID NO: 163847 - protein, 65 aa, Triticum aestivum
  Clone ID: PAT_TA_58265.pep
KGRPFFHLIDFCFFLFISFFFFFFLFFFFFFFFFFFFFFFFFLTSTQCQYEHCLDTTLFLFYFRI

SEQ ID NO: 163848 - protein, 128 aa, Triticum aestivum
  Clone ID: PAT_TA_58266.pep
KETPLYRVKRKNAHLLRKRKGRAPIARAIGLSKVKGTLCGSSPHPALKKTRQGAHHIPLGVRTCLKSARCGPLRHYTTCGKRGYAPKRVKMGGATGFSHSNGVYLRAHVNYLWCHYIRDYFVSRASCV

SEQ ID NO: 163849 - protein, 132 aa, Triticum aestivum
  Clone ID: PAT_TA_58267.pep
AGIEISFTLTSKSGADDENDEFADLYIVKWTSLMIPPIVIMMVNLIAIAVGFSRTIYSEIPQWSKLLGGVFFSFWVLAHLYPFAKGLMGRRGRTPTIVFVWSGLLAITISLLWVAINPPSQNSQIGGSFQFP

SEQ ID NO: 163850 - protein, 81 aa, Triticum aestivum
  Clone ID: PAT_TA_58268.pep
RTRGKKKKKKKKKKKKKKKKKKKKKKKKKKKKKKKKKKKKKKKKKKKKKKKKKKKGGALLKDQIFCPRPSKQKFFFLGPLI

SEQ ID NO: 163851 - protein, 42 aa, Triticum aestivum
  Clone ID: PAT_TA_58269.pep
KFDEHDRSSPQLRLQFARFKGPRGQAGGPGGGGGGGGGGIRR

SEQ ID NO: 163852 - protein, 100 aa, Triticum aestivum
  unsure (1)..(100): unsure at all Xaa locations
  Clone ID: PAT_TA_58270.pep
MDRSKEWWQKAVVVPVRRAWVVVAARLRRKKQHDGRGGALVKLHDDVQTCAYEDVQVMWEMLQRSETGKMMAGAPPSKGSALVWLRPRRRXHSIDLRPRC

SEQ ID NO: 163853 - protein, 73 aa, Triticum aestivum
  unsure (1)..(73): unsure at all Xaa locations
  Clone ID: PAT_TA_58271.pep
VVSSPPGACWACLSRGTEVTATCVRRQRSAIETPKFNALAVYIQRADXQNPATTQLNYLATHTHFTRPAYYNK

SEQ ID NO: 163854 - protein, 122 aa, Triticum aestivum
  Clone ID: PAT_TA_58272.pep
MFPRVWPIYKTYKCIRRTLDENERGWYGIEERRRWRKILPKEWVTMVLGGGHYIKNPKMRQMFAGGLHDYALDTCQLGIASCMHLIWTLKFCMYLTPNVRAPAYAYSKGYIRQTVKYCWMDF

SEQ ID NO: 163855 - protein, 69 aa, Triticum aestivum
  unsure (1)..(69): unsure at all Xaa locations
  Clone ID: PAT_TA_58273.pep
QQQQGIQILRSCFNYAQGQGIIQPHQPAHYEVIRSLVLRTLPNMRNAVCTVPXTRSTINAPFATIHPRL

SEQ ID NO: 163856 - protein, 117 aa, Triticum aestivum
  unsure (1)..(117): unsure at all Xaa locations
  Clone ID: PAT_TA_58274.pep
HASGAIVCLLVLGLVLEQVQVEGVDCGANPXKVACFNSCLLGPSTVFQCADFCACRLPAGLASLRSSDLLRFGXEPNAIEYCXLADNTEEMKLYVKRCGDACDSFCKGDTLLASLDD

SEQ ID NO: 163857 - protein, 139 aa, Triticum aestivum
  Clone ID: PAT_TA_58275.pep
MDAFYSTSSAAASGWGYDSLKNFREISPAVQSHLKLVYLTLCFALASSAVGAYLHIALNIGGMLTMLACIGTIAWMFSVPVYEERKRFGLLMGLGNTLAQLLGLLLLRLDGTLNLLLFLQDDGVDDSTDCLIAGLLGGG

SEQ ID NO: 163858 - protein, 118 aa, Triticum aestivum
  Clone ID: PAT_TA_58276.pep
FGEPQGFSFPLGLKRRARIFILGTPLKNFLVSPLGTLSFFFLNGPPFFFFFFFFFFFFFFFFFFFFFFFFFFFFFFFFFFFFFRVYIHRKRIQHILLYLSHGSTSSRHQYDIHHDIFY

SEQ ID NO: 163859 - protein, 37 aa, Triticum aestivum
  Clone ID: PAT_TA_58277.pep
GRVGQDLGVFRDLKGGAWFLGATEPYHVVVFKKAPPA

SEQ ID NO: 163860 - protein, 167 aa, Triticum aestivum
  unsure (1)..(167): unsure at all Xaa locations
  Clone ID: PAT_TA_58278.pep
AHVRMDIXQLGAARQELMGQIQGYTQDLARSAVELQQVAAVKAETQELRHETQHLXSSIELEKKGYAESYEQGQEMQKKLVSVASEVEKLRAEVANAEKRSRAAVSAGNQGYAGSYGNPNANYAANPYKAGYSMTQANATDSGSQYGAGAAHSSWGAYDMQRAPGRR

SEQ ID NO: 163861 - protein, 107 aa, Triticum aestivum
  unsure (1)..(107): unsure at all Xaa locations
  Clone ID: PAT_TA_58279.pep
VTXPRTNMCPFPVWPAVAPNAGHPVLAAGGFFLPPGQSKRVGAPATWNGRLWGRTGCTFAGRGANAASCLTGDCDGRLTCTGSVGAPPATLVEAHLRAGLRWGSSCG

SEQ ID NO: 163862 - protein, 125 aa, Triticum aestivum
  Clone ID: PAT_TA_58280.pep
AFRGKTPHFGVKGGKKTKGAGGKGLGKLKVTLGGNPPPPGVKGEVKGGGPLAFRVGQFLGRRFGWALFFLRQMGKRGFFSKGFNWGTPGFFPFPGVLKGGPGILFWGPLKKNFTLARPGKENWVL

SEQ ID NO: 163863 - protein, 39 aa, Triticum aestivum
  Clone ID: PAT_TA_58281.pep
GKQELCLSFIPKLELALVGVTHDGARHFICHRYIDWCIC

SEQ ID NO: 163864 - protein, 37 aa, Triticum aestivum
  Clone ID: PAT_TA_58282.pep
GGSGGGCSHRCCGHGGCHCCAGPDEIPKPKYRAEVRN

SEQ ID NO: 163865 - protein, 139 aa, Triticum aestivum
  Clone ID: PAT_TA_58283.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQLPISPHSYETAPAPGPPSSHRAPGRTAGSPG

SEQ ID NO: 163866 - protein, 94 aa, Triticum aestivum
  Clone ID: PAT_TA_58284.pep
RASDATSAVPTASAEDLKNWDANFVKVDKATIFDLMLAANHLNIKGLVHLTCQTVADMMTGKTPEEIRKIFNIDDKFKPGEEEEIRRENQWAFE

SEQ ID NO: 163867 - protein, 146 aa, Triticum aestivum
  unsure (1)..(146): unsure at all Xaa locations
  Clone ID: PAT_TA_58285.pep
KFQIYIPLLSAPPFFFPNLSSPSPPPLFSFFCPPNPFPSPLFSPADFPIPPFSPIXITFQPIPLFPLLDYPNXALPHPPSPNFSPLNFNWSPPXAPFSSPPPMGPPPSVYLPSFPAPFPPFPRIASLPFPPLKPPFPPLFFNLGPP

SEQ ID NO: 163868 - protein, 93 aa, Triticum aestivum
  unsure (1)..(93): unsure at all Xaa locations
  Clone ID: PAT_TA_58286.pep
KLKKTRKTGGIMKGGPSLYQVDPSGSYFPWKATAIGKXAASAKTFLEKRYTEGLELEDAVXIALLTLKETIEGEMNGDTVEYNLPSTASQPYD

SEQ ID NO: 163869 - protein, 91 aa, Triticum aestivum
  Clone ID: PAT_TA_58287.pep
NRWFQLTVTELQAMQGKEACTYSACWCNTWANLDLHQPRTIYSTSQHITKEETSRLHILLSSTNQMTFLTTVEGSSHGGTWNQPWIHGLAL

SEQ ID NO: 163870 - protein, 54 aa, Triticum aestivum
  Clone ID: PAT_TA_58288.pep
IKFRSLKRTPLFFLFFFFFIFFFFIFFFLFFFFFFFFFFFFFFFFFFFFFFFFF

SEQ ID NO: 163871 - protein, 71 aa, Triticum aestivum
  Clone ID: PAT_TA_58289.pep
SGEAFYLHYYGSSVEHHVCALRHVYGYIRCSILSPCTFRVFYPGDPPVLRPLLWLTVLAAVSLVLCTLCPP

SEQ ID NO: 163872 - protein, 60 aa, Triticum aestivum
  Clone ID: PAT_TA_58290.pep
EMDSTGMPGSGIGEAMRVNELLEPRRSVRLRQLYEEEEFDSEEEEFDDDEEMHSDEENDY

SEQ ID NO: 163873 - protein, 68 aa, Triticum aestivum
  Clone ID: PAT_TA_58291.pep
NIYFLTFRPVNFFFFLTMPHPISFSCSRSLSLLSFKPLHPFFFFFFFFFFFFFFLDKTCVCLLFPSLN

SEQ ID NO: 163874 - protein, 60 aa, Triticum aestivum
  Clone ID: PAT_TA_58292.pep
KFVFPKKKKKKKKKKKKKKKKKKKKKKKKKKKKKKKKKKKKKKKKKKKKKKKKKKGGGPF

SEQ ID NO: 163875 - protein, 153 aa, Triticum aestivum
  Clone ID: PAT_TA_58293.pep
MKTFLIFALLAIVATSAIAQMENSHIPGLERPSQQQPLPPQQTLSHHQQQQPIQQQPQPFSQQQPCSQQQQQPLSQQQQPPFSQQQPPFSQQQQQPLSQQQQPPFSQQQPPFSQQQQPPFSQQQPPFSQPQQPFPQPQQAFPEQAEQIIPQQP

SEQ ID NO: 163876 - protein, 80 aa, Triticum aestivum
  Clone ID: PAT_TA_58294.pep
SNDLVRQFRPRASPSGLPASATAFVVVAVVLSSLVSMARSPFLFLTHLPVHALSLRSRPSLRRTLNRPAVRTGQTPSNSS

SEQ ID NO: 163877 - protein, 43 aa, Triticum aestivum
  Clone ID: PAT_TA_58295.pep
TSYGVHTCTDVQETTQRCAPGGVGLIGSLWSCLCKFHCFTTIN

SEQ ID NO: 163878 - protein, 95 aa, Triticum aestivum
  unsure (1)..(95): unsure at all Xaa locations
  Clone ID: PAT_TA_58296.pep
ECHXIGIILGKRIAVSCGHGCCYRRCNAGLMELVTKNLECITNKFMSRFGWSVNVRLPSIESNLGCHITLFLCWLVLLASFPLSGKIIVWRLSNK

SEQ ID NO: 163879 - protein, 62 aa, Triticum aestivum
  Clone ID: PAT_TA_58297.pep
MCAIIYSIVLQEQQHGQGFNQPQQQQPQQSVQGVSQTQQNRKRLERGFFKQPNHHQWVNGPK

SEQ ID NO: 163880 - protein, 44 aa, Triticum aestivum
  Clone ID: PAT_TA_58298.pep
CNQTRSYIAPKPVPISTLVALVLFINTQPSNDEPRKKNHVISSS

SEQ ID NO: 163881 - protein, 73 aa, Triticum aestivum
  Clone ID: PAT_TA_58299.pep
IKPPFLFFFFFFFFFFFFFFFFFFFFFFFFFFFFFLFFFFFFFFFFFLDQQGTSLLFINDAFRIGAYTILFNL

SEQ ID NO: 163882 - protein, 138 aa, Triticum aestivum
  Clone ID: PAT_TA_58300.pep
SCASTADLALMSGAELFIREDLGLTDTQVELLAGSMNVFMLASILFSGWTADLLGRRVTLVVANAFLTAGALAMSLGGGYAALMAARFVTSIGMGLALVVAPVYNAEISPPSTRGVLSSLLDVRMCRRLMDRNRVRFD

SEQ ID NO: 163883 - protein, 223 aa, Triticum aestivum
  unsure (1)..(223): unsure at all Xaa locations
  Clone ID: PAT_TA_58301.pep
AGHLGDRMDLRIVLTIGMISTAIFTALFGAGYWLNIHNFYYFLVFQMIAGLFHSSGWPSVVAVVGNWFGKSKRGLIMGIWNAHTSIGNISGSLLAASLLKFGWGWSFAIPSIIMALAGLVVFFFLPVSPDVMEIDIDDXEVNSDKDTAKEPLLEPGQEVKHKAIGFLEAWRIPGVAPFALCLFFSKLVAYTFLYWLPFYISHTPIGNEYLSDAMAGSLSTAFD

SEQ ID NO: 163884 - protein, 70 aa, Triticum aestivum
  Clone ID: PAT_TA_58302.pep
RTRGLNPLVLCPYCPNYVHYAAYQNIQVFELRAKLPAITNFQDHNLTWMLLPQIWSLTLQRCFLSSASRT

SEQ ID NO: 163885 - protein, 235 aa, Triticum aestivum
  unsure (1)..(235): unsure at all Xaa locations
  Clone ID: PAT_TA_58303.pep
ACSEEXQGINHHDLLKFGSGWMKLQKFEXERKRERHDHYIGYDFYDPSYDAHSTDIYDFSCESLKDLRLAHIKTWPEIGLRVVLGKCKALENLWLEYVYALNDNDMIALFRSCSNLKSISVGLNLQRYCSEDGYCETRTSFTDNSIYALALNYPMLQIVDLKFTGCSRDWPSEIGFTKKGFLALIQSCPIRVLVLNTANFFDDEGMKALSSSPHLETLELILCHAVTDAGMPLKH

SEQ ID NO: 163886 - protein, 191 aa, Triticum aestivum
  unsure (1)..(191): unsure at all Xaa locations
  Clone ID: PAT_TA_58304.pep
PAHCARISVHNSVTYGPLLNGPTTTRLSRELHTSHRNXWRCRHYADLYXVTIYHTGPTLMPSLTRDDSECVKRHSLKRLINRGSGGEXLHPTRVDTCQYTIARYFRCLIXTTRHETETAASITTPLPASRAQIQXSTTSPSFETQSGRWDKXGPIMTVDCSAYLDIKNSRPRAVLTLHADTDSNHTSYYKP

SEQ ID NO: 163887 - protein, 58 aa, Triticum aestivum
  Clone ID: PAT_TA_58305.pep
LFFCFFFFNILVFFFFFFFFFFFFFFFFFFFFFFFFFFFFFFFFFFFEENYSIPFPHY

SEQ ID NO: 163888 - protein, 144 aa, Triticum aestivum
  unsure (1)..(144): unsure at all Xaa locations
  Clone ID: PAT_TA_58306.pep
QLIPCRDVVLQQHNIAHASSQVLQQSSYQQLQQLCCQQLFQIPEQSRCQAIHNVVHAIILHHHQQQQQQPWSQVSYQQPEEQYPXGQGSLQASEQNPQAQGCVQSQQLSQVQEIRNLTLQTLSGVGSAYMPACWWTTIGVRGVG

SEQ ID NO: 163889 - protein, 94 aa, Triticum aestivum
  Clone ID: PAT_TA_58307.pep
KKEGGFRFKKLRFPFLGIQIFFFVLPKLNFLSGVFHFHGGDWLVLAHLNVIALDPPFPLCGSSKKFGPGPFSHKVRILRVFGNGPCPCRLSSPA

SEQ ID NO: 163890 - protein, 170 aa, Triticum aestivum
  Clone ID: PAT_TA_58308.pep
IIQMQALPVPPDPCAPVPAPIPMRCRAQEFGEKAAAVLAREKGAGPCWRCKGGTTQVGYAVGQRRRRARSTVTCPPQPVLSRLPQLRALVQCKSMELPTQIVVGCYKKGGSSPRIYIRSVLDEASNVDTEFAAGRSAEFAGGRRSAEFAEGRRTAVELSNVPCVGYSRRP

SEQ ID NO: 163891 - protein, 80 aa, Triticum aestivum
  Clone ID: PAT_TA_58309.pep
EDAPEDNEMEKHGMATQEVDNESDLARTLSSLRRGSTDPATDPAMRERENGDPAEASAKSTSSAVKKFYMRRNSSQSFKK

SEQ ID NO: 163892 - protein, 57 aa, Triticum aestivum
  Clone ID: PAT_TA_58310.pep
AKHVNYQALCCDGAKQHPCMESVVVLQQHNLAHGRSQVLQQSTYQLLQELCCQHLGR

SEQ ID NO: 163893 - protein, 83 aa, Triticum aestivum
  Clone ID: PAT_TA_58311.pep
MIFDRRRATLHSDSIHLACSGLLVVSTDSEGSVMMNMHGLQGFVHRHETSIAVLEVENTHTRADSEFDQRKTRKNNEIMKSWY

SEQ ID NO: 163894 - protein, 113 aa, Triticum aestivum
  Clone ID: PAT_TA_58312.pep
VYHPYRPLLHLLQDAGVTDLTQFAWGLVNDTYKMDLILVQPPYMIALSCIYIASVLKDKDTTSWFEELHVDMNIVKNISMEILDFYETYKVDPQRGLSDEKISPIMNKLPAKA

SEQ ID NO: 163895 - protein, 43 aa, Triticum aestivum
  Clone ID: PAT_TA_58313.pep
LIPQMQILLNAGLTSTQHTVFQIHKIIQRDCRTNVMQHSPRVR

SEQ ID NO: 163896 - protein, 116 aa, Triticum aestivum
  Clone ID: PAT_TA_58314.pep
QGQQPGQGQQGRQPGQGQPGYYPTSSQLQPGQLQQPAQGQQGQQPGQGQQGYYPTSLQQTGQGQQSGQGQQGYYSSYHVSVEHQAASLKVAKAQQLAAQLPAMCRLEGGDALSASQ

SEQ ID NO: 163897 - protein, 60 aa, Triticum aestivum
  unsure (1)..(60): unsure at all Xaa locations
  Clone ID: PAT_TA_58315.pep
RSPFRLPNCLQGGPVGASSLVRQLAKRQCTPRPXSWATKRRSPSGRGKTAATKRISGVNI

SEQ ID NO: 163898 - protein, 137 aa, Triticum aestivum
  unsure (1)..(137): unsure at all Xaa locations
  Clone ID: PAT_TA_58316.pep
LSVKMVNAQMVSGYLDNSFNALVVSGGGESXXGWXGCQLXVAXEPILMXDPLGVLQCPFSTMGYNLKITVIIIFSRSDRCIHNISLALIIQHHSFRQTFPYRCLLLCTLLLDAHTGSPYANWLKLPAPAYSLMGHWL

SEQ ID NO: 163899 - protein, 59 aa, Triticum aestivum
  Clone ID: PAT_TA_58317.pep
QIQMKRKGDYLLFLLHLHLHITEGRNSRINEHAQKLHKPNTLKYPPSTYKTIKNSFLTL

SEQ ID NO: 163900 - protein, 239 aa, Triticum aestivum
  unsure (1)..(239): unsure at all Xaa locations
  Clone ID: PAT_TA_58318.pep
MQKSQAYMEGTAARRRKAQHVCKQRCKRELMGATLRLPEYKRVLITCLLWRWWTWRNKINAGEKVGSGEHLPAEINTWTTDSLNLCAKHSTDEPAKVLQNWKKPTGDILKINCDGAFQAADGTGGWXFVIRDSDGDVRGSGAGCLPHVASAIRAEAEACAAALQEASGWGMVNVVVESDCNILINALKSKESDLAPEGIIFKEIREFARLNFSSISFXFAPRACNKLAHCVAAFGARSQ

SEQ ID NO: 163901 - protein, 74 aa, Triticum aestivum
  Clone ID: PAT_TA_58319.pep
GAFHFTAPYAYDRCSSLVSTDRVAFTNKKITMINVNPAATEYRHYEKNICCLVFRRKPSVICRPLGLYQCKPGT

SEQ ID NO: 163902 - protein, 91 aa, Triticum aestivum
  Clone ID: PAT_TA_58320.pep
SQYASHSTHATVHMPNTRNQHPSASLLALGNPTLTQPKNWADFLNALSSHARRLLLPYHLHQCGHAGYFENGLAREPNSSVLKRLIRGHAS

SEQ ID NO: 163903 - protein, 148 aa, Triticum aestivum
  unsure (1)..(148): unsure at all Xaa locations
  Clone ID: PAT_TA_58321.pep
MVQEPNSGPCSWRDPATGYKVSALTGCRSLEKLHRVGCQQPDADLRDCCQQLPDINNEWSMCCVPQHPDAYRSLMSSEXVRGYRGCLPGQRGRRVMXLTVASVPEDCKVPITNPQTDRARVWYCAAYADVYSSRICILIGAARAHKID

SEQ ID NO: 163904 - protein, 233 aa, Triticum aestivum
  Clone ID: PAT_TA_58322.pep
ASITAGKNFLSSSVRYLAAPHTAAPNQSRSSYLLFSANSTVVHHQQQQSQQQHLQAATTASSSFSSANNSSSSTQQPQAAAVQRAPSAAPTVSSSNCRLFSVFLQHQQASRTSSKPASTWPLPWRSRLLPLPSATHSSTRSTRSTSRVRTSSRERAVPPVASNPLQALRRQPARSHAAAPAGPLQARLYRRRSRLQCPAQHTRANNHPGCPELRPTLPIHRRRPTEPSIASRL

SEQ ID NO: 163905 - protein, 80 aa, Triticum aestivum
  Clone ID: PAT_TA_58323.pep
NQSAHVLGKHTYNIGINQPTYAHAAIHPSHAAPHPSSHAAIPQQRHQRERHQGKGGGRSGAARRARVRGGSRRRRRRHEV

SEQ ID NO: 163906 - protein, 143 aa, Triticum aestivum
  Clone ID: PAT_TA_58324.pep
MASKSNCVLLLAAVLVSIFAAVAAIGNEDCTPWMSTLITPLPSCRDYVEQQACRIETPGSPYLAKQQCCGELANIPQQCRCQALRYFMGPKSRPDQSGLMELPGCPREVQMDFVRILVTPGYCNLTTVHNTPYCLAMEESQWS

SEQ ID NO: 163907 - protein, 71 aa, Triticum aestivum
  Clone ID: PAT_TA_58325.pep
CWSDDQLKVVAKVYWGDAREKLCDAVEEQRIDTIVMGSRGLGTIQRILLGSVTNYVLSNASCPVTVVKGDR

SEQ ID NO: 163908 - protein, 228 aa, Triticum aestivum
  unsure (1)..(228): unsure at all Xaa locations
  Clone ID: PAT_TA_58326.pep
TSVTAWLAEDTPSFDYAGFVVGDGPRVATLWGKSSGVIAGRPFFDEVFVQCGCTVEWHAEEGNDVDLSSGKHRVATVKGPVRGILLGERVALNTLARCSGVATKSSRLVSIARKAGYTGVIAGTRKTTPGFRLVEKYGMLVGGADAHRMDLSAMIMLKDNHVWSRGSITDAXKAAKSVGGFSMKVEVEVQSEAEADEAIEAGADVVMLDNFTGDGVRGASRSLKERWQ

SEQ ID NO: 163909 - protein, 196 aa, Triticum aestivum
  Clone ID: PAT_TA_58327.pep
TKHHQPYSPMAATTTTSAPADTFKFPREYHFPAFFTRQTNLTTLHAQHNKWADLILAYARHNRIFRLSLSEAADSDLFVNRKLDRRLQFDDIRDVVSFMHTDGRVEYVGGGTSGDVVFLYWRKPEEWAELVENYVEESGQKGSVLTVYELVEGDGTKGNDIHGMDTDVLLKALNVLVKRNKAQIFGQDDSLGVKFF

SEQ ID NO: 163910 - protein, 117 aa, Triticum aestivum
  Clone ID: PAT_TA_58328.pep
MSAQNSAGIKQLLDAEQDASKIVQKAREYRTKRIREARDEAKQEIADYKAKKEEEYKKFEVEHSKGNEQAEAEANKDAETQIKSIQEAGKKGQAGVVKNLLSAVFDVNPVPPTNTKS

SEQ ID NO: 163911 - protein, 157 aa, Triticum aestivum
  Clone ID: PAT_TA_58329.pep
AGRSRDETSSSAESKTKTSTHASKATGDSHSTGTFVTATASATNGSSDSEDSTATGTGSSSKPTSGSGSGSSSESGSSGSGDASESGSSGSGSSGSSGSGSSGSSGSGSSSESVSKSEAGSSSETGAAAAETPSTVNGAAGLTFSAAALAFFAMLAL

SEQ ID NO: 163912 - protein, 166 aa, Triticum aestivum
  Clone ID: PAT_TA_58330.pep
MSSAPLKTLHLRAREASRNADAVARALEASPLVIAVNYPGLDSHPHRHIAKKQHRDALGGGMLSFRIQGGHAAAERFCQVTKIFTLAESLGGVESLVEVPSSMTHAGIPRDQREAVGIFDDLVRISCGVEDAQDLTNDVLQALEKATSAAKANGLNGNGVNGSNGH

SEQ ID NO: 163913 - protein, 87 aa, Triticum aestivum
  Clone ID: PAT_TA_58331.pep
CAALEPAGPGSSVAGVNARKRDKPLPPIIIDDPSDIVAMKRARNTLAARKSRERKAMKMDELEDKIAKLEEERDHWKRIALAQSGVQ

SEQ ID NO: 163914 - protein, 176 aa, Triticum aestivum
  Clone ID: PAT_TA_58332.pep
MAQEGIFSANLLSPEVKAALPEGYTLRALRKSDFNNGFLDCLRVLTTVGDITEADFVKQYDDMAAAGSYYIIIIEDTSRKENPVVGTGALITERKFIHSLGAVGHIEDIAVAKDQQGKKLGLRIIQALDYVAEQVGCYKSILDCSEANEGFYVKCGFRRAGLQMAHYYEGEKGSKI

SEQ ID NO: 163915 - protein, 54 aa, Triticum aestivum
  Clone ID: PAT_TA_58333.pep
GAFFFFFFQALCFIKSRTDGIITRRCFQKSPDTAKTLAVILFDAKPTRRPRAPH

SEQ ID NO: 163916 - protein, 36 aa, Triticum aestivum
  Clone ID: PAT_TA_58334.pep
YYKGYWMVASLRIVVNDFTYIILLTKYHKKKKKKGP

SEQ ID NO: 163917 - protein, 117 aa, Triticum aestivum; identical to SEQ ID NO: 123484
  Clone ID: PAT_TA_58335.pep

SEQ ID NO: 163918 - protein, 99 aa, Triticum aestivum
  Clone ID: PAT_TA_58336.pep
SGSVLGAFVGGAVVEVEHAALAVVGRAHAGAPVELLAGVVLAGDVPSLFAPDDVAGRLRVPEHHQRGEEEDEGERQLHGGGHACATVPARRAVSGTRPA

SEQ ID NO: 163919 - protein, 112 aa, Triticum aestivum
  Clone ID: PAT_TA_58337.pep
IIHSYIFITPSIVEIDEAITGTRAHTYTQGHQGQSIGGERASKPHAHAHAPLLDSIRSEGRSLFTYTLTPSHECMQLNSCRSCTCSCRRSCSPRRTGRRTPRTAPPVFGPGR

SEQ ID NO: 163920 - protein, 109 aa, Triticum aestivum
  Clone ID: PAT_TA_58338.pep
MAAGAGGDDLKLLGMWASPAVLRVRLALSIKGISSYEYQEEDLDNKSELLLRSNPVHKMVPVLIHAGKPVCESTVIIQYLDEAFAGDALLPAGPHERAVARRDGARNLT

SEQ ID NO: 163921 - protein, 128 aa, Triticum aestivum
  Clone ID: PAT_TA_58339.pep
MAGSHMSHDEFFAKLGELFDHRKGSDHGSIYLSQKRFTYGQDIPQPSEEEPSPDINPGKPLPLIIKATNGKGKRDRSKKVKLSTVVNPEDLEAFYVRYADVCKTGMTALKPRDRSKKKAKAKKKKAAA

SEQ ID NO: 163922 - protein, 90 aa, Triticum aestivum
  Clone ID: PAT_TA_58340.pep
MQRSSSFGTSWADQWDTGADPSPRARGGGNGGGDGKKGGVEKTKAAAATGLKKVKAGTAQGFQWIKDKYQKKSAGKSGKQGVVSEVAAGY

SEQ ID NO: 163923 - protein, 98 aa, Triticum aestivum
  Clone ID: PAT_TA_58341.pep
WSIQHRLVPDHLIVIIPSTIIFIVCHISRSSAGFNHPDVIPKVKSQLNALREIPEAPERQVRCVYLDLALIFLLLRLRRRTRFFLHLALILIEDVFRG

SEQ ID NO: 163924 - protein, 173 aa, Triticum aestivum
  Clone ID: PAT_TA_58342.pep
AGRSGWSAEKCDDSCGYARAKDVAYKGFSGSIKIFLFQFKMPFDGNTGFNGDMPALWALNGRIPRTGQYSECSCWKTGCGEVDIYEVLASGDDKCKSTFHMNNGAGSSDYFKRPVDKYIKVAVVFCERTSSVAIKQLPDTFNFGSSLSDETVQSWVKEMTSHKKGSSIFQIAA

SEQ ID NO: 163925 - protein, 84 aa, Triticum aestivum
  Clone ID: PAT_TA_58343.pep
MSYSTVARPPPSAISRPLSESLLNEKWDRCLSNLLVKSSLGLGFGVVFSVLLFKRRAWPAFVGVGFGAGRAYEECNFSLKQAAR

SEQ ID NO: 163926 - protein, 43 aa, Triticum aestivum
  Clone ID: PAT_TA_58344.pep
RALPSQVKDEQFQFTSMTTILRYLYHLRYPLDMQIELFLPITT

SEQ ID NO: 163927 - protein, 108 aa, Triticum aestivum
  Clone ID: PAT_TA_58345.pep
MGETESKSANGAVHATTTSDSSTVAAGQDDQPPIAEPPDLAIEKPILPHTLSAHRVAQDLKSDVDDGLSSEEAAARLARDGPNSIKGAKGISLYEIFIQQKKKKKRPL

SEQ ID NO: 163928 - protein, 86 aa, Triticum aestivum
  Clone ID: PAT_TA_58346.pep
PAGSGPPDHHTVAQTANVDNHPSTFAFAADKGPLKLPPTPAADPVPAYESMSDQEGLIINEWKDAEMAHGEQDHMSFLEKEFNGYF

SEQ ID NO: 163929 - protein, 163 aa, Triticum aestivum
  Clone ID: PAT_TA_58347.pep
PAGSGITHQNVWNTEQINLDTLEPQQLAQVKKQLDEELEHLTTSFAQLHAAQNKFKDCLRCVKSRSGAPEGANSVLVPLTNSLYVRGELSDADTVLVDIGTGFLIEKKLKSAEKFYESKVEELGTNLKDLEVIVQRKQTNARTIEEVLRQKIMASQGQDDQQA

SEQ ID NO: 163930 - protein, 62 aa, Triticum aestivum
  Clone ID: PAT_TA_58348.pep
PKLGPRTSGIRMIKDQVVYLPQPEQEQLEPQLQEEAPEQPQSPAIVKIPVRPAFYRSPDRPA

SEQ ID NO: 163931 - protein, 238 aa, Triticum aestivum
  unsure (1)..(238): unsure at all Xaa locations
  Clone ID: PAT_TA_58349.pep
MSDSKKEGAYGGAPSGDTDFRKTWDLEEYAAKGKEREAKEKEEGKARYEAKLAGKKYFKPLTGDETYTSARRHVIDFTQQIGKTQLVPGGAGVGKRGRGAGQYCEACDLTFKDNRQYIEHITTPQHLMNTGQTMNVKRATAEEVHERIEAYIRRQEDLEKEKQTSLHERLQLREEEAEKEAEERRKRRRDEMERKRLKQEEATKVKTEYGEDVRIEGEHDEDDMMASMGFXGFGTSKK

SEQ ID NO: 163932 - protein, 53 aa, Triticum aestivum
  Clone ID: PAT_TA_58350.pep
CIHWHPVPGARPLLHLLSSLYIFHIDSLLSATNWLPTINILVRTAKKKKKKGP

SEQ ID NO: 163933 - protein, 110 aa, Triticum aestivum
  Clone ID: PAT_TA_58351.pep
MLLFCPHCANILTVSLTSTRTNRLECRTCPFEHHITEPVFSRRLYERVEREDVFGGPGAWDNAQKGPAQCPADGCDGEEAAFFQVQIRSADEPMTSFFKCMSCGHRWREN

SEQ ID NO: 163934 - protein, 160 aa, Triticum aestivum
  Clone ID: PAT_TA_58352.pep
RPVRTRKPEHPTPEHPEKPEYPTPETPAQPEHPETPAQPEKPEYPAPEHPAKPEHPETPAQPEKPEYPAPEHPAQPEHPAQPEHPETPSKPEEPAKPHYPAPPAAETDSGYKAPAPSQPSATVPYHQPTGTAPAVEVTAGASRFGVEMAVAAAGIFAILL

SEQ ID NO: 163935 - protein, 32 aa, Triticum aestivum
  Clone ID: PAT_TA_58353.pep
FCHSRFGSKVICLLHIGAQISCCPLHHIKEYT

SEQ ID NO: 163936 - protein, 72 aa, Triticum aestivum
  Clone ID: PAT_TA_58354.pep
CAALEPAGSGIGWLAYGVNITETNKSPLLFSDTRMVDTPTLTLEWEVVLAVLPVQKRTLLITLLKQLLQKLF

SEQ ID NO: 163937 - protein, 62 aa, Triticum aestivum
  Clone ID: PAT_TA_58355.pep
GPFFFFFFFFFFFFFFGQDTEILLSIHGCRSSLPKLCSSIFWRSNNQTNDANESRINPNRPA

SEQ ID NO: 163938 - protein, 69 aa, Triticum aestivum
  Clone ID: PAT_TA_58356.pep
AGRAPGYPAFGVGSEILALTMEYGFDYLDAPAARVTGAEVPTPYAQKLEEMSFPTEKLIEDYAAKVLRL

SEQ ID NO: 163939 - protein, 103 aa, Triticum aestivum
  Clone ID: PAT_TA_58357.pep
MNKDSSFTFVHMHRSRDADLFEDFCKDRLPDDEIYVPPMHQPINPEDEDDVVPDQHAAFGIQRATQKSKEPAWKDLGLSELMNKGPSIGTGGKPKGAGSTFPR

SEQ ID NO: 163940 - protein, 110 aa, Triticum aestivum
  Clone ID: PAT_TA_58358.pep
GPFFFFFSFFFWTEQLSFVPSSYGSPKTMQTPPLRSQLKGMFSSPMQIQYLSYNRQSPRVPVNPHSEQRALPLPSLGISYDPRSRPQTPSSSGVYIAHRALYVLSPDRPA

SEQ ID NO: 163941 - protein, 80 aa, Triticum aestivum
  Clone ID: PAT_TA_58359.pep
AISFIIHSLLMTVLGHPPYSYFVMASPDLHPSPGHEPHPDIDSKRVLLIIKADEISLYLSGFFLGRPLSRSPSSLGNETE

SEQ ID NO: 163942 - protein, 179 aa, Triticum aestivum
  Clone ID: PAT_TA_58360.pep
MAAKNPKVFFDILIGQAKAGRVIMELYADKVPRTAANFRQLCTGEAGLGKSGKPLHYKGSAFHRIIPGFMCQGGDFTRGNGTGGESVYGEKFADENFLLRHTGPGVLSMANAGPGTNGSQFFICTAKTPWLDDKHVVFGQVVDGYGVVEKMEAVGSSGGATAEPVVIEDCGQLADGDQS

SEQ ID NO: 163943 - protein, 110 aa, Triticum aestivum
  Clone ID: PAT_TA_58361.pep
EGEKTHTCSAAAAMACAGAPMTKKELGKTHDGLGFDVNDSVRGDSRGDPVQATPREASSWEEKKNVGTEAIYGSVCHIRRDLDAPILSTYQRAPGALPSSMLGYEATTRP

SEQ ID NO: 163944 - protein, 92 aa, Triticum aestivum
  Clone ID: PAT_TA_58362.pep
PPAPSATLGMPSARGPAPLCAAVPDTPAPAGTPLENIRREDAPRTLREGSRPTRKRLIQIIDFYKRGNKVIGMNVRIVSLYVTLISWNPACG

SEQ ID NO: 163945 - protein, 75 aa, Triticum aestivum; identical to SEQ ID NO: 106874
  Clone ID: PAT_TA_58363.pep

SEQ ID NO: 163946 - protein, 101 aa, Triticum aestivum
  Clone ID: PAT_TA_58364.pep
SDAPSPQKPELGRQLLVKVQSACAKKRIREPLLKVLVSLCKNPNSVASGKGLVSLCKNPNSVASGKGLVSLCYSAFSLCTAAEELFCLSKKRSPAGSSAAQ

SEQ ID NO: 163947 - protein, 103 aa, Triticum aestivum
  Clone ID: PAT_TA_58365.pep
PVRRSRRPGLQKGKSSVLMDIKPWDDETDMKKLEEAVRSVQMEGLTWGASKLMPVGYGIKKLQIMLTIIDDLVSVDTLIEEVLCETPINEYVQSCDIVAFNKI

SEQ ID NO: 163948 - protein, 140 aa, Triticum aestivum
  Clone ID: PAT_TA_58366.pep
MATEVLRPHNILQPQTQRIRAAHRRPSNPGTTRRSPPPPATAVSTTGRRHHGRPSSSSSSYGKVTSAAAPARRPAVEVYAGPAFSAASPEPSSLPLPQFPRAARPLARFYCGRRYGARRPWAPTTAVWNEHSQRCDHGPA

SEQ ID NO: 163949 - protein, 248 aa, Triticum aestivum
  unsure (1)..(248): unsure at all Xaa locations
  Clone ID: PAT_TA_58367.pep
MSPRTSLWGACRTLAIRSRPVAPRPAPFVNALPRNRWYSNDGNDQLPKAIDNAQKPQDSQVGSVSAKSDAPEASTGNRDAEVTSAPASSDEIIDDATLEQIFYGGRTQSSTIEGGLTPAQEDILYREGTIPSAEKAEALVAQAEQAELDSPDSTEMQNPGHKFGLPKRPWPEGFNLKKRYHPVLEQITRLLMKDGKLSVAQRNMAIVMNYLRTAPPPIYSPLYPLLPXTPPXTHLPLNPILYITVAVD

SEQ ID NO: 163950 - protein, 70 aa, Triticum aestivum
  Clone ID: PAT_TA_58368.pep
RGLFFFFFWQQPQHFPFMQSASIIQKDCRIIDSLQEPHSEMLHPGSSSNHITEMNVRSVTLQPLLQPASV

SEQ ID NO: 163951 - protein, 55 aa, Triticum aestivum
  Clone ID: PAT_TA_58369.pep
GPFFFFFSFFFFFFTTQRNSYRELRKLRYMLRWNSTLKLQNYVQSTDPGRPSKRP

SEQ ID NO: 163952 - protein, 51 aa, Triticum aestivum
  Clone ID: PAT_TA_58370.pep
RPGPVLPEESWTWRRRWASPSAGRTTCICMPKSLCRLISACFICRMLDAID

SEQ ID NO: 163953 - protein, 50 aa, Triticum aestivum; identical to SEQ ID NO: 132678
  Clone ID: PAT_TA_58371.pep

SEQ ID NO: 163954 - protein, 116 aa, Triticum aestivum
  Clone ID: PAT_TA_58372.pep
LCGARGGRSLYAPSFTTYGATQFCRDGVALVSIVERYIPNGSSILDSLTEGIQLLSLPVEAGEAGGLTLKEASDRVFTDNEEARKVLEELHLEELSPQSARNILQRRVENNENVGW

SEQ ID NO: 163955 - protein, 144 aa, Triticum aestivum
  Clone ID: PAT_TA_58373.pep
MASYTHSRSAVRAQRRDSSSSSSSHTMSNRSRPRLLRSSATEPSITVSNATGNSFAGPESPHRATDLLNRVAVYSPSPEQASTPAAIPRHNRPMSICRDHHEHSPSSSPGSQSAVMSDSPSGYYFSFPSFEEWNQDDITKDNDD

SEQ ID NO: 163956 - protein, 78 aa, Triticum aestivum
  Clone ID: PAT_TA_58374.pep
FYSNKRSTFAAEYLMEHNMWRTSGVLTHACTRTTNQIPNRKLPIYCRFSIAFLPREFCRNLIYTVYLPATSRTRPAPY

SEQ ID NO: 163957 - protein, 115 aa, Triticum aestivum
  unsure (1)..(115): unsure at all Xaa locations
  Clone ID: PAT_TA_58375.pep
RSSHRRADGRGRRRRPLQWRTAAKRKAAPEATSAAARDGAAAPAADTGLGAGASXAATTEKAATDRTARTATALDATVEAAIASVGRWXICGGGGEGLSRIGMEKISVALVDSRP

SEQ ID NO: 163958 - protein, 63 aa, Triticum aestivum
  Clone ID: PAT_TA_58376.pep
CRTTVHNKEKNGRGNQRKHEHELWQMFKSIELQQQSTKAATDKLPADTTPNKQASKHIHRDVC

SEQ ID NO: 163959 - protein, 172 aa, Triticum aestivum
  unsure (1)..(172): unsure at all Xaa locations
  Clone ID: PAT_TA_58377.pep
MARKGGERKKAVTRSTKAGLQFPVGRIGRFLKKGRYAQRVGSGAPVYLAAVLEYLAAEVLELAGNAAKDNKKTRIVPRHLLLAIRNDQELGKLLAGVTIAHGGVLPNINPVLLPKKALEKAEKESQSPKSPKRKXPAPAPAAKKTPKKKAADKKTAAADKKTAAADKKKAAA

SEQ ID NO: 163960 - protein, 66 aa, Triticum aestivum
  Clone ID: PAT_TA_58378.pep
EVSEVQRCAHVAVCSGLALDSLLVMSCCDGFQTCATSNSFRLICVTSWCYIIIMLVEAVMIICVLT

SEQ ID NO: 163961 - protein, 59 aa, Triticum aestivum
  Clone ID: PAT_TA_58379.pep
KLAHQQVVCVYTRCGQDGLVLACRGLGVPSEGEKKVTFAVLHLKCGLFRVLEREKNQSL

SEQ ID NO: 163962 - protein, 133 aa, Triticum aestivum
  Clone ID: PAT_TA_58380.pep
RERDPVVPAVSTRHVSSPHPLSRAPRCCLTDPAPSQPPATCSNPRIDGVSQTAAQSCSGGLELQLWHMVQDASLLFPCGSTELTMLNQLWLPDHSRSYEGRPLPLWRWFQLRYKGFHFFLKILPVLPDLHVLM

SEQ ID NO: 163963 - protein, 209 aa, Triticum aestivum
  Clone ID: PAT_TA_58381.pep
MYQTLSRGQSMDRRRQHHAGEFVTDVVLWRRGRAELSALLLAAAVASWILFHGASGYTAVSLAADVLLLLLAVLYAWSRAARLLGRPAPPIPDLQPAADELAALIHSCLADLASAFRRVAQGQPGSGQVFLCLAAAALLGRLARDLPTLCYAVVVGALTIPAVYERLSMERYMRMASLNMYRYEVLYQSLSLTCYLSTRDYLIELLKEA

SEQ ID NO: 163964 - protein, 112 aa, Triticum aestivum
  Clone ID: PAT_TA_58382.pep
PAGLLSYAMGRMESVWGEDARAYRPERWLDPDPAEATFRPESPFRYIVFHAGPRICLGKEMAYIQMKSIVASVVEEFEVAVDGGYTPRQVASLTLRMADGLPVRVKDFRGGN

SEQ ID NO: 163965 - protein, 68 aa, Triticum aestivum
  Clone ID: PAT_TA_58383.pep
KTGSRTREGLGLCYGCTMVNWLGRSCLISVPELKGYWEGLCCFNVMYPNGGKSMLLCMSNYKDLDLFS

SEQ ID NO: 163966 - protein, 100 aa, Triticum aestivum
  Clone ID: PAT_TA_58384.pep
WLLFPTGTTLHPFLVLFFELLGNFPVLALWVKKRTGFTKILPGFLPNYYPFHFPFPFRLPHLWEGPFGRAFFVIPPPAERGRSSKRINWGTPRFFPSRPW

SEQ ID NO: 163967 - protein, 40 aa, Triticum aestivum
  Clone ID: PAT_TA_58385.pep
RYYSLVGHLPQKRVEARPVSCCILRLFPVLSFTPSASERA

SEQ ID NO: 163968 - protein, 138 aa, Triticum aestivum
  Clone ID: PAT_TA_58386.pep
PIAGKNRIMIQISEILPWHYQFAFMIFEPSVIFATLPLIPASPIDHFHSLAPADSAGPFWSPSPLHGLCDAASAWNTPQLRGLWYAFMSALAFSGVIEPLLLYVARYKLRDVHDAEQVIKGRFCSLLWHLMLFMHLRH

SEQ ID NO: 163969 - protein, 55 aa, Triticum aestivum
  Clone ID: PAT_TA_58387.pep
GPFFFFFFLFFFFFFFFFFFFFFFFFFFFFIRKSIHGVYMSALDMIGSERSIEIA

SEQ ID NO: 163970 - protein, 133 aa, Triticum aestivum
  Clone ID: PAT_TA_58388.pep
PAGLFIITLTFSSIYYYNKHQLQLTYHNSQTSPCLTTSPLSTTVSARMASPTAASALASSLTARLTPMKLVSRAERPLAAAAVEVSRAPATTAAITSPLSTMAFARMESPMAVSRATTRYTCLDEAFNEALYA

SEQ ID NO: 163971 - protein, 129 aa, Triticum aestivum
  Clone ID: PAT_TA_58389.pep
TPATMTSTKPTCSLCDLSFDNSQEHRVHAKSESHVAALRQRAVASGLIDETVDDDHTYSSHTQVTGASHGQPSGSDTETADEVSDEALPEFEPAKCIICTQNNESFDDNVQHMKTAHSLRIPYENHPKC

SEQ ID NO: 163972 - protein, 41 aa, Triticum aestivum
  Clone ID: PAT_TA_58390.pep
LAALEAAGPRPIPFSYNLREDSDNDKILPSASSDTLGTSTF

SEQ ID NO: 163973 - protein, 135 aa, Triticum aestivum
  unsure (1)..(135): unsure at all Xaa locations
  Clone ID: PAT_TA_58391.pep
VRRSSRPGLHCCAELSPFPACPPLPSRPAPPRPDPVIRPRTNXMASARRLLQTYPGQFQAAEPPDALGADSDVVVILAALLCALLCVVGLAAVTGCARSRRGAGATRSAASDASKGLKKRALMALPKLAYEDPVP

SEQ ID NO: 163974 - protein, 199 aa, Triticum aestivum
  Clone ID: PAT_TA_58392.pep
RATLIDFFSPSVSANFVEDASMLRVRRGLGSPASFASIYRPYVRYPRQCTLVRSFATDPNLDNASEPPTDSKSHTENIPNPLDSTPDILQELTSRAHLKEAQEVKEQEEAVNHGSVSNDANFNEALNVIRRVYGVDHKEKKKTTTSQPQAGESNDAQETIREDDMVETDSLAGTQQTAVWTSLREKLQQKISPTSSYTF

SEQ ID NO: 163975 - protein, 117 aa, Triticum aestivum
  Clone ID: PAT_TA_58393.pep
RIGSEHRSLLPQVDFLACVGGRRRQIPQRGDASDFRSTFLAFATPPTTLGTYQRQAPLPRAPSRQRLSDSCRGAPRPQLLSCLSSSTSSSGPWSYRVRVTEAATIPRGTKLELQKDQ

SEQ ID NO: 163976 - protein, 191 aa, Triticum aestivum
  Clone ID: PAT_TA_58394.pep
PGLQVVGIDLSPTQPSFVPPNLTFYIDDIEDQWTFSYKFDMIYARMMTGSIRDWPKFIQQSYDNLESGGWLELSDIILQLHSDDDTIPEGCAAAKWGDLMLEAADKFGAPLDSCLRYKQQLLDAGFVDIVETIYKWPTNPWPRDPKFKEMGLWNYENLGNGASGLSLALFTRALGWTAEQGEISVHQPSYT

SEQ ID NO: 163977 - protein, 119 aa, Triticum aestivum
  Clone ID: PAT_TA_58395.pep
ALQALELELEPLETSGDRAIGGGGLSGSRLPSRATACICMRMNHQSSSLTEIRTAYESKDHNAAYTGRRRRRGTLHDPFSFVSQLLVRGLFVLYGERKFSTTAAYVHACLCVSSRRPGR

SEQ ID NO: 163978 - protein, 157 aa, Triticum aestivum
  Clone ID: PAT_TA_58396.pep
AGRACTFASASDPDFVPFHWKTRWFILDGWLNVVYFADVAWIAYLWRPTSNNRRFAMSDEIAQDDDGNFDLGDIGVPGEDSDDEEAEVAKPQNNSQNANGLSFSSASRSAPQQPRNTRTGPRKSLENETIFAVGEDGDKFSDDDDSDEEDAKLVKAK

SEQ ID NO: 163979 - protein, 209 aa, Triticum aestivum
  Clone ID: PAT_TA_58397.pep
AGRVVLSQRKDDDGRYPIHWASSNNLEIVQLLANQRSFDADVQDGSGWSPLMISASVPESEAVLKLIISKDADVNLKNFTGQTALHFVASKKNLDIARILIDSGASTRVRDRRGQYPIHRAAAVGSVPMVNILLKNRSPLNPTDNEGYTPLHHAIAEGHGDTAVALLKEGADFTLKNSAEELAMDLAPDKEVRRYILQGAEREGIEMSG

SEQ ID NO: 163980 - protein, 157 aa, Triticum aestivum
  Clone ID: PAT_TA_58398.pep
TNRSAKAQHSSVPLHWVPFNTLPASPAITYNIYVFLFTHRQYVSLKKVQYKMAPTNDANNRATKAAGSDSGDADLAQAYRDLARGEQAATNLENNLTNLESRLDAILAALEANENIQVPAATKVSQANYSSQSTRATGNQDKLQDGINENVDKKDTA

SEQ ID NO: 163981 - protein, 250 aa, Triticum aestivum
  Clone ID: PAT_TA_58399.pep
AGRALDHFQLKNCFPFFSYPLYFKVGNNSLTMASRISTGQLCRSISQASSHRLALPHIAAQRRYLATTVHPVTQDATGSKGPTAMVFLNMGGPSTTDEVGSFLSRLFADGDLIPLGPLQNYLGPLISKRRTPKIIKQYSAIGGGSPIRKWSECQNAEMCKILDKISPETAPHKPYVAFRYADPLTEEMYEQLLKDGFGNGKGGRAVAFTQYPQYSCSTTGSSLNELWKWRHRLEGRPTRSLVTDYYMECN

SEQ ID NO: 163982 - protein, 148 aa, Triticum aestivum
  unsure (1)..(148): unsure at all Xaa locations
  Clone ID: PAT_TA_58400.pep
LPSLATTHSQGGXLAAAATAGAAPAASAATAAAGARCSPTWRPPPARPPWTCPPPPTRGAPAGSRWPAGRPAAATAPPASAAPRAAAPAAAATDPAHRRPAGRGEHQDEXRRNKQSSSPPPPPNRINTTKPPHAPPPALNKIKPPCVP

SEQ ID NO: 163983 - protein, 84 aa, Triticum aestivum
  Clone ID: PAT_TA_58401.pep
MALELCRRMTASALLLLFLLVATEMGTTTVKVAEARDCLSQSHNFKGACLSSSNCTAVCRTENFPDGECHAPHYQRKCFCKRPC

SEQ ID NO: 163984 - protein, 54 aa, Triticum aestivum
  Clone ID: PAT_TA_58402.pep
MTFKRRNGGRNKHGRGHVKYIRCSNCAKCCPKDKAIKRFLVRNILEKAAVRLSF

SEQ ID NO: 163985 - protein, 62 aa, Triticum aestivum
  Clone ID: PAT_TA_58403.pep
CDTHSGEGDPGPPLGVRGVDNVNMEFLHRGGSCSSQGRGALGPPPLCVMVLPVRVKTMWQFQ

SEQ ID NO: 163986 - protein, 117 aa, Triticum aestivum
  unsure (1)..(117): unsure at all Xaa locations
  Clone ID: PAT_TA_58404.pep
YTDQTFGSSIKTSNALNTVNAKPMLSAARSSKMTYVCGSDSLRMPSSRKGRNYFVIESSEGAAVFSFTESTMSDSSRRPMCLGLERLKNSWISGENSPSSGIAATVSLGPPLLXRPA

SEQ ID NO: 163987 - protein, 68 aa, Triticum aestivum
  unsure (1)..(68): unsure at all Xaa locations
  Clone ID: PAT_TA_58405.pep
LLFFCVVGAPPFCWLCSGSPCSVRXLVGVSLPRLLXXLGLLLVLVCLVSCCCGCRPPPSXXLXXFFAA

SEQ ID NO: 163988 - protein, 102 aa, Triticum aestivum
  Clone ID: PAT_TA_58406.pep
LHNTISLGPTSCDAPMTTIFYAESPDTQPQLDLLPICFNCFYFLLFPKTTQAPCIPRSFNARYNRIISRCHATTPTLLQHRLIHAPGSAASYLTLINTRHQK

SEQ ID NO: 163989 - protein, 59 aa, Triticum aestivum
  unsure (1)..(59): unsure at all Xaa locations
  Clone ID: PAT_TA_58407.pep
GSATTSGHDAFFPPPATFPWSSSSHARHKYVPTGLICSTDERPATXLRQIQRQVKERPA

SEQ ID NO: 163990 - protein, 128 aa, Triticum aestivum
  Clone ID: PAT_TA_58408.pep
STGTTHPTSHVQNINQVSNHRWGHSNTSPKDKKSPSNRSQKGVVVADDQVLRPRSGDTVMYVVYGVLDQRRFVSGLHSSVIYAESLSTQRQCAPLCSPKPWSTCSSAQVIPLLIVTAIRSLPLLIPAG

SEQ ID NO: 163991 - protein, 93 aa, Triticum aestivum
  Clone ID: PAT_TA_58409.pep
QQEITRLQMDRRSFYSSLPFLTIERSSMQDKYNSVLDHASVLVCAQLNRVCLVWSLPAKKFDEQVVELEGNARAFLLCTVKIVDLIVLNSNAC

SEQ ID NO: 163992 - protein, 145 aa, Triticum aestivum
  Clone ID: PAT_TA_58410.pep
TTIIFILPGRGRNFLLHQEKRCHDPNRIHGSLHPHLLLVLVGPSANSAIYRWSSPRIAARSRIYHYPLARTSDLFFSVEAFIKADILSCLIFFIFTHHQGGSHTWMEFYFYCIIRTWDTGYSTGSCISPPNTGMNQLVHTWEREH

SEQ ID NO: 163993 - protein, 84 aa, Triticum aestivum
  unsure (1)..(84): unsure at all Xaa locations
  Clone ID: PAT_TA_58411.pep
RWTQVRPVADTVPTPFPTAAPSPPPPPPPPPFFVPFPPPPAGGRXRRKPPPPPPPKPPPPPPPPPPPPPPPXPPPPPPPPPPPP

SEQ ID NO: 163994 - protein, 95 aa, Triticum aestivum
  Clone ID: PAT_TA_58412.pep
SFFGQFPPPSAVKKKKGGSFWGPDLGLSAPSPPKTLIGGRVPLGALPPISRFSPLGGGSPRSLLVAFGSNRDHHSPLPRPILWINKGFSGFGLMG

SEQ ID NO: 163995 - protein, 63 aa, Triticum aestivum; identical to SEQ ID NO: 133779
  Clone ID: PAT_TA_58413.pep

SEQ ID NO: 163996 - protein, 104 aa, Triticum aestivum
  Clone ID: PAT_TA_58414.pep
IKLALVQKKKKKKKKKKKKKKKKPKGPQNDLQLMQAPRLHDFFIYPYRRRRPPGLAPLPPSPYIEIKDPRGPGASIFHVFPTPPPRGADQTPHSPPWAPIPRPP

SEQ ID NO: 163997 - protein, 74 aa, Triticum aestivum
  unsure (1)..(74): unsure at all Xaa locations
  Clone ID: PAT_TA_58415.pep
AGRLPMQRGVNXNSPKNTRKIQNISKKKCGERCAHLNIRRVLSKKDKYEVCEKVYFCTIWSCFFFLLRATRMSE

SEQ ID NO: 163998 - protein, 136 aa, Triticum aestivum
  Clone ID: PAT_TA_58416.pep
EISLHPLTVSLSLLEPAFFLAGTMFLFCWNLVMLASSLQREHASARHGRRSARSTPLAGEGNHHQKMLQPRRGGATSVGPEAATSQTNNGTGNGRAATATAAVDHCWNQLLFLLEPPLSFAGTAFFVATSTSVVCC

SEQ ID NO: 163999 - protein, 162 aa, Triticum aestivum
  unsure (1)..(162): unsure at all Xaa locations
  Clone ID: PAT_TA_58417.pep
MSDSPQSPPKEVDQGAPSPDDEAQMNEQQDPQSANAAGYEFEGVKEQDRWLPIANVARIMKNALPDNAKIAKEAKECMQECVSEFISFITSEASEKCQQEKRKTVNGEDILFAMTSXLXFENYAEALKVYLSKYREQQNQXHRERVNMDNGQWGSGTMMGDA

SEQ ID NO: 164000 - protein, 168 aa, Triticum aestivum
  unsure (1)..(168): unsure at all Xaa locations
  Clone ID: PAT_TA_58418.pep
PAXVRQTNFRFLLFRPIKNRNMTSLAQSSKQSGFPPSAPLSPSLVTATKILSIVRIATGGACLFAPQLTCSLHGYYVPAPYALLVRMMGAREAINGALLFTASDGKESDGGNRFIMRALWVGILADSMDICSVLYGFAMGEVGTSTAGILGTAAAGAITIAALMLRVL

SEQ ID NO: 164001 - protein, 77 aa, Triticum aestivum
  Clone ID: PAT_TA_58419.pep
RPGLEEGAFVKGPDGENIALGIPAKQKQAAGDAAFADIPLRRAGTPTEAASAILAVASPLFSYVSGQTIMVTGGRNM

SEQ ID NO: 164002 - protein, 182 aa, Triticum aestivum
  Clone ID: PAT_TA_58420.pep
MVGSILRQFFSPAIRRPLATAISTPPSRLLQPSLRTFTTTTPRAFAPTTARPATLNQVLRGIRKGKRARHAVSPALSNTHCPALKGVCLRVGVVRPKKPNSGERKTARVKLSTGAVVTAYIPGEGHNIQQHSVVLVRGGRAQDCPGVRYHLVRGALDLGGVASRTTSRSKYGTKKPQKATGG

SEQ ID NO: 164003 - protein, 121 aa, Triticum aestivum
  Clone ID: PAT_TA_58421.pep
KKAAAYNFVASQIQYSRGSRRRLGFGAHLLLHEAKESSPAARSTTTSSLLLSSGAGGLLVLAALCAVERRFGLVHAPELLLVGIPEHVGLHEVSSHHGRHGLSAPPFLLLNYSCCCRCFLA

SEQ ID NO: 164004 - protein, 75 aa, Triticum aestivum
  Clone ID: PAT_TA_58422.pep
LHLIYSTRLDKGSRIAEAMRLQCKKGSLVGLSMSTRGVNGVDCWVSVESWVELSQRHESKTQRSIFLSRPTNVIT

SEQ ID NO: 164005 - protein, 61 aa, Triticum aestivum
  Clone ID: PAT_TA_58423.pep
YRINFFKHCSINVLKYVLPSHRHKDMTVSNNLTIKMKHRTTTKQILLCSDCMLLCLAEPGR

SEQ ID NO: 164006 - protein, 178 aa, Triticum aestivum
  Clone ID: PAT_TA_58424.pep
MATSANTLFRAARPLFRQVTITQPARQAFHQQTFRQNFYQGSGRRWQSTDGAQQQQQQGWFKRMYESEVGFKTVHFWAPVMKWALVLAGISDFARPAEKLSFTQNLALTCTGIIWTRWCLIIKPKNYLLAAVNFFLGLVGVVQVSRILSYESEKKKGLHGVVEDIKADAKETIQEVKP

SEQ ID NO: 164007 - protein, 122 aa, Triticum aestivum
  Clone ID: PAT_TA_58425.pep
MDAPAACEIERLPEDLLVHVISLTSPAGAIHATAVSRAFHAADSDTVWSRLLARDLPQFAKRELPRKPPSTKKGMFRRLSDEPALLPGKYVRMQLDKATGAKCYTFSASALQITRLMMHTRP

SEQ ID NO: 164008 - protein, 181 aa, Triticum aestivum
  Clone ID: PAT_TA_58426.pep
PAMDLVNSLEGRLLFAVPKKGRLNAATLNLLEGADVQFRRENRLDIALVKNLPIALIFLPAADIPTFVGEGRCDLGITGWDQVQEHDASVRAYNQLRRSSVDLTSTEDKVAGSDMVMELGFGSCKLQVQVPEKGQYKTPQDLVGKTIGTSFVHLAADYFLKLEQGENADGELSPRKMRTKI

SEQ ID NO: 164009 - protein, 184 aa, Triticum aestivum
  Clone ID: PAT_TA_58427.pep
RPGTKEEPRISAIPIPDGAFGLIRYHLTTQREALAVRSKEVLPDADQPSVAARVEALTWERLMGNKEILGRWQEALAVMAQPSYVPESLKELAKLSDEIWFLAGDKAVDPSWYTKRATLSMIYSTSELFMTNDRSPDFVETRQFLQRRLGEVKSVGGMVGSFGQWAGYTLSAGVNILRSKGVRI

SEQ ID NO: 164010 - protein, 96 aa, Triticum aestivum
  Clone ID: PAT_TA_58428.pep
TNDYKDMGGDMQWGEFGDVAELAKGYCLDGTVKPLFAMESYTGEAMSLFELSGKHYLYNAIEGSLYQVNQPNDLQSIVSTIDDPEKCLSELEIEAL

SEQ ID NO: 164011 - protein, 57 aa, Triticum aestivum
  Clone ID: PAT_TA_58429.pep
TRLKQELEYYVTSKHTLFSPDREKKNRNLASTPSQTTITRQWIITGKKNKQFRTRPA

SEQ ID NO: 164012 - protein, 111 aa, Triticum aestivum
  Clone ID: PAT_TA_58430.pep
RPFPGVCCCVRHRPNSKSRPTTKYRSVTMIITRALSITNFVVASSALSFQVGVLYPWHKQLDDDFEALKREHLRVLTAVEGKVGRTQEPALLQENRPGILSMIGNLAPWKA

SEQ ID NO: 164013 - protein, 88 aa, Triticum aestivum
  Clone ID: PAT_TA_58431.pep
PITDYLLLPSQQSERVLGELKQALTIPLGLLDTNLFLLCCVDNLDIRSTNTVNLDLLSTQTLELGLEILVLVNIHHSKVNSTIGTRPA

SEQ ID NO: 164014 - protein, 82 aa, Triticum aestivum
  Clone ID: PAT_TA_58432.pep
AGRVPLFSRFIIDSALRHGHILLGASGVHLSISHYLFLIMEQGVGRSQLGIKVADQYGMRSSMQHERPNILLLGGLSYPIIQ

SEQ ID NO: 164015 - protein, 194 aa, Triticum aestivum
  Clone ID: PAT_TA_58433.pep
MAPQLDGFFKQVDSSADHFIERLRKAVAIPSISAEDARRPDVVRMGEWLGDELKALGASVELRPLGKQPHKEHLDLPPVVLARYGNDKNKRTILVYGHYDVQPAEKSDGWATEPFDLTVDDKGRMFGRGSTDDKGPVLGWLNAIEAHQKAGVDFPVNLLMCFEGMEEYGSEGLDDLIKEEAKKYFADAEAVCIS

SEQ ID NO: 164016 - protein, 80 aa, Triticum aestivum
  Clone ID: PAT_TA_58434.pep
PAGTEKLSGFNNFLSSYEETVYLAMERLKVHFETNIKNGLDSNSSEEVLVMPSGQIGVKTDIVFRYEQNLEDGQGHGRRI

SEQ ID NO: 164017 - protein, 172 aa, Triticum aestivum
  unsure (1)..(172): unsure at all Xaa locations
  Clone ID: PAT_TA_58435.pep
PLPPRAPRPAGAQRGRSRPPGSERGPAPAHFPQTHTHKGERPNTNTARAGEKXPAPPNPRASPXGQRRXXXXAEKGPPNEXAEENXTAGKSDRHPRPNPTHKKTPARRHDGRPXNEPPSTPNHRDDAAPDTPXPRPADPDERPPARPGADHADKKANDRATRHRKPKGEPHA

SEQ ID NO: 164018 - protein, 99 aa, Triticum aestivum
  Clone ID: PAT_TA_58436.pep
RHHTTDNYRENPRRKKFTNKPFRVPATTKSTLAQTNHRRRRSIRRRRRRRATIHPGSKRECHSSVSQGKQTALQASEQAPSKTTARKHCGSRPVSKRPA

SEQ ID NO: 164019 - protein, 58 aa, Triticum aestivum
  Clone ID: PAT_TA_58437.pep
IMGARGKVAQTDNANNQSTSEANQEPRDIASKLRSTCRARAEQSKRIKHQLCQAYEIA

SEQ ID NO: 164020 - protein, 77 aa, Triticum aestivum
  Clone ID: PAT_TA_58438.pep
EDDATRHGRKGPDSVAALLKILSTLYKGEEEEFLCVNPQGGFSMHNPPSWVSGRIYLLIRLVFPLSNTQSDDFNAGP

SEQ ID NO: 164021 - protein, 88 aa, Triticum aestivum
  Clone ID: PAT_TA_58439.pep
MKTKEGMPSGGIPKIRILAILECLGVPWSSPSLGFCHSLFHSPSNLYPKLENFTTQNSTGNLISSVSERKKNHHIRYCNELIIYLYLC

SEQ ID NO: 164022 - protein, 71 aa, Triticum aestivum
  Clone ID: PAT_TA_58440.pep
VFPSVFENQGINPVGGYARVPRTCTKQITLVLPISSILIKQDVGFYLHREGPNLDKTSCPLPPITIQPRRT

SEQ ID NO: 164023 - protein, 70 aa, Triticum aestivum
  Clone ID: PAT_TA_58441.pep
RPLSMRNLRFFAFKNIMPMIIYVSIACSSTMRNDMPGISILKEQRNTRKKKIRLKKKENSTPTSRSCTKS

SEQ ID NO: 164024 - protein, 111 aa, Triticum aestivum
  Clone ID: PAT_TA_58442.pep
INKIIRSPCTIITIVCEKESVQIANLGHCIPSSIPMCIRKKYQKQNILTLDPIHFTAVQFNEQKDTATLGNSTYVGQAIHLSRHYQHWLDDRYCFVAPKYWSSQSRSRVSW

SEQ ID NO: 164025 - protein, 120 aa, Triticum aestivum
  Clone ID: PAT_TA_58443.pep
RPASKKGKKREDRSFIALYPTGDSIHLSTSNQNPPLRVSALHSSILSHSIHCQVTMCTKTSIEHRCGHVVLRGNTRCYREDCPGRKEDVTKVDDDCAQCENKPSRFRSSRWCSVGCCVCQ

SEQ ID NO: 164026 - protein, 127 aa, Triticum aestivum
  Clone ID: PAT_TA_58444.pep
IMFSLLIIFPKRNSILSFFASLCAGSQRIRTLYQVLQQFSSCNDKVLTDHVASGDRHHHLHAKLSRVDEKNTIYCMEYSHTSFGLRLRYYDALGCESLASLLSTTWTFQAAFEILFNVSKKKKKKAP

SEQ ID NO: 164027 - protein, 57 aa, Triticum aestivum
  Clone ID: PAT_TA_58445.pep
QYQTSPPLPPPRGARSECATENGTHYYCSLIRVILWLDLVIPVANKPKPLESLIPFT

SEQ ID NO: 164028 - protein, 57 aa, Triticum aestivum
  Clone ID: PAT_TA_58446.pep
FAMIRKPPYLVHDLVAKPTSNKKTQVTQAEYPFLIPIPLLSQITLNSCEAGSACCSP

SEQ ID NO: 164029 - protein, 137 aa, Triticum aestivum
  unsure (1)..(137): unsure at all Xaa locations
  Clone ID: PAT_TA_58447.pep
MASSYEIFIAFKANVGQCALADPIISRSKNRGFKIAGITLMTPGKEHLXKHYADLAGKAFFAVLIENMNSGPICAMYCHVRRFVNTDRSILEATNPLASSPVIILGDYAIDDSRNVXHGSHSIENAQKDIVLWFKEG

SEQ ID NO: 164030 - protein, 75 aa, Triticum aestivum
  Clone ID: PAT_TA_58448.pep
RPVSGLSKGRYRTCRLSWGLCSGMLCLGRTAAYMRGRHHDWGVYMYLDRYDHDHRHRRFLSYSAFVFFTSYYNFD

SEQ ID NO: 164031 - protein, 91 aa, Triticum aestivum
  unsure (1)..(91): unsure at all Xaa locations
  Clone ID: PAT_TA_58449.pep
PAGSGKKNYQSCHVGADGSVFNKYPHFKERGAKALRDILDWREDQQEGXDPIEVLTAEDGSGVGAALIAALTLKRINEGNMAGILHPENFK

SEQ ID NO: 164032 - protein, 50 aa, Triticum aestivum
  Clone ID: PAT_TA_58450.pep
GPFFFFFFVHQEYCHSKAMNPYAKEDHITVRSSEELKSFLSVPLIQDKGF

SEQ ID NO: 164033 - protein, 139 aa, Triticum aestivum
  Clone ID: PAT_TA_58451.pep
MASTNYKEAFALFDKRGNGRVTVDSLGDLLRACGQNPTLSEIQDLEKNVGGEFDFETFQRVLNRPGGFRDPGEPEEYCRGFQVFDKDMTGFIGVGQLKYILTNLGEKMTDEEVDELLKAVDTSSGQVNYTDLVRTILAN

SEQ ID NO: 164034 - protein, 109 aa, Triticum aestivum
  Clone ID: PAT_TA_58452.pep
RPVPTADKVDAIMDELREQNAMSDEIVNAITQTPMGDAIDDDELENELDELQQEQLDEQMLKTGTVPVSDAVHKLPTPASAEPVSSKKQAVEEDDEEAELRKLQAEMAM

SEQ ID NO: 164035 - protein, 97 aa, Triticum aestivum
  Clone ID: PAT_TA_58453.pep
QSIHILSNNHRHRFPIPSYPDTHLTCALGQAEQRDVGVLSTSSEKGTSTADTFRFARLESLGVRVVKTAVVASGFRSRNSDGGNSQDADNRELHFDN

SEQ ID NO: 164036 - protein, 107 aa, Triticum aestivum
  unsure (1)..(107): unsure at all Xaa locations
  Clone ID: PAT_TA_58454.pep
GPFFFFFFFFFFFFFFFFFFFFFFFFFFFFFFFXXLEYRLIDAYLPIINTLNHPQFCPRHNGRNRRYTTSCNQWEMSSPALVRSTQAHKTQGKKVNGFTVCTVSDIN

SEQ ID NO: 164037 - protein, 255 aa, Triticum aestivum
  Clone ID: PAT_TA_58455.pep
RLCTCLPLPSIKSPFSIPISISKSVTMSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWG

SEQ ID NO: 164038 - protein, 188 aa, Triticum aestivum
  Clone ID: PAT_TA_58456.pep
MGPLSKMAGMIPGMSNMMQGMDDEEGGAKLKRMIYICDSMTDKELDSDGKILIDQPTRMTRIARGSGTSVREVEDLLTQQRMMAGMAKKMGGNMKNMQRAQQAMGGGNKAQQLAAMQKRLQSMGGAGGAGGMPDMGSLMKMLGGGGGGGMPGMPGGMDMQAMMRQMGMGGGGGMPGMPGMPGGGRGKR

SEQ ID NO: 164039 - protein, 138 aa, Triticum aestivum
  Clone ID: PAT_TA_58457.pep
MASLVQRRMLSKADEEAADEVEVRREDQDKINRFSRLHQRELVLGDELSAKNKEKEELDDLSTELELADEDEKIQYKIGDAFFHVSVEQAQEMLEKATETLEEESTSLEDKLSSIREEMTKLKVDLYARFGKQINLET

SEQ ID NO: 164040 - protein, 131 aa, Triticum aestivum
  Clone ID: PAT_TA_58458.pep
RPVREKPIKTSYKLINIFYFTMKFSIATLAAVIAASAPTVMADSWQCNGSWNDGGLKRLSFLFDGYCENQSGQCFLSALRGKGLTVHNWQAWDRGDGWWQVDFSTTAGLAWQANNAIEQVTGSWRGCWPNQ

SEQ ID NO: 164041 - protein, 73 aa, Triticum aestivum
  Clone ID: PAT_TA_58459.pep
RPVRVSRAWLPSPDMLVTLPLLLFSTVLRLISAATALARIWELVVERFAFRSIFLVMSLTAPGKWSPPTKCTY

SEQ ID NO: 164042 - protein, 73 aa, Triticum aestivum
  Clone ID: PAT_TA_58460.pep
EVERRSATQARPDLTWHSLVELKWSFFVGTRRTFLTYSNVYNERKQHMAETLDLHANNAFFHSFQKKKKKRPL

SEQ ID NO: 164043 - protein, 106 aa, Triticum aestivum
  Clone ID: PAT_TA_58461.pep
PFQQSLLQNELDMKVFHDLTLLATPQPVAFLLHIETPRCLALMEFPALHGTTPVMSASGSCLPASAPCGAMLTARTRRAARRRLLVAIGLYPLDLSVVVSCMCERI

SEQ ID NO: 164044 - protein, 59 aa, Triticum aestivum
  Clone ID: PAT_TA_58462.pep
PAGSGRLKGRALVGLRLWDMVSTLWVTDGVIQSRTRDRIKDLFMYNAFWSHGWTWALAM

SEQ ID NO: 164045 - protein, 60 aa, Triticum aestivum
  Clone ID: PAT_TA_58463.pep
GIRSDRSCLFVFLGWWRRVAVDAVAMATLPTARSHGGAQACCIRMLRRQIKSRRRLEPAG

SEQ ID NO: 164046 - protein, 84 aa, Triticum aestivum
  Clone ID: PAT_TA_58464.pep
RPGPETYHSAAWDAALAPRVLQPTAVGQESAARMTLRWVAGNTSTCLTQPRWIPTMEKVSVTSYTKQTPTGNSLLPPSHLLLNR

SEQ ID NO: 164047 - protein, 52 aa, Triticum aestivum
  Clone ID: PAT_TA_58465.pep
AGRFPERSALVRVKREPPPGLFLRAAVRPFTYRNLVKEIVLMRHQIIDGEIV

SEQ ID NO: 164048 - protein, 58 aa, Triticum aestivum
  Clone ID: PAT_TA_58466.pep
LWNPLPLSSEAVPDAACPDCAYMWDIHCPISTDIIYLEHKAHWPPDYNNKTGPQPAAT

SEQ ID NO: 164049 - protein, 75 aa, Triticum aestivum
  Clone ID: PAT_TA_58467.pep
RPVPVRPVSPPRLASEERCRVKQPRVFLPFSQFCPHSLPTTSLACGCWVVTFVLAVFYLGCAADSTLKTNKRFSF

SEQ ID NO: 164050 - protein, 115 aa, Triticum aestivum
  Clone ID: PAT_TA_58468.pep
AGRSEFGERRAYSPSVPAAQTLVSPFEELSALPSPHSLRKSSTFTGLDFAPPKRFKDSDNMSDAGSIRSNRSGMSQAQLGAIRNGAGRVSRLPGDQVFTADALQDTLKPSWGIRP

SEQ ID NO: 164051 - protein, 123 aa, Triticum aestivum
  Clone ID: PAT_TA_58469.pep
RPVPTHYTYLVEFWPYAMRSRGIGVQQIFGKLAGFFSTNVNSIALDAIKWKYLAIYCGWIVFEFLIIYLLYPETSGRTLEELTFLFEDDELKEKATAAVEKQIHFGDAKEEENKTQVQTREVA

SEQ ID NO: 164052 - protein, 208 aa, Triticum aestivum
  Clone ID: PAT_TA_58470.pep
RPVRVLTGRGLAALSAPGQIYELTLKEGEEFVAHPGSVVAYSISRSLPQPFRFKSNSLQLQVPSLSRWISEPDWVKTVRSSEVWKYLARAFYGLRTATRRTIWGDRLFLQFHGPTKILMSGRGVRASDVLSNKQVNEIADSEPGVISQAVELSNQPKLTDGAETKSAVVNVAGQGQDDKSVTGIHVAKVEKDGKVKFEDNKDLKEFIR

SEQ ID NO: 164053 - protein, 79 aa, Triticum aestivum
  unsure (1)..(79): unsure at all Xaa locations
  Clone ID: PAT_TA_58471.pep
PAGSKGIXGELSHAIGLLRVSRPRLAVSRRDWTCFPPSLGGALPAGMKQIPRYGCLFGLVLERFSVTRDDDHEQGRRFI

SEQ ID NO: 164054 - protein, 77 aa, Triticum aestivum
  Clone ID: PAT_TA_58472.pep
AGRSGVESPEAAQKRADVYPGPPFGSLDDDLQVLMERFLEERGITQALAIFVPDYVDVKEQREYTRWLNNVKAFIDA

SEQ ID NO: 164055 - protein, 64 aa, Triticum aestivum
  Clone ID: PAT_TA_58473.pep
AGRAGPPYVRGLVLSATFGLLLPPCWLCLAGSHRHCRWRRRSRWRSRAAVHRWSTVGFHNEFTT

SEQ ID NO: 164056 - protein, 78 aa, Triticum aestivum
  Clone ID: PAT_TA_58474.pep
TCFTIQGSSTRMGVRCRVTRRYPNLTREARLMETCIMIRHAPQHDLNTELGYIPVWCNCIANVVVKSWVIWSCHNVSC

SEQ ID NO: 164057 - protein, 67 aa, Triticum aestivum
  Clone ID: PAT_TA_58475.pep
GPFFFFFFFFELKLAQPSYKYMKKCTLVSYKYIFSSKFYEMDAPEPGHSSILLMLSPTANQVSRNEQ

SEQ ID NO: 164058 - protein, 59 aa, Triticum aestivum
  Clone ID: PAT_TA_58476.pep
PHGGTIEEMFKRCFRQGPQHACCVYDGSTTEFLEADQHLTSICCDVVGMRFERDHIGIS

SEQ ID NO: 164059 - protein, 194 aa, Triticum aestivum
  unsure (1)..(194): unsure at all Xaa locations
  Clone ID: PAT_TA_58477.pep
MLSSITAKDPPPRLTETIFVPGDAVGEEWFFSDEDESRTVVRVREDTKLVGDQKRPPKPEVEPRKEKAFDEWGRWQDDNTQDSFSDNVLWWSDHDMAIRLAKYISPERVDRQVVKAHVEQAKKSSGWGFLKKSKPQTPEPXKPXVQEEDPVTMVGXAERVTFRKENAMGIWEGKTGWGLVIKVKIRQWIQLYAR

SEQ ID NO: 164060 - protein, 67 aa, Triticum aestivum
  Clone ID: PAT_TA_58478.pep
HNRLIEDDYIVDGHTTKAAGTAAHQSSDPSLGQQSVIAEHDNTRWIMTASLSLLLSLHLMGSRTRPA

SEQ ID NO: 164061 - protein, 50 aa, Triticum aestivum
  Clone ID: PAT_TA_58479.pep
DILKPGSARQMYESNKIQKYDCTNSKFLNDCKVLEIELLSTAKKKKKKAP

SEQ ID NO: 164062 - protein, 169 aa, Triticum aestivum
  Clone ID: PAT_TA_58480.pep
MSQSLRPYLQCVRSSLTAALTLSNFASQTAERHNVPEIEAQTSPEVLLQPLTIARNENERVLIEPSINSVRISIKIKQADEIEHILVHKFTRFLTQRAESFFILRRKPIKGYDISFLITNFHTEEMLKHKLVDFIIQFMEEVDKEISEMKLFLNARARFVAESFLTPFD

SEQ ID NO: 164063 - protein, 142 aa, Triticum aestivum
  unsure (1)..(142): unsure at all Xaa locations
  Clone ID: PAT_TA_58481.pep
SQLPVTPENTKPYXFHIGHLIHKDPNPMTLHRQMLKNPLVELVRDSVQALINQXLTTCPLISTVRRVNLITLPASIIRLPVRRPALRTRTRTEXKRFVASKGIKPKTRXSRRNLAFNEYTGEWEFKSGYNDLNNNDEDCAIV

SEQ ID NO: 164064 - protein, 195 aa, Triticum aestivum
  Clone ID: PAT_TA_58482.pep
MAAVQPPRTRSARLMAGFTTKTANHAPPASATHAHHGPSALSIFLTNLNLLDLDQLQDWPAICAETFATDGTSAQGLKKRVHCVEWALLHLFSLWDPEETKKKLKPFFPPLDQTQSVNLRAALLRALEAAKKNGVLGRDAIVRKTMLDECRGERLEDVLAAFSSAVLKHVIAQEVASGSEYKALALEKKKKKRPL

SEQ ID NO: 164065 - protein, 163 aa, Triticum aestivum
  Clone ID: PAT_TA_58483.pep
MAYTDFLTKAMALNSPATSSGLTTPDSLPDSATSEETDRSLKREASPPSSSASSITSKASGRPTPPATAPMAPPSPFTCATPMSAPPAGAACFPSLKVPPSPSVSNIDSPMSASTVRSPFSARPVHSSVFDWDAALKARLLEKKQKSSRTTTTLEGGQTALHS

SEQ ID NO: 164066 - protein, 38 aa, Triticum aestivum
  Clone ID: PAT_TA_58484.pep
TCVVTVVKSCKSDLHYMVMNITLATCKFPQKKKKKRPL

SEQ ID NO: 164067 - protein, 255 aa, Triticum aestivum
  unsure (1)..(255): unsure at all Xaa locations
  Clone ID: PAT_TA_58485.pep
RPVRVQDRFGVEGICEFYAATEGTFATFNLSKNDFAAGAIGRNGWIYNLILSQSVALVEVDWDTDLPKQPXTGRCYKARTGEPGEMLFRLPSGNPFQRFQGYYGNRAATEAKVLRDVFSKGDVWFRTGDVLRWDGEGRVYFHDRIGDTFRWKGENVSTAEVSDTMCKHASVKEANVYGVSLPHHDGQAGCAAVHLASDPTPETMHDIATHVCTELPKYARPLFLRIATELXGGQXTGTMKQQKHALREAGVDPAE

SEQ ID NO: 164068 - protein, 110 aa, Triticum aestivum
  Clone ID: PAT_TA_58486.pep
AGRVRDVTSSDTVTVSVNVSNKSKRDGSEVVQLYVKDMLSSVDVPRYQLKGFKKVAVKAGKTETVKIDLKVEEWGLWNRKMKYVVEPGDFTVFVGNSSENFMGNVTVTVA

SEQ ID NO: 164069 - protein, 146 aa, Triticum aestivum
  Clone ID: PAT_TA_58487.pep
MTTHTLQSKLRALKVLEGASYAKTDFKLFPNTPHQAFETWLDEAIECGVSEPHAVTLSTIDQDGRPDARILILKNVDDRGWHFATKADSPKGRQISMNNNVALTFYWPGMGRQIRLRGKAVSLSRSECDADFSARKKRKKKKKKAP

SEQ ID NO: 164070 - protein, 146 aa, Triticum aestivum
  unsure (1)..(146): unsure at all Xaa locations
  Clone ID: PAT_TA_58488.pep
KRRPVSGMRRYVQPLYAGHTPSTHSLTNCPSGCWAIPSTPRVADPPMVSRRVPRACARMLWCTTHSWTVSIVRGSVSVTSPVRRCSLYDEAHHDDCLHPFELILTVLSRPCWAIICLHIMPPSLYNHGCELLVHLEKNPPXSPSSR

SEQ ID NO: 164071 - protein, 223 aa, Triticum aestivum
  Clone ID: PAT_TA_58489.pep
MRPSRDLRLAVFLLLFSASVLLPAARAQQETEEEEEFSYSLDAENGPAHWGDIKEEWSACGKGNMQSPIDLASPRVSLVRGLGYLNHSYSPANATIVNRGHDIMLKLEGDAGSVSIGGTPYFLRQLHWHSPTEHSVNGRRYDMELHMFHESAEGKAAVIGVFYEIGAHDAFLHKLEPYLEMIADRKDREEKMGMMDPRGARGKGSVYYRYVGSLTPHPGQKGS

SEQ ID NO: 164072 - protein, 76 aa, Triticum aestivum; identical to SEQ ID NO: 141100
  Clone ID: PAT_TA_58490.pep

SEQ ID NO: 164073 - protein, 58 aa, Triticum aestivum
  unsure (1)..(58): unsure at all Xaa locations
  Clone ID: PAT_TA_58491.pep
MENVPADXREFSLGATTVSDSGGISIAGLLSIVMETKLCNYQVAHGRDWCQRISAQGQ

SEQ ID NO: 164074 - protein, 45 aa, Triticum aestivum
  Clone ID: PAT_TA_58492.pep
GRRYRHSLLERGGSIPEMEFLKEFLGREPSSEAFYKELGLSSSTS

SEQ ID NO: 164075 - protein, 129 aa, Triticum aestivum
  unsure (1)..(129): unsure at all Xaa locations
  Clone ID: PAT_TA_58493.pep
PAGSGKARLERIASKXQRDAAEKATAHARKPVPVATAHPSVNDHPHLQGLVPHIILDAKKATGKESRYLSTIARRFNDENLANSWQIMCKYFDGRCALERIALQEDMKRKLVWNTLTAMSEYLLCTRHW

SEQ ID NO: 164076 - protein, 191 aa, Triticum aestivum
  Clone ID: PAT_TA_58494.pep
MSTQREAVNPLRPYYIPPSIGAPAETAAKSSPSPNPFPDGRHVTAAGERYASKARDILSDLEYNDYLGDTSPSMVQNAKSLIDELLWKYSSVLMAQPFEVAKTLLQVRNQDENAVYGLPAEPEPPKKPVSPPRSSMYDFRDSDSEGEEPNYFSSNDKAELQIRQELLITSNKSEGGKSVLEFRNREKPPNN

SEQ ID NO: 164077 - protein, 69 aa, Triticum aestivum
  Clone ID: PAT_TA_58495.pep
VAITKCGKRRKRSALMANERGTEFVLGRYVGYITDFLGVYFILERLRQVWEGIRIFDGNIYIINEFTIL

SEQ ID NO: 164078 - protein, 138 aa, Triticum aestivum
  Clone ID: PAT_TA_58496.pep
MSSFAVVKDIDHLVLTCHDVQATIAWYTKYLGMKHEPFGPESSPRHALKFGTHKINLHQRGNEFEPKAQTALPGTADLCFILEEGTDLQGLITEFEKEDIKVLEGGGVVARTGAMGGIKSIYVRDPDGNLIELSYYTS

SEQ ID NO: 164079 - protein, 232 aa, Triticum aestivum
  Clone ID: PAT_TA_58497.pep
GRNRIIFDDADLEQAAKDTMYSIQWNSGQVCMANSRVYVQDSIADNFIQACKKALSAAKSGNPTEKGINHGPQADKVQYEKVMSYINEGKKSGTLELGGNGNLDKTGGFFVEPTIFLNTPEDAKVMKEEIFGPVVNINVIKTEEEAIEKANDTEYGLYAAVYTKNVDRAMRVTQKLNSGYVGINCTSPTTARDLPFGGYKSSGQGREGWLYSLDNFLEVKSVMMKVDSGSKL

SEQ ID NO: 164080 - protein, 94 aa, Triticum aestivum
  unsure (1)..(94): unsure at all Xaa locations
  Clone ID: PAT_TA_58498.pep
MEQQPINTQEATTQPLNETPVVGSPPQDRRASDAAYDRRMSDEWDASKVXPSRFQKRKGSIYATPGSRDGHVDRNYADKYWNKMTEKNWGSSSK

SEQ ID NO: 164081 - protein, 71 aa, Triticum aestivum
  Clone ID: PAT_TA_58499.pep
AALEAALLEELPSELEVLYESMWSRLNAKNKVYRQTAAMYFHFLLAKGWNFKVIYPDVEVPFTKKKKKKAP

SEQ ID NO: 164082 - protein, 95 aa, Triticum aestivum
  Clone ID: PAT_TA_58500.pep
QKKKKKKSLLLLLQLDVEATTPICYISLFFLVFSSKMASRPIFTATHPRACSTAFERVFMARRDILESVHEPFGDAFYYGPEILSDRKKKKKKKI

SEQ ID NO: 164083 - protein, 255 aa, Triticum aestivum
  Clone ID: PAT_TA_58501.pep
MPPRVPTEEDFSPLKSTLPHTLHFPDPPESTTTFLILFHGLGDHDVPYAGFAKNLNLPGVLGISVRGTSVLPAALMGTDVPGYHFGDDLTVDPNTGDIADDSGFEKARKLVMEKLITEVLIEKCGWEMRDIMFFGFGQGGSLALGLAASLDTTSRVTDVTEGENTTAAGNKTFKGLISLGGPLPQSMVSTVTNRRKSRTSVLVCQLDEDAVDAVKQEFDDVKVVQWKRRQLSMPIDRDEVLPLMQFFADKLRNEF

SEQ ID NO: 164084 - protein, 147 aa, Triticum aestivum
  unsure (1)..(147): unsure at all Xaa locations
  Clone ID: PAT_TA_58502.pep
RPGPIEIDVAWLRXNATSVQNIKPQVDRFLMPSGRHIILLAEGRLVNLGCATGHSSFVMSCSFTNQVLAQIMLYKAADKTFAEKYVEFAKTDKLDVGVYVLPKILDEEVARLHLAHCQAELSTLSNVQAEYLGLTVEGPFKADIYRY

SEQ ID NO: 164085 - protein, 76 aa, Triticum aestivum
  Clone ID: PAT_TA_58503.pep
PAGLGQRSHAPPRGMLGEGERERRPFGRGRGGDRGDREGGYRRRDAGEGKEGGAPGEFAPQFRGGFGRGRGAAPPS

SEQ ID NO: 164086 - protein, 79 aa, Triticum aestivum
  Clone ID: PAT_TA_58504.pep
MATMVRAVVLALLLVQCCNVVLAARLLEGDGGWLHGDVGAAGALIMQTLAGHSPGAGAPNPCTHDPVNNNPPGAVCHGG

SEQ ID NO: 164087 - protein, 82 aa, Triticum aestivum
  Clone ID: PAT_TA_58505.pep
AGRVRCDTVHHNTVRYSAACDSIVLWKHGGWVVMGKCLNSMRNMTFASSRSSPMMYVSHQLAIRGAGAAPSLHVSQCDAIHS

SEQ ID NO: 164088 - protein, 60 aa, Triticum aestivum
  Clone ID: PAT_TA_58506.pep
VTYRRPSGTRSGSPATAMATLTAARLTPLLALSSTLLSSTVSSSSRGPVALAARSSLSEC

SEQ ID NO: 164089 - protein, 57 aa, Triticum aestivum
  Clone ID: PAT_TA_58507.pep
PAGPGRKTMFPQTSRRALEKVSLKWIDTSSEFGHGAFQTPAEKKQYQGTLKKDLSSA

SEQ ID NO: 164090 - protein, 186 aa, Triticum aestivum
  Clone ID: PAT_TA_58508.pep
MTTYIPALTLPDSVFLKPALSVLLPIGLGTAVGFSATQTQKTYLALKKPSVQPPPWLFGPVWTILYGVMGYAAYRVADIGLSPFSSPETIVNTRQAMTVYSIQLGLNLIWTPLFFGLYRPIEASVDIITLLGVNGYLTYLYSSIDSTAAWCQVPYLGWLTFATYLCTTIGHLNNWDLASSETNKKE

SEQ ID NO: 164091 - protein, 79 aa, Triticum aestivum
  Clone ID: PAT_TA_58509.pep
LYTSKSKTLHHVRRHYLIRALLHLRSGIGSLESNLGQSSGDLLHPHVVLLLIRVERACGRTTLLAKINGVALKLARTGR

SEQ ID NO: 164092 - protein, 232 aa, Triticum aestivum
  Clone ID: PAT_TA_58510.pep
METMAPLKQALPSLQIFLSQEQAQELGMTPWFSYSVTLPERPIPGASERKSIETERLVVRPFTMKDLEAFHELRKLQELQVYSTARGRANKDKDESERQLHSLVQDDQCHWWFGAFLKSTGELIGEGGLPDVLAMSSSISGWPEAEFLIKPQHCRQGYGSELWTAIMDSWWDLPRERRRHQLIPLVAPGKEPGDKVDECVVFQWESNEVARNFFRQDPGTSTRCCAGWLREY

SEQ ID NO: 164093 - protein, 139 aa, Triticum aestivum
  Clone ID: PAT_TA_58511.pep
PAGFGILPSPIFILFQITSTQLNTPLSSSLLHSPANMYTAPGILTLTGSNRMTLTFIIDDVHFTLTGNINPAMPPFKANQVILTYNNVHELSSTVSFEGQIGPNNFKLNLENGVTAEGYLDFPISPASRISGSGTWSQN

SEQ ID NO: 164094 - protein, 121 aa, Triticum aestivum
  Clone ID: PAT_TA_58512.pep
GPFFFFFFFFFFFFFFFFFFFFSSRHIGIIQAEFCVYDHNNQWCTARQLVMANNILEFEEKQQQYSCIPSEGKKKSRGGIPSFLLAWTRGLRRRRPGLVLWWVGEEAVMPGRSRRMPVRPA

SEQ ID NO: 164095 - protein, 67 aa, Triticum aestivum
  Clone ID: PAT_TA_58513.pep
PAVPDIDYYSGEPEADGEPVFFLDVRPAATPLGSAERIIRWSTDTWWKAIGGDRHEQDPQPWFRGSS

SEQ ID NO: 164096 - protein, 64 aa, Triticum aestivum
  Clone ID: PAT_TA_58514.pep
AGRSGIPGGGSQGGGGFGNSARHVRLVDGGQRLEGELSRDGDWVLSSIVLDERIRNYNGTLELV

SEQ ID NO: 164097 - protein, 236 aa, Triticum aestivum
  unsure (1)..(236): unsure at all Xaa locations
  Clone ID: PAT_TA_58515.pep
PAVPGDESVMSLXRGNTANVILYFPTHALNFTFRDKSYKKSGHQKDKDDYTMWMPVNLAYAGAAGATSLLFHYSLDYSRTHLDNHDKNFNPGADRQVNCLDHVYKKNLASDDIDISLPRTACPSXDDIVNHRDRYFIMYDSISPDVLSDNLQGNFLASIDPGRIVPTGDTIHTYPLDTIRXTHXMMTSGEDVKYNNTMDAARQIVSKEGVXTLFKGADATIXRADDGAAVLSIYHQ

SEQ ID NO: 164098 - protein, 145 aa, Triticum aestivum
  unsure (1)..(145): unsure at all Xaa locations
  Clone ID: PAT_TA_58516.pep
PAGSGHHSLFFTSITYYNLPTHPIIMSAKVYVGNLGWNTTDDSLRNAFQDYGQILDSIVMRDRDTGRSRGFGFVTFGSSQEAETAIISLNEQELDGRRIKVNLANARPGEVVXXGGGYSGGGGYSGGGGYSGGGGIWXGGGYNGR

SEQ ID NO: 164099 - protein, 110 aa, Triticum aestivum
  Clone ID: PAT_TA_58517.pep
MAKQTTLDEFNAVFPKLEEVLLDHARSYKLPQEQLDWYKKSLEANPLGGKCNRGMSVPDSVSLLLEKPLTEEQYFQAATLGWMTELLQAFFLVSDDIMDSSITRRGQPCW

SEQ ID NO: 164100 - protein, 181 aa, Triticum aestivum
  Clone ID: PAT_TA_58518.pep
RPGRVTTTVNLIFGSLLMDNLTGVILNNEMNDFSIPGVPNEFGFAPAEANFVRPNKRPLSSCTPIIVSNKDGSLFAVIGAAGGSRIISATTQVAWRVLTSPSWSIEDAVREPRVHNQLMPNTLLVEKKFSSYDVPSLKERGHNITWVDEGLSSVQALVRDSDGVFEIAAEPRQKNSGGATL

SEQ ID NO: 164101 - protein, 41 aa, Triticum aestivum
  unsure (1)..(41): unsure at all Xaa locations
  Clone ID: PAT_TA_58519.pep
LXIFLRRVLSYMTSSVYKSNNLVSLADKVHGTRPHLLLLLL

SEQ ID NO: 164102 - protein, 221 aa, Triticum aestivum
  unsure (1)..(221): unsure at all Xaa locations
  Clone ID: PAT_TA_58520.pep
RPVRVDIFSLGLVFFYVLTNGSHPFDCGDRYMREVNIRKGQYNLDLLDSLGDFSREASDLISSMLEADPKCRPTAKEVMAHPFFWSARKRLSFLCDVSDHFEKEPRDPPSSALAELESHASDVTGDFLKALPRDFVDSLGKQRKYNGARLLDLLRALRNKKNHYEDMPEALKRNVGXLPDGYLAFWTVRFPSLLLICWNVVWAIRWDKTDRFREYYEPAAL

SEQ ID NO: 164103 - protein, 70 aa, Triticum aestivum
  Clone ID: PAT_TA_58521.pep
PCAHAWRLSVKQYAFGILSFSLCLVIAATRSRTFIAALTISELPLMSGDMRDQLLHSRNPLSDHVYQQTL

SEQ ID NO: 164104 - protein, 73 aa, Triticum aestivum
  Clone ID: PAT_TA_58522.pep
LAVAVLCCTKQRYRLLQARLAYHLTYWQHGHCPSILFGVIIWCKDSRESERVSGLLFLCTIHNGVVSSEDRPA

SEQ ID NO: 164105 - protein, 246 aa, Triticum aestivum
  unsure (1)..(246): unsure at all Xaa locations
  Clone ID: PAT_TA_58523.pep
NLSLHFQITSPASSMADTPGLSPEQLEAFSRDGYLILPGALSSSTVKSLLDETHNLLENFSLDDHPLTRFSTGEKRDHVGDDYFLTSGDKVRFFFEEDAFDDEGKLIKPKARAVNKIGHYLHALSPPFAHLLDHDTSKVSPPAVARSLGFKDPRCLQSMVICKQPEIGGAVPPHQDSTFLYTNPPSAVGFWYALEDATLENGCLSFLPGSHRXAPVENRLVRKEGNAGTEMVNMDGPEFPATDGYX

SEQ ID NO: 164106 - protein, 164 aa, Triticum aestivum
  Clone ID: PAT_TA_58524.pep
METFKSLFAKPDPQAQMRKCNALMRQNMRKLDRDIQTVKQVEAKTKNLIIQADKRGQRDPSRSSQAQKEVRDFARELVRARKQSQRLVTSKAQLSSVQMQVNEAFAVRKIEGSIRASVGIMKDVNSLIRLPELAGTMQELSVELMKAGVIEEMVEDVLPADECS

SEQ ID NO: 164107 - protein, 80 aa, Triticum aestivum
  Clone ID: PAT_TA_58525.pep
PNPPTPRGGPDPNPPKREPNNPGPRAAVYQRRDGKNPGVTHLIRLEDLPPFPSGGITKKARTNRPSHKWPSRKGKGKWKR

SEQ ID NO: 164108 - protein, 104 aa, Triticum aestivum
  Clone ID: PAT_TA_58526.pep
HMLGMHQLRSDYKVMDTFAKTIPSGKRQVKASESHNDAGKRYMVMHTPFADMAGTTSRARSPVGVNGDSRQRLVAERERPGRAGKQKRPVMAALPRKKKKKKAP

SEQ ID NO: 164109 - protein, 62 aa, Triticum aestivum
  Clone ID: PAT_TA_58527.pep
SHIEQCVQQLVSRTVIDVYFMSVTYVSMSCEKTVSCRRDVIKLLAESYSSGRRCKHQDHRLG

SEQ ID NO: 164110 - protein, 210 aa, Triticum aestivum
  Clone ID: PAT_TA_58528.pep
RWLHLTGIDLDRHHVKGTHRTAPKSDNVYLKLLVKLYRFLARRTDASFNKVVLRRLFTSKINRPPVSLSRIVANINKEGEKRTVVVVGTITDDNRLLECPKVTVAALRFTATARARILAAGGEAITLDQLALRAPTGSNTLILRGPKNAREAVKHFGFGPHSHKKPHVESKGRKFERARGRRRSRGFRSKRFQGENYWPWGGVGASLWGK

SEQ ID NO: 164111 - protein, 45 aa, Triticum aestivum
  Clone ID: PAT_TA_58529.pep
VTLEEVTPCYNPRFLSCSYYSLQVSLELGAHIRGVRAWSSSTSHT

SEQ ID NO: 164112 - protein, 69 aa, Triticum aestivum
  Clone ID: PAT_TA_58530.pep
RVPTRHATGERSLQSETSLKGHLQCLGPQKFQHRELPARVGGHRSVRAGRGGGLEAQARPELGWTVKRV

SEQ ID NO: 164113 - protein, 52 aa, Triticum aestivum
  Clone ID: PAT_TA_58531.pep
AGRVGLRNVVTEAGLFAIKDYRESINQDDFNKAVRKVAESKKLEGKLEYQKL

SEQ ID NO: 164114 - protein, 108 aa, Triticum aestivum
  Clone ID: PAT_TA_58532.pep
GPFFFFFFFFFFRGSLMSLDHRSYICSIKTFAGKHLNCSTLDCHLPWTCSHQISALYKIVSPSISTLSYFPTRSEGAIGSATSHSMHSSSPCPLLVLIHDTQRFPFSR

SEQ ID NO: 164115 - protein, 60 aa, Triticum aestivum
  Clone ID: PAT_TA_58533.pep
INSSLFDGWEGQSVCTSSMNIQLMKAGCDEARYSGVIAVRRCQSTIVEPRSVSQGRCMSI

SEQ ID NO: 164116 - protein, 181 aa, Triticum aestivum
  Clone ID: PAT_TA_58534.pep
AGRFGSVRASSAAFHLPSDPETTPIICVAAGTGLAPFRGFIQERAAMLAAGRKLAPALLFFGCRDPENDDLYAEELARWEQMGAVDVRRAYSRATDKSEGCKYVQDRIYHDRADVFKVWDQGAKVFICGSREIGKAVEDICVRLAMERSEATQEGKGATEEKAREWFERSRNERFATDVFD

SEQ ID NO: 164117 - protein, 121 aa, Triticum aestivum
  Clone ID: PAT_TA_58535.pep
RGLFFFFFSFFFFFFFFLVQCMQAPIWYLPCATIEKWPSQLFIRMLYHFFHYVHSHVCLTCLMRDRSRDVLIMYSDETLSRNRDVSQVLSGLDNNGFSACSKSSRWCKKRRRGYSKSRETC

SEQ ID NO: 164118 - protein, 69 aa, Triticum aestivum
  Clone ID: PAT_TA_58536.pep
VTCLVGIGEKFRRCTAGVNKEVPEWLARVLISQEVSFKCDLPRRYVHYARKKLKIAEIIAPSAVPELFW

SEQ ID NO: 164119 - protein, 98 aa, Triticum aestivum
  Clone ID: PAT_TA_58537.pep
TAALHRSQRQSQLPHQATAIDSNFQQIQLSILTGYSIEINYHFPQISKPNGDAFVITALLTSQTNAVHASPEAGVVVTKTAVLSCLLATSSLLPDPAG

SEQ ID NO: 164120 - protein, 81 aa, Triticum aestivum
  Clone ID: PAT_TA_58538.pep
AGRVGVSAFEADAVRQVGAVQHITIRVQEACVDNRPEIRRFATRRLRQRCVGGGSKYRTGDAQCQGGPRECHGSFSTMNIT

SEQ ID NO: 164121 - protein, 95 aa, Triticum aestivum
  Clone ID: PAT_TA_58539.pep
MGGISAVLLILITIFFPPIGVWAISGCGMDLFINICLTLLGYIPGHIHAFYLEYIYFDRREQAREGRFATGPAPGVYSDNVQTGGQGYGTIGRTG

SEQ ID NO: 164122 - protein, 63 aa, Triticum aestivum
  Clone ID: PAT_TA_58540.pep
HLHVIGLDGFFTYNAATQVIRNVGIAHLSKTIPYDRQWISQEKDKNKPNRKVLATKKKKKKGP

SEQ ID NO: 164123 - protein, 60 aa, Triticum aestivum
  Clone ID: PAT_TA_58541.pep
FIASISIALHTHFKHGKNRRMGLKGLHLMSWMWVFVILLSVPHVYIITQFRLQDIMEVFG

SEQ ID NO: 164124 - protein, 68 aa, Triticum aestivum
  Clone ID: PAT_TA_58542.pep
RLLVQWFNERGVWKVRWSLRVVSLLACFCQLYSLFIAPISFLTLLPLLFPQSTIKIDYFQKKKKKRPL

SEQ ID NO: 164125 - protein, 56 aa, Triticum aestivum
  Clone ID: PAT_TA_58543.pep
PARVQKRHVYVYFLPDCIKAEQAWKKVDGFPSLVDTSVVQYQSTFYIQKKKKKRPL

SEQ ID NO: 164126 - protein, 57 aa, Triticum aestivum
  Clone ID: PAT_TA_58544.pep
AGRVGSYEATTIYFLQHAFPNTYYFLHWYLPVYTFTFCTLKYILDFLLQKKKKKRPL

SEQ ID NO: 164127 - protein, 139 aa, Triticum aestivum
  Clone ID: PAT_TA_58545.pep
RPVRDDVSSRTQQLNQSQWSFSKSFDGALPLGPTLVLKSLIPDPSKLHMRGLKNGEVYQESGTDDLIFSVPKIISWLSQGTTLPPGTVIVTGTPAGVGMGRTPKDALRHRDEFAVEILPHIGTLTNIFENEKSEFMTKL

SEQ ID NO: 164128 - protein, 63 aa, Triticum aestivum
  Clone ID: PAT_TA_58546.pep
QTLVNFFVYIHSPRDRDCSTIGDLATCQAFMANNCASGLAPDLLKVINKDPHLLPKKKKKKAP

SEQ ID NO: 164129 - protein, 60 aa, Triticum aestivum
  Clone ID: PAT_TA_58547.pep
GRFERPGFGKKKKKKKKKLNVLTPGDTVVVVQGWKGGMGNTNTLRIVKADPEHLGIGQLQ

SEQ ID NO: 164130 - protein, 171 aa, Triticum aestivum
  Clone ID: PAT_TA_58548.pep
MNKFDSSFFPTVPPTNTFDDELDLDLLIVPGGSGARNPNLQAVTSYIAKMFPKVKILMTICTGAGVAARSGVLDGHMATTNKNAWATMKEMGPKVNWVSPARYVIDGKIWSSSGVTSGLDLIFEFIATFWGKEQSERLAGIAEHVPREATDDPFSKHYNITPTEAQPCPQP

SEQ ID NO: 164131 - protein, 128 aa, Triticum aestivum
  Clone ID: PAT_TA_58549.pep
PAGSRENKKLIKKLARKYDAFVASEALIKQIPRLLGPGLSKAGKFPTPVSHADDLTGRINEVKSTIKFQLKKVLCMGVAVGNVEMSQEQLVGNIMLAINYLVSLLKKGWQNVGSLTIKASMSPPKRLY

SEQ ID NO: 164132 - protein, 65 aa, Triticum aestivum
  Clone ID: PAT_TA_58550.pep
IESTRVLFTKEAVEKKCCINTLRLPNRYQPDPFHNLQSKGLLGDTKDLQSGLDLSTNTLLAGPAG

SEQ ID NO: 164133 - protein, 111 aa, Triticum aestivum
  unsure (1)..(111): unsure at all Xaa locations
  Clone ID: PAT_TA_58551.pep
RPGRGRLHVLGGSVAXNVVGRPVQWQFMKDNWDXITKLGNPVVVDRYMNLSLSRFTDVSAVEDIEKFMADKDTSSFNRTLGTVKDKIRGRAAYRERDSEKLKEWLSAHGYA

SEQ ID NO: 164134 - protein, 160 aa, Triticum aestivum
  Clone ID: PAT_TA_58552.pep
PAGPGIGRVDIVESRFIGLKSRGCYDTPGLTILRQAHIDLEGLVLDSKVRAIRDRLTQDWSACIYNGMYFSPERELVEHAIKFSQRQVEGKVSLVAYKGNAYVVGRSSETSNLYSEDESSMDTLDMNWTPQDTTGFIAIQGIRLEKYGARKIKDGEPLAP

SEQ ID NO: 164135 - protein, 130 aa, Triticum aestivum
  unsure (1)..(130): unsure at all Xaa locations
  Clone ID: PAT_TA_58553.pep
GLDVRPRINNSSNRPNGQEQRENGRNERGRGHVRAIRCNNCSRXSPKIRLRDSHPQRGESAAVRGISDAXVCPEYTVRKMHLKMQNCVACAIHGKIVRDRAVVGRRKTAPPPRVRYKKDGKKIVPTAPKA

SEQ ID NO: 164136 - protein, 57 aa, Triticum aestivum
  unsure (1)..(57): unsure at all Xaa locations
  Clone ID: PAT_TA_58554.pep
KLAQSTFITRAXLGQDMQERDICTLVILYTVSRRLWIELATNKPLSFYQQKKKKKGP

SEQ ID NO: 164137 - protein, 59 aa, Triticum aestivum
  Clone ID: PAT_TA_58555.pep
NSDQIKAPSNLLYKQCQNDMFPQNSVLVTLWLQLGPRTYSLTCHSNPYIHPIISFNQIL

SEQ ID NO: 164138 - protein, 52 aa, Triticum aestivum
  unsure (1)..(52): unsure at all Xaa locations
  Clone ID: PAT_TA_58556.pep
GPFFFFFFFFFFFFFFFFFFFLXIKFYLFVFIGFVTIYQGPGTFSARPIFRL

SEQ ID NO: 164139 - protein, 48 aa, Triticum aestivum
  Clone ID: PAT_TA_58557.pep
CQVRLLDHSCTRAQTSNPLFTFNTNVSVSYCCKKKKKKKKKKKKKKGP

SEQ ID NO: 164140 - protein, 104 aa, Triticum aestivum
  Clone ID: PAT_TA_58558.pep
RGFFFFFFWLNDMTFADTVLAGYLSWQYMRMRNDASLASTRRKKETSHTSWSKNSHLSEQRLSFINVHKVTNTPPPSVHQTTIVNNAPKTMAKTATARRTKTGK

SEQ ID NO: 164141 - protein, 144 aa, Triticum aestivum
  Clone ID: PAT_TA_58559.pep
LTVLLAIHLCSIGPQVHAIGRLLVNKFHLIPFRAIPSQAPCFHYPVRNHPSVSNSFYRRLSPPMASCPCQASAISPSFPFFLLEHRRSFSPRRSAPILSPSFTSAARLSRAAMSRYRLQVRPSALRAAGICAVLVVRLGWDWFW

SEQ ID NO: 164142 - protein, 85 aa, Triticum aestivum
  Clone ID: PAT_TA_58560.pep
PAGSVRFCRNEALRHHSTISLGLPRLVPENGNGVTIAGYHFAPGTVLSIPIYTVHHLKEVWGPDADEFKPERWEDVTQRQKQGFI

SEQ ID NO: 164143 - protein, 57 aa, Triticum aestivum
  Clone ID: PAT_TA_58561.pep
MAKKAKARLVHARLVSMAMTGFFYTFKRPRTAPMMSMLKYDPIVRKKVLFLETKKRK

SEQ ID NO: 164144 - protein, 57 aa, Triticum aestivum
  Clone ID: PAT_TA_58562.pep
RPGRDAAANLGLDEHANRISKATYAVIADGKVRTPDMGGKSTTHEFTRAILDKLETV

SEQ ID NO: 164145 - protein, 66 aa, Triticum aestivum
  Clone ID: PAT_TA_58563.pep
KPKGTNHYLHSKKYRTWSLLGPSMQAWTSNMISITISSWYSSLFLCPSGCSLYRPSIRFCKNIHGH

SEQ ID NO: 164146 - protein, 150 aa, Triticum aestivum
  unsure (1)..(150): unsure at all Xaa locations
  Clone ID: PAT_TA_58564.pep
RPGRALASPPPSSRRLLLPRRRRTLQRPQXMGVFTFVCRDSGAEWSAKQHKGELEASAATPYDLQRQLVSAACAEDKSGGVQSSFTMVSPKSAIFQVVIGGASAGPIGGGGAAGGAAASGGAAAEAPKAEEKKEEEKEESEDDLGFSLFD

SEQ ID NO: 164147 - protein, 97 aa, Triticum aestivum
  Clone ID: PAT_TA_58565.pep
WSVCKLATPVSHADDLTGRINEVKSTIKFQLKKVLCMGVAVGNVEMSQEQLVGNIMLAINYLVSLLKKGWQNVGSLTIKASMSPPSACTKRVSLAFA

SEQ ID NO: 164148 - protein, 98 aa, Triticum aestivum
  Clone ID: PAT_TA_58566.pep
RPAGTFCTLQRESFTQRIAKKSTSPRWAPRSRPTSQSFHILNFQLQPREALVAHTRQDPASGMVPKIISTSRISRPGWTLIRYLMVARINGEVCRSLL

SEQ ID NO: 164149 - protein, 84 aa, Triticum aestivum
  Clone ID: PAT_TA_58567.pep
TVTAHPKKMQEIAVYASPCFQLLSNPQTVDVSCFKFHAFGQGYGVSEVRQVHTKAVNEGYSNCFHQKQLPLGPHLKDDMNCTFG

SEQ ID NO: 164150 - protein, 123 aa, Triticum aestivum
  Clone ID: PAT_TA_58568.pep
MSSTKKPSGKTQRSAIADVVAPEYTIHMHKRLHGVTFKKRAPKAIKEIKAFATKSMGTSDVRIDPQLNKKVWEQGIKGVDYRIRVRISRRRNDEEGAKEKLYSYVQAVNVKDPKGLPTVVVEE

SEQ ID NO: 164151 - protein, 57 aa, Triticum aestivum
  Clone ID: PAT_TA_58569.pep
RPGSAGDENDFFPMTVRFNKSTPYIDVDVNTASLLEEDEEVTFSKEVKSHADNFLVE

SEQ ID NO: 164152 - protein, 127 aa, Triticum aestivum
  unsure (1)..(127): unsure at all Xaa locations
  Clone ID: PAT_TA_58570.pep
MADHPSFTLAALLAAGGTAGYMRTRSTPSLVAGAGLXVSYAYAGYLLKNNKDXCSELGLPNSVLLTGSAVPRIIKTWGRAPAPIILGALAGLATYYYHNKFREFRYGVYAKLDSCILTKGTFKMGQG

SEQ ID NO: 164153 - protein, 47 aa, Triticum aestivum
  unsure (1)..(47): unsure at all Xaa locations
  Clone ID: PAT_TA_58571.pep
LCQLRVEEAKNKAIVFLFNRHRLNPTKLLHPACRCDAGFINXPTRPA

SEQ ID NO: 164154 - protein, 132 aa, Triticum aestivum
  Clone ID: PAT_TA_58572.pep
RGLFFFFFSCNLEKRCFYCSLIIRYLVKQHSQKHPPPLGRSLVKQRLTREERSEEERNLSRKSSSRTRLRLALIFQHPPFTGDLPEYGVVPESVPNSSFPPGLITGSAVPIPCDHIAFRSNQSERKNPRPAG

SEQ ID NO: 164155 - protein, 192 aa, Triticum aestivum
  Clone ID: PAT_TA_58573.pep
PAVPGIAELESTIGHLREAPGAAERQDALSAAQKQLQITEDKLKAALTDVEFMRSRYQDVGSAAAQLSNEVNALKTQNVALEQKASANLLAIHAQQASGERQAMQQAIENLQAQLQQRDAELTAAHQKLNSFANGRNTRGGSMPRSPRVPSGVSPRPNLAYTGSASRGTSPSGPGTQFMSQQAQNTRWNPIQ

SEQ ID NO: 164156 - protein, 78 aa, Triticum aestivum
  Clone ID: PAT_TA_58574.pep
RPVRDQLQATVFKRITVKMVSFTYLLAAVSAVTGAVAAPNPTKVDAQPPSGLLEKRTSPTTGVNKRVLTEKKKKKRPL

SEQ ID NO: 164157 - protein, 73 aa, Triticum aestivum
  Clone ID: PAT_TA_58575.pep
MVKSPHSTYYDPRLRQGAALVRARRPYLFKNAITGLGLLGVVGSIYWYTLNAVGQDNFEDVKVPDAPKPAASK

SEQ ID NO: 164158 - protein, 105 aa, Triticum aestivum
  Clone ID: PAT_TA_58576.pep
MVHNIRTKDEFQDALKNYSVVVVDFYSTHAAESKNIAPTFAHANELDKFKDFRFLKIDIDDLKSLAEELGVSKPASFQMYKNGEKINDLQSDQTEDLIQFLETGL

SEQ ID NO: 164159 - protein, 116 aa, Triticum aestivum
  Clone ID: PAT_TA_58577.pep
AGRAGEFARCLDFIDRGRRNGTATLVHCRVGVSRSATICIAEVMRSKGMSFPHAYCYVRARRLNVIIQPHLRFAYELLKYEEALQQDGDPDAEVKRTLEWAEIAREIALMNRPYSR

SEQ ID NO: 164160 - protein, 213 aa, Triticum aestivum
  unsure (1)..(213): unsure at all Xaa locations
  Clone ID: PAT_TA_58578.pep
MVLYFTSSVVDPSGFIYVGKDKFENEDLIKFGWEEDIWFHADKLSSAHIYLRMKEGQTWDALPEELVMDLAQLTKANSIEGNKKDNVTIIYTPWSNLKKDGSMEVGQVGFKDPRKVKRILVPQRENPIVNRLNKTKVEKKPDLKQERDDRLKELRRRDQAVFLARKKEEAKQAQEWKEKKYQKDHAYDDIFTEELMAGSSNXDRDENWEDDFM

SEQ ID NO: 164161 - protein, 87 aa, Triticum aestivum
  Clone ID: PAT_TA_58579.pep
LRSILPLKMGYPCQVFHASELPERVQTNLSGRKRKLGQGAKNVDLNGCELLEMLQYKCEIKEPVKWDSPVQCFAVGRLFKKKKKKGP

SEQ ID NO: 164162 - protein, 40 aa, Triticum aestivum
  Clone ID: PAT_TA_58580.pep
GPFFFFFFLFFFFFFFFFFFFFFFFFFFFFFFFTQHKGSI

SEQ ID NO: 164163 - protein, 81 aa, Triticum aestivum
  Clone ID: PAT_TA_58581.pep
RPGSVRATIAMQSMLEGKIRSRQLPVMAVVLRSLSKSHLLSLPSPRLAGETLPDLLLRPLHPSESRQQQHHPVHAGRNKEL

SEQ ID NO: 164164 - protein, 95 aa, Triticum aestivum
  Clone ID: PAT_TA_58582.pep
RPFRNQSSIADKGARAIGWSSMPRKIRCMKLHEDRIREDYRRVYFASFCVSETRKLVFRYKIKTEKLKKNHELLLVMKQTNQNIKNTKKKKKKGP

SEQ ID NO: 164165 - protein, 95 aa, Triticum aestivum
  unsure (1)..(95): unsure at all Xaa locations
  Clone ID: PAT_TA_58583.pep
MVSSSRSRLLLKQQTKPNRSIIRXKKKKKKKKKKKKKKKKKKKKKKKKKKKKKKKKKKKKKKKKKXKXXKKKXXXXXXXXXXKKKKKKAPKGRAP

SEQ ID NO: 164166 - protein, 153 aa, Triticum aestivum
  Clone ID: PAT_TA_58584.pep
PAGPGYLKPGGWIEHVELWGNAMSDDGTMTEDSPLKTWVRIFDQIGEKIGNPFFWDPVEAFQEAGLQNISERKVKVPIGTWPKNKDLKQWGAWNRQFLMQGLEGFSIRGLTELLGWEYEKAQVFLVDMRKELLNPSLHSYVLVTAVCGQKPLE

SEQ ID NO: 164167 - protein, 120 aa, Triticum aestivum
  unsure (1)..(120): unsure at all Xaa locations
  Clone ID: PAT_TA_58585.pep
PASSGFPATVWVYPSEILPLRLRHVAXSISTASNWIFNYMIVQITPVSINNXXGWRTYIIFAVLNAFFVPVIFLFFPETEGLELEDVDQLFGGEDIAKVLDNKGDGTVVTVESVNRDGAT

SEQ ID NO: 164168 - protein, 130 aa, Triticum aestivum
  unsure (1)..(130): unsure at all Xaa locations
  Clone ID: PAT_TA_58586.pep
MAGVGSSSSGQPEGGFHLMSCLKEVPTLRGDNHTEWRKKVELAFVCADLDWVVDEQXPVRPIEPVREATDDDVAWAKKRGDYAPLEMSYIIENQKWVNANKKCMTFIKNTIESTIVGSIAECKEKKKRPP

SEQ ID NO: 164169 - protein, 45 aa, Triticum aestivum
  Clone ID: PAT_TA_58587.pep
LVRHYCISSTEQWTVNTRESSIPYESATTYTLSCCFCKKKKKKGP

SEQ ID NO: 164170 - protein, 278 aa, Triticum aestivum
  Clone ID: PAT_TA_58588.pep
PAGPGALRHKDRAITKKIVQHAEKRGCKGLFITVDAPQLGRREKDMRSKFTDPGSHVQEGTDTDNSQGAARAISTFIDPALSWKDIAWFQSITSMPIILKGVQRVEDVLKAIDYGCQGVVLSNHGGRQLEFARSAIEVLAETMPILRERGLENKIEIFIDGGIRRGTDILKALCLGARGVGIGRPFLYAMSTYGEAGVIRAMQLLKDELEMNMRLIGASKIEDLHPGMLDLRSLFQHGAVPSDNLSSTVYDPLAVPAQRPKGWEQGAPRLSCRKSHLI

SEQ ID NO: 164171 - protein, 127 aa, Triticum aestivum
  Clone ID: PAT_TA_58589.pep
PAGSGLHSNRLKLASNHISSIQHPTTMERPSSSSDTASILSGSTVFSKEAQISVSVSDSPTKAEIDTLTSDASKQQRKSMRQRVRNVVADLGRPPTTRDDLKSGNATQKYVDVGPASGTVLMGSTTV

SEQ ID NO: 164172 - protein, 96 aa, Triticum aestivum
  Clone ID: PAT_TA_58590.pep
VGHRRDSWFFVQVSSRFINSNSGFSWRHVTTIVTNSVLMSSLSRDKIYSGYQVYRLRISIICKSHAVTKYAPLHLTFAMRPCHRVEVLSLVQWFVV

SEQ ID NO: 164173 - protein, 187 aa, Triticum aestivum
  unsure (1)..(187): unsure at all Xaa locations
  Clone ID: PAT_TA_58591.pep
MTCLLTSYKMTSRNANIDDEDLTAHACCAPIQNLASSRVISRELHEDKRPFFHCPIFGPLSPDNESSDAREHCANERTFLSYLPLSVYMAIVSETITLSFHLKSEASPLXLPMAKPLGTIFWALSDMTLFAGMANYIRTDNKNSKRALIVQIGWNTMXVFSLTTGSIIRTCIILMDVAKVRDSSPNS

SEQ ID NO: 164174 - protein, 76 aa, Triticum aestivum
  Clone ID: PAT_TA_58592.pep
KKWSSQIFMRMLSHILSLCPFTCLSDLLDERKIQRRGHNVLLMQQCQGGVMSSKCSQVWIIMHLVLASRAVAGARS

SEQ ID NO: 164175 - protein, 112 aa, Triticum aestivum
  Clone ID: PAT_TA_58593.pep
RPGRVGFLKTIENEQTALACEAERALMRALEGGCSVPIGVETKWIDDKLRMKATVVSLRGDEGVDCEIAEAIKTHDEADKFGKKVAETLVEQGAQKILDAINETRQVPETVK

SEQ ID NO: 164176 - protein, 167 aa, Triticum aestivum
  unsure (1)..(167): unsure at all Xaa locations
  Clone ID: PAT_TA_58594.pep
AGRFGDAIIEQXHGRHGLRLTRILREKGKLDEKMLPAAALMKKGDVQGKMLAMQMAGIVDVQEVPKDSSRLANRTLLFWYFDKERAQTQALDDIYKAMLRCLQTLEVERHKERNILSFVERKDVQGKEEEVMTAEHYNKYNTHLEVQNKLLGQLMRLDELVSVLRDY

SEQ ID NO: 164177 - protein, 71 aa, Triticum aestivum
  Clone ID: PAT_TA_58595.pep
SKKTWRSVWPLASLAYEANWRSAGQYVYFLINLYYCTWEHEAACRFCISYSFFHSFVIKTMLTKKKKKKAP

SEQ ID NO: 164178 - protein, 114 aa, Triticum aestivum
  unsure (1)..(114): unsure at all Xaa locations
  Clone ID: PAT_TA_58596.pep
CSSCRGRWFGACGNRTCVGMVSLFILPSYRSFGDVPYQKKLAMTKPEPRAMLRFRTRFRRSIPMMGWTAIVTDLFVRSCSGEEAERSRVAEVLRISMGVFFWFFFFFFFFFXFF

SEQ ID NO: 164179 - protein, 135 aa, Triticum aestivum
  Clone ID: PAT_TA_58597.pep
PAGSGDALKQGNATELFKRAKSAVDSGDLGDLEKYVKDATEKVKSKGNELAGGWVDIREVHQGDTQRRRDYGKAPAAERGCRQAQGGGREALQGDRRGATTGVGEEVRKGSGDCWRGQEGRQEGGQIKAQNCTLL

SEQ ID NO: 164180 - protein, 152 aa, Triticum aestivum
  Clone ID: PAT_TA_58598.pep
AGRVPNIPHHQQSTPSSNNILQHFQHFSTLPKPTSSYKMQFSTLTTVFALVAAAVAAPHSSGGNNPVCSAQNNQVCCDGILNCPIQVLGSNCNGNSYCCKTDAPVVSFTHTLYKRLVSNFLRALSSTLLSSTVSSSSRGPVALAARSSLSEC

SEQ ID NO: 164181 - protein, 86 aa, Triticum aestivum
  Clone ID: PAT_TA_58599.pep
PAGSASRSLTVLRATRSPSRTSPPRSSLPSLTRPSSKRSSRPERPSSQARRMVSSSRSRSLLKQQTKPNRSIIRSIIPKKKKKKAP

SEQ ID NO: 164182 - protein, 209 aa, Triticum aestivum
  unsure (1)..(209): unsure at all Xaa locations
  Clone ID: PAT_TA_58600.pep
MKAAGKKYFGTALTVRNDAGETNVLNTKGEFGSITPENAMKWEAIQPNRGQFNWGPADQHANAATQRGMELRCHTLVWHSQLPSWVANGNWNNQTLQQVMKDHINAVMGRYKGKCXHXDVVNEALNEDGTYRDSVFYRVIGEAFIPIAFRMALAADPTTKLYYNDYXLXVWXGAKTAGAIRITKLYQSYGLXXSDVVGLQAHMTSESTL

SEQ ID NO: 164183 - protein, 73 aa, Triticum aestivum
  Clone ID: PAT_TA_58601.pep
RPGRENHTKAGRVPWLVTLLLQHLLWRKKRTDLLQRSYETYLSGSISFIVLHRSGGFIQFEDFTVDVKLQEPL

SEQ ID NO: 164184 - protein, 107 aa, Triticum aestivum
  unsure (1)..(107): unsure at all Xaa locations
  Clone ID: PAT_TA_58602.pep
LRPAGSGTGVIYXVTKSAVGVIIYKQVKHRYIEKRINVRIDHISQSRSREDFLKRVKANAEAKREAKATGTVVQVKRQPLGPRGAHTLSLSENPPMTVTPLAYETTI

SEQ ID NO: 164185 - protein, 72 aa, Triticum aestivum
  Clone ID: PAT_TA_58603.pep
GGRFEGRPGSGTSHHHTGMINHSNLTRLRPVNQRKAAKMIRRVQGMGIYPSVHAHPEMLREDFFSRNKYDQP

SEQ ID NO: 164186 - protein, 145 aa, Triticum aestivum
  Clone ID: PAT_TA_58604.pep
MAGGKPRGLNAARKLRTNRKDQKWADLAYKKRALGTAYKSSPFGGSSHTKGIVLEKVGVEAKQPNSAIRKCVRVQLIKNGKKVTAFVPNDGCLNFVDENDEVLLAGFGRKGKAKGDIPGVRFKVVKVSGVGLLALWKEKKEKPRS

SEQ ID NO: 164187 - protein, 72 aa, Triticum aestivum
  unsure (1)..(72): unsure at all Xaa locations
  Clone ID: PAT_TA_58605.pep
PAGFREKKKKKKNNDTLSHESVXNSRPRNYGKGSRSCRVCKHKAGLIRKYDLNLCRQCFREKAKDIGFNKYR

SEQ ID NO: 164188 - protein, 106 aa, Triticum aestivum
  Clone ID: PAT_TA_58606.pep
RPGRVWEQVGASGEEVTETLQLSGMESIADATEQLTKALSLQPLEGTDVPVNQTTHTLKLLGKTVGGGRVVANVRMAFSSKTGVTTKITVRSEEENVAALVIASVA

SEQ ID NO: 164189 - protein, 97 aa, Triticum aestivum
  Clone ID: PAT_TA_58607.pep
MSEAYERERQNNARLDELSAKVSALRGVTVDIYDNARAQDVIDNTSDTFSSMTTQMKGSAGRLTRMGASGNRVAILKLSGIVIGVFLVLFYGAKLIF

SEQ ID NO: 164190 - protein, 54 aa, Triticum aestivum
  Clone ID: PAT_TA_58608.pep
GPFFFFFFLGRCRNWIQVSWDSYTQLGETPGKFCCRYPVKSFHFRDTADLERPH

SEQ ID NO: 164191 - protein, 134 aa, Triticum aestivum
  Clone ID: PAT_TA_58609.pep
QPGPIVPPITNQSILSFNMGIPCPREKNSGFGGGHRLGRSSLDPDGGFAPVPSLGVVADGFPISGGNPLGPRGVLFLPLGKFLFGWERFGARHGAGVDFFFFFFFFFFFFFFFFFFFFFSRTKKFNDRNLAGGI

SEQ ID NO: 164192 - protein, 267 aa, Triticum aestivum
  unsure (1)..(267): unsure at all Xaa locations
  Clone ID: PAT_TA_58610.pep
MASVSRIPHILEPYLALPSEGSLNLVTSVLGASSNWLLLRHVYSYLRGSTDGDESTKDTGVVLVSFMRDGAFWREGSTKLGLDLDAHSRTGRFTFVDGLTGTYGDSKPQTPGARKERVLRGTNLADIKKEIEGAIGDLKASRKVLIIDQLDALLAITDESTTSLTLQNLVLGLRSLVHSTLLTLSADTPLVAAQATTLEREHASLVLSTAHVADAVLALRMLDTGTARDVSGVVRITGPGIEXNGRXXEYXVHVVADGGVXVFERGT

SEQ ID NO: 164193 - protein, 129 aa, Triticum aestivum
  Clone ID: PAT_TA_58611.pep
PAGFGRSTIGHDHHPQPGSRSCSSSIFFSAGSPGKGRTLPSIEPILSSRDGSRGERRRARCRRGAGRSEHGGGVGGRGRRRQEGRPGRGLPAHGRRARRHLPRALIDRSVDGRRLGEFIFVSLHLCINL

SEQ ID NO: 164194 - protein, 162 aa, Triticum aestivum
  unsure (1)..(162): unsure at all Xaa locations
  Clone ID: PAT_TA_58612.pep
AGRAPDIGGHXSGETIVPLFSKASPSVQIPDDKYDALVNRIQFGGDEVVKAKDGAGSATLSMAYAGFRFAEKVLRAVKGEKGLVEPSYVYLPGVPGGEAIAKETGCDFFSVPIELGPNGAEKATNPFEGITEKEKALLAKATEGLKGNITKGVSFVHNPPQK

SEQ ID NO: 164195 - protein, 54 aa, Triticum aestivum
  Clone ID: PAT_TA_58613.pep
FYYKLCSRYKYMYIYTTQSLIVVSNLKPISTCYPDFFFFFFFFFPGTGPGLEAA

SEQ ID NO: 164196 - protein, 40 aa, Triticum aestivum
  Clone ID: PAT_TA_58614.pep
IISFIYPIVPNLLEVLANERTKEVLLANLNTLLSHPNRPA

SEQ ID NO: 164197 - protein, 64 aa, Triticum aestivum
  Clone ID: PAT_TA_58615.pep
MVRLGTQLPRHGYIRPKADTHAMGPYRTLAFSYLVFFHALRLMFSRFTRRRSRYKPTLDFWFAT

SEQ ID NO: 164198 - protein, 233 aa, Triticum aestivum
  Clone ID: PAT_TA_58616.pep
MSTMPASHGHSEACCNIPPVITKGYEAKGTYKDIGGYKTYVTGPVDAKKAIVVIYDIFGYFEQTLQGADILAFSDAHQKYKVFIPDWFKGGPCPIEIYPPDNDDKKKQLGEFFETYPPPKVAGQVPDYVKAVKEQDFSIEKFGILGYCWGGKVVALSVKADSNPFSIAAQIHPAMVDASDAEGLSVPTMLLASMEEPEEEGQKFEDNLKVAKHVETFKDQIHGWMAARADLND

SEQ ID NO: 164199 - protein, 81 aa, Triticum aestivum
  Clone ID: PAT_TA_58617.pep
AGRVGIPCIFLSSWMLNPTGANLGGKCGYVWAGTGAFCLLCAYIWLPEMKDRSYREIDILFNRKVQARKWKKTVVDIHDNE

SEQ ID NO: 164200 - protein, 125 aa, Triticum aestivum
  Clone ID: PAT_TA_58618.pep
AGRVPDPRYQRRQARKSSFLPSHLPLHLHLPPRLVYSSPLYTDSTSTYITSSTYLSIFSRSSSLFLSLTRRRGSEHQNPTRLVTPLSICPLHFFQKKKKKKRKRKKKKEKKKKKKKRKKKKKKAP

SEQ ID NO: 164201 - protein, 181 aa, Triticum aestivum
  Clone ID: PAT_TA_58619.pep
PAGSGQEKLCYVSYDLELDKRLSEDTTVLVEDYTLPDGRVIRVGSERFEAPECLFQPHLVDSESPGLGEFLFNTIQSADVDIRSSLFKAIVLSGGSSMYPGLPSRLEKELKQLWLTRALQGNPERLSKFKVRIEDPPRRRHMVFLGGAVLANIMADKESMWVTKAEWEEEGTRVLEKLGPR

SEQ ID NO: 164202 - protein, 101 aa, Triticum aestivum
  Clone ID: PAT_TA_58620.pep
VRRSGGGSSREISKRCRRIAPAVGVSATSNAPQSQPPIAVQEGDFVPTSLDDIVTEEPPHVADPKSDDVPILNKAAVLEARKDKPAEEKPVEEQETPPGQE

SEQ ID NO: 164203 - protein, 142 aa, Triticum aestivum
  Clone ID: PAT_TA_58621.pep
MASESRLYTFSGESKDHLRKFRLTTSRAKGPQAVIYLIDKHTYEIRQDEDKTVYTSLEEVGDDLPDHAPRFILLSYPLTMGDGRLSVPYVLLFYLPVTCNAEIRMLYAGAKELMRNTAEVGRIIDIETAEELEEIPDKLKSE

SEQ ID NO: 164204 - protein, 146 aa, Triticum aestivum
  Clone ID: PAT_TA_58622.pep
MLFQNMLFAATIGLAAAASQPTGQECGRKVAPCSKDAVCKPTLANCKDINKCPGTCYFKNEYQSCGGFRAKPPPPCKKNTHCVDDPRTPGDCGMACDKPGICAPKKPQSCGGFAGLSCPKGLYCYDDPKDECDPKKGGADCPGICL

SEQ ID NO: 164205 - protein, 146 aa, Triticum aestivum
  Clone ID: PAT_TA_58623.pep
AGRFGTSPEQQSIHIVSHLIGQVSTLLHYSISLRSQTFNPTIAIMRLAAIIAATGVIFTASVSGLACKDGIKYCSYNLNSGGHFWTEDEIWSQLQSEGLPDGYTKGHIQHTLFKCQDRWYWSKAHLYYVEWCANSCQNGGGGKDDR

SEQ ID NO: 164206 - protein, 79 aa, Triticum aestivum
  unsure (1)..(79): unsure at all Xaa locations
  Clone ID: PAT_TA_58624.pep
PAGFGITGRINHPLTTIWLPVKKRLCMTAATFNAEMNQXQIAANIMLAIDYLVSLLTTGXTNDGTLTITASMSPPNTLN

SEQ ID NO: 164207 - protein, 101 aa, Triticum aestivum
  Clone ID: PAT_TA_58625.pep
NHSSRLHLLVYHQINTTKMDSAGNRSVLSNDMQELRTGREEISHKIQGHKANMSNPNTSEASKENSKKEIESLGGDVNHYGQESDPRSKSAAENLEGSRAA

SEQ ID NO: 164208 - protein, 80 aa, Triticum aestivum
  Clone ID: PAT_TA_58626.pep
AGRVGVYLPGVPGGEAIAKETGCDFFSVPIELGPNGAEKATNPFEGITEKEKALLAKATEGLKGNITKGVSFVHNPPQKL

SEQ ID NO: 164209 - protein, 137 aa, Triticum aestivum
  Clone ID: PAT_TA_58627.pep
PAGSGLSSLTHHPVSFLRNQLLILLDHTTMAAQLRLQDSKEKFQAAYNAAVTQKESSEKDWKDEKEAGMHDQEFDQWFPINAPAYAVAFQQYRGARAAYEAALHAVDEQAARSWQEKVRQAVIDNKLNYNILIGPDE

SEQ ID NO: 164210 - protein, 220 aa, Triticum aestivum
  Clone ID: PAT_TA_58628.pep
RGLFFFFSKRDGCFRQAIRRRLCVITRRPPIESSNSSSTQFSPILESIRTAGVTSGQELLSIVKPRDSLDWLSLIILLDQIPRNSYRGDKASVCFTYFDPLAVQVSLKAIAQGIPDKAPEIRWVFSHRNWFYMPLMHSEDLSAHDEAVLAFKRMNEDILSLTTGTGGGDEYERKAREVVQSDPDKAKTVGQTSLKFEERHRVIIERFGRYPHRNKVLDER

SEQ ID NO: 164211 - protein, 78 aa, Triticum aestivum
  Clone ID: PAT_TA_58629.pep
AGRVPIQKHPCTLSIARVPGLRGLYDSVMQCMQVVAFLVTYPFIKGQFQSLGKVLIDAVKLMDSSQSHLAKKKKKKAP

SEQ ID NO: 164212 - protein, 245 aa, Triticum aestivum
  Clone ID: PAT_TA_58630.pep
MDEQVDLTTIPVDPAGKEDSSDVKDDKPVTVFHDKDNFNVKHPLQNKWTLWFTKPPSGKGDNWNDLLKEVITFDSVEEFWGVYNNVTPVSELSLKSDYHLFKEGVRPEWEDPQNKHGGKWSYQYKDKRNIDIDRLWLQVMMGAIGETLENEDDGEVMGVVVNVRKAFFRIGVWTRTIGKSIPGRGEGDVAGGKGRSGEKGKEILLSIGRRFKEVLELPASEQVEFSGHTDSAHSGSTRAKAKHVV

SEQ ID NO: 164213 - protein, 116 aa, Triticum aestivum
  Clone ID: PAT_TA_58631.pep
PAGPYVELEVASKDRIDPVSFTIVESNHRVIAGLAYNVLLHEADTLCLDGSFDTQNVDQYTHKLVAGFTLLSLNCFYKMPLFRFYHKCALKYSDSRDVPLHRHALCTLHDCICLVP

SEQ ID NO: 164214 - protein, 169 aa, Triticum aestivum
  Clone ID: PAT_TA_58632.pep
MMASFHFARHPVRTTVSFVKAACLVHLGITYGYTVSPAQGPSMLPTFTVDGDWILCDHTRRYGRGVSVGDLVVYRIPIFNNQWGVKRVTGMPGDYVSVGTPGEQGEDLMIQIPEGHCWISGDNLPASRDSRHFGPLPLALISGTTIAKILPWNERQWMKTGLEKVDELD

SEQ ID NO: 164215 - protein, 144 aa, Triticum aestivum
  Clone ID: PAT_TA_58633.pep
MLPMMTGMQGQNQFMPMQAQPTGFQQQFPATQPMYGAPTGINSFLPPALEPQRTGMPGMLPQATGMSNMGNMGGMNNAPTPQPLQPQQTGPPPPVRFGVTNDANKLAPQATGRRANLSQATPQNPWILIQESPVTIGRCWRAIL

SEQ ID NO: 164216 - protein, 99 aa, Triticum aestivum
  Clone ID: PAT_TA_58634.pep
RHGSSTADKLKMGALMGGTVGVIMGFVFGTVNIFRYGAGPNGIMRTLGQYMAGSGATFGFFMSIGSVIRSDTDPKLHDMYMRAQRRPIMLMANPAWRKS

SEQ ID NO: 164217 - protein, 96 aa, Triticum aestivum
  Clone ID: PAT_TA_58635.pep
KLREQPHHIQRIETTSSMCVNPPTAKIDEASNRMVVKISILLSTYSALASTLELNAMKALTGGQLTDLARGKNQIYHFDTSASAMEKPTANSLLIL

SEQ ID NO: 164218 - protein, 67 aa, Triticum aestivum
  Clone ID: PAT_TA_58636.pep
RPAALSWDLTLGITSGWLNPALERLMWHTMNIMVDGIMTIRWSGTRRCWIDHYQMLTNTKHHNNIQR

SEQ ID NO: 164219 - protein, 81 aa, Triticum aestivum
  Clone ID: PAT_TA_58637.pep
SSNNGKFLKKPRRLKHVQAGGGDDDDDSGLFQGQILEDVKLKYSFSAPLVVAQPRPVPSSERHNPDRLLFRHVADDEGYAK

SEQ ID NO: 164220 - protein, 92 aa, Triticum aestivum
  Clone ID: PAT_TA_58638.pep
AGQVRLPFVIMARVTYVHHYYPALYFAILNFGFLIDWFTRNRNNTIKSIVYGVLYTVIIGLYIYFIPICWGMTGPHKEYKYMKWFDNWRVTD

SEQ ID NO: 164221 - protein, 100 aa, Triticum aestivum
  Clone ID: PAT_TA_58639.pep
GREKHKTLPAYSLSTLLSHHTTATTKKRTDWGHGWKKLLLLLFGEERWRRFSSRRPLTRFRMSPAWIEIFPEQMKDMWQPEQRALLDQIILVGERQSRLS

SEQ ID NO: 164222 - protein, 266 aa, Triticum aestivum
  unsure (1)..(266): unsure at all Xaa locations
  Clone ID: PAT_TA_58640.pep
AGRFRTVRNTDMIKDLEGPGMSCFPLEVTDPKSIEACKNQVAELTGGRLDILVNNAGRTHTIPALDMDLDDVRATYEVNVFGPMSMVQIFAPLLIEARGLIINISSTSTLVPYIFGAIYSSSKGAINVWSRALRLELKPFNVRVMNAVTGTVRSNIASRTHRSLPQNSMYKPIEDFFQQRLTFSQRTATMPTEIYAKKLVTAALKGEGYLGGLIGGTPDWFYAGGMATKVWLLSCLPRXVSETVIGIFFNIXSLSKRIQDARRKLS

SEQ ID NO: 164223 - protein, 62 aa, Triticum aestivum
  Clone ID: PAT_TA_58641.pep
RPVPVYMTHESRYAWHGVPKVLKDTCPAYLEDWPARDDGKFSEWRGWMKTKRINLNVRQMRD

SEQ ID NO: 164224 - protein, 223 aa, Triticum aestivum
  unsure (1)..(223): unsure at all Xaa locations
  Clone ID: PAT_TA_58642.pep
MQRHTFIRAALGAGDVPRGVPRASRASSTTLCPTKPGAPIRRAASRCPTAAPQSRPPRRSRPAIGPSRRTPRPGRALRPPRRXSAPAAASPATANAAGTSTGLKRRTRGAASAKPVSVASRSAAAASVATRGSMRSADPRLSPSMRPAVGTVAASHHAAGARALTPSWPWRAQAVEVEGDDDKALIWRAEAGMCRAAAAPTGGASSRMSRAVTGDGRVGRLPG

SEQ ID NO: 164225 - protein, 157 aa, Triticum aestivum
  Clone ID: PAT_TA_58643.pep
MQEFYVRFKGPAETPFEGGTWKVHVELPDTYPYKSPSIGFVNRIFHPNIDELSGSVCLDVINQTWSPMFDMINIFEVFLPQLLRYPNPTDPLNGEAAALLIREPKSYDAKVKEYVQKYASKEAADEAGAESEDDDELSSVASFGDDDDEPAGQMDDV

SEQ ID NO: 164226 - protein, 243 aa, Triticum aestivum
  unsure (1)..(243): unsure at all Xaa locations
  Clone ID: PAT_TA_58644.pep
RGFFFFFSGGTNVSFSLSFEYLDQILLPTLEERFGIQVERALEHRGWSIGPQSRGQISLKFHPLKIGQSLRYKAPKQRKYPESYEIKAXSRWYILLVAHSTSGLRWGHDWLGSLPKKTKNRDRFTDQVSKQLCRGLCKEVEVGGQVDVHLQDQVVVFQALCEGYSSFPRDDGPGGSSSRVVIDDMGNLDIGDDRMRKEKTQEPFGYGSLHTQTARWVASEMLPNVEFYNKGDLSKAQVPDPAG

SEQ ID NO: 164227 - protein, 108 aa, Triticum aestivum
  Clone ID: PAT_TA_58645.pep
AGRVRMVSLIPPSTSFAMILFIFSVLDLLTFPWLLLDLESSYLVGTTLLFPMTVARMARSPTHRMYSWMVRNLGGLSPLRPAKVLEYLKVVKAKRRNNKIGCRVLEGN

SEQ ID NO: 164228 - protein, 125 aa, Triticum aestivum
  Clone ID: PAT_TA_58646.pep
MGNFHESSNNIWLEDGHILHAECGNGEGDYVESTLDLDYYIGNDDGSFSWGGENFSGSASNITLDIEGDDNIPVLRAELNPMDGDPVEANVNLSEHRQRLWHSYLPRLNWIENSTCDEKRGSIKQ

SEQ ID NO: 164229 - protein, 60 aa, Triticum aestivum
  Clone ID: PAT_TA_58647.pep
PAGSGKNTALGGNSKTLMFVMVSPLETHLKETLTSLRFATKVHNTHIGTAKATKKVRDST

SEQ ID NO: 164230 - protein, 94 aa, Triticum aestivum
  Clone ID: PAT_TA_58648.pep
GAFFFFFFLLKYTIVWSTLGQPTLHCALLHGFELCCFTEDGYIEMPSPTSQKRLKSCFRTHKATILFLHAQPSANQPLFDTQSTESSRNDAIYW

SEQ ID NO: 164231 - protein, 132 aa, Triticum aestivum
  Clone ID: PAT_TA_58649.pep
RPGRVKKLNKNKKLIKKLARKYDAFVASEALIKQIPRLLGPGLSKAGKFPTPVSHADDLTGRINEVKSTIKFQLKKVLCMGVAVGNVEMSQEQLVGNIMLAINYLVSLLKKGWQNVGSLTIKASMSPPKRLY

SEQ ID NO: 164232 - protein, 72 aa, Triticum aestivum
  Clone ID: PAT_TA_58650.pep
RGLFFFFFSCHQISTYFLFNVIFNKQYPPYRTMPIISVQKKCISLNDKCTHRYKPERNQEELMSVKTHKSQP

SEQ ID NO: 164233 - protein, 61 aa, Triticum aestivum
  Clone ID: PAT_TA_58651.pep
RWHDLTFLGNTRYVLLFDFVVGFGPEHSFAYGWKVVYNFIMALIIYMGKIAFTKKKKKKAP

SEQ ID NO: 164234 - protein, 87 aa, Triticum aestivum
  Clone ID: PAT_TA_58652.pep
KSYPLNMKNAFFAVSQNPFLVVSLCITKNASVMPAHIALCVKQVAKENYNSFIRRRVRVKPLALVDRDGRHKPRGTARWQVVLLCVE

SEQ ID NO: 164235 - protein, 102 aa, Triticum aestivum
  Clone ID: PAT_TA_58653.pep
SSAKLYMVLLLSNNSFYIVPSAVLAPVSFQLPRHRVMHVLALCHKLPGQINEVLHDDFSYKSSKQPNAKSLSLYQPTYWSPLFSPLTSFYPSCSWQNHPQMR

SEQ ID NO: 164236 - protein, 114 aa, Triticum aestivum
  Clone ID: PAT_TA_58654.pep
AGRVGPREGAGLEAFVDSSDTGYTVNGAPVENGKANAHQVAMNSIENSKLHASGPEGVDGLQQESSGSSSSDEDYVLGNSKTNGQQEKGILSDVKEKVVGLQNQVAKAVTVQSQ

SEQ ID NO: 164237 - protein, 41 aa, Triticum aestivum
  Clone ID: PAT_TA_58655.pep
HTIRAENLAYIYELHREIKGKHYTGVTELTREFMLDRNLYH

SEQ ID NO: 164238 - protein, 94 aa, Triticum aestivum; identical to SEQ ID NO: 141108
  Clone ID: PAT_TA_58656.pep

SEQ ID NO: 164239 - protein, 85 aa, Triticum aestivum
  Clone ID: PAT_TA_58657.pep
GAFFFFFFACSNVCCILLCICIGQSVHLSNPRAKIPDLYPLSCSASPAKPYIHPSVQLAENLHQQHLVLFPVINPKIWTRHFSRR

SEQ ID NO: 164240 - protein, 70 aa, Triticum aestivum; identical to SEQ ID NO: 141235
  Clone ID: PAT_TA_58658.pep

SEQ ID NO: 164241 - protein, 49 aa, Triticum aestivum
  Clone ID: PAT_TA_58659.pep
GAFFFFFFAVNMLVYCQESHNTPRVAHKWSMMAPRYFPRLWRSSLLQSE

SEQ ID NO: 164242 - protein, 31 aa, Triticum aestivum
  Clone ID: PAT_TA_58660.pep
GPFFFFFFFFFFFFFFFFFFFFFFFFFFFRQ

SEQ ID NO: 164243 - protein, 241 aa, Triticum aestivum
  unsure (1)..(241): unsure at all Xaa locations
  Clone ID: PAT_TA_58661.pep
MFSKALTALALVAPLVSAQTFTSCNPLTTTCPPDPAFGKDTVHCDFTKGACPDFKEDAGTSITHNANGAVFTIGGPNQAPTIATGKYIMFGRVDIEVQASTGVGIVTSAVLQSDCLDEIDWEWLGGDNAQVQSNYFSKGDVSTYNRGAFHPVANPVGQFHVYSIEWIPALINWIIDDVVVRTLTYEDAKGGSAFPQTPMQIKLGTWCAGSPDAAEGTIQXAGGLTDFSQAPFKAYYKSISI

SEQ ID NO: 164244 - protein, 110 aa, Triticum aestivum
  Clone ID: PAT_TA_58662.pep
AGRSGKIQLPARISPPAHDACPRVLRAAAGGPKPNITGFNMRAFQASTGQPRYDPWERNEAWRYQGPYTRWNRLKSGFPGLGIATVAFTAYCGYEYFFLEDEHHHGEEHH

SEQ ID NO: 164245 - protein, 129 aa, Triticum aestivum
  Clone ID: PAT_TA_58663.pep
MSESGYSEGEYVIDANGNFLLDAQGNKIPFAAPPSTYSGSDGEAEEYATPATTVPPSGKHDSPSTSTGEGSGGNGGQWTTGTQLEPQDYTGQGYGTPGWETVPRHHHPTRLSDVMEEEDERSRASTSRV

SEQ ID NO: 164246 - protein, 90 aa, Triticum aestivum
  Clone ID: PAT_TA_58664.pep
YQTPVSACTNIKIVRCSDPKLQIRLETPRQSPGLLLVSPSQRHRKGKIVFVAATGIKHERIMNGRFVWQVFGGGSWSLVWGYFFFPGPAG

SEQ ID NO: 164247 - protein, 32 aa, Triticum aestivum
  Clone ID: PAT_TA_58665.pep
SSPIIYSIARLSFSLYLLILNILAKKKKKKGP

SEQ ID NO: 164248 - protein, 73 aa, Triticum aestivum
  Clone ID: PAT_TA_58666.pep
HNRYSNTSCTNDLLKAPCITSAAAAAGCTDIACQCASSEVIQASALGCVVGNCGIPVALSVQAAAAAVCTACA

SEQ ID NO: 164249 - protein, 252 aa, Triticum aestivum
  Clone ID: PAT_TA_58667.pep
MSFKDKNGSDESLLHNEEGSEGTDWTPLKQRGSRKGHAWLAFNVFFFLISLCLFVATYTRINVISEMEHVRKTSFYSPVLDSINFKLRPIETEGGLFEAKNPTKWRNSVKPDSAVDEAWEDLENIRVFPITENEVRRLGKDPELLVKFPPEYGLGDNAYMAQIDMFHQIHCLNLLRHLAWAEYHRNGTAKKPFSELHWIHVSHCTDILMQNLMCNGNLDIITFNWVETQTNPFGLWCQSSVQGFRCDIRVAG

SEQ ID NO: 164250 - protein, 171 aa, Triticum aestivum
  unsure (1)..(171): unsure at all Xaa locations
  Clone ID: PAT_TA_58668.pep
DIETADDAKYNYIYFHIYRCNPNTPTEKPRLPNNTLNLNKTAPMILDVLIRIMNDFDPTLTLRPMCRDDICGSCAMNINGHNTLACLCRIPTEAASDVKIYPLPHTYVVKDLVPDLTHFYXQYKSIKPYLQRDTPVEDGREYRQTKEDRRKLDGLYECILCACCSTSWPSY

SEQ ID NO: 164251 - protein, 74 aa, Triticum aestivum
  Clone ID: PAT_TA_58669.pep
AGRFSKSCCCRCLYPKWPEIEQLQDRIDNPDAYASAAPAAAAFGDDAPAAEEAYKDQSEDDDDDEGCRGLFYYM

SEQ ID NO: 164252 - protein, 79 aa, Triticum aestivum
  Clone ID: PAT_TA_58670.pep
VRRSRRPVEIWGGLCTFAFVYTYFLVPETKGLSLEQVDKMMEETTPRTSAKWRPHETFAQTMGAGDMKIVPKTEHDDHV

SEQ ID NO: 164253 - protein, 131 aa, Triticum aestivum
  Clone ID: PAT_TA_58671.pep
CGAQAGRFQTSTQDASTLSQIRKLKANASASVSSSFFQASASYSNEKQSNESKSSDSKSLNKSMAWEATGGDTLLCNSPAQWCSTVSHYENWRIVNQDEVVRLSEFLAEFPEVKKINENLVEYFKKCADTY

SEQ ID NO: 164254 - protein, 71 aa, Triticum aestivum
  Clone ID: PAT_TA_58672.pep
FFSSFSEFITRFIGRQPTHPGLVCQRVPSSHQLMELSANSPRCTRTSYHGNSHSTYSTDNQIRCPYVHVTI

SEQ ID NO: 164255 - protein, 199 aa, Triticum aestivum
  Clone ID: PAT_TA_58673.pep
PAGPDQYLGRGAMSRGRMTITSALNTVVSGNPFLNDPEDKKAVVKALDNLRKALSGVKDLVWLQPAPSVSSQQYVDDMVVSWSNRRANHWIGTNKMGKDDGRQGGTAVVDLNTKVYGTDNLFITDASIFPGMVTTNPSAYFVTASEKASDAILALPVSKAQEPYKQCGGTEWNGSMQCGKGYYCKALNPFYGQCYPEGK

SEQ ID NO: 164256 - protein, 83 aa, Triticum aestivum
  Clone ID: PAT_TA_58674.pep
RAAFVSPYTASPEETEEHAPRWVELDIIGRQQHLEPLNITTTRASSPSMALTCLSRDYVVIITIKSTERGPCWALRCRPGLPT

SEQ ID NO: 164257 - protein, 104 aa, Triticum aestivum
  Clone ID: PAT_TA_58675.pep
QCLYSNNSSQSHRSRKEHRNKIKNSSTSRYTSLKGTDPKSRLPHPHDLHGNMMDLTEAKRGQVLGPLTTRPTNIAALLWRIPIAPIRTTHNTTCALEPWRIPYD

SEQ ID NO: 164258 - protein, 161 aa, Triticum aestivum
  unsure (1)..(161): unsure at all Xaa locations
  Clone ID: PAT_TA_58676.pep
PAGSGGDHLNTVEFHWYSAEEXGLLGSQDIFNSYSRLGIQVEAMLNQDMVGYKGRDGIERFGLVTDFTSPSQNEFLKLLIDEYADIPYEESTCGYACSDHASAHRNGFPSSFLFETPFGNHNPYIHTPNDTMAHVDFDHVMQHAKVTAGFVYELAHRDFTA

SEQ ID NO: 164259 - protein, 56 aa, Triticum aestivum
  Clone ID: PAT_TA_58677.pep
GAFFFFFFPFDSRLLTYSPMIQYLALIHQYFALASKQTSLVPRTHPFCLCRDTRST

SEQ ID NO: 164260 - protein, 56 aa, Triticum aestivum
  Clone ID: PAT_TA_58678.pep
CGARGGRSGSPSTHYYNTLFNTSFHPNIFTTSGDCGCSGASSCNCGSSCSCSGCGK

SEQ ID NO: 164261 - protein, 91 aa, Triticum aestivum
  Clone ID: PAT_TA_58679.pep
MTLIQGAIAAQFDSYGSSAMWFTGAYLIPMSSLAPVTGRLATIFPPRTLILPIAALIATGGLVCTVSTSFGVFVAGRVIAGTGAAGPEPAG

SEQ ID NO: 164262 - protein, 160 aa, Triticum aestivum
  Clone ID: PAT_TA_58680.pep
PAGSRETASPEIVEELLIRGAETKVRMLGGQTMLTYSIDVNHRNHVKSLLSYGVDVNEVDGLNRTPLMLAMLRLDFNMAKLFMDYGADAMADVNESAVKFIKALKRRDFLEILGLTGEPRLHQVRGLPQVRDSPTTSPSTTEEHAPDVPPPSYEVAAGKA

SEQ ID NO: 164263 - protein, 117 aa, Triticum aestivum
  Clone ID: PAT_TA_58681.pep
AGRVRANKKMLTGISHLDTTTFGGAKAYVNPETATVDPSGKVVVQLREAEPEAQLIAKEAKGRARVYDPSKRSKTEIKEADIWRTGRVADELLGGDAAAPEDDAVSSSRNYGLDDRQ

SEQ ID NO: 164264 - protein, 62 aa, Triticum aestivum
  Clone ID: PAT_TA_58682.pep
CRSIDRSMCHARARVLVTDRSNVFVIKSTRSNVKMRFLNLDHLDLHASMSTFLQKKKKKRTL

SEQ ID NO: 164265 - protein, 148 aa, Triticum aestivum
  Clone ID: PAT_TA_58683.pep
GRGGCRGALFFFFFLGRCYGFVGCWGLLVCVVGGKFYFFLFSFGFFQCMQAPIWYLPCATIEKWPSQLFIRMLYHFFHYVHSHVCLTCLMRDRSRDVLIMYSDETLSRNRDVSQVLSGLDNNGFSACSKSSRWCKKRRRGYSKSRETC

SEQ ID NO: 164266 - protein, 117 aa, Triticum aestivum
  Clone ID: PAT_TA_58684.pep
MGVKSDSHLNHGELRTSCVFSSQDALKAEQDHSAKNYQSLPIVFSRAQGASVWDPEGRHYLDFHAASTALNHGHCHPKLVATLVDQASRLTLTSRAFHNDIYPQFAHSEKKKKKRPL

SEQ ID NO: 164267 - protein, 204 aa, Triticum aestivum
  Clone ID: PAT_TA_58685.pep
MVEKLYVTYNDVHKMCQKSAEKLLLDFQPQLLIAIGGGGYVPARILRSFLKKGGAPNIPIQAIGLSLYESLGNDEVEAPGTKVTRTQWLDLTALGEMQNLVGKRILIVDEVDDTRTTLEYAVRELEKDVETARQKMGGTAPKTEFSIFVLHNKDKPKKGKLPDEMLATRYSAAETVGDVWINYPWEAIDIDEHDRNASLQTKSN

SEQ ID NO: 164268 - protein, 128 aa, Triticum aestivum
  Clone ID: PAT_TA_58686.pep
PAGFRTLTRRIFLQAAANSNPDVPSWSYLASYDYGTPILGTFHGSDLLQVFYGLLPNNAMRSVRTYYFNFVYNLDPNKGVTKYAKWPEWKESKKLMWFETANKNSIINDDFRQDSYEFIAANAGALVV

SEQ ID NO: 164269 - protein, 90 aa, Triticum aestivum
  Clone ID: PAT_TA_58687.pep
PAVSKEPKEEQAVPSPSAKTTALRPPRLLRLLRMPALLRRRVVRRSRLLSNRVLKSLGSEKPPKPYEGRWETRGMRDGGLLRRQLFICIC

SEQ ID NO: 164270 - protein, 141 aa, Triticum aestivum
  Clone ID: PAT_TA_58688.pep
MDAGGSGSGADLRSSIKKWKIIYPVYLNSKKTVAEGRRIAAAKACSDPTCIEIADSCAYLKIPRAIELDKAYPRDFFQVGRVRVQLTNDDGSPVNPAIRTKKQLMIQIAELVPKHHGRTKKQEPVAGPSVTTTNKKNKKKK

SEQ ID NO: 164271 - protein, 47 aa, Triticum aestivum
  Clone ID: PAT_TA_58689.pep
NFHALQYSCSSQIGNRLTGHYMLKVLFKQTSCSRIIYCESITEFHAK

SEQ ID NO: 164272 - protein, 52 aa, Triticum aestivum
  Clone ID: PAT_TA_58690.pep
GPFFFFFFSLALYTQYIYTFSSLSVTEKKCRCYVEYNSIIIVCIIINPTILY

SEQ ID NO: 164273 - protein, 173 aa, Triticum aestivum
  Clone ID: PAT_TA_58691.pep
MRPGVRSTVERLDRPSAYYQNRNKRRRDRDDESNQPQEPQVDPLANATTLYVGNLSFYTTEEQVYELFAKCGEIKRLVMGLDRFNKTPCGFCFVEYFTHQDALDCLKYIGGTKLDERIIRTDLDPGFEEGRQYGRGKSGGQVRDEYREDFDEGRGGVGRAIQAEERDEYAEGK

SEQ ID NO: 164274 - protein, 96 aa, Triticum aestivum
  Clone ID: PAT_TA_58692.pep
RPVPDLVTDTWVSMGQEADTQKRLKDFAGFQITNDLAKRGGAKADWKFMHCLPRHPEEVADEVFYSPRSLVFPEAENRLWAALSALEGFVVNKGKF

SEQ ID NO: 164275 - protein, 96 aa, Triticum aestivum
  Clone ID: PAT_TA_58693.pep
SFEVRIYDFFNRSSICSHGEYCWLVYSLSYIIPRGVFAHLLLREERQQVVSLILSYYHEHELVSIPIEIWTWVNINCRVLSNCLDIVYLHIGLSSD

SEQ ID NO: 164276 - protein, 121 aa, Triticum aestivum
  Clone ID: PAT_TA_58694.pep
MVYHITSNDELQKLLSSTTYVAVDFFADWCPPCKAIAPVYEQLSTKHSVPDVLAFAKVNVDHVQDAAQQYGITAMPTFMFFKEGKQVAVNGQAVIKGADPRTLGAAAEKLGGLAQKRVAGA

SEQ ID NO: 164277 - protein, 82 aa, Triticum aestivum
  Clone ID: PAT_TA_58695.pep
TNPRLLPLGTCAYASSLSLSCGSRRSSRSWDGGLGLSDGCFLGDIVWDVGWIRVYPAMLFVLVLGMSSGSVVYERKHLELEG

SEQ ID NO: 164278 - protein, 101 aa, Triticum aestivum
  Clone ID: PAT_TA_58696.pep
VFFKMALHLPRTINMNSLPTTVKSRTTTLQSITDYHTDTLEQPSMMLTSTRMAASLVLISICFHISRPHRLMPKTHQNLLFHPRNVHFIQDPPDCDCLTLP

SEQ ID NO: 164279 - protein, 95 aa, Triticum aestivum; identical to SEQ ID NO: 140866
  Clone ID: PAT_TA_58697.pep

SEQ ID NO: 164280 - protein, 99 aa, Triticum aestivum
  Clone ID: PAT_TA_58698.pep
RGLFFFFFSNESQIYSMGMYLRHPLIAKLQVNLNLSRANEARLGLPSPSSDITLAHSSDTLIIIAGTVGRISIFRLAKRTSIGSAESTSNSSKVLLLGS

SEQ ID NO: 164281 - protein, 132 aa, Triticum aestivum
  Clone ID: PAT_TA_58699.pep
MSADFWAGYLSGAVGIIIGNPLDVIKVRRQAQQASPPPVLSSPSMIAGETSATSQGTSFGTRFLRSYTSLVTGTAAPILGYGALNALLFVSYNRTESTLNSVFSTSENLWNAWIAGSVGGLATWIVSTPTEL

SEQ ID NO: 164282 - protein, 243 aa, Triticum aestivum
  Clone ID: PAT_TA_58700.pep
MATDRVKASVLHGEKDLRLEERELPKPSSNEVQVAVQSTGLCGSDLHYYNHFRNGDIIVREPLTLGHESAGTVVAVGSEVTHLKPGDHVALEVGLPCETCELCDEGRYNICRGMKFRSSAKANPHAQGTLQERINHPAKWCHKMPEHVTLDLGALVEPLSVAMHARDRASLPKGSTVLVLGAGAVGLLAAAVAKADQAKTVIIADILKDRLDFATSNGFADASVVGPMEPQLSRTAGFRSKVA

SEQ ID NO: 164283 - protein, 234 aa, Triticum aestivum
  unsure (1)..(234): unsure at all Xaa locations
  Clone ID: PAT_TA_58701.pep
MWTMPFICTWITYQAVTPCALNQLRPMAYFDAMILANKWLFSFLFGMTSSILIYRGFFHRLNKFPGPFVARLSNVYASWLAIKEEHMYLEVQKLHQKYGDIVRIGPQELSIATPSAFRILHANNSPIVKGPFYNVARPCVNLLADRNKKSHAQRRKTWDKAFTAKALRDYEPRVVRYTKQLTEQIEKTKGNXSTXGAWINFYTFDIVGDLAFGTSFNYLVNGVKDKFLRDYMTV

SEQ ID NO: 164284 - protein, 185 aa, Triticum aestivum
  unsure (1)..(185): unsure at all Xaa locations
  Clone ID: PAT_TA_58702.pep
MPKEGVAGDGSKTAEHSSAEDTRAADALALRGRPGGELGAPRSVRDVSMSSTSFPLLTRTNYPSWSVMMKVIMEARPMWKAVETGDVEYEEDRLAMEAILRSVSEEMVLTLGAKETAKEAWDTIKTLRISVEXVXESKAQTLRLQYEGXSGFKAGEQVDDFALRLQGLVNELANARMSGPRLDAT

SEQ ID NO: 164285 - protein, 197 aa, Triticum aestivum
  Clone ID: PAT_TA_58703.pep
RPGRDVSDFGSSLTWHVANVKDSGLECPVMGTFGYVDPEYCLRGRVKPASDVYSLGVLMLEVLTGKRAFLQGGLKIKEDLACFASPIIEAGNITELLDKRPVPEPTPLQLQALKRVAQIARCCVKWVGRARPAISDIVANLEMVYKLICRDEPCLVEESVVWPFLEKVDESPHAKSVPSAGYQPNLVHQKLTELCSH

SEQ ID NO: 164286 - protein, 268 aa, Triticum aestivum
  Clone ID: PAT_TA_58704.pep
SQVTMAAEIPGEDIYSADSDVDSDTGQTEEIPRFDLGLLHKTEVPIIQSLNVFEGATIKLEHNQHNSNKPGPPLLGPVSVSMGGNLQITIHNQSTNYNTSALMLVPPTAGTQSPAAMMRILNRDLPARARTNTSEDEDILYEHYAPYVTIEDDRVKDMALQIAEKLQFVDKILASFFASIVAEDNKTYIQKQLTSIRQHIARKMNSGSQPCQSNTQTVKQEDAILGDLGHFCEDLFDYSTTTESRDENAQAPRIYSTHGSSTEKVHYL

SEQ ID NO: 164287 - protein, 71 aa, Triticum aestivum
  Clone ID: PAT_TA_58705.pep
GIVISRPWLSISYETEYRMPFLETVCRANGLEVKEVGVIAGILLGILIAAGYVFISGEVGGGNIRNKYLGF

SEQ ID NO: 164288 - protein, 243 aa, Triticum aestivum
  Clone ID: PAT_TA_58706.pep
RPVRGVDCMLILLPVCRTVMRWVRPKIRFLPLDENLWMHRQLAYSMLLFTCLHTGAHYVNFYNVEITQIRPVTALQIHYAQPGGITGHIMLLCMLLMFTSAHARIRQQSFETFWYTHHLFIPFFLGLYTHTVGCFVRDTPEAFSPFAGDEFWEHCIGYLGWRWELWTGGAYLLERLWREVRARRSTKITRVVRHPYDVVEIQFNKPSFKYKAGQWLFLQVPSLSKYQWHPFTITSCPFDPYVS

SEQ ID NO: 164289 - protein, 40 aa, Triticum aestivum
  Clone ID: PAT_TA_58707.pep
GAFFFFFFHELTCFIFTVMLLKNSVDLLGGVSNGVHRGTS

SEQ ID NO: 164290 - protein, 155 aa, Triticum aestivum
  Clone ID: PAT_TA_58708.pep
LVVYQPCWQEHFFGVLSKDVVLLLADTGAVVVLIVVSAVIGALVAVPVQVLRALPSIAAAVVVLSLGGSFTHASSRTSEVPLSHPRIVRVFVKVLEIRPDSSTLEVVTSVDLGAHTLSGVGVIVVRLIARGRTLSVFPSQYLVAFALVRTLVASV

SEQ ID NO: 164291 - protein, 226 aa, Triticum aestivum
  Clone ID: PAT_TA_58709.pep
MSPSSTKVASGGSFHTFQGIIPKKQPAASSNARPRVAGTRRITTPHACTECKRRKIRCDGKLPCGQCITSRAPKNCSYDKHRQRMIPSRKALDSLAQSLEECRSVLRRLYPNHDVSALRSLDKQELINLLAQSQCSLSDPLPSPPLESSFPKSGTPMMGSDSLLELQTSLEADLDSLIGELEFEVPGEQREASEEANYLAQQSVGWLETMELRIICAHDGWVIVRA

SEQ ID NO: 164292 - protein, 134 aa, Triticum aestivum
  Clone ID: PAT_TA_58710.pep
AGRVREALHFTRLSDSYSKSTLHRTTSTTYTNQTSTMADNNNQQPGLIGSHAQYVKGAAEATIGAITGSQPWKASGEQDKAAGLADMKKAGELRAQNDPNNQNGYGKAEEIAGKLTGCQGMEREGHASAAQKKE

SEQ ID NO: 164293 - protein, 158 aa, Triticum aestivum
  unsure (1)..(158): unsure at all Xaa locations
  Clone ID: PAT_TA_58711.pep
MSAEEERQAALNSYRAKLIESREWEAKLKNLRLEIKDMQREFDKTEDNIKALQSVGQIIGEVLKQLDDERFIVKASSGPRYVVGCRSKVDKVKLKQGTRVALDMTTLTIMRMLPREVDPLVYNMSLEDPGQVSFAGIGGLNDQFRELREGIELXLKNP

SEQ ID NO: 164294 - protein, 58 aa, Triticum aestivum
  unsure (1)..(58): unsure at all Xaa locations
  Clone ID: PAT_TA_58712.pep
VVRGLGRSSSAXEGERPEELHDDDCVSSLGVLRFNLDIRMMERNGDWGMHWGNADPAG

SEQ ID NO: 164295 - protein, 237 aa, Triticum aestivum
  Clone ID: PAT_TA_58713.pep
PAGSGPSKHSTTPMYQVQSPCRVEDGQYIAQSKVAAFWDEAWWRLSWTGRAKEYMIRGITDRSPKNLLTDRDVRRHQKAVHSETGDIVGYARWIMPESHKDSWLTAQTPDVSAEQQEIFAKRHAETDWDPSHDNDELDEHMDGWREKYKHADCMELHYIAVRPEHQKKGLASMLVRSGLEVADQLGIDVLVVATGRRGQGLYSKHGFEILDEKSQSMSKFGVDEMYETFVMMRPAQK

SEQ ID NO: 164296 - protein, 197 aa, Triticum aestivum
  Clone ID: PAT_TA_58714.pep
ITHIHLVRAACNMLATMTRHITALFLYFLPICLAASKCYYPNGVEANDFPCDPDADESVCCSGGLGTVCLSNKLCIGADGNTLRGSCTDKNWASPECAMFCLGADKGGTDLISCSNVTGSDTSFCCDHNSGCCNSGVGRFAVLPSNPKVWATWNRKANEYTVVGTIFTDESTSTTGVGYFRHIFLRSQSQTSHMPLR

SEQ ID NO: 164297 - protein, 138 aa, Triticum aestivum
  Clone ID: PAT_TA_58715.pep
MANYILTEPSPSTNVFVRSGRGGYGNISRASKPTNSSTSRTVATTTTTPTAPSRRFFSGIGGAGNVHRASEQPSVSLDDEYDRIAARDQMAAGHVGIGGAGNVFHRKESDAGSDISSSSSLSSKTKLWARVSSTFSRD

SEQ ID NO: 164298 - protein, 219 aa, Triticum aestivum
  unsure (1)..(219): unsure at all Xaa locations
  Clone ID: PAT_TA_58716.pep
MAPIKNLVWALFVAADLAAAHSVITNAVGDAGGSGMALGVDTSTPRDGTRRRPFQTDATRFRGASADTVGETLAGGDNQVEQGTADIMEETGDQLPQVNPGGSLEMTVHQVNSDGAGPYTCMINADGTGTSWENIPVTTNLEGNDRGRNRDGEMGDFPLVASIPAGQTCTGTVAGEDNVCLVRCQNPXRAGPFGGVIPVQMAQTNNAGNGTETDAGNGT

SEQ ID NO: 164299 - protein, 223 aa, Triticum aestivum
  unsure (1)..(223): unsure at all Xaa locations
  Clone ID: PAT_TA_58717.pep
MTVTQLRSAGRLAQLAGHVNGARQFSTRPALRKELQDAYILSAARTPTAKFNGSFLSVSAPKLGAVAIKAALEKSKVPVEKITDVYMGNVLQGSVGQAPARQAVIFAGLPKEIEATTINKVCASGLKAVTLAAQNIQMGLSEAQIAGGMENMSQVPYYVSRASGLPAFGHVKMEDGXIKDXLTDVYDQFHMGHCAENTXKNPHITREQQDEXRIQSYXHAQKA

SEQ ID NO: 164300 - protein, 262 aa, Triticum aestivum
  unsure (1)..(262): unsure at all Xaa locations
  Clone ID: PAT_TA_58718.pep
PAGLGTPHGANPCFEPTAGHHLFDGDGMVHAIRIRNGAAESYTCRFTETARLSQERAVGKPVFPKTIGELHGHSGIARLALFYARGACGLVDPSHGTGVANAGLVYFNGRLLAMSEDDLPYQVRVTADGDLETVGRYDFDGQLDCAMIAHPKLDPVSGELFALSYDVIKKPYLKYFYFHADGTKSADVEIELDQPTMIHDFAITENFVVVPDHQMVFKLAEMFRGGSPVMLDKEKTSRFGVLPKYAKHSXEMXWVDVPDCFC

SEQ ID NO: 164301 - protein, 186 aa, Triticum aestivum
  unsure (1)..(186): unsure at all Xaa locations
  Clone ID: PAT_TA_58719.pep
MAPALIRILRSAPSLTQHTPRAAEAFSSLQGHLLEASKVLNARDDKDEDSNNRHKPSVEPESGSFDPHDINNAGFFFLFALIGVVFVCTGIWFFFWAKNGGFQFKEDDWDDYKSTVLRRTGPNGTILSNATRPTNLGGGSVYKDVDDDNNXVTEGTTLTGITAGASDIYXXEKRRRKQEKRDRERA

SEQ ID NO: 164302 - protein, 155 aa, Triticum aestivum
  Clone ID: PAT_TA_58720.pep
RPGPELSIEDADGNAAEKGVAYVDEFMQLKVRVTNRTAQKIHPLVRILPALCHRPANVGLEFTRKLAWNGTLQQLIPVLEGHGSAEVSVGMTVLCRGEFEISASVEEVQVWEGPRVAPTRARSESQTMQDAALGVKERRIWHARQPCMLITRDRK

SEQ ID NO: 164303 - protein, 275 aa, Triticum aestivum
  unsure (1)..(275): unsure at all Xaa locations
  Clone ID: PAT_TA_58721.pep
RPGSEMLLSSLTYHNSHNKFYPIYSPDLSTFSMDTVNQATDNPATDNLEATHSHPGLSYPVDFIMNIELQTSNGTDIPLYNKTLEIEKLPPWMPDYAKKQYPSITRNEGEREDVFDSDNEDYWLFYVHLHNAELEIAIGGEEPIYATSRPNWNKISENDKSVQDVHGQDGTLYQLRWQYGDSYDRFVAVRAPKMDNPAISLRTHGQFGAVHWVGLFTKTGVSNTNHFIAVRTSNRLLPHYAERTKKYPGYRNGYLEDGPXNILDCAFDVFPSSCT

SEQ ID NO: 164304 - protein, 153 aa, Triticum aestivum
  Clone ID: PAT_TA_58722.pep
TSCSLVKPRSKSSQSSRSLCSIISRCIIGRACGRRVRLIHYSNSFGMEEAFSIFPTLTFRLPSVFRISCLKASRKDRGTNGPALPFYGQARPSLTADLQRTMSKELVQSFRPSQVVLTERVSGNLSRDLSERLAVRGCLRVSPSWTWNAEPGR

SEQ ID NO: 164305 - protein, 100 aa, Triticum aestivum
  Clone ID: PAT_TA_58723.pep
YSLCAIFSRSSAGFSRPDVLSNSQIPSQCVAGDPRGARTPSSLLRPRYREACEVVHHDNESSQVRCDLLFGSPSFFLCSEAQNPFLHPFGCHLIDGVFSG

SEQ ID NO: 164306 - protein, 204 aa, Triticum aestivum
  unsure (1)..(204): unsure at all Xaa locations
  Clone ID: PAT_TA_58724.pep
MDYLSEKMTLSDSNAKAIQLHLLRTITEGFAEKLKVGSGGYGEVYKGLLNGDEIAVKKLFPVPGLNDEAFDNEFRNLKKVQHKNVIRMIGYCYEISHRDVEYQGKLVWARVIDRALCFEYMKGGSLVNHISDESCVHDWPTTYKIIHGACEGLHYLHKGQEQKIFHLDLKPDNVLLDEDFVPKXGGFGFVKNSLLHIPPLAVRK

SEQ ID NO: 164307 - protein, 187 aa, Triticum aestivum
  unsure (1)..(187): unsure at all Xaa locations
  Clone ID: PAT_TA_58725.pep
MPMPREDNEPPNTEDYINDSHRNSNSNGTFVNDNPNNNIGGQRRVSKDTLLSNPLGSMTRAELLADADSFIDARGLQEHHEDFRKGALDAQVNNTPGAFEKIDIDTEEEKAALRKEETSRWNQPFALYFLCTLXAXTAIVHGMDQTAVNGAQMFYSDEIEIGNEWMQGFTNGDPYSAXALIGCWTSP

SEQ ID NO: 164308 - protein, 247 aa, Triticum aestivum
  unsure (1)..(247): unsure at all Xaa locations
  Clone ID: PAT_TA_58726.pep
MASALLRSTPALRAGLRARSTPLAAMATTSFVRGKATLPDLPYDYGALEPYISGQIMELHHSKHHQTYVTGFNNATDAIAEANHKGDAKAAAAQAPLLNFHGGGHVNHSLFWENLAPNGKGGGGEPEGKLLTSINEDFGSFEAFKKQTNATLAGIQGSGWAWLVKDKNAGTLSIVTRPNQDPVTGNLEPLLGIDAWEHAYYLQYQNRKAEYFSAIWDVINWXTVAKRFEKKSIHISKVKSLSGDNVK

SEQ ID NO: 164309 - protein, 80 aa, Triticum aestivum
  Clone ID: PAT_TA_58727.pep
AGRVGRRGGAQVDWWRGRLGAGTPCHHHQWTPLLHMLVRLAGFFSCLFIAIIVGRSYLSAQIIVRQGMQVPGMRRKIFLF

SEQ ID NO: 164310 - protein, 181 aa, Triticum aestivum
  Clone ID: PAT_TA_58728.pep
MSLTNCRFYEEKYPEIDSFVMVNVKQIAEMGAYVKLLEYDDIDGMILLSELSRRRIRSIQKLIRVGRNEVVVVLRVDKEKGYIDLSKRRVSPEDIVKCEERYNKSKMVHSVMIHLAKATEIPLETLYQAIAWPLNKKFGHALDAFKLSITNPEVWNDITFPRRGHRPGAEEYIGKRLTPNP

SEQ ID NO: 164311 - protein, 93 aa, Triticum aestivum
  unsure (1)..(93): unsure at all Xaa locations
  Clone ID: PAT_TA_58729.pep
XFRRALKTVMRILALQFATSAGINSTIKDEHIRDDFLRRFGLDSRDINNEQYIMASLCMDVKCLDQAFRTFTENVDWIDEHEGLGLMRGVEAA

SEQ ID NO: 164312 - protein, 165 aa, Triticum aestivum
  unsure (1)..(165): unsure at all Xaa locations
  Clone ID: PAT_TA_58730.pep
MAGAEVVDSGEKRLNELGYKQELRREMTLFKTLAISFSTMTLFTGITPLYGSSLQYAGPASLVWGWVVVSFFTWFVGIAMAEICSSFPAYAGSQVLQSIILLCSGTNKGGGYLAPRWLFLVMYLGLTFIWAVFNTFALEVIAFLDVISMWXGRWVGGTAIVIMLP

SEQ ID NO: 164313 - protein, 231 aa, Triticum aestivum
  Clone ID: PAT_TA_58731.pep
RPGLDTLETHAGHTTNSSIIPDPISQSLHRLNSPRTPDRPRDYVSCHVCAHIHGDCRRRMCAADPARPRSSSAWPAASRRRRVSSSALARWCAATPQKMPAATPVVLLKEDHYRTLRLTTISTTGYANKGLHRLELQHHPVRLESIKQRPRVLPAYQREGPDDDEQHAQSGCYAPVLWPTLPTPRRGPRTVPPLPQRRRKGRLVPRSLKRSPTRFLSCQRHHHCNYLHDTS

SEQ ID NO: 164314 - protein, 195 aa, Triticum aestivum
  unsure (1)..(195): unsure at all Xaa locations
  Clone ID: PAT_TA_58732.pep
MAAAASSLLAAAASSSSRAAISVRRPRAASAAAAAAASIPSSSRTSFTPLRASPARALRSLVVASAAPAMEPPAVSRVSTVVDVDLGDRSYPIYIGPGLLDEPDLLQRHVIGKRVLVVTNTTVAPLYLEKVTWALTHQNPNVSVESVILPDGEKYKDMDTLMKVFDKAXESRLDRRCTFVALGGGVIGDMCGFAA

SEQ ID NO: 164315 - protein, 182 aa, Triticum aestivum
  unsure (1)..(182): unsure at all Xaa locations
  Clone ID: PAT_TA_58733.pep
RPGWDSSDPHSHRRVTKQPAIVHSYYDAQEDRTPVIPRRDFSIGPFVLDVEMRFGVAXIFASFDDIFGDRTDVIGXETIARVTGEMKGXADREEPSPYAAMLAAHNSSARCKEFAIYALHIKMRGTGANGTKTPGXGDQPALRDRGRDGMKIERIEDVTRTPSDSTRRKGGRRWSSISELLT

SEQ ID NO: 164316 - protein, 162 aa, Triticum aestivum
  unsure (1)..(162): unsure at all Xaa locations
  Clone ID: PAT_TA_58734.pep
MSNVEVTENGAAPTIHKPHHNAALPYQSVGDFLSNTNNFKIIESTLREGEQFAXAYFDTETKIKIAKALSDFGVEYIELTSPLASPQSRKDCEEICKLGLKAKILTHVRCTMEDAKVAVETGVDGVDVVIGTSQYLREHSHGKDMAYIKESAIEVIRYIKSQ

SEQ ID NO: 164317 - protein, 179 aa, Triticum aestivum
  unsure (1)..(179): unsure at all Xaa locations
  Clone ID: PAT_TA_58735.pep
MAIYSSVPPPEQQPTTTTPTPTATNPPLAAIHVQSPPTPVKNSSIDIDAWTLSALQSLNVSPVARGTGIPLTIPIDEAVKVQPKSPERNVDFDEREAPTSIPKRPLSRRDSQRKRDLVLKGKEGSRQRRRWENDRLMHVPNVQPPLPSDYEVHPTHTIHRVPYQLAQXWDRGVRQRVEG

SEQ ID NO: 164318 - protein, 238 aa, Triticum aestivum
  Clone ID: PAT_TA_58736.pep
MATFTRIADDERPTISVDPSAVISTIDDNIYGGFTEHMGRCIYGGIYEPGNPLSDENGFRKDVIEAMKELNCPVVRYPGGNFVATYHWQDGIGPREKRPVRPELAWIGTESNEFGTDEFMKWCEVVGTEPYLCLNFGTGTLDEALAWVEYCNSDRPSYYANLRRQNGREKPYNVKYWALGNEMWGAWQVGQMTKEDYAKKAYQWAKAIKLLDPSVTLILCGETGHSTWLVRYQGVHQV

SEQ ID NO: 164319 - protein, 244 aa, Triticum aestivum
  unsure (1)..(244): unsure at all Xaa locations
  Clone ID: PAT_TA_58737.pep
AGRARALLEQGVIPIVNENDTLAVAEIKFGDNDTLSAITAAMIHADMLFLMTDVDCLYDKNPRTHPDAKPIEVVEDTAALQADVSSAGSSLGTGGMSTKIIAARLGTSAGVTTVITRSSNPGNVLHIVQYLQSIQRGNTPPSPDERAEGLTRSASALSLSASNXNGAPWPPLHTRFVPANNPIRDRHFWLLHTPYPHGTLYIDSGAYKALVXKAGLLPVXVVDVEGTFASREXVRLVTVKRRST

SEQ ID NO: 164320 - protein, 234 aa, Triticum aestivum
  Clone ID: PAT_TA_58738.pep
MDASAACEIERLPEDLLMHVISLTSPADAFHATAVSRAFHAAADSDTVWSRLLPHDLPQFAKRELPRKPPSTKKGMFRRLSDEPALLPGKYVRMQLDKATGAKCFTFSASALQITQANDAHTPLIRVGSVPGYSKRGKRFSQAADIGHVNILEICAKIQRNMLSQNTTYVAYMVFKLGPRFYSFDFPFQEASFGIAGSQSTRQVCLQGYVEDGDGADVPPREHIVPSSYHIYKS

SEQ ID NO: 164321 - protein, 273 aa, Triticum aestivum
  Clone ID: PAT_TA_58739.pep
RPGSGHARFARELASSGGRTVAAPTRKDLPNGGEYIMTLSIGTPPLSYPAIADTGSDLIWTQCAPCGSQCFKQAGQLYNPSSSTTFGVLPCDSSVSMCAALAGPSPPPGCSCMYNQTYGTGWTAGIQSVETFTFGSTPADQTRVPGIAFGCSNASSDDWNGSAGLVGLGRGSMSLISQLGAGMFSYCLTPFQDANSTSTLLLGPSAALNATGVRTTPFVASPSKAPMSTYYYLNLMGISIGTTALAIHPNAFALRANGTGGLIIDSGTTITSL

SEQ ID NO: 164322 - protein, 234 aa, Triticum aestivum
  unsure (1)..(234): unsure at all Xaa locations
  Clone ID: PAT_TA_58740.pep
AGRALDCKPDKDMKCTFVQHDLRQXPWPFGDEEFDLIMVKDACLMVPSHVYQLFIEDYLRLLKPGGVLEIWDSDPTFRMLRPHVPSALPGSEEAEEHEAALDLGAFLMTSKTPLSAPLNSFLVEYNTWLSRTLEGRQLSPVPCSLISAVLLQESEDLMDIKSKRLAIPLSEVRWEREGVGGVVTKDGKSYVEMKAKSAPNQKVEKKTLTPGQSALRKTALLDGCANSGRHWSQF

SEQ ID NO: 164323 - protein, 67 aa, Triticum aestivum
  Clone ID: PAT_TA_58741.pep
TFLLVNRIITPIPGLSAHRRTIMICKNSIYQIAKSNMLIIPHIVAFQITSCGFSMVPETPSSRTKPG

SEQ ID NO: 164324 - protein, 192 aa, Triticum aestivum
  unsure (1)..(192): unsure at all Xaa locations
  Clone ID: PAT_TA_58742.pep
TQVAVRLPPATSPPYTTTADSSPIMKVTFKDLKQQKFTLDVEPSELISAVKEKISAEKGWQPQLQKLIYSGKILKDDETVGSYNIEEKGFVVCMVNKPKPTKPAESSAAPPATPAAPPTRTPAAPAAPAQSASQQAAVPATPTPQRSADAGSEEPSGLAMGSQRTEAIANMEAMGFERXQIEAAMRAAFNTP

SEQ ID NO: 164325 - protein, 177 aa, Triticum aestivum
  unsure (1)..(177): unsure at all Xaa locations
  Clone ID: PAT_TA_58743.pep
MAENYILRITAGPHYDLSQQAEVPVNVAKPTTIKSDRADIELNVRINDYKGLPRNSPSTSPYFSTEPHAYNQDQYSISFRFTPKKPSSSDTDDVSGIKVTDLQFGNDFDHPIRDRLPPGFNTAMGIVRWWIDPGLDGDAYADKPYLYGPALSSFNTIHVGEGDFDEXKGGLWFEEGG

SEQ ID NO: 164326 - protein, 191 aa, Triticum aestivum
  Clone ID: PAT_TA_58744.pep
MASAAAENASPIGIANLPNQRHKIVAKRGAGFTIMVAGESGLGKTTFINTLFSTTIKNYADHKRRHQKQVDKTVEIEITKAELEEKFFKVRLTVIDTPGFGDYVNNRDSWMPIIEFLDDQHESYMLQEQQPRRQDKIDLRVHACLYFIRPTGHTLKPLDIEVMKRLCSRVNLIPVIAKADTLSPGDLGQVK

SEQ ID NO: 164327 - protein, 72 aa, Triticum aestivum
  Clone ID: PAT_TA_58745.pep
MGEVAAELYTQDGTIDIKGNPALKSNTGNWRACPYILANECCERLAYYGMSTNLVNFMKDRMGMANAAAANN

SEQ ID NO: 164328 - protein, 254 aa, Triticum aestivum
  unsure (1)..(254): unsure at all Xaa locations
  Clone ID: PAT_TA_58746.pep
LNTQYHHLGIVSSLIFVATEHCVLYGAMRKDKVKNVPTIEAIRSKLGVGVPGDKESKIFRRVVREFHQDYKTANGTPGAVFTQWTNPTHQDALRRMAEEFLEVRGWAKRFWPDTAGSGTVKKLKWSENHIQIMRHMRQLFFRHNQQVRKEPGSTPRKRMASRTTPCPSRTISPGSTRTTTTHTGDVTMNDMMGPRHQDDQYDDIFRPXNPYRVPSSPISTTSDRSCTIFDIPQDSHPLLGLXNESSGPTSRPLA

SEQ ID NO: 164329 - protein, 225 aa, Triticum aestivum
  Clone ID: PAT_TA_58747.pep
HSRFTMSVPEAIKIPNWEDDILPLIQKPYWVAKNSEAAGRKWVREMLYWGNWDLSSYEDVRKRAPGIYNHLRSKSMPITRNPDHYWPEETLELFRLWANNGYMRNKQDTQSVQSLEPAIPEPLEPPISYRVRKDIMSMSREELVEYQSKLDDILHIQEVYLEGKKTKWQELGLLHAYWCLHYQEATFLWHRAYLRYVEELIDFPIPYWDGYAEEASVSSSKFAGI

SEQ ID NO: 164330 - protein, 134 aa, Triticum aestivum
  Clone ID: PAT_TA_58748.pep
ILIFYEFSLSSPMCLEFEWLLEPSLAQMIIGSVLIPTYINARIHVNSNCSVIQFSISIVCRSDVPANSPSQKCIVMSQNAKPVHVPSRMPSTIMHHSSPTRLFYSLVLSFRSTSLQPDCVELLQLCIVVLGHNM

SEQ ID NO: 164331 - protein, 92 aa, Triticum aestivum
  Clone ID: PAT_TA_58749.pep
RPGLRKLPITSSKVTALPVPSLFKMQPTSFILLTLSAVSTVMAGCNAGAPFQGTCLTCTSECHSNYGGPDRKSALQRTGCMTACLLRCDDCN

SEQ ID NO: 164332 - protein, 231 aa, Triticum aestivum
  unsure (1)..(231): unsure at all Xaa locations
  Clone ID: PAT_TA_58750.pep
MASSAPPAPAERPHAVCLPAAAQGHIIPMLDVAKMLHARGFHVTFVNTEYNHARLVRSRGPAAVAGVPGFRFATIPDGLPPSDDDVTQDVASLCKSTTETCLGPFRRLLVDLNAGGPPVTCVVSDVVMDFSMEAARELGLPYVQLWTASAISFLGFRHYRLLFARXLAPIKDVEQLTDEYLDTPVEDVPGLRNMRFRDFPSFIRSPAPDDYMLHFALRITERAGGASAVIV

SEQ ID NO: 164333 - protein, 116 aa, Triticum aestivum
  Clone ID: PAT_TA_58751.pep
LFILRLCILCPGWKKKALTGLLSIESVCDVDGKLPIAKRDGDGYRGRPDSPLEVAQLKEARPDMATRDCLESRPCAALHRHTSPSPAEYGTKDVRCNLSETGGGILGRQLRQEVQA

SEQ ID NO: 164334 - protein, 210 aa, Triticum aestivum
  unsure (1)..(210): unsure at all Xaa locations
  Clone ID: PAT_TA_58752.pep
MPIESTDNVPADLPGHGRTVCVTGAGGFIASWLVKRLLQKGYTVRGTVRNPVDPKNDHLRAFDGAADRLVLLRADLMEPETLVEAFTGCEGIFHAASPVTDDPEKMIEPAIRGTKYVITAAADMGXKRVVFTSTIGTVYMNPHRDPSKPVDDTCWSDLEYCKKTANWYCYAKTVAEQDALETARQRGIELIVVNPXVLVLGPLLQPTVTR

SEQ ID NO: 164335 - protein, 154 aa, Triticum aestivum
  Clone ID: PAT_TA_58753.pep
EGRYSYDDILSTTQLSKEVSDQAIAVLLKAKVLIMSGAAGEKPGSGKTFKLNYDFKSKKIRINLNIGGVKEAKQEEVETNKTIEEDRKLVLQSAIVRIMKARKKMKHTQLVSETINQIRSRFVPKVGDIKKCIEILLDKEYLERLEGDELGYLA

SEQ ID NO: 164336 - protein, 119 aa, Triticum aestivum
  Clone ID: PAT_TA_58754.pep
FNGPVILVLFACAISILKVLIAEEELQVVRVKLVDLGEKSTSVGEIQHCTSRQSYLWCQRRQIALISFSDAFSVAVVAEADEGHHILVVEDVLVLSPFRVQEEHQVALLCSSSWSGHLD

SEQ ID NO: 164337 - protein, 260 aa, Triticum aestivum
  unsure (1)..(260): unsure at all Xaa locations
  Clone ID: PAT_TA_58755.pep
AGRVPQRIWISKSFCPSGCLFVFQSPTTREAARAGVIHGPVAAVSARGTTDFTQPDPEMAQSLDLAREIVAALITAQHRAREGKTEKRFGEGEWWTTEKRWGGGSGGPIGREIEKDSVQGDKDAKPSDENGLPMPLAKKARKNMSIYDNYRMIRPPAATWDKKAQYEAIGRVKGADYDDIFVVSSLFHHVSILRVRVPNRLLEVLDGAREPEXGRRSWGKVEAWRSPWYDLFDTVERLXCMELVWGMMAYQMRKDDTDGD

SEQ ID NO: 164338 - protein, 237 aa, Triticum aestivum
  unsure (1)..(237): unsure at all Xaa locations
  Clone ID: PAT_TA_58756.pep
MPLPTASIYEPPSAGFNGFPSRRSVVHSTEGIVAAPQPHAAKCGLEVLRAGGNAADAAVAVAAGLNVTEPVSTGIGGDMFLLYFDAATKQVKSLNGSGRSGAKQTLETIRKALNIPGGKIGEIPTHGVHAATVPGAAAGWVDTVERFGSGKLSLSQILEPAIKLAENGHPVSEIASHSWQAQEKLLRDASPNFAEMLKQDPSAQDGVRAPFPGEVFKNPTLXKTFRALATEGKKGFY

SEQ ID NO: 164339 - protein, 113 aa, Triticum aestivum
  Clone ID: PAT_TA_58757.pep
RVTNVDGITVLYVLCLDVAQILIHVDDESTVAVGIIETRRASSQDQYYGLKWVRCSRCSAHIQQIWISIASRAVQVVATYVTVVFVGHDVSAGVGDTSGIETMVVRTLDVDIR

SEQ ID NO: 164340 - protein, 239 aa, Triticum aestivum
  unsure (1)..(239): unsure at all Xaa locations
  Clone ID: PAT_TA_58758.pep
LAILYFLSCCNDIYSPNLSRKMTQDFAPLKNDLLLRTAWGQTVERPPMWVMRQAGRYLPEYHEAKGNRDFFECCRDPEVATEITLQPVRRFAGLIDAAIIFSDILVIPQAMGMTVEMVDKKGPHFPEPLKSPDDGQYGQVLAKDVDVAVELGYVYDAITLTRQKLDGQVPLIGFCGAPWTLFCYMVEXGGTKLFAQVKTWIYKYPEEAKKLLSKIXDICVEHLALQVKAGAQXVMVFDS

SEQ ID NO: 164341 - protein, 174 aa, Triticum aestivum
  unsure (1)..(174): unsure at all Xaa locations
  Clone ID: PAT_TA_58759.pep
MKEPGFNIPPLFNIASRKTTMAGSSSIPATTVREIRVVQRADGAAAVLAIGTANPHHCVPQGDYPDYYFRVTNSDHLTDLKPTFAKLCGMTGIGRRFFHHTDEMLATHPNLSLDARLXDVVATAAPELAASAAXEAIXEWXPSVXDITHLVVSTNAGSHAPGTDVRLVSLLXXA

SEQ ID NO: 164342 - protein, 212 aa, Triticum aestivum
  unsure (1)..(212): unsure at all Xaa locations
  Clone ID: PAT_TA_58760.pep
MDTAKLMNLYTAYPDADFLDFVNAPLGKGRPVDKKLTPLIAVPTTAGTGSETTGTAIFDLVSKRAKTGVAHRNLKPTLGICDPLNTRTMPAAVKAASGLDVLCHSLESWTAIPYNERTPRPTNPILRPAYQGANPISDVFSFHALRDTIKYLPRSVKNPDDLEAQSKMLLAXTLAGVGFGNARSHLCHGMSYPISRQNPGYSHDGYEVASPL

SEQ ID NO: 164343 - protein, 216 aa, Triticum aestivum
  Clone ID: PAT_TA_58761.pep
MDAAIEWFGLTTFRIKTNGLVIFLDTWLDRPDVMPKALAIDDVTEADYIFISHAHFDHLPGADKIAIKTGAHVIANGEAINILRSAGVPEDQLIPVAGGERIPLFTTECRQAAARGEVDVAHGPPGAPARPDNKLAAASVQVWPSLHCLLPGSSPADLPEIMDTGKEYIGGASQYACSLDITFMMKHGLQIGDHMPREDMDEGMRSFAEWISGPAK

SEQ ID NO: 164344 - protein, 76 aa, Triticum aestivum
  Clone ID: PAT_TA_58762.pep
MSNQSPAPPDLTDLAANLLRLPRQMVIDFSASWCGPCRFIEPAFKEMASRFADALFVKIDADELAEAVQRFGGEAM

SEQ ID NO: 164345 - protein, 239 aa, Triticum aestivum
  Clone ID: PAT_TA_58763.pep
RPGWASHFPALFVAARPFLYRNGDGDMSQTQWITFAMIMLHFVKREYETLFVHKFSANTMPWMNIFKNSFFYWAVSGAACAYSIYHPNSLAAKADMPAIDAVGVALYCFGEFMNALVHRYLSTLRSTGGTERKIPVGYGFNIVTCPNYLYEVLAWIGIIIVSRDWTVAVFISIGAAQMISWAKGKERAYRKEFGDRYKKKRFVIFPGLLKQLKSYLQIKAWALKDRKARSIDIWAKMVS

SEQ ID NO: 164346 - protein, 257 aa, Triticum aestivum
  unsure (1)..(257): unsure at all Xaa locations
  Clone ID: PAT_TA_58764.pep
AGVVPLLLAAGVSPASASSSAVDLGVNWGSQCTHQLDPSEVVRMLKANGIMKVKLFDADPWPVGALLDSGIEVMLGIPNDMLEAMSSYGNAEDWVAENATSYGDRLKLRYVAVGNEPFLKSYNGSFMETTVPALKNIQKALDEAGIGDTVKATVPLNADVYVGDKPSEGKFRPDIDGVMTNMVKFMHDHGAPFVVNIYPFLSLYQSDNFPFEFAFFGGGRSIQDNGGVSYSNVFDANYDTLVSALKKAXRAGLKVII

SEQ ID NO: 164347 - protein, 233 aa, Triticum aestivum
  unsure (1)..(233): unsure at all Xaa locations
  Clone ID: PAT_TA_58765.pep
RPGWELRDTTTKDISDSYEQGLLTEKVMDRALKRLFEGLVHTGFFDGDKSEWSSLDFDDVNTRHAQDLALQSAVRGAVLLKNDNTLPLNIKKKESVALIGFWADDKTKLQGGYSGPAPHVRTPAYAAKMLGLNTNVAWGPTLQNSSVPDNWTTNALEAAKKSDYIVYLGGLDATAAGEERDRTDLDWPSTQLTLLKKLSNLGQPLVVVQLGDQVDDTPLXXDXXVNSILWVNY

SEQ ID NO: 164348 - protein, 109 aa, Triticum aestivum
  Clone ID: PAT_TA_58766.pep
MASKSLYAIIAGVGPGTGRSVALRFAQKYPVVLFARRPESYESTVADVEKAGGKAIGITADVADPASLKKAFDDINKQFPNSHLAAAGYNVGSGGFAKKPFLEQTEKDL

SEQ ID NO: 164349 - protein, 179 aa, Triticum aestivum
  unsure (1)..(179): unsure at all Xaa locations
  Clone ID: PAT_TA_58767.pep
MGSGSRAASCLCCPFKCLACGLFSCLCSILVSLLVTAGVLALILYFVFRPQMIAATVDSASLAQFALGTPASPALLQYNLTLAMTVRNPNKRVGLYYDNVEALALYDGQRFGFAPLDPFFQGHQASTEVKPAFGGQQVLEGDVTQSNLRTQLAXGAVEVEVKLNAKLRVKGGRPKVPGP

SEQ ID NO: 164350 - protein, 132 aa, Triticum aestivum
  Clone ID: PAT_TA_58768.pep
KGQKQTILSLRISPPDSLSRFRLGLDQCGQPPFALWVPHEGPAPSRCRYICRRSCTATPSPETTSPAGAHTSPPSWRAAPGTAKNTTIISNITCTALNFPAITIQASVCFPLLRSLYQSLTRFLLAAAQTNE

SEQ ID NO: 164351 - protein, 251 aa, Triticum aestivum
  unsure (1)..(251): unsure at all Xaa locations
  Clone ID: PAT_TA_58769.pep
MRFSIASSLLFLTSAASAASSWGFKDGSVTVASKQGHAATAKFSNQEPVKDTLILGKADTIKVSLTTTEGSEAKRPHQAFIVITESTGIEVALPLDVKSSGKAVASISHKDISVPLLLSEEPLKVNLVLGSFGSSSPLISPVFNIQIYHVPNTPLPAFERPMRYGRREEIHHVFKVGETSPPKIISIVFVTAIVCTFPLLLVGWSKLGANLDHLPKAFQTAPISHALFVGSSSXFEGSFFLYYVKWNLFQL

SEQ ID NO: 164352 - protein, 275 aa, Triticum aestivum
  unsure (1)..(275): unsure at all Xaa locations
  Clone ID: PAT_TA_58770.pep
RPGFVEVTEKLLAAGADANAAAASEYGRTALEAAAKGGYLEVVEKLLVVGADANASEDRQTALQAAAEGGHLEVIEKLLTAGADANAAALQAAAWGGHLEVAEKLLAAGADVNAAASRYYRRTALQAAARGGHLEVIEKLLAAGADVNAAAANKDGRTALQAXSWXGHLKVAEKLLAAGADVNAAASRYYGRTALQAAAEGGHLKVFEKLLAAGADANAAALEVAAWGGHLEVIEKLLAAGADADNAAALEVAAWGGHLEGIESCAAELMVCCCC

SEQ ID NO: 164353 - protein, 162 aa, Triticum aestivum
  unsure (1)..(162): unsure at all Xaa locations
  Clone ID: PAT_TA_58771.pep
MVNFTIDEIRQLMDKPTNVRNMSVIAHVDHGKSTLTDSLLAKAGIISTAKAGDARATDTRADEQERGITIKSTAISLYGQLGGDDDVADIVGQKTDGKDFLINLIDSPGHVDFSSEXTAALRVTDGALVVVTPVXGVCGQTETVLRQGLGERIKPVIIINKV

SEQ ID NO: 164354 - protein, 63 aa, Triticum aestivum
  Clone ID: PAT_TA_58772.pep
EGYWFCTMEHANLWMMAGPRHLSLVSSPRAIAHQVLLTINEALIILQESITFYKCNPFDQFAF

SEQ ID NO: 164355 - protein, 108 aa, Triticum aestivum
  unsure (1)..(108): unsure at all Xaa locations
  Clone ID: PAT_TA_58773.pep
IIPMTLKNVIELGLLYNLVTGEGKMVTTTEMTDMLAATENNATGDIVYRHARAGSTRTTRRPSNMDDSKDERLCRNNNDDDVXKVLIPNEDGVFMAXLALMNSDKDLM

SEQ ID NO: 164356 - protein, 230 aa, Triticum aestivum
  unsure (1)..(230): unsure at all Xaa locations
  Clone ID: PAT_TA_58774.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIRKESTLHLVLRLRGGMQIFVKTLTGKTITLEVESSDTIDNVKAKIQDKEGIPPDQQRLIFAGKQLEDGRTLADXNIQKESTLHLVLXRLRGXQ

SEQ ID NO: 164357 - protein, 100 aa, Triticum aestivum
  Clone ID: PAT_TA_58775.pep
MGNCAPSRHAGESWADDGEWEEASSTSEDGDHHHASEVTIRITKRQLHELMERKTPGGRGSSTRQLLADIMDSGEVHHHDVHREEHWRPALQSIPEAVES

SEQ ID NO: 164358 - protein, 51 aa, Triticum aestivum
  Clone ID: PAT_TA_58776.pep
VRRVSSTDINPVRFPEEGRPQKDPASFQLGTWTIVPSICHLLTAVNSVAYG

SEQ ID NO: 164359 - protein, 143 aa, Triticum aestivum
  Clone ID: PAT_TA_58777.pep
PAGLGVHGNGFPRQWNLRDHMKRVHNDHGSSSGSPTTGSAQPAKGRKRKTENSETQTSHSRKAAVKSMPPPPEPKENLTQPLIDQWMEHHKAVQSLMRNVIKPEDAQNLKHIGTIQNRLNSMIKLTTDLNAINNPGNTLTGTG

SEQ ID NO: 164360 - protein, 252 aa, Triticum aestivum
  unsure (1)..(252): unsure at all Xaa locations
  Clone ID: PAT_TA_58778.pep
MSSPPPKGIYVPVPTFFASKRAANYNAISSPVDVETQVAHAVYLAKNGIKGVVVLGTTGEAVHIHPRDRHAILSGVKAGLEKEGFKDYPIVAGTATNSVEETVEQLKDAQKSGAQWGLTLVPGYNAAAVTQEGLVQWFTAVADQSPIPVMIYHYPGVSNNVKVAVSTYVTLAKHPNIVGCKLSHGDVSVAAQIASNPSIDHSHFHAYTGLXHSWLPVVSVGFAVAIDGSAGFLPKSLVRLLRVVDKDAAHRC

SEQ ID NO: 164361 - protein, 174 aa, Triticum aestivum
  unsure (1)..(174): unsure at all Xaa locations
  Clone ID: PAT_TA_58779.pep
RVYDQAMEGIEMCXRVCKPTVARPSRESRFPYNARLQKSGSDGTSNTNHGELANGDGSSGVLGNLRRLRRATVATSGTSRGSGLGGGRRDGGVVGNREEGGLLLNNSSGDDLGRGLDSSGALASGGDSTDRREVVSLGHDGGRCLSGGLLSESEGRQNSQDELGEVHFVGFVVI

SEQ ID NO: 164362 - protein, 136 aa, Triticum aestivum
  Clone ID: PAT_TA_58780.pep
QRDDFEVSVMISGSAEGVSLAPVCPDQVAHSFASAESLGVASAFSSPASVVFSGAGQDDAQHGGDSEDDGAVEGSPRGSGLPGAQYFRGRRRHPMALDLHHALRWVAVMCAVRNRFLSWVSTEMSVRVAVIEGPAG

SEQ ID NO: 164363 - protein, 90 aa, Triticum aestivum
  Clone ID: PAT_TA_58781.pep
MVKAVAVLTGSEGVKGTIFFTQEGEGPTTVTGSVTGLKEGLHGFHVHALGDTTNGCMSTGPHFNPAGHVHGAPEDEIRHAGDLGNVTAGV

SEQ ID NO: 164364 - protein, 203 aa, Triticum aestivum
  Clone ID: PAT_TA_58782.pep
MMNMRLLRQQCLRTKPSLATRISTRGFASQKDLLGSSLEQGDPEIHAILKREEKRQNHFINLIPSENFTSRSVLDALGSVMQNKYSEGYPGARYYGGNEHIDEAERLCQSRALETFRLDPEKWGVNVQPLSGSPANLYAYSAILNTHDRIMGLDLPHGGHLSHGYQIPGKKISHDLKYYENFPYRLNEETGLIDYEKLRENAL

SEQ ID NO: 164365 - protein, 173 aa, Triticum aestivum
  Clone ID: PAT_TA_58783.pep
MGKEFELIDSILLDSMSTTSSNMDGTATPTHTVMSETLLDYTESVPYPGAHFIIRQRDTGKVITLIAGELQLAEGLNPKGGYHWECIEKNRWLGFRNCVSGTIIGHNNNKKFVARAEKHQSYEYITLRPNPHGGYELMTKHNHDELWSMNVADDGQQLVETKGQGALWDFLKV

SEQ ID NO: 164366 - protein, 100 aa, Triticum aestivum
  Clone ID: PAT_TA_58784.pep
DIQTCHIRELRILSFSSHSGVVLSLRTTESASGPSFQPAAIGWHFLYPSSPSQVSQHIRDTSDICHNLSRLPVLLLHCQFRLPKADLAYTEITTRTSYGV

SEQ ID NO: 164367 - protein, 49 aa, Triticum aestivum
  Clone ID: PAT_TA_58785.pep
GPFFFFFFGNMGIWAQTLTFIFYKFGRKQKTSENKDLHIMQPFLLVENA

SEQ ID NO: 164368 - protein, 75 aa, Triticum aestivum; identical to SEQ ID NO: 106874
  Clone ID: PAT_TA_58786.pep

SEQ ID NO: 164369 - protein, 66 aa, Triticum aestivum
  Clone ID: PAT_TA_58787.pep
SPGPDGFTNEFYKAFKLLLKDDLLRFLGEQLMACTISAQENRTVRADRSSGVYNECTSTLFIEGVD

SEQ ID NO: 164370 - protein, 111 aa, Triticum aestivum
  unsure (1)..(111): unsure at all Xaa locations
  Clone ID: PAT_TA_58788.pep
MSFGRTVTLNSGWKIPQIGYGTWQAAPXEVGNGVYEALKAXYRHLDLAKIYQNQREXGEGXKKALSEVPGLKXEDIXITXXLWNNXQRPEXXXXALDDTLEEXGLEXXRLW

SEQ ID NO: 164371 - protein, 65 aa, Triticum aestivum
  Clone ID: PAT_TA_58789.pep
TLIYHGVLQKWLEKCNQELGSGYLPLHPLHLVTFPHNYPNCNSSRLSSDLNTTGGAHAFFKSPFE

SEQ ID NO: 164372 - protein, 100 aa, Triticum aestivum
  Clone ID: PAT_TA_58790.pep
LLCKETDQARHKIDVILSEKARMPVPPHPPHTKCGKAHHDIRGIPGLLTSYRAQYKYDFISVLNEGDDDDAPLCSPIITLNPPIDIYRALMQMTTLGCNT

SEQ ID NO: 164373 - protein, 192 aa, Triticum aestivum
  unsure (1)..(192): unsure at all Xaa locations
  Clone ID: PAT_TA_58791.pep
GRPSSAKTITLEVETSETIDNVKAKIQDKEAIPPDQQSIIFAVKHLEDGRTLADYDIQKESTLHLMLRLRVGMQIFVKTLTAKTITLXVESSDTIDNVKAKIQDKEGIPPDQQRLIFAGKQIQDSRTLADYNIHKETTLHLVLRLRDDMQIFVKTLTDKTINLEVQSSDTIDNVKAKIQDKQGIPPDQQRLI

SEQ ID NO: 164374 - protein, 176 aa, Triticum aestivum
  Clone ID: PAT_TA_58792.pep
PAGPGVVIRPSSKGNDHLAVTWKVADGVFQHIDVLEMQKETEFAVGKLLRVGGKYTYTDLDELIVEHVKAMARKVEELMRHDKYQNRSRGETEKWLTTYIDANPNRSTYAFCIDTKHPGYFWLCFKASRAAKVIALPVRAIPQGFELKGYQYPDMRALCNGFKLRYQNEFSKMGQR

SEQ ID NO: 164375 - protein, 177 aa, Triticum aestivum
  Clone ID: PAT_TA_58793.pep
PAGPGLAQHSSNSSLLTLQINYNYFATSSSITTITTMVSFKSILLFAGLAMAAPTPDTEKSLTKRFNGGWCGVHIHLFNGENPKGSHEMNVFVYDGKQQLVWSKESIWGNGILMAESENLPAVLNINTYGGGALATFTYGDQDWDSNEKPRCSVGAWDGPSFGSSTQTLEMDCGFSC

SEQ ID NO: 164376 - protein, 163 aa, Triticum aestivum
  unsure (1)..(163): unsure at all Xaa locations
  Clone ID: PAT_TA_58794.pep
NDHMAPTCKVAGCRVSTHLTLPEMQKETEFALANLFCVVGKYTYIDLDELIVEHVKDMPPKVEELMRHDKYQKRSRSETEKWLTTYIDANPNRXTYGFCIFSKHPGQFWMCFKASRAAKVIALPVRAISQGLELKGYQYPDMRALCNGFNLRYQNEFSKMGQR

SEQ ID NO: 164377 - protein, 131 aa, Triticum aestivum
  Clone ID: PAT_TA_58795.pep
MSAFIRVARGVRAAPIRPAMQPLVARSAVAHFTTSMPRRSEHAEETFEEFSARFEKEFDGVQDVFELQRNLNNAFAYDLVPAPSVIAAALKAARRVNDFGTAVRIFEGIKTKVENKGQYEQYLEELYPEEK

SEQ ID NO: 164378 - protein, 102 aa, Triticum aestivum
  Clone ID: PAT_TA_58796.pep
VRRSRRPGIKMMTRSGSFARAHRVTTASLYSPVSVAGPTGRRCLLYQPASGSCCRCCIVLLMVVARSSGVSSPFSFAGVCFGAIFLFPMRRSTVSFTLFFLE

SEQ ID NO: 164379 - protein, 55 aa, Triticum aestivum
  Clone ID: PAT_TA_58797.pep
GTFLARPLPSFAHYLILSSIRCLTLPVAYITCPLLYDYKIKNCLLLNNGRISLLT

SEQ ID NO: 164380 - protein, 216 aa, Triticum aestivum
  unsure (1)..(216): unsure at all Xaa locations
  Clone ID: PAT_TA_58798.pep
MAPGGPPGTSSRGRGGKFRKPARGGGKKFSRDIRPLDADGNEVSMWAVDHDKENGDEEDSSEEESSEEEEDSDDGAGPAKELTQEQTRELHKAEKKARKEAAIAKSKAKTVEVGDLPSSDSEESDSEDEDMPANPNHSKKARKQATAGVDELTEDMENLKAAPTRREREALEAAAAKEKHMRLTAQGKTDAXRADLERLKAIREXRRLDAARRQPS

SEQ ID NO: 164381 - protein, 104 aa, Triticum aestivum
  Clone ID: PAT_TA_58799.pep
WIFLRATHGPLRGGSASPRRRAGSAPSRRPGNACGWRSAPGPQPRVGPPAAGSGSPPPGRRAPAPCDSQAPVVAGGERGVTGGRGAWVGWGGMRGGLANGCRTR

SEQ ID NO: 164382 - protein, 114 aa, Triticum aestivum
  unsure (1)..(114): unsure at all Xaa locations
  Clone ID: PAT_TA_58800.pep
GESEGENTGHNEEXPKEAEKEEGNGKHHNKRDEEEEERDTAQRDKTTQRNPDDRTHTGGRQATKRGRKDNSPTSERKTNPTEAPRPKQRKEGQGRPQRRPRRRESHQKTDKNPR

SEQ ID NO: 164383 - protein, 65 aa, Triticum aestivum
  Clone ID: PAT_TA_58801.pep
VRRSRRPVSYSAMLLTGCSTSVGESGKLVDVGWPSVWVRIATQWATAGLFIWSLVAPLLFPDREF

SEQ ID NO: 164384 - protein, 120 aa, Triticum aestivum
  Clone ID: PAT_TA_58802.pep
PACSGKAEKRPPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 164385 - protein, 127 aa, Triticum aestivum
  Clone ID: PAT_TA_58803.pep
ASTVGKANCSACLGYHPTRRRGIAVHVNQLGHGPVFPTRGVVNRRPAAPVNRRRYWSNRLPAQPSRRPVRLRSFSIRARGGESPGFGSAASIRGLFFFFFSNNIIEVQQRQYNIIISHATQFNPINK

SEQ ID NO: 164386 - protein, 88 aa, Triticum aestivum
  Clone ID: PAT_TA_58804.pep
MASRLRSFSRPVAAAFLRSASARSPAASLPRALSPTPRASSLGRQVALARSLQPLHSAISAARLTSRLGAEVARAVSQGTLCSSNPGV

SEQ ID NO: 164387 - protein, 81 aa, Triticum aestivum
  Clone ID: PAT_TA_58805.pep
GPFFFFFLAFESLSLTYNSYHESSKNKVPQIGHRPLSLVSCFPYPTCPSYHLSVRPPARHLSIVAYRRLVQKRLQNIMCSG

SEQ ID NO: 164388 - protein, 74 aa, Triticum aestivum
  Clone ID: PAT_TA_58806.pep
RPGPPAAAPAPALTVAPTPSATAPAPADSPMFSPPAPTPDMSPSPTAEPATPGSGAAGLRPAFVLAAAVAIYAF

SEQ ID NO: 164389 - protein, 197 aa, Triticum aestivum
  Clone ID: PAT_TA_58807.pep
MKLHYIGVLRNESQPAHEIVAEKELSSYSRFTRNNYGEFMTLFAKTVAERTRPGQRQDVEEQDYTFHAYGRTEGVCGIIISDHQYPALVAHQLLSKVVDEFLSKNPRSSWATGTPTLAMPELKEYLTKYQDPQQADSILKIQKELDETKIVLHKTIESVLQRGEKIDDLVAKSDGLSAQSKMFYQQAKKQNSCCILM

SEQ ID NO: 164390 - protein, 55 aa, Triticum aestivum
  Clone ID: PAT_TA_58808.pep
FTSSQVPWFNLNQRSTYTPKRYAIMSSTQAAILLVLVTHIDRRFRTFHMTALVIR

SEQ ID NO: 164391 - protein, 65 aa, Triticum aestivum
  Clone ID: PAT_TA_58809.pep
PAGSGLSVPKSQNAGFSRLAQNQHNFPLSVRSSQTPKRPIHVLTLLVETCRPRGMLRGEKSGFPS

SEQ ID NO: 164392 - protein, 76 aa, Triticum aestivum; identical to SEQ ID NO: 141100
  Clone ID: PAT_TA_58810.pep

SEQ ID NO: 164393 - protein, 79 aa, Triticum aestivum
  Clone ID: PAT_TA_58811.pep
PIGPVQSLFDRLHHASKLDCKNLKGTEQCISAKLLDRKQQHKVCTTVPSHACNMTSIVELRAYTPRSATTYNSTSGERM

SEQ ID NO: 164394 - protein, 238 aa, Triticum aestivum
  unsure (1)..(238): unsure at all Xaa locations
  Clone ID: PAT_TA_58812.pep
RPVRETLLPLLSFPNPSADLGPLLDPSAAVSALAFHSIGPVPRNLLAASDDGLLHLYDADGFALLTSLRVFPRGREAADALAVHPSGRVALAVGRAGGLSMVNLLRGRRSFTCRLERPASAVAYAQDAAGGDRFVMAAEEKVTVHDSEDARIIHEMRCDKRVLALAPSKNGILYTGGEDRGITAWDLTSGKVSSRIEGAHSTRGKGIVVLRXRNDGSESSXLVASASSDGIIRIWDVR

SEQ ID NO: 164395 - protein, 93 aa, Triticum aestivum
  Clone ID: PAT_TA_58813.pep
AGRVGKLRVYWNVYHHSVGYTIIILGIVNIFKGMSILDVARKWKTGYIIAIGILGGIAVVLEVITWGIVLKRRKTEDKAYNGSANNNNGHLPM

SEQ ID NO: 164396 - protein, 110 aa, Triticum aestivum
  unsure (1)..(110): unsure at all Xaa locations
  Clone ID: PAT_TA_58814.pep
MAHEDADYPAKLAEPAARNDQMAENMNIATAEDRDLTGXERNTLSGGNKNAIGASRASCFTVPPTHQNEASKANSTPVTLIKEHRPRIEAELAKICEEILEALDPHPIPS

SEQ ID NO: 164397 - protein, 69 aa, Triticum aestivum
  Clone ID: PAT_TA_58815.pep
MSAMTAAVPFWRAAGMTYIGYSNVCAALVRSCLKEPFKTEVSSREKVHFSLSKWADEKQQKPTVRTDDE

SEQ ID NO: 164398 - protein, 96 aa, Triticum aestivum
  Clone ID: PAT_TA_58816.pep
SSVMAQHGLEGRANLPDDPDNNAPYELILSGLHLMLMASRTDVSSLNLAPQGNGLHCLVHHYFSPRMLLQMLASWTQSEEEAGYWLLLGRLPEPAG

SEQ ID NO: 164399 - protein, 77 aa, Triticum aestivum
  Clone ID: PAT_TA_58817.pep
VRRSRRLASPSRDSRRTLYRRASGAAGVCPARKGRSASLFALPRRPAQPDAAAPILARAARLAVTLVTSPARKRMKL

SEQ ID NO: 164400 - protein, 104 aa, Triticum aestivum
  unsure (1)..(104): unsure at all Xaa locations
  Clone ID: PAT_TA_58818.pep
MKPLPVTLALLALFLAASYQDLAVAAADADADGVGSGAPVLDSVCEGKCKNRSSQKVAGRCMGLCMMCCGKCAXCVPSGPLAPKDECPCYRDMKSPKSGRPKCP

SEQ ID NO: 164401 - protein, 81 aa, Triticum aestivum
  Clone ID: PAT_TA_58819.pep
WNRRTITPTNMNEYMNMSTRVGCRGSQPHRDVVYQRGLHLSTTSSIGPANGWLWQKRPHLSKGNGLNHYCALKGSMGFGRP

SEQ ID NO: 164402 - protein, 286 aa, Triticum aestivum
  unsure (1)..(286): unsure at all Xaa locations
  Clone ID: PAT_TA_58820.pep
PAGYRYMEDEAEKLMAESFSKNFIDYEEYPQSADIQNRCVNMIGDLFHAPPGSSVGTSTVGSSEAIMLGVLAMKRRWKNRRIAEGKSTEHPNIVMSSAVQVCWEKATRYFEIDEKLVYCTPDRFVMDPEQAVDLCDENTIGMCAILGTTYTGEYEDIKAINDLLVERNLDVPIHVDAASGGFVAPFVVPDLEWDFRCEKVVSINVSGHKYGLVYPGGGXVIWRSPEFXPQELVFNINYLGXDQSSFTLTFXKGASQVIGQYYQLIRLGKHGYRAIMSNLTRTXDYL

SEQ ID NO: 164403 - protein, 147 aa, Triticum aestivum
  unsure (1)..(147): unsure at all Xaa locations
  Clone ID: PAT_TA_58821.pep
SILNYKSIYYSYHLLSSLSPSCSSCCKAKSSFACLKQNNAQRDRSRSNKIGTMLRTSELPCAIRPPLAQLCLLRQPPSIHKRSPARPHAAASAIRPEREREEGAHVPGSGSRCRCRRRLCCLSDRRSPIWRCGGDERNVSFVFDXGR

SEQ ID NO: 164404 - protein, 80 aa, Triticum aestivum
  Clone ID: PAT_TA_58822.pep
GPFFFFFFVFKEEFSRVPLLHNHSITSLIASINQSMPYASSPVKSTKVASFATKSPSQSCFPKPVSASHASTLEVPDRPA

SEQ ID NO: 164405 - protein, 58 aa, Triticum aestivum
  Clone ID: PAT_TA_58823.pep
YRDKHFVRHSFILYQLGSTKKSCGTVELIMRIQKCSFCIKCLFRNVHFSEVGDVSTPS

SEQ ID NO: 164406 - protein, 221 aa, Triticum aestivum
  unsure (1)..(221): unsure at all Xaa locations
  Clone ID: PAT_TA_58824.pep
MASYHRVHPVIVDGAPPPVPEQNKDKLPPPPYGDRLPITAPAPGAPAPLKAPRRKRHSRCCRCVCCTLLVLIVLVVALGATAGILYAVFRPKIPTFRVERLTSTRFDVNTTSMTVSDAFEVQVITDNPNRRIGGYYDGGWVAASFNGTELCRGAFPKLYQGHRSTVRPLITLQGETRLDSAVAAQLAQQRXAGFVPLTVTARVPIRIKFGALKLWTMNGKA

SEQ ID NO: 164407 - protein, 91 aa, Triticum aestivum
  Clone ID: PAT_TA_58825.pep
RPVRTWASARTSSSTPCWSASRSGTASPCPSTSEASPGPPWRRGGGGFQSTSKNKTLNSFVHVLLLQFLSPFAFRCSCVGVDRRVALLLIV

SEQ ID NO: 164408 - protein, 220 aa, Triticum aestivum
  unsure (1)..(220): unsure at all Xaa locations
  Clone ID: PAT_TA_58826.pep
MASELNAGSLFNVDGVVAVVTGGATGIGLMFVKALLQNGASKVYIAGRRKEKLDQVAGSLGDRVIGVQCGVTSKDDLKNAVSQIEKDVGYINLLVCNSGIGGPQVKPITPETTLEEWAQSNLDTDFDAYVNTFAINTASVWYTSMAFLGLLKKGNEKANVEQTSQIIVTSSIAAFNKKAXPGGWAYGQSKAGAVLAAKQLAVALPQWNIRANCICPSLFP

SEQ ID NO: 164409 - protein, 80 aa, Triticum aestivum
  Clone ID: PAT_TA_58827.pep
RVITVHSLIQVESSMCHSDDQDPWDGIPIRYSVRYMFIQCITSVPFTIGSPLRGEAVLRQRPSHGDPEQSPGSSQPGVSM

SEQ ID NO: 164410 - protein, 89 aa, Triticum aestivum
  unsure (1)..(89): unsure at all Xaa locations
  Clone ID: PAT_TA_58828.pep
MKGTKLAAILILQAVLVMGVLSHVNADFFPKCCNNXGPFSGVDVCDDAHPKCPKGCSACRVVSTSPEMWRCADMKSTVDXTCGGPCKKY

SEQ ID NO: 164411 - protein, 102 aa, Triticum aestivum
  unsure (1)..(102): unsure at all Xaa locations
  Clone ID: PAT_TA_58829.pep
SCGAAMAEQLHNHQXRPKRIIRRPRSCSLRIQRTLLGILSKFCQSKFHTLCSGILPPDQEDLSVVGREFMALNTNCEDPRRISQELRERGTNWKRLQPDRRP

SEQ ID NO: 164412 - protein, 117 aa, Triticum aestivum
  Clone ID: PAT_TA_58830.pep
RPGSDKTGSFSPLDIFIVIFFSFLLHQRSSSLHLNSIMASNDPKPDTANNKPENASDDARADVTAAVEELLNSLSNKFAGVSSEIFAKMDEMSRRLDNLEAALQESNKPKDGSANKP

SEQ ID NO: 164413 - protein, 187 aa, Triticum aestivum
  Clone ID: PAT_TA_58831.pep
RPGPDCAPAATAFAVTKTISVTGRDFTVTDAHGAAVMQVEAAVFSFLQHRSLLLDAASRRPALTLQDSTYLASTRWEAFRGDSTSRRNLLFVAVKTAPVQLARTKVRVFLAGNGSGERVPDFVIGGSYYAGACTVSAGGGGGGDDSDGTIVARISRQNTARRRSSGGTRIPRGSTPASTRRSSSRSP

SEQ ID NO: 164414 - protein, 122 aa, Triticum aestivum
  Clone ID: PAT_TA_58832.pep
RPVRVSSYRYELGSDTFIRNHLRRLYDAMLEQNLIKVIEPFSRVEIDHIANMVGLDTQQVERKLSQMILDKVIIGVLDQGAGCLIIFDETHRDESYDAALATIEKLSSVVDVLYTNQASMLE

SEQ ID NO: 164415 - protein, 70 aa, Triticum aestivum
  Clone ID: PAT_TA_58833.pep
HYNYFAVYIQKYADSFLIAFLPVRNDISFQSITQSPSDVHCSTNSLKTVIVTKLFITMKSTHSFNPDRPA

SEQ ID NO: 164416 - protein, 81 aa, Triticum aestivum
  Clone ID: PAT_TA_58834.pep
IVEMKRCDPVLLNFQLKHAGFASADNARNTWLSTVSFSIVRQATSQPRTRLSRRMPSSSTVFAKASSPRNRSGEMHPTRPA

SEQ ID NO: 164417 - protein, 109 aa, Triticum aestivum
  Clone ID: PAT_TA_58835.pep
MASRNLSKALRGPARQLASAPRVQQRTFVSAARAAVRAGAVARPVASGPIQQQIRGVKTMDFAGHKEDVYERADWPQEKLLEYFENVDASKVCYSGCYVVPKKKKKKAP

SEQ ID NO: 164418 - protein, 131 aa, Triticum aestivum
  Clone ID: PAT_TA_58836.pep
SVLPTSPQDRNANLEFSGETLPLPASSEAMPLSTMLCSPSAGYTQYPPTSRLLDPHWLHIYQHGEGKLDRGGWHNHLATDSLSRLVDAQGDRTMLCVVSATVRALTLADAAVGVSRCYHVALPCLALEETL

SEQ ID NO: 164419 - protein, 98 aa, Triticum aestivum
  Clone ID: PAT_TA_58837.pep
RPVRVVLEMVGARDKNISPNTESSSQYFPQWIYEHLDEYCVSASEINGEITEVVRKMIVVGLWCIQLRSTDRPTMTRVVEMLEGSTTGLELPPKVLLS

SEQ ID NO: 164420 - protein, 64 aa, Triticum aestivum
  Clone ID: PAT_TA_58838.pep
VAMDWYEKVKKHMSSPFFIESFYCKAQLPQVSGGVRSSWHSWMGGYLPDNPSNQQVGYSRNRPA

SEQ ID NO: 164421 - protein, 121 aa, Triticum aestivum
  Clone ID: PAT_TA_58839.pep
AGRSGRFPKRRGNQVKKTTYAASSQIRAIRRKMTDIIQREASSCTLTQLTSKLIPEVIGREIEKSTQGIYPLQNVHIRKVKLLKAPKFDLGALMALHGESGTDDQGQKVEREFKERVLEEV

SEQ ID NO: 164422 - protein, 129 aa, Triticum aestivum
  Clone ID: PAT_TA_58840.pep
RPVRGWSIIPSGAKIGINPCVVTRDVGVFGEDVDVFRPERWLRGKGETEEGHASRVRRMHECTELMFGHGSRVCMGKYMSKLEMYKMFATLYVNFDVRITDPSHTWKYENNWFMYHRDIPCKISRREKA

SEQ ID NO: 164423 - protein, 55 aa, Triticum aestivum
  Clone ID: PAT_TA_58841.pep
MGFRVSLLEGISIFSKLSIINYQMIAVKARELWRGYYTGKRAAGGKGTLADLPSL

SEQ ID NO: 164424 - protein, 47 aa, Triticum aestivum
  Clone ID: PAT_TA_58842.pep
AGRAGKYSQRVDVSRSNYLLSFFNHSMYYIPFNKMSFARKKKKKKAP

SEQ ID NO: 164425 - protein, 215 aa, Triticum aestivum
  Clone ID: PAT_TA_58843.pep
AGRSGIEASHYQKIREGDSKSSSLEYRTIKNYGRTLAGVGLYPLDTEKLDVGEGPALEYDMYLYTNTSAANVTIFMSPGANYLGDRNPLEYAIVLYPSGEEQPDPTLVRPIGPNVGTNMPDGWGYAVGNAVWGLYGNYTTSSFEVPKEGAYTLRIWALLPNILIQKIVVDLGGVRQSYLGPPESFLLGRDEQGKYNGTSFASTPGILGGTYDKSS

SEQ ID NO: 164426 - protein, 228 aa, Triticum aestivum
  Clone ID: PAT_TA_58844.pep
PAGSGTVPRLMLVLDPIPVTIEDHEETVELEVPYSPKDPKFGTHKVRFTKTVYIDRSDFREEDIKGYFRLAPGKTVGLLNAPHPIKATSFEKDESGKVTSIKAVFDKESKPKTYIQWVPEGSIKLEARVQSPLFKSDDPTAVEGGFLNDINPDSEVVYPEALVEEGFNEVRQRAPWPVTAGETNEASGPESVRFQAMRVAYFAMDSDSTDDKIVLNRIVSLKEDREKN

SEQ ID NO: 164427 - protein, 151 aa, Triticum aestivum
  Clone ID: PAT_TA_58845.pep
MVATKTGELRALFLSLDRDADGRISAVELRGCMRATLGEDVPAEEAEALVASADADGDGLLCEAEFLELAQQAAWAGADKENDELRIRALREAFGMYKMEGQGCITPASLGRMLGRLGAERGAGECRAMICRFDLDGDGVLSFDEFKIMMS

SEQ ID NO: 164428 - protein, 74 aa, Triticum aestivum
  Clone ID: PAT_TA_58846.pep
SAPFWGDWGPGPPPGLAGFVNLISDFLHPGGSLIFGPPRAQGPFFFFFFLTKIFFFFFFFFFFFFFFFFFFCRR

SEQ ID NO: 164429 - protein, 89 aa, Triticum aestivum
  Clone ID: PAT_TA_58847.pep
VLRAASYSRTQQRRPSDVADAPRDSCTALSSGYKTPRGLLPMQKLIAIAGCIRSSPYNDSRHSRFVTSALYKTQSKMQCMKYVLTYLAY

SEQ ID NO: 164430 - protein, 75 aa, Triticum aestivum
  unsure (1)..(75): unsure at all Xaa locations
  Clone ID: PAT_TA_58848.pep
SYVATLHTINPHSQRHIRTFCIKQHRYISIKQPVTRYVVSLQYFLQLLYWSQYLCLDLEELDSANRPGSXLYRPG

SEQ ID NO: 164431 - protein, 61 aa, Triticum aestivum
  Clone ID: PAT_TA_58849.pep
IGLGASSRSGGSLLFGRGFFFMCGFFFFFFFFFFFFFFFFFFFFFFFFFFFFFLIQNSKSC

SEQ ID NO: 164432 - protein, 82 aa, Triticum aestivum
  Clone ID: PAT_TA_58850.pep
MENGAISQGEGKDPSSFLGNIIGNPVTVKLNSGVVYKGELQSVDGYMNIALEKTAEYVNGQKRREYGDAFVRGNNVMYISAD

SEQ ID NO: 164433 - protein, 53 aa, Triticum aestivum
  Clone ID: PAT_TA_58851.pep
PAGPGPSEVESDAPKKTKEEWKEISQKYKSKKLTKEEKEKRVQERIQEIMQRD

SEQ ID NO: 164434 - protein, 70 aa, Triticum aestivum
  Clone ID: PAT_TA_58852.pep
RGLFFFFFWSCMRVSFSYSAELKYAYLSSPEAERRNVVYQTLPSKGIAAQMLSCLCRNVWELAMSTRPGR

SEQ ID NO: 164435 - protein, 57 aa, Triticum aestivum
  Clone ID: PAT_TA_58853.pep
AGRVGTRRQRRWQRQHQHGCPCPRRCRCSRPDLLSIDEARLLAFLFKGVILCRHHVS

SEQ ID NO: 164436 - protein, 42 aa, Triticum aestivum
  Clone ID: PAT_TA_58854.pep
RPGRATRVSPDQLPPLPAHEEVPAEKIDASIDKWFFISGASA

SEQ ID NO: 164437 - protein, 265 aa, Triticum aestivum
  unsure (1)..(265): unsure at all Xaa locations
  Clone ID: PAT_TA_58855.pep
MAERNLSQIISQLKHSPSMSYTDANALLSKAKLALLKLNALTPSPSTPTQLLPLARETYEQGALFAIRARNPEAFTRYVQQLQPFYELPASVLPPNLLERNKVTGLSLLLLLTQGRYGEFHTELESLENREGGGGDVESDRYLGYPIRLERWLMEGSYDRVWKAMKSSEVPCDEYSVFSEILKNQIRSEIASSSERAYPSLPISSTKSLLFLDSEGDVISFAHHRGWIVRDGHIYFPDAAEGENGDQNKEMSQMVIXDALGYARE

SEQ ID NO: 164438 - protein, 168 aa, Triticum aestivum
  Clone ID: PAT_TA_58856.pep
MINLFKIKGQKNEEAANSKGGPPVKKQSPGELRLHKDIAELNLPKTTKISFPNGKDDLMNFEATLRPDEGYYVGGTFTFTFQVSPSYPHEAPKVKCKTKVYHPNIDLEGNVCLNILREDWKPVLNINTIIYGLNLLFSQPNDEDPLNHEAAAVLRDTHRSSEKCQRRC

SEQ ID NO: 164439 - protein, 72 aa, Triticum aestivum
  Clone ID: PAT_TA_58857.pep
SVHQRRSKSKSTFMQPHLFGQATIRFLQQSNRLLSVPALPEPFFPSFHPIIAPYRQVFSPICTCAASSTPKF

SEQ ID NO: 164440 - protein, 138 aa, Triticum aestivum
  Clone ID: PAT_TA_58858.pep
MASQLVESHRAGSEVHKGNDICKKKTVELLEVLGLPKGLFPMDDIEEVGHNCESGFVWILQKNKKKHMFNKLNQTVFYDTEVTAFVEKGKMKKVTGVKVEEFSLVEVYVDESSADKVTIKTDTGLADTHDAVVFALGE

SEQ ID NO: 164441 - protein, 193 aa, Triticum aestivum
  Clone ID: PAT_TA_58859.pep
PAGLRAGSFGYAAPEVMRKEGHGKPVDMWSMGVITYTLLCGYSPFRSENLQDLIRECTDNSVVFHERYWKDVSNDAKDFILKLIDPDADKRWTSEEALGHIWLTGENATDYNLLPEIKSFRARSRFRRIIEKIKLQARIEKLKAMEEDPDNSDLSAIFSEVARAKLADEKEEREVLRITQEVEKEVKRRSFQA

SEQ ID NO: 164442 - protein, 185 aa, Triticum aestivum
  Clone ID: PAT_TA_58860.pep
MHLPPPDLARRLAMAITKGDTSMVHSLIMQKSPSFNWTGGPLDEEKRTSAMNMAAHRGHSKILELLSQVEPRANLAANDPNDNGMTPLHCACRGGFPIMVRWLLQFDTVKAAVDKKDNEGRTPLSYAAQVGFERTVRSLLKFDAVDPFSYDHREKTPYDYAVNGGHRYVAKMIHNKKDTRNQVRW

SEQ ID NO: 164443 - protein, 82 aa, Triticum aestivum
  Clone ID: PAT_TA_58861.pep
LTNTATKQRAGTRCSKADLSLYKEIATRAINFLARHLYQHLQPLNSSKVQRRVVHTAQQPPFPPLWRLHIGVIVGLAAEPGR

SEQ ID NO: 164444 - protein, 103 aa, Triticum aestivum; identical to SEQ ID NO: 107316
  Clone ID: PAT_TA_58862.pep

SEQ ID NO: 164445 - protein, 131 aa, Triticum aestivum
  Clone ID: PAT_TA_58863.pep
RPSDSLIGISGMVSFLQDTTLNEEQLDYTNTIQTSANSLIMIINDILDLSKVDAGMMKLKHEWFHTRSMIEDVNELVSTMAIAKRLELNYLVEADVPAWVKGDKVRIRQVLLNVTGNAIKFTAEREVFSRC

SEQ ID NO: 164446 - protein, 141 aa, Triticum aestivum
  unsure (1)..(141): unsure at all Xaa locations
  Clone ID: PAT_TA_58864.pep
GQKKKITITNDKGRLSKEEIEKMVHEAEKYKSEDEEEMKKVESKNALENXSYNMRNTIKDEKITSKLPADDNKKIEDAIDTAIQXLDTNQLADADDFEDKMNELDALCNPIIARIYQGAGAEMEGRMDDESPGCIRRCWVQ

SEQ ID NO: 164447 - protein, 112 aa, Triticum aestivum
  Clone ID: PAT_TA_58865.pep
GCSGWVASVLVPLGVGGSTTRSGAARFSSSFSSMLGLGPWILHGRLGCALCPMVYIRGLVICPLGAWRVVRVYMGMNVGCSTSIPSSEDFELKSSSEENPNPKPIHLRTQSD

SEQ ID NO: 164448 - protein, 74 aa, Triticum aestivum
  Clone ID: PAT_TA_58866.pep
VNNSTLKNCCDPHKLVGYHHAPHRSLLVTLYVIMSEVLHAPESPECCPRASRGSHPRLSGSSMLRAGGKTRRLV

SEQ ID NO: 164449 - protein, 41 aa, Triticum aestivum
  Clone ID: PAT_TA_58867.pep
SSSIFLKEYPMEAYFLFSALLSCKSFKTRGMYSLAQKMGYK

SEQ ID NO: 164450 - protein, 46 aa, Triticum aestivum
  Clone ID: PAT_TA_58868.pep
LSIFNVASFIYFFRYLFDNCSLFFSFFFFLDLIFFLVFTHFYYFFL

SEQ ID NO: 164451 - protein, 78 aa, Triticum aestivum
  unsure (1)..(78): unsure at all Xaa locations
  Clone ID: PAT_TA_58869.pep
PGIKQKKGNVFSLPRLGFRRSRATFIWSSGSCXDKPAGVKPNARLPVNLRIRLLACLPKFHTTTRTPPDDTAQRATLR

SEQ ID NO: 164452 - protein, 68 aa, Triticum aestivum
  Clone ID: PAT_TA_58870.pep
NSRAYSDGTQRLRFAQANAGQLDRLGYHTECSENHTYAHVRMHKQEQQIVCLQDMVYLEMADKLATTM

SEQ ID NO: 164453 - protein, 146 aa, Triticum aestivum
  Clone ID: PAT_TA_58871.pep
RGYNRDTTTWVLEWITGNVHHEAKAFDLIELTGISTPGELYEPGCQLHRDVVESIFQKAELNMSQILSMMKPLPRDAEYPKEFFVEDLEYLPRTIYHIIRRTLVPIKGHSSSAKLDGAMKTLVFHILNGKSFNTQDFFIRQFIASA

SEQ ID NO: 164454 - protein, 117 aa, Triticum aestivum
  Clone ID: PAT_TA_58872.pep
RTTALMKHEYMMQCYWSVGVGDRRRSLSVDDASLGRCSRMLEDSGHGCSIRLLLSVMCLVKAGVTIECSNTDCVRMGKWTEMSGEPCFWDATVRDMGKLRTYTPSIIWASRRLWLAS

SEQ ID NO: 164455 - protein, 64 aa, Triticum aestivum
  Clone ID: PAT_TA_58873.pep
INMQIAQAVLNFQSCWSYISIRNTQITTDCSVFDMFYLRCVHVLMALWFSLMSFCHRKVGIQLI

SEQ ID NO: 164456 - protein, 48 aa, Triticum aestivum
  Clone ID: PAT_TA_58874.pep
HNSCTTNANLPHPHTAWAWTPPLATRQRDPAAATPSLLAGALIHKLPT

SEQ ID NO: 164457 - protein, 81 aa, Triticum aestivum
  Clone ID: PAT_TA_58875.pep
VSGCSVRVSSFRRLDIFSYLVAKNKPYNKELYPFILYRSESEPLQFSNHCLHSVNYRLHPPVSCWSYPRGSLKFRVLFTLV

SEQ ID NO: 164458 - protein, 106 aa, Triticum aestivum
  Clone ID: PAT_TA_58876.pep
FLSSSPTTRSFMSSRSAMTGRRSFGWTCDQGKKTKAAEALERSRRHAATVAEMSRRTAEPSIELSLACKGSHKLARRVGDHDELALLKSRASNDDIFAGLIKLQVL

SEQ ID NO: 164459 - protein, 62 aa, Triticum aestivum
  Clone ID: PAT_TA_58877.pep
FVAKDKLGQFLIMRKELPRTHGNYRQASFHHAHMIHVRYFDNLICGWTGAWVLPLLGQASHL

SEQ ID NO: 164460 - protein, 96 aa, Triticum aestivum
  Clone ID: PAT_TA_58878.pep
CVRTQRASDRSGRTYYGHPVLATVGETTTDSDVHSDDVSLRADYTIPPTCVADRLHGIPADATLVANLSCALCSNDLEWVLAIISHLLDQLPPYAI

SEQ ID NO: 164461 - protein, 60 aa, Triticum aestivum
  Clone ID: PAT_TA_58879.pep
GPTLIQPLGRPSLYSPTTPVILRRRQPHIAAEPVNRRTPLSMGIHCRVFPVDFCRLLAAV

SEQ ID NO: 164462 - protein, 65 aa, Triticum aestivum
  Clone ID: PAT_TA_58880.pep
QVNSVLESPFFSLVMLHHPEIILRLGGCKTLAASTCTDDLHQLFFRVCHKLVMIRSNLVYIFIVV

SEQ ID NO: 164463 - protein, 85 aa, Triticum aestivum
  Clone ID: PAT_TA_58881.pep
ILENFFLSIPIIGMLHTLFTKDERTRYFYILKIFPFSLKGDAKIWFNSLDPGCVRSPHDMIYYFSAKYFPAHKKQAALKDIYNFV

SEQ ID NO: 164464 - protein, 66 aa, Triticum aestivum
  Clone ID: PAT_TA_58882.pep
HFSGTYNCYLTATENNWLEKQCIRSTVCYRTNVGTKVNMYDDIRTCEQNLMVVYLFQLAVYEISPK

SEQ ID NO: 164465 - protein, 84 aa, Triticum aestivum
  Clone ID: PAT_TA_58883.pep
TPTHCAMPCIFPNVDSGFIHPSIVLFLRVAATLYISSELWQTSMLRDSRLIRCRLLSDANGSRGACAYPVRVLQFTISNVVKDT

SEQ ID NO: 164466 - protein, 74 aa, Triticum aestivum
  Clone ID: PAT_TA_58884.pep
DEHTTINLENTGYGLHKRDHRGSRYQHDVGRNPRGRSFTFGMDPTGETRITREKHKGKHGEIQYDHLTDQESIT

SEQ ID NO: 164467 - protein, 57 aa, Triticum aestivum
  Clone ID: PAT_TA_58885.pep
GLIDRGSQNNCLIGGDDLKSGQTRINSVWAEMHVGAGCKLRRLGSADNLGKYDGVGL

SEQ ID NO: 164468 - protein, 54 aa, Triticum aestivum
  Clone ID: PAT_TA_58886.pep
LQLMDGPDLRHAPTLKASTSLVWAADDVEVWLITGLVPVSVVECKSPSLRDDGI

SEQ ID NO: 164469 - protein, 79 aa, Triticum aestivum
  Clone ID: PAT_TA_58887.pep
NTMGMDGGTARPWSTMRLNRSWIHIPSRFSFFQVFCLLEAVSDKPSHRIHSGTDTPRKLGAQTYKAIPRWSLLTIVIPV

SEQ ID NO: 164470 - protein, 60 aa, Triticum aestivum
  Clone ID: PAT_TA_58888.pep
QYHLGSQSTVQNSHNVQMSDSYPPNFFKKRSPMSAVLQHAYHMSRQFHPSSDVLNRLTLS

SEQ ID NO: 164471 - protein, 56 aa, Triticum aestivum
  Clone ID: PAT_TA_58889.pep
CLSAAERSGVNTTSTIHAVDESGSCSHSTQDTLEGNVSFELSVTFMHMRASNEFQY

SEQ ID NO: 164472 - protein, 62 aa, Triticum aestivum
  Clone ID: PAT_TA_58890.pep
GANTCSHTRTHATLTRTHAATHTRTHACTHHTTNTHFHAQVLNLHVHAHTSGPDKRIHNQVV

SEQ ID NO: 164473 - protein, 160 aa, Triticum aestivum
  unsure (1)..(160): unsure at all Xaa locations
  Clone ID: PAT_TA_58891.pep
GHAPIAATGLWKARIPPKIKVFLWQLCQDRLPTSINIAKRNGPASGPCALCDDAEDADHVFFRCPLVRFAWSAVREAAGVDXDPRSRSELVSYLSSIQGPLRRVMWTSASAMLWALWHIRNKFTIEGVFPPHSADVIFKCILFLQQWATLGRQQESDLHH

SEQ ID NO: 164474 - protein, 132 aa, Triticum aestivum
  Clone ID: PAT_TA_58892.pep
NPPSSSSSTSLSPASPSSTLTTSSSPTINGDIGPMLIGTATIIESSSLLALRLLNKAYSSCKSHIYTCLMLAIPMFPFVHDVSPCLARLVRRFVNFVIIRLCMLDAGNTDTCLHKQRLLLDAPLLQHHCAHD

SEQ ID NO: 164475 - protein, 99 aa, Triticum aestivum
  Clone ID: PAT_TA_58893.pep
YGSLVSSFLMRCCRPRELVSGVSGDELFPVLNMLLESVHGFLHQPFALHVQHDILVQKFLDDDVGPLQQGSGLLLLLRTSDDLRPQQVALGLELLIALP

SEQ ID NO: 164476 - protein, 98 aa, Triticum aestivum
  Clone ID: PAT_TA_58894.pep
AGELLLLFMCLQIFENKLQYKKNGWSVQLLQPTQVVAPFATTVAAQTLVWSSSTSFSRGLPASPAHDQDNLDRLHMLLTKLIGSTCCPGVYPYGAEMT

SEQ ID NO: 164477 - protein, 87 aa, Triticum aestivum
  Clone ID: PAT_TA_58895.pep
YGCEKTTEVDGAGVGGLLAVLTSCLTNMDGFIHSHLNLLAIASHACTHAHVGAHLPGMQLGQQARPPACTIETAYLRPSRSFDPGRH

SEQ ID NO: 164478 - protein, 119 aa, Triticum aestivum
  Clone ID: PAT_TA_58896.pep
KWTPTPCVLGFATMETSCVHGTRDGHESKMLMPFVRRQSWGLARCPSNTHKGACRRPSCMPSSACSCASATTRRLGWRPRPRTKAPRRCPTHPLPRARSPLETSGRAGSCPGPGRRNLA

SEQ ID NO: 164479 - protein, 62 aa, Triticum aestivum
  Clone ID: PAT_TA_58897.pep
ASEEGPGIHCTHPLMMRNHRSGCTFNCEQPSLNRLLEQIKDEAIAWGRAGATECLPCTWAVH

SEQ ID NO: 164480 - protein, 87 aa, Triticum aestivum
  Clone ID: PAT_TA_58898.pep
AVCGGVIRSLSISTRVIPSFTSHRDVVLPFFSCRRPAACYNGQRSLLAPPPAGVVPWRRRVYVLCRRVLPCLYLDGWLLFPSTIVTG

SEQ ID NO: 164481 - protein, 137 aa, Triticum aestivum
  unsure (1)..(137): unsure at all Xaa locations
  Clone ID: PAT_TA_58899.pep
AHIKVLRRTAIPLGTTVIDKINPAELVNLVDILGPSSTPVMITITIRMGANNMRVKLPHPIRAVCNSGHIVTWITDPMHRNTITATCGLKTHPFDSIKNYVPPIFHLHYQEGSHPRGIHLEMTVQHVIXYIGGSRTV

SEQ ID NO: 164482 - protein, 73 aa, Triticum aestivum
  Clone ID: PAT_TA_58900.pep
MRARYRTALSCLTDRCYALSCLVGRCYARHIFQGLQAVSAGGTLQHGAEVYQWRPRRAQLFARREEVSLGSVV

SEQ ID NO: 164483 - protein, 57 aa, Triticum aestivum
  Clone ID: PAT_TA_58901.pep
NTIPFLKILEIIRGTFENILNCLKVLPRVFEHFKIFIVLKMPKFKYLWLVQKSRMAP

SEQ ID NO: 164484 - protein, 119 aa, Triticum aestivum
  unsure (1)..(119): unsure at all Xaa locations
  Clone ID: PAT_TA_58902.pep
LGGITARRLHLNAKDGVFFGGIYATRLANYLRVPIKGNDIELAXTFLDYNALVCYQFLVRNEQSLLYRIIFDRQHAVHITXXSLAFFNFQVKRRYFITREEANEYEREVEATCLHVADL

SEQ ID NO: 164485 - protein, 53 aa, Triticum aestivum
  Clone ID: PAT_TA_58903.pep
KKNSLQTLSIFNFYFYYFFFFYFYFLFFFFFFFFFFFFFFFFFFFFFFFFFFS

SEQ ID NO: 164486 - protein, 33 aa, Triticum aestivum
  Clone ID: PAT_TA_58904.pep
SAFGLCGRHAAASSSRVSTVAARVIFLYASAKG

SEQ ID NO: 164487 - protein, 45 aa, Triticum aestivum
  Clone ID: PAT_TA_58905.pep
LYFYSPHDMCFAWSVLYYISICFLVFQNHPCCTHLLGESHLIRIY

SEQ ID NO: 164488 - protein, 70 aa, Triticum aestivum
  Clone ID: PAT_TA_58906.pep
WALVGLRGEREGSSQEVAPPKGSPNRTRGGGCGPSFPLPLPHLPSSPTWTKKRGSQFLLGVRLPPLGAPP

SEQ ID NO: 164489 - protein, 93 aa, Triticum aestivum
  Clone ID: PAT_TA_58907.pep
CCIQFLKAIPFLAYRLLLQSSKKFRDTTPAKHYMNSLIMVSTCAILGLSSGASAVHSTPIFTIPIVSSPSPSSSPPSAAPLAVTTARSTIPML

SEQ ID NO: 164490 - protein, 94 aa, Triticum aestivum
  Clone ID: PAT_TA_58908.pep
VNPPHHPYRRGFSLPPHPFFQSFLNFFGAQLHHFTPNSIVYLAAFVCLCENFLGCRPHWGLFKHIFTCRSQSVKKAKSSDERTQVIQLCGGLAI

SEQ ID NO: 164491 - protein, 61 aa, Triticum aestivum
  Clone ID: PAT_TA_58909.pep
RQETGNDTSRTSPADASHATRLEQGNGFSSSLDYETNNQIELSSRQSIPCIGKLQSLVHVS

SEQ ID NO: 164492 - protein, 137 aa, Triticum aestivum
  unsure (1)..(137): unsure at all Xaa locations
  Clone ID: PAT_TA_58910.pep
WLFLGDFNEILSLDEKVGGGDRPQXLLDNFREALESCELSDIGYYGDKFTWRNHSKELSTYICERLDRATVNAPCCDWFPNFSVLNGAPRHSDHRPVIVCTQGXNRTERCGDHGFCFEAWWLQDEGSSEDVQWAQGE

SEQ ID NO: 164493 - protein, 119 aa, Triticum aestivum
  Clone ID: PAT_TA_58911.pep
EEPNDDKRLPAGKSAAKDGGDKKGKKKANKSVETYKIYIFKVLKHVHPDISISPNAMSIMNSFINDIFQKLACEAAKLARYNKKPTITSREIQTSVRLILPGELAKHAVSDGTNAVTKF

SEQ ID NO: 164494 - protein, 142 aa, Triticum aestivum
  unsure (1)..(142): unsure at all Xaa locations
  Clone ID: PAT_TA_58912.pep
FQDYTLIWWEQVIXRRHTRGEPPITTWTXMKDVMRARFVPTHCTHDLFKKLQLLKQGTKTVEEYYQEMEIAMIXSNVKEDDEQTMARFLNGLNHPIKRIADFQPYSNLLDLVHQATKAERQVQDDFKYAKYSSKNYGSYSQA

SEQ ID NO: 164495 - protein, 71 aa, Triticum aestivum
  Clone ID: PAT_TA_58913.pep
IRTEEIKSKKKNRERESENVAGTHLVAQPANAPPPCHLTPLLEGLGAWSPRAHAHRAPFAAFVQRVCFTQR

SEQ ID NO: 164496 - protein, 79 aa, Triticum aestivum
  Clone ID: PAT_TA_58914.pep
GRLNRQFAYIRRPGASKPPLGHTFLDLLYRHPYVDDRGGGRSDRHVLKISSDGWVQCVFVSGGFAVCLCLNVRGQCEVL

SEQ ID NO: 164497 - protein, 94 aa, Triticum aestivum
  Clone ID: PAT_TA_58915.pep
ENPGTQNLKCQMSNGGSGNAVVVCTWQCGSGMMAIYVSELKLPSLSSRNTLGDTSHNSNKLKQNWVKLVVAEVYGGHAYAEVAVVVDEEAIIPK

SEQ ID NO: 164498 - protein, 51 aa, Triticum aestivum
  Clone ID: PAT_TA_58916.pep
FHTSSSTRHMNGTNPFRWNGAVTFHSTLFPNQTHPTYIANNRNFQWHHSPA

SEQ ID NO: 164499 - protein, 119 aa, Triticum aestivum
  unsure (1)..(119): unsure at all Xaa locations
  Clone ID: PAT_TA_58917.pep
GAATELDDRFKLDIAQLVPSSFEDVYGGTLFEESMTILDSESXKSFNDALSAHDHMGIGTLLRECHGLLNGLQSRIDSRGGDGMRSRANVYAFPQIICIVLDPSKSINKAPSDGLVNDI

SEQ ID NO: 164500 - protein, 122 aa, Triticum aestivum
  Clone ID: PAT_TA_58918.pep
LLVIRPIAYLLSPSKLPFKNSNPPCASPTVGANYHGIVMSDVLVEGLSRGAIATRKLKGVNRDKGHGVYTGSAPCSEGKSLRSSFEWDCLCLDYQGAKSLDLALDPMLLALNRRRVIPLYIE

SEQ ID NO: 164501 - protein, 103 aa, Triticum aestivum
  Clone ID: PAT_TA_58919.pep
IRRGPPGPVPPLSQIRRDPLLVGRPSAIASHCATTATAASLHALPPAPELQIRSPRVATDLQALDPPGVTSHGRRSKDPSANKFRWSPAVQTRTPTASSMRGS

SEQ ID NO: 164502 - protein, 128 aa, Triticum aestivum
  Clone ID: PAT_TA_58920.pep
ALSKHLFHWKQHELEPLSWKKRLNIALDVARGMEYLHTLAQQCYIHRDLKSANILLGDDFRAKVSDFGLLKSAPDGNFSVATRPAGTFGYLAPEYAVTGKITTKADVFSFGVVLMELITGMTAIDERR

SEQ ID NO: 164503 - protein, 92 aa, Triticum aestivum
  Clone ID: PAT_TA_58921.pep
CSSLHASALDEYSRLLFSPFFPLYIHGCYDQMLEPRSQTPLSMMTHTTLEVPTAMCRPRTTTRSSLGGSRAGGIPVFRSVSQLVLAILWQHV

SEQ ID NO: 164504 - protein, 54 aa, Triticum aestivum
  Clone ID: PAT_TA_58922.pep
NRLLHANLFCLGTKGSSSFRLVGLSSRHTADNTIGKGHMVAAEQPLFGQHLHLT

SEQ ID NO: 164505 - protein, 48 aa, Triticum aestivum
  Clone ID: PAT_TA_58923.pep
NKRNNAHVQKKKRKTKKQKIKKDKKDKKRKKKNKDKKKKGRPKRIKPK

SEQ ID NO: 164506 - protein, 52 aa, Triticum aestivum
  Clone ID: PAT_TA_58924.pep
LVFFINLRAHLSMDIDCIKIYAYVGNHATDSSLHRTLISHTQCEIPCVRPSC

SEQ ID NO: 164507 - protein, 53 aa, Triticum aestivum
  Clone ID: PAT_TA_58925.pep
RRDTLQGGRERCDAGLADREGFYSRLVSSGMGGDDTSTLRHASRATCSALWAV

SEQ ID NO: 164508 - protein, 57 aa, Triticum aestivum
  Clone ID: PAT_TA_58926.pep
CELRPLWAPEDPAEIPHACLETTHGQHSQWDEHRLTPSRVEHLVAQRSNHPWKSGDT

SEQ ID NO: 164509 - protein, 108 aa, Triticum aestivum
  Clone ID: PAT_TA_58927.pep
SQRWPYTLRTPSPRLMMGLIRSSSVARSASSGKLSSAASKSRLGFQYATLVRTLVMAPRQSFRTSLAREVALLEPKCSRALRNALEGPGSVGLWNHVRLRGLPHVWHP

SEQ ID NO: 164510 - protein, 76 aa, Triticum aestivum
  Clone ID: PAT_TA_58928.pep
LPCLQDSVAVVGYPLGGDTISVTKGVVSRSEVRPDAHGRSDRRGVHIDAVVKAGNSRGSAFNEQGECVGVPFDVFR

SEQ ID NO: 164511 - protein, 63 aa, Triticum aestivum
  Clone ID: PAT_TA_58929.pep
TPCSCASNDSLPNTQLSLRDLDMVERFFEWKSTRGRIEIRNPVVLLEYIGLNTCVGGSISENE

SEQ ID NO: 164512 - protein, 82 aa, Triticum aestivum
  unsure (1)..(82): unsure at all Xaa locations
  Clone ID: PAT_TA_58930.pep
TPASNEVNTTGNTTGRXQGKMASHDVIRYTIYISNVLDPVHADICISSNATSSNKSIIKHIIDKLTGDSANLARYNKNPIIT

SEQ ID NO: 164513 - protein, 59 aa, Triticum aestivum
  Clone ID: PAT_TA_58931.pep
ANRENEVNRQISPQRCNNAGRGSQWEPTVVVTNAHTLSSDQQVPQVPHRLRCPQCPLEQ

SEQ ID NO: 164514 - protein, 115 aa, Triticum aestivum
  Clone ID: PAT_TA_58932.pep
GTLFVNSVPASVLSDTGASHSFISAEFAFLHGIHYEEINTPLVVHTPAGQCQTSMVSHDVTVEIEGLEFLVSPIVLKSCSIDLILGMNWLKAHTASIVCTTKTVHLLHPSDEIVT

SEQ ID NO: 164515 - protein, 52 aa, Triticum aestivum
  Clone ID: PAT_TA_58933.pep
AICLRTEGNYEQRTPCFTQVWAFLMEVRPYSCLIIFKGIGVTRVDLPRDRFG

SEQ ID NO: 164516 - protein, 112 aa, Triticum aestivum
  Clone ID: PAT_TA_58934.pep
MDHGSSPTKICKSVVDEDIISNLPEALRDKILCCLPIKEAVGTCLLSRTWRYTWASMTELMFRTADFASGNDSADDDRRLLKFTDMFLFLHNGPILKFCLNTVNEMVSTGGH

SEQ ID NO: 164517 - protein, 67 aa, Triticum aestivum
  Clone ID: PAT_TA_58935.pep
NVFLTLFLNANMKMLMNFKKHHKFKNFEKLQKRAPKFKKCSSTRKILKLVTNLKNIFDIKNIYEFEK

SEQ ID NO: 164518 - protein, 40 aa, Triticum aestivum
  Clone ID: PAT_TA_58936.pep
KRWATSMQTISRSDVEDLDPQRADVCSLLDRHLVHRHIKH

SEQ ID NO: 164519 - protein, 34 aa, Triticum aestivum
  Clone ID: PAT_TA_58937.pep
LSPLAPSITCCRPSSVCLAPSTSVVFSQPYPWPR

SEQ ID NO: 164520 - protein, 74 aa, Triticum aestivum
  unsure (1)..(74): unsure at all Xaa locations
  Clone ID: PAT_TA_58938.pep
SSFVDPSYFFLTAFLLKFIYLGILSVGLFLFFLFVVFFXFLFLFFFYFFFFFFFFFFFFFFCFCAVTHIAHSSS

SEQ ID NO: 164521 - protein, 48 aa, Triticum aestivum
  Clone ID: PAT_TA_58939.pep
CLYNDHCLDIIIIILSSINCPTVICLPVVCYFSLEKPLVKSTAPGSLP

SEQ ID NO: 164522 - protein, 97 aa, Triticum aestivum
  Clone ID: PAT_TA_58940.pep
NQIVSDNKAMSCQCDHESSITLCHELHQTQYTQMSQTPHTDPLCLELHPTQHTQMTQTPNTDLHRRGTVQTNFIRQLSSRRGETAMPNASKLYSVTL

SEQ ID NO: 164523 - protein, 68 aa, Triticum aestivum
  Clone ID: PAT_TA_58941.pep
GCMQAYVSFNLLGPPRHPPPSSSTMPELIPRRRRTLQAIDLSHPRLRTGILASRPLVSSQFCRLLAAV

SEQ ID NO: 164524 - protein, 81 aa, Triticum aestivum
  Clone ID: PAT_TA_58942.pep
TAKRRRQKSTGSGVVVYESKSHCVGDSKKKKKKKKKKKKKKKKKKKKKKKKKKKKKKKKKKKKRKIKKDKNIKKKKKKGKT

SEQ ID NO: 164525 - protein, 66 aa, Triticum aestivum
  Clone ID: PAT_TA_58943.pep
KPISKNVMLLAIWANSSFSMFSSHTGFFPDPCNNAIWQLRGINETMRHHITFGISLEHLIPRASHE

SEQ ID NO: 164526 - protein, 120 aa, Triticum aestivum
  Clone ID: PAT_TA_58944.pep
SRRSYPAFCSSTSCSTFLQLWRSWPLVRWILQYCLSLPPCLSAAAATSLLELPTLASLALAPLTDCSTTSTSLPFFFLLLRRRFLFAAAVPSLSDPAASAFSPRSLLPSSACAHLSAWAY

SEQ ID NO: 164527 - protein, 74 aa, Triticum aestivum
  unsure (1)..(74): unsure at all Xaa locations
  Clone ID: PAT_TA_58945.pep
PGFLGRFTPSSNIPNRVLGHPAYVTWAGLMGYEDTRQKTLSRVRIGLSFAWMASLASRYEDSFLCNRLCTXLIP

SEQ ID NO: 164528 - protein, 54 aa, Triticum aestivum
  Clone ID: PAT_TA_58946.pep
MARRKGSNMYTASKIIQMDKGVNPSYFKDTVSQAFFDLQNGIQELRSDLRDLYI

SEQ ID NO: 164529 - protein, 71 aa, Triticum aestivum
  Clone ID: PAT_TA_58947.pep
GGLLWPPFFYLGFFGLSFFYFFYFFYGAMLYNDDHNTFIYLELNITTRYWNKDMTLYECLRQCTGMCNDLA

SEQ ID NO: 164530 - protein, 97 aa, Triticum aestivum
  Clone ID: PAT_TA_58948.pep
PYHSRSAVSQPCVSQAIFATKDLSQESYNFPFLWIFSFGGVRDKGKSVTLSLGKATFQRFSRETEHLPRRNGNAHETESPPILSISYCCLLSLALPP

SEQ ID NO: 164531 - protein, 61 aa, Triticum aestivum
  Clone ID: PAT_TA_58949.pep
WRFPPFLGNGITRVSSFNMDILLADSFTDRLICEIVVLLLLRPQPDMKIKKWRMLPLATLV

SEQ ID NO: 164532 - protein, 79 aa, Triticum aestivum
  Clone ID: PAT_TA_58950.pep
NASCSRTNNELQLAERLFGLQELRLKGCLPKKWLRTQGVHIVQVGFPPHRPTVKQPTSRPLLNLLENSNRLSTFLPKSG

SEQ ID NO: 164533 - protein, 92 aa, Triticum aestivum
  Clone ID: PAT_TA_58951.pep
GYGCEKTSTGIGFATPCIVSVYASSFCIFHEVADVYTYHRTFCNVTSSTLYLTEHLLMQLRSGCFLAYADTLLLPIISSPNICPSLHFCLPS

SEQ ID NO: 164534 - protein, 112 aa, Triticum aestivum
  Clone ID: PAT_TA_58952.pep
TSSCVVKYVHVYSIPRSIFAQDLPCVRYRRWPSTRRREALVKKKGKTSWVPHLTALGSFGASGQIRHDGCTEPASTSRLVSGEVETACNVVSTSRNRRVCFSKEVEPVVDVI

SEQ ID NO: 164535 - protein, 132 aa, Triticum aestivum
  Clone ID: PAT_TA_58953.pep
TATRRRQKSRGKKGTGRVERVEQLTFLTRVAKTPAQKLEILFHVISAQFDVNPSLLGHMPVNVWKKCVNNMLLVLDILQQYPNIVVDTSVEADEKETQKGADYDGTIHVTGDLVAFLERIDSEFFKSLQCSD

SEQ ID NO: 164536 - protein, 76 aa, Triticum aestivum
  Clone ID: PAT_TA_58954.pep
STCSIVVTPTLSSTEVSCFTNHRLIAKGNTANQIVKTITIQCYLVLRHVHPQVHTLAEGSLHHLSTDSADLLYAPR

SEQ ID NO: 164537 - protein, 96 aa, Triticum aestivum
  Clone ID: PAT_TA_58955.pep
TGKVFIFRSLSTMTKTFTTCNWAPSRVTKEDLNNFVETRVLSKKADIHWRVPGLKNPPEPKEGEIIVFTDHMIWGFTPPASVVFSQPYPSTSVVFS

SEQ ID NO: 164538 - protein, 69 aa, Triticum aestivum
  Clone ID: PAT_TA_58956.pep
GHQHASCHSCWLRAAKSGSCCSPITDLSCVRWCHKEPVHHHYSYPKFHFISHMLYYLSFFLTSSTSACL

SEQ ID NO: 164539 - protein, 135 aa, Triticum aestivum
  unsure (1)..(135): unsure at all Xaa locations
  Clone ID: PAT_TA_58957.pep
ADVAEDESELGAGTPCKATVQKPDERSRTGRLGEAAVHQYLAGQLGPSNVKWVNEEKESGLPYDIVITPEGGAAEYVEVKATVTSNXDWFHITPNEWQFALEKGDSFSIAHVVLKGSEKANIMMMKNPQKLCHQK

SEQ ID NO: 164540 - protein, 73 aa, Triticum aestivum
  Clone ID: PAT_TA_58958.pep
SFSPFLSSPGQEQFFQNDVRTNEKTACSAVDYLCGYLDGCSLDPHPRWCPDTLFVIQRTIHTSLRASCRRIAE

SEQ ID NO: 164541 - protein, 69 aa, Triticum aestivum
  Clone ID: PAT_TA_58959.pep
TSTRKEKSKACSHLYRYPTHHPARFHLPSALISCEKTLLIDTSERSWSGSCKAPSSAIVTLMLSMAPTC

SEQ ID NO: 164542 - protein, 79 aa, Triticum aestivum
  Clone ID: PAT_TA_58960.pep
EAILDEDSWEATQFFDILEIPEGNTRRNIKIEVAEMYRSTEDKYFNLSEKWNQGENVVGTTIATRPDPRYEMNLYQGNN

SEQ ID NO: 164543 - protein, 96 aa, Triticum aestivum
  Clone ID: PAT_TA_58961.pep
CSSDRSQASGIVRGRDDDPRVAGSKDGVMLPTGGAATSKGGKATSKTPPLAHASRSSQVMHDEQRRNAGDSERPHGKSPHHQSRDAQAGMHSKMMV

SEQ ID NO: 164544 - protein, 49 aa, Triticum aestivum
  Clone ID: PAT_TA_58962.pep
LTPHDHNQRRSHKRYEFSPTATIMQNLTSTYTISPTSCPSGFSAQITCR

SEQ ID NO: 164545 - protein, 124 aa, Triticum aestivum
  unsure (1)..(124): unsure at all Xaa locations
  Clone ID: PAT_TA_58963.pep
MPTYIRATRKTRDFRRCDPCWGCDKFMRRDALERSASLKSDCFTSRCDIVVCKDNTPDATGSGTGTEVLLPDIHQHFSNLLQNKVGADVTFEVXGETFAAHRCVLAARSEVFMAQLFGHATPSV

SEQ ID NO: 164546 - protein, 74 aa, Triticum aestivum
  unsure (1)..(74): unsure at all Xaa locations
  Clone ID: PAT_TA_58964.pep
QQQQQQQQQHQHQQQQQQQQQQQQQQQQQQQQQQQQQQQHQQQQQQQQLQQQQQQQQQQQQQQQXQQQQQQLQQ

SEQ ID NO: 164547 - protein, 57 aa, Triticum aestivum
  Clone ID: PAT_TA_58965.pep
LPQPWPLHQPGHTRASRQPFTSSSAPVNLLTFPLQICFRVSQFFSIHRLPLAHMIDL

SEQ ID NO: 164548 - protein, 47 aa, Triticum aestivum
  Clone ID: PAT_TA_58966.pep
DVLKMYDFLLPKIDISDYLLSIYCAGTASASAYVKGLNAALVTAIAI

SEQ ID NO: 164549 - protein, 35 aa, Triticum aestivum
  Clone ID: PAT_TA_58967.pep
IVHAKSDQRTYYGIIVLVTGLLRSIHSGLDTYRIP

SEQ ID NO: 164550 - protein, 80 aa, Triticum aestivum
  Clone ID: PAT_TA_58968.pep
HSQHKCQPHSDTPLRRPGILSWEPCYKKRLHQCYGSADGIASGLPGMLVSMLASAVAQQMALLHQCCQEWLYQPAARGIH

SEQ ID NO: 164551 - protein, 66 aa, Triticum aestivum
  Clone ID: PAT_TA_58969.pep
RRYIQSSEWEKNHAGHASTECHRLSVCYHRRQDVPQTGTVIIGPQAPYKERKHQREQHHHLRRKRS

SEQ ID NO: 164552 - protein, 92 aa, Triticum aestivum
  unsure (1)..(92): unsure at all Xaa locations
  Clone ID: PAT_TA_58970.pep
TXKHTAAVEQAPLRTHHDHTVATDSKITDIEASRQQHLTTARDVTTGENLGDGGGADDAEGNLVTAMVPSDTGYAESSPGRSRRTEVRISQP

SEQ ID NO: 164553 - protein, 49 aa, Triticum aestivum
  Clone ID: PAT_TA_58971.pep
LNLTLTKWSTTSISTALAPVHPLVYPPSSRSSTRREREREIERERERER

SEQ ID NO: 164554 - protein, 57 aa, Triticum aestivum
  Clone ID: PAT_TA_58972.pep
LHKYHHQHAMQIVRYVRQARYQCSESTCCNRQLVLLHPDTASVSPRINQPGEITVHQ

SEQ ID NO: 164555 - protein, 90 aa, Triticum aestivum
  Clone ID: PAT_TA_58973.pep
LWVQCRIAVQQLAGVVCVYNWRDMVFKACISFSTRSVVLASYMHVYCSLTVRSSTCTVRRPLRIDFILKVAVVNICVLRTVLKYLNRESC

SEQ ID NO: 164556 - protein, 42 aa, Triticum aestivum
  Clone ID: PAT_TA_58974.pep
CSVAHRHLPVKETCHLCSDKCMSISLSECIEMLPLGLILRVN

SEQ ID NO: 164557 - protein, 101 aa, Triticum aestivum [sequence omitted]

SEQ ID NO: 164558 - protein, 55 aa, Triticum aestivum
  Clone ID: PAT_TA_58976.pep
IDAAKQLLKPNTWLTALHGKQMIQSICCIIHYTASQTSSSAKHLAQGGACTPGST

SEQ ID NO: 164559 - protein, 61 aa, Triticum aestivum
  Clone ID: PAT_TA_58977.pep
PVHPEGGSISITCFVANPPCDWMVRGTVVSQPIRIKSWCPHVFLDLLQDFWQCVFSGMRRR

SEQ ID NO: 164560 - protein, 63 aa, Triticum aestivum
  Clone ID: PAT_TA_58978.pep
YNVGKGSLLYENANDLPTFTRTNLVDDIANVHSSKRKMQVNCGLHDIKMPKSGPRECLQELFI

SEQ ID NO: 164561 - protein, 122 aa, Triticum aestivum
  unsure (1)..(122): unsure at all Xaa locations
  Clone ID: PAT_TA_58979.pep
AAKRRQKSAGPHRVIPQLDPTQRPNCMVYKMQEKENFTYPTVKGFGPLPKSTFIANARDSIPVARVTTAMASGRVRRNADAAAESSAGKRQARXGTRAPRGRRSAGRGGATAPIGGKSAGRR

SEQ ID NO: 164562 - protein, 64 aa, Triticum aestivum
  Clone ID: PAT_TA_58980.pep
NALVYNSDLSVKMLTCQICLLLLQFVREAISSMMLETRLMQFCAGCMNVQSSRSQSRCIGIFNL

SEQ ID NO: 164563 - protein, 83 aa, Triticum aestivum
  Clone ID: PAT_TA_58981.pep
WTSQGRRLLVHRIVLWGGIMHYIQQSRSFSTFVRCLDEVATHGDRLNGLGSANLAMFGAIFVVTSRGIREDQRRGRGERDFLF

SEQ ID NO: 164564 - protein, 61 aa, Triticum aestivum
  Clone ID: PAT_TA_58982.pep
SRCPNDSRGMHGAGPCRCGTLRQTRRNPSTKRKSQSSISYTKTGVFHKFKAKVYASTRHGK

SEQ ID NO: 164565 - protein, 122 aa, Triticum aestivum
  unsure (1)..(122): unsure at all Xaa locations
  Clone ID: PAT_TA_58983.pep
AQHGHNLPSPSGVMENVVVPTLKTFSLRAYDPKQVIIAGGNKKALGIPPKGTQRKSIDFPGPRTKPLTLKDFSGDGLTDITLXTSGGLYGFVQTKXPGALFFSTLVGFLIVVIGVIFVSLQL

SEQ ID NO: 164566 - protein, 131 aa, Triticum aestivum
  Clone ID: PAT_TA_58984.pep
ESKKRSKEVQAEKLKETAKEKKESIESVKKWRKQRQQGGFSKGNEDGPNLNFEVEGLKQHKKHRPGVSPGDRSGGLAKRGKQGKNHRSKDSKFGHGGRKGMKKQNTAETTNDFRGFNNQKGESRNKKRKMF

SEQ ID NO: 164567 - protein, 49 aa, Triticum aestivum
  Clone ID: PAT_TA_58985.pep
DCLQRPCPFPRILSLGSLLICWSMLIQIQPSPVLQPPGQGSCFLCPAGS

SEQ ID NO: 164568 - protein, 73 aa, Triticum aestivum
  Clone ID: PAT_TA_58986.pep
HQGAAADEGHRRNASCCLVSGLAFVGNVLSRVGKLGSCFLTQYRRKRSYIRAYTHLYECTHAHLTPMSFSERL

SEQ ID NO: 164569 - protein, 50 aa, Triticum aestivum
  Clone ID: PAT_TA_58987.pep
RYINYAALRADQIPCDKRGASYYINCGSMQQANPYTRGCSAITHCARNMN

SEQ ID NO: 164570 - protein, 112 aa, Triticum aestivum
  unsure (1)..(112): unsure at all Xaa locations
  Clone ID: PAT_TA_58988.pep
SSPPGTDGCRALNPKIAQFANRNPDLRSRKFTYKNHSSMCXTLKVKVLPFYRFYREAKGRVSSLSCTIAPITNFKDALAKHSPDRXSLGPARGLKEAELCGLAAKRDLEFTY

SEQ ID NO: 164571 - protein, 67 aa, Triticum aestivum
  Clone ID: PAT_TA_58989.pep
LGLNLLGRPFFFFLFFFFFLPNQTPWNLGFGFKPLFPPVTDFNGLKPYFGVRRRCRRTLGAVATTGP

SEQ ID NO: 164572 - protein, 45 aa, Triticum aestivum
  Clone ID: PAT_TA_58990.pep
PNLDQSRPRPSSVLDLYLSCGNHSVSVKQMALAASNPHGRRFMLE

SEQ ID NO: 164573 - protein, 58 aa, Triticum aestivum
  Clone ID: PAT_TA_58991.pep
CALEITWQICMYALCVIISKFVMSSSVNMAEVTICRYSGKNMKMTPRSTLGTASRTSS

SEQ ID NO: 164574 - protein, 110 aa, Triticum aestivum
  Clone ID: PAT_TA_58992.pep
EISWRDSQINSTSSVIVKEYLLNVTSGKLGIEFTPDEGSFAFINAMEVLPVSGTSIFDSVNKVDGHGLKGPFSLYGIGIETMYRLCVGFIDVLARKDDPGLWRRWDKDDH

SEQ ID NO: 164575 - protein, 134 aa, Triticum aestivum
  Clone ID: PAT_TA_58993.pep
GKNNVAFLCLFMLGKLEDCIQLLVDSNRIPEAALMARSYLPSKVSEIVAIWRKDLSKVNPKAADSLADPAEYPNLFEDWQVALTVEQNVASQRGHYPSADEYLNHAEKSDTTLVEAFKRMRVIEEEEPVEALDE

SEQ ID NO: 164576 - protein, 83 aa, Triticum aestivum
  Clone ID: PAT_TA_58994.pep
RATASSRGATTAMSHTCLQTATVGRRLPASAFTTPTSDLQRLAELGAPNTHSIRPGLQILRQIEQSTPVTCVTGKFPLRCSIC

SEQ ID NO: 164577 - protein, 128 aa, Triticum aestivum
  Clone ID: PAT_TA_58995.pep
MDEETARDSACNDRDDLKKRLAKLKEKSLNARMRYDPKFSTSPIFVTDKDYEFSVDPKLITLVESDPFYGYESETVVAHLTKLDDIATLFAHVEKIRYYLILKLFPFSLKGDAKLWFNSPAPSCVRSP

SEQ ID NO: 164578 - protein, 118 aa, Triticum aestivum
  Clone ID: PAT_TA_58996.pep
RKVFPLGGPRYLMAPLCEFWRHFLKFFDVLWIFIFSFILFVLLFFFFFFFFFFFFFFFFFLRVKSCNYIRKNHLFRQKFHAPALLMYIPRISFGRCHCSLRIAACVADLQPYHRFLPP

SEQ ID NO: 164579 - protein, 61 aa, Triticum aestivum
  Clone ID: PAT_TA_58997.pep
RQNVLEEGDGGESCQIWEVFGFLFLCIALICENSNVTPESTASTGPHSSKKKPIVTSYLDA

SEQ ID NO: 164580 - protein, 56 aa, Triticum aestivum
  Clone ID: PAT_TA_58998.pep
TLWGAPFFFFFFFFFFLFLCFFFFFFFFFFFFFYFFFFFFFFFFFFQIKHKYKHVL

SEQ ID NO: 164581 - protein, 128 aa, Triticum aestivum
  Clone ID: PAT_TA_58999.pep
HTMLKYDHSASKVGAFIREDGDSNLKIKISQSNRKALRRGKYGFVEVPELKAKNLEIKTFWEVCPSHQRKRLRVPNTFHARYIIGGSQAENKVYSFFHHILSLSMANRIHGCLPSQHFPRNLLFDNIK

SEQ ID NO: 164582 - protein, 43 aa, Triticum aestivum
  Clone ID: PAT_TA_59000.pep
WACSIHMSSTGDAHHFDPLYQIHEMSTGSARCCSTSALEHDLH

SEQ ID NO: 164583 - protein, 69 aa, Triticum aestivum
  Clone ID: PAT_TA_59001.pep
VPTVPGLQRERPHRMPRLLLLMLLFFSVTVYRRLKFSCCFRCFYFVQCEEHLQKTPNISRQEVLLTILQ

SEQ ID NO: 164584 - protein, 79 aa, Triticum aestivum
  Clone ID: PAT_TA_59002.pep
PVIICVFWHTPRINLFHRENLHTYALCVHMYVLSQFLTCKNMDSEFFKNRSPWSSASKRDFLSKFYLLVVSKGKAVASV

SEQ ID NO: 164585 - protein, 52 aa, Triticum aestivum
  Clone ID: PAT_TA_59003.pep
QHAVCPTALTVIVNGHPSINLNARQYLFAMKNLYIIPNQFNTSQRPSNLDLL

SEQ ID NO: 164586 - protein, 128 aa, Triticum aestivum
  Clone ID: PAT_TA_59004.pep
GGRAQGGRPPPSWTGCGPPGLHLLRGFFFIFSKVFHGVSGHSKNLYFLHKNNTMAILLKIATVRVSSIQIIQVRVQNKGKSVWKSRYDGHVSTPPSLNPCLSSCNSVDKLKEKKKNFYKLCLLVLLST

SEQ ID NO: 164587 - protein, 37 aa, Triticum aestivum
  Clone ID: PAT_TA_59005.pep
THQTNKVLQYTRRSHTIQTILGLHHHVPSACRIVTCS

SEQ ID NO: 164588 - protein, 50 aa, Triticum aestivum
  Clone ID: PAT_TA_59006.pep
VWKGNTLIILSHTHERLNNIPADYSSLIGPEQANCPCYMLHLISSQVTLV

SEQ ID NO: 164589 - protein, 49 aa, Triticum aestivum
  Clone ID: PAT_TA_59007.pep
DKLYAHVGVVAINFIKLFHICIESLPILEIFQRNIYVQENVSTWFINVE

SEQ ID NO: 164590 - protein, 74 aa, Triticum aestivum
  Clone ID: PAT_TA_59008.pep
SGTQPSLQARITSVLYHTIRVSCYASTLSRTVYIAAVDTSNCWPARITERLRVCCHCTTTLSYVPYVIARSGQF

SEQ ID NO: 164591 - protein, 74 aa, Triticum aestivum
  Clone ID: PAT_TA_59009.pep
EHKKDGEHKKDGEHKEGMMEKIKDKISGDGHGYGKKDGDHKEKKDKKKKKDKKHGDGHKDDDWHRSSSNDSDSD

SEQ ID NO: 164592 - protein, 42 aa, Triticum aestivum
  Clone ID: PAT_TA_59010.pep
ILVSAKVSVFYSKIKKTFPKSSQRFYLAQTLIKHKKHNQNRG

SEQ ID NO: 164593 - protein, 37 aa, Triticum aestivum
  Clone ID: PAT_TA_59011.pep
SGSCALGECRVLHAWPWTMVNHCARLTCDLTSRAMWT

SEQ ID NO: 164594 - protein, 52 aa, Triticum aestivum
  Clone ID: PAT_TA_59012.pep
TELHSCIWLITLYQSPGYQQYAIFSTAPSISVKGHGMIIPKASIDLFAMINH

SEQ ID NO: 164595 - protein, 49 aa, Triticum aestivum
  unsure (1)..(49): unsure at all Xaa locations
  Clone ID: PAT_TA_59013.pep
SHQTNKVLQYTDDSKSIXHDILGPASPRYSASRISPVLISLAVAVKPCN

SEQ ID NO: 164596 - protein, 101 aa, Triticum aestivum
  unsure (1)..(101): unsure at all Xaa locations
  Clone ID: PAT_TA_59014.pep
TFWGAPFFFYFFFFLWGXFFFLFFDFFFMFIYFFIFFFFFFFFYRDGQTKLTDENSAVRNLLPLQSRYRLGTGVALLMYRMIVPKDSAWNTIVVPWTTFVF

SEQ ID NO: 164597 - protein, 56 aa, Triticum aestivum
  Clone ID: PAT_TA_59015.pep
YKLHGHVRIVAINFIKLFHICFESVKILEIFQRNIYVQENVPTWVINEERIPAPET

SEQ ID NO: 164598 - protein, 69 aa, Triticum aestivum
  Clone ID: PAT_TA_59016.pep
SGTQPSFQVRIRSVLSHLIRVSCHTSTLRRTVHIASVATSNCWPSRINGRFIVCCHCRSTSYTYLTSLM

SEQ ID NO: 164599 - protein, 72 aa, Triticum aestivum
  Clone ID: PAT_TA_59017.pep
HRRTGGADVFLDGTTAVSTWGWGVQGVASPRSHRQDHLLISSTTLNLPVGICLRSDVFWLLGCTPLVAKFLS

SEQ ID NO: 164600 - protein, 61 aa, Triticum aestivum
  Clone ID: PAT_TA_59018.pep
LFILFAFFFPKNIAHAFFCGLNSAHTDAATKVQMDAPLVDPCQRILPRSTTELCFFRTKKY

SEQ ID NO: 164601 - protein, 107 aa, Triticum aestivum
  Clone ID: PAT_TA_59019.pep
SNQLDSTSLFTLSLFLLFLLSFSVLFIYIFRFLFFVKFMDILVGNTKGKKKLREQFFQKEKKAQFFKKNFNGLRINFNGFKRNLKIFQRKSSRNFEKICKIEKISWI

SEQ ID NO: 164602 - protein, 138 aa, Triticum aestivum
  unsure (1)..(138): unsure at all Xaa locations
  Clone ID: PAT_TA_59020.pep
TRITVGNGSFXPITHVGQTSFPSTSTPVNISNVLVSPDLVTNLVSVRRLARENPITVEFDDIGFSVKDARTRMVLHRCDSSDELYPVHPSGATTTRRPAAFAASVDLWHTRTRMVLHRCDSSDELYPVHPSGATTIRR

SEQ ID NO: 164603 - protein, 73 aa, Triticum aestivum
  Clone ID: PAT_TA_59021.pep
DDRICLATFVSALPSSTAHMPHLPSQRSRPSVSSPVLATPAVCPAPLSRCLKQSSSTTNPCPCPPTQEDQLLA

SEQ ID NO: 164604 - protein, 68 aa, Triticum aestivum
  Clone ID: PAT_TA_59022.pep
VESRRESSPAGPWPFSSPLGRPPKAHSPANPSAGREPIFSSSRSHLSLSSSSSAASHLVFSRRSPRPL

SEQ ID NO: 164605 - protein, 87 aa, Triticum aestivum
  Clone ID: PAT_TA_59023.pep
MNKHYHCHDKEDYHRLGPSGYMVARPTRDKAEQEMLDARVSPVTLSWLPRCRTWFYVHGGALAPTTAKVLNNASLKGAHLKLLVAIE

SEQ ID NO: 164606 - protein, 43 aa, Triticum aestivum
  Clone ID: PAT_TA_59024.pep
SIKKFSRSSNFGRIVWVPEVGVSYRLLQTVLFLIDSVLRVLFA

SEQ ID NO: 164607 - protein, 112 aa, Triticum aestivum
  Clone ID: PAT_TA_59025.pep
SDWLIQRNHFHRPVHACEDRRRSVQRPSRVYTRLHTLRCTGSTAMLLDRPCRACHQPSWCALFLACTTALGKQNLMRLAWVVQLSAETRSGRSSGSRMSLLVIAFCSQPAVP

SEQ ID NO: 164608 - protein, 84 aa, Triticum aestivum
  Clone ID: PAT_TA_59026.pep
FISVSARILALSILFGPIFREGHAKFLFGSKISFCSTPQATMVRTMTEGIVNRFLRSAKAEMLQKNETEIRCPCRRCKLKSLIA

SEQ ID NO: 164609 - protein, 97 aa, Triticum aestivum
  unsure (1)..(97): unsure at all Xaa locations
  Clone ID: PAT_TA_59027.pep
PVIDPNLLWWRLLGPVTVQRLEHPAEVVRHHVSEEDVHVRRYLVTLEHRFSNTXEVSXGSHWSYDPVMVPSLWVSNALRXGFSCISDVICMILFGMY

SEQ ID NO: 164610 - protein, 58 aa, Triticum aestivum
  Clone ID: PAT_TA_59028.pep
MTSTSSSESLHFTSAVRSMSRLHQLPASYINFMQLSIPVTIQPQLHLAPGLNLFDQFF

SEQ ID NO: 164611 - protein, 58 aa, Triticum aestivum
  Clone ID: PAT_TA_59029.pep
LTSEVSLFFLSSLLFNAAKVVDHHFLFLVLRSLIIHFSFLFFSSSYHGLLIAATILIL

SEQ ID NO: 164612 - protein, 99 aa, Triticum aestivum
  Clone ID: PAT_TA_59030.pep
NDPNLCKWVGMPMVGIHVRFEQFLSPYASCDMSSHLSTFLTEKTRENAKFIEHQNNLAWYLELVRQGHGKKIGPLQGYRETTCSQMEPPSPIKTIYRPF

SEQ ID NO: 164613 - protein, 42 aa, Triticum aestivum
  Clone ID: PAT_TA_59031.pep
LPKLVAWLLCLCPTFPLVRLGHKGSTSAIVTAGSSGCVPQTR

SEQ ID NO: 164614 - protein, 140 aa, Triticum aestivum
  Clone ID: PAT_TA_59032.pep
RTKEMQSRATVLLWHAGSTIAYVVDDLSSSSTGSYSLLWSGRMQLVGTCNGLLCLCDDGGSITLVNAATRETLPVPRRPPCAGQLFGEDRRWHREYNFAYHPTTGRYKVVHVPCSFNRVRDAVHVLTLGEEAWREVPAPG

SEQ ID NO: 164615 - protein, 40 aa, Triticum aestivum
  Clone ID: PAT_TA_59033.pep
QLASYPGYKASIQPPNYSLNPITSLPTAQKLIWFPRSVDH

SEQ ID NO: 164616 - protein, 68 aa, Triticum aestivum
  Clone ID: PAT_TA_59034.pep
PGLALDNKSPVSIWIAPLESCAYKSLGILFKSLIANMAGFLLWLSITSIMIKVFKVALTQWISYYQWI

SEQ ID NO: 164617 - protein, 50 aa, Triticum aestivum
  unsure (1)..(50): unsure at all Xaa locations
  Clone ID: PAT_TA_59035.pep
IVLNPTCXVLCELLDHVVDIRKCCPEIYSSTREKKXKKKKKKKKKKKEQK

SEQ ID NO: 164618 - protein, 69 aa, Triticum aestivum
  unsure (1)..(69): unsure at all Xaa locations
  Clone ID: PAT_TA_59036.pep
EICDWKIPVVMQIGPLAANLPFTIXDNSQEDSMYRSSHQLHSQNEXWDSPCSGTFSTARVLVNRIVTAT

SEQ ID NO: 164619 - protein, 49 aa, Triticum aestivum
  Clone ID: PAT_TA_59037.pep
IACAGALDSSGGNMWCTLKVLLVQTDHVWISSILLTCTTYCLHLNLIHL

SEQ ID NO: 164620 - protein, 55 aa, Triticum aestivum
  Clone ID: PAT_TA_59038.pep
KKGHLSRFIRPICPGWGTGTKGSLPMPRPFVPVLILTGTDGPPRGRCCEYRQEAL

SEQ ID NO: 164621 - protein, 43 aa, Triticum aestivum
  Clone ID: PAT_TA_59039.pep
VRLLINPNLRLHLRSHDLLIIIIISRLDIRSTSSSSSSSYSSS

SEQ ID NO: 164622 - protein, 112 aa, Triticum aestivum
  Clone ID: PAT_TA_59040.pep
AFPENESQLKVSRTKIRVSPARVSFGPCFELRCLLFHLSAISLVMNTSFILIFYFCPFSFGTPNLGQITSKREPRRLLSKKLLRHLGFDRDAWVFTLSINRMAGLPDPFLPR

SEQ ID NO: 164623 - protein, 108 aa, Triticum aestivum
  Clone ID: PAT_TA_59041.pep
RNRARMNVFFPYFYVYPVRMKDKLDDVSPFVPMSRGMEQLLDEVMENMDQDEPSTKSAPLAKSSSVAMHTPPAMSDPAANSSTVAGSNLVAKPASLVTKPAFFNTSTG

SEQ ID NO: 164624 - protein, 112 aa, Triticum aestivum
  Clone ID: PAT_TA_59042.pep
YGGSLSLLLCTGRIVSLPERWGSPDPYGHSAWHRLSRCSATWDCSDIEVVALPALCILPSPRLSSVRIWPVILSCSSGNVLPCNPPLGGLGGASLDVPSAGCYRTWGVLSGL

SEQ ID NO: 164625 - protein, 67 aa, Triticum aestivum
  Clone ID: PAT_TA_59043.pep
HASKGHVRAPYGKFLLQISQNIHVVFVSLLSSMTESSKPNVQSVCEKTGQTAPPMPVIVPGTTVSFI

SEQ ID NO: 164626 - protein, 90 aa, Triticum aestivum
  Clone ID: PAT_TA_59044.pep
VPLAEKTMADPLVYHHLVLPPASSNKVAPMKNKGCAISKNCYPCIMFAAAMQCRCSGNLPASFSCSHPCFLIHGLLKENKPRSHSLKIRG

SEQ ID NO: 164627 - protein, 56 aa, Triticum aestivum
  unsure (1)..(56): unsure at all Xaa locations
  Clone ID: PAT_TA_59045.pep
EEEEDDEEEDEEEEEXEEEEEEEEESAAVYEHEDDQEEAEEHDEEDHEEQDEALHE

SEQ ID NO: 164628 - protein, 77 aa, Triticum aestivum
  Clone ID: PAT_TA_59046.pep
YSDISNQHDPSSYCALRVNFTLMGQPSWTPACGILHEIIDQNSSFSRCSFVYEFRSSNFKAHNLAKHSLKLRMGRHV

SEQ ID NO: 164629 - protein, 88 aa, Triticum aestivum
  Clone ID: PAT_TA_59047.pep
RAGSARCRHLDDEGVAAAFVLGQQVSALAHLVIHRYIGLSEIPGWAAAHPGHPVAPPLTGYMGRDFMEGGLHLILSSCLLNTKPYLIC

SEQ ID NO: 164630 - protein, 41 aa, Triticum aestivum
  Clone ID: PAT_TA_59048.pep
ACMTSYESLMSFYVGFDRIDASSPIFHIYLLPLIETKCYVI

SEQ ID NO: 164631 - protein, 73 aa, Triticum aestivum
  unsure (1)..(73): unsure at all Xaa locations
  Clone ID: PAT_TA_59049.pep
ILLGISIILNRRTNNLIFFFVKYTLFPMFGLPPVXGGPTRWSWRKNETFLNYSFCRTNFVQSFIFKRNALHIL

SEQ ID NO: 164632 - protein, 107 aa, Triticum aestivum
  unsure (1)..(107): unsure at all Xaa locations
  Clone ID: PAT_TA_59050.pep
EEAKASRAGDDEVIVLSSGSESVPKQKTRQASRKVRFSHPLAYLDPNFILKKQQHEACRTTRNRESGILSSGLPNTPAPHKRRPEVSTNSDLTYPKAGXLRQPLNPF

SEQ ID NO: 164633 - protein, 87 aa, Triticum aestivum
  Clone ID: PAT_TA_59051.pep
VKCLKGDPSFWSWDFGFSYVRCREQSGIVARNGHHGVIIAQLIELSVYQLHEYVRIFFEYGTNGPVRVLWLWRWAVFLPYSFSQFLH

SEQ ID NO: 164634 - protein, 141 aa, Triticum aestivum
  unsure (1)..(141): unsure at all Xaa locations
  Clone ID: PAT_TA_59052.pep
YSTFDKELYALVRTLETWQHYLWPKEFVIHSDHESLKHIKSQAKLNRRHAKWVEFIETFPYVIKHKKGKENVIADALSRRYTMLSQLDFKIFGLETIKDQYVHDADFKDVLXNCKEGRTWNKFVVNDGFVFRANKLCIPAS

SEQ ID NO: 164635 - protein, 83 aa, Triticum aestivum
  unsure (1)..(83): unsure at all Xaa locations
  Clone ID: PAT_TA_59053.pep
TLXTLDCGRVSSQLRQCALPLLAILCYYYLSVRLKMDIRRLHETMVQKYVSGDLKKTDEVKKCATLSPSAVLIHRGRIEPPLL

SEQ ID NO: 164636 - protein, 55 aa, Triticum aestivum
  Clone ID: PAT_TA_59054.pep
NIRAANTAYSRWHQHDGECLATPTAKNTEPRKMTCVAYVIHLSTATSLGVANLEY

SEQ ID NO: 164637 - protein, 64 aa, Triticum aestivum
  Clone ID: PAT_TA_59055.pep
MQLTVQKNYGAILKVKTRTKNVKKITRASKRHFTSQASVSPPSPARQTSNSCSIILAKSVKGDH

SEQ ID NO: 164638 - protein, 91 aa, Triticum aestivum
  Clone ID: PAT_TA_59056.pep
MFLVFVLICFLFNTGADELGLTKAFLKVWSLNLGSVCVIAALGLCFPISVFLSFSFLQSQRKRLGKQTKNFALLTGIVIGTFQQAGHKQNE

SEQ ID NO: 164639 - protein, 59 aa, Triticum aestivum
  Clone ID: PAT_TA_59057.pep
MRSQPEYSPCGYGALLETKRCWVRYHVLQVFYQRGKNKSRAGITDKLQKSCRQDLSFSD

SEQ ID NO: 164640 - protein, 33 aa, Triticum aestivum
  Clone ID: PAT_TA_59058.pep
ENTQLKHQHSARTRHVKFWAIPSSSIILSLTSR

SEQ ID NO: 164641 - protein, 100 aa, Triticum aestivum
  Clone ID: PAT_TA_59059.pep
AQGPGRGLVSIGPGLSGPICPGSRHEPGPMVLAPGPQPLVPVHALNRCRRGSFSPGSWHEPGQINCLYIPITAAEHSTVLCFFWPARRGHLGALSHLLCT

SEQ ID NO: 164642 - protein, 131 aa, Triticum aestivum
  Clone ID: PAT_TA_59060.pep
YGYEKTTEVDGPKKIEEVRRDAVKQKMSQSTRVGSSPNYNSSASSISSSARPGPPPDYGVRGSSASRGSSQVRVYGSQNVNLDTRYQTSNRAMSVPLHQRRSDKSIRLSPQGDLGREMSICGKPPASNDIL

SEQ ID NO: 164643 - protein, 86 aa, Triticum aestivum
  Clone ID: PAT_TA_59061.pep
IHLFCSVCNHLLLFMTKICILFKFVAAIIINIMLLCPYFVFIDTSLSLSMWTCFSISVFVCGQARSKLGGVDTFILHHVFLLLFMI

SEQ ID NO: 164644 - protein, 41 aa, Triticum aestivum
  Clone ID: PAT_TA_59062.pep
NFILKRLPKRSHHLVMTTSSLPIHVEPPLNLQLLRSFGLTT

SEQ ID NO: 164645 - protein, 57 aa, Triticum aestivum
  Clone ID: PAT_TA_59063.pep
DSPLIGDWPTQDLVLGFFRLESFEDLAYTSLLILVGKLIGNQKNSPYMNTQGQYEYA

SEQ ID NO: 164646 - protein, 57 aa, Triticum aestivum
  Clone ID: PAT_TA_59064.pep
DQPILTDSLLKKKGGMPAGASPSLEARDFLKYYLGMPWASPRLRFCVSLIPLISRSP

SEQ ID NO: 164647 - protein, 65 aa, Triticum aestivum
  Clone ID: PAT_TA_59065.pep
FCFFFTILMLWIGFLFNFFFFKSSKKDLFCLFFVFIVLILLLVFIFFFFFFFLFHFLYFFFFFIF

SEQ ID NO: 164648 - protein, 60 aa, Triticum aestivum
  Clone ID: PAT_TA_59066.pep
TSAGISLATKRFIIFTWRTTVLWRHITFTTYYISRGTIQGGHISSSSLSTNDKGYSFKRI

SEQ ID NO: 164649 - protein, 83 aa, Triticum aestivum
  Clone ID: PAT_TA_59067.pep
EELRMGEVEVEKSLSVEESAVEYQRERWCNHYYEYYNLEGGAEDEDEDEDAVNFSRGDAESTNGGMSPGQSSTSHLTPVMHRP

SEQ ID NO: 164650 - protein, 44 aa, Triticum aestivum
  Clone ID: PAT_TA_59068.pep
YRNTLSAYNFDRFKRLHTKMMKDVDDMLAYDIPDLLKQFRNPYE

SEQ ID NO: 164651 - protein, 47 aa, Triticum aestivum
  Clone ID: PAT_TA_59069.pep
YLPPLVPVQSRTGTKAHPRGQCAEPSQETLWSRLVASTGTNRHPRVS

SEQ ID NO: 164652 - protein, 62 aa, Triticum aestivum
  Clone ID: PAT_TA_59070.pep
INEGIREDHNMYVRSIYFRTHTIGLVHSLQLSSTYDVISGSTVTLLNIRALNIMHVSLACLL

SEQ ID NO: 164653 - protein, 73 aa, Triticum aestivum
  Clone ID: PAT_TA_59071.pep
ISLFSKLAKRPKHNKLSLRRFSQSRPGENNGSRCPLNALFPLLYGGFFLNERRSLLRLCLQTRKQWLLRHQVK

SEQ ID NO: 164654 - protein, 112 aa, Triticum aestivum
  Clone ID: PAT_TA_59072.pep
GERTKRRSDRKLTCIVSKVLQSYITSFVAAVLTKDKNVLVRNLQRQCETGCLISVLALYPLDSADMADDGLDTLPERREVHTLRQAVQRGVEVKVGVPVHHLGEYLGDVTLA

SEQ ID NO: 164655 - protein, 125 aa, Triticum aestivum
  Clone ID: PAT_TA_59073.pep
QDIRSVCSGRTSINILMLVLVCFHEFSWVKSVSPSVVGSFRLVAAPAANVDVGGRRLLAAAAAGFPPGRDAAGADAVHLLRRKLQLATTTRGASSVHRGFSAPVGIVRRRPLQSAQLATVAGTVA

SEQ ID NO: 164656 - protein, 62 aa, Triticum aestivum
  Clone ID: PAT_TA_59074.pep
VEKEYQTESKRNKTFAMIFLGPEDAQETWSSSQRSLEAAIRVEGVPRGVGCAPDLVGPSRVP

SEQ ID NO: 164657 - protein, 87 aa, Triticum aestivum
  Clone ID: PAT_TA_59075.pep
HCRTYSVDQRKLAHTINGAGAGVNRRSLYMRMSRMSLVRSKMPSLSPIQQYRCSCYVEARAVPSGRAGTCTTSLWDLSGMSAPASFI

SEQ ID NO: 164658 - protein, 69 aa, Triticum aestivum
  Clone ID: PAT_TA_59076.pep
KIHSASPIAHGSRRSWRSAQKTADQKPSEPVNTRPRRTPSRSHYHAASRRTIRLSCLMPSSCTSGCNHR

SEQ ID NO: 164659 - protein, 37 aa, Triticum aestivum
  Clone ID: PAT_TA_59077.pep
GYCLAFMLSLVETVSSWVQFKSRNCLSTDMLLLTAME

SEQ ID NO: 164660 - protein, 122 aa, Triticum aestivum
  Clone ID: PAT_TA_59078.pep
TAKWNASKSPAYYKRGDYVPGLNVDGMDFLAVKHACKFAKEHVLEIGPIILEMDTYRYHGHSMSDPGSTYRTRDEIAGIRQERDPIERVRKLLLTHDLATAQELKDMEKEIRNEVDTAIAKT

SEQ ID NO: 164661 - protein, 122 aa, Triticum aestivum
  unsure (1)..(122): unsure at all Xaa locations
  Clone ID: PAT_TA_59079.pep
HLMCDIEGHHLASAAILGHDGTVWAQSADFPQFAPAEITAIMKDFDEPGHLAPTGMFVAGAKYMVIQGGPGAVIRGKKACXGAGGITIKKTGQALVVGAYEEPMTPGQCNMVVERLGDYLVE

SEQ ID NO: 164662 - protein, 78 aa, Triticum aestivum
  Clone ID: PAT_TA_59080.pep
LENFTTHNYTGLYVSFFTGFTAQFRSEVRVSTVAYHGATMAKRNLVDSGRDPRRRRTGGDDDDPETKGQQCWGTGSRG

SEQ ID NO: 164663 - protein, 76 aa, Triticum aestivum
  Clone ID: PAT_TA_59081.pep
SSIYFPTVICLPTVCYFSREKPLVKHTAPGSSFSYICFAIYFSFAFLFRSIKPKIQKYLAAFYFICDLLFQSNTIF

SEQ ID NO: 164664 - protein, 80 aa, Triticum aestivum
  Clone ID: PAT_TA_59082.pep
NWRKVRNLRQKSQQMFDLAVKAKGAISDCRRYQYCSCKYKDGAIVLVLAVLCLMKQKSCPTPPFPGESDKTKPVKTKTWG

SEQ ID NO: 164665 - protein, 50 aa, Triticum aestivum
  Clone ID: PAT_TA_59083.pep
SQTHYQHCLLDRAKSTKREGKENSPSVRYCPSLPSSSASSVRTTVGTASL

SEQ ID NO: 164666 - protein, 119 aa, Triticum aestivum
  Clone ID: PAT_TA_59084.pep
QKRNIKRSPNELKIYGDFLWTTTSPGASKLGQKSPEGTTRVGGAPYPWVRHPGLWVPREPPDVNPTPKILINPKMPQASVATKNQPRAHFDTLPEEETIIGGHLHHPGGLHDKEGVVHP

SEQ ID NO: 164667 - protein, 51 aa, Triticum aestivum
  Clone ID: PAT_TA_59085.pep
HGTIKKKKKKKKKKKKKKKKINKKKKTIKKKKKKKNQQKKKKKNKKNKKKK

SEQ ID NO: 164668 - protein, 59 aa, Triticum aestivum
  unsure (1)..(59): unsure at all Xaa locations
  Clone ID: PAT_TA_59086.pep
LGRSWKFDQCVIYNGRTNHYSFKMKGKEYVLRXMSPSQVIADKQATHRGEKSEKASHHK

SEQ ID NO: 164669 - protein, 75 aa, Triticum aestivum
  Clone ID: PAT_TA_59087.pep
DSVVEFKKWFSCCWFCFGSIRVSVIDLLNCVKRVDFPEYDASYCQECDFMNQNQGKLHVDHPLPIVSYACSYITL

SEQ ID NO: 164670 - protein, 62 aa, Triticum aestivum
  Clone ID: PAT_TA_59088.pep
CGYFPPLGACGGTVYEGAHTPETCATSSTTKKYTSVMIRVCHSRSRFLSCMYIDDDFMTESR

SEQ ID NO: 164671 - protein, 91 aa, Triticum aestivum
  Clone ID: PAT_TA_59089.pep
RHQIKMAEKDQATTAFITPYGPFCFNTMPFGLKNAGTTYQRMIQTCLATQIGKTVEAYIDDVVVKTKHVETLVDDLRVTFDNLRAYDIIAQ

SEQ ID NO: 164672 - protein, 36 aa, Triticum aestivum
  Clone ID: PAT_TA_59090.pep
LSLYLNSTLLQPTNCDNLFVPHNTLTLLNHRLLQIF

SEQ ID NO: 164673 - protein, 68 aa, Triticum aestivum
  Clone ID: PAT_TA_59091.pep
YQMNAFYPQQTFTPTPLSPLNYPGPESAYVQESYCCGGQKDALVSSEECYEAATINHRRSCLRRRHPR

SEQ ID NO: 164674 - protein, 87 aa, Triticum aestivum
  Clone ID: PAT_TA_59092.pep
EPWKQPLPKDDDTIVIEISHQGQVTMLANEPCKSMSLSDPLSSHGHNDHSDEHKNDVDDEEWEDGRRKFGAAETFKLPDEIDIAHLS

SEQ ID NO: 164675 - protein, 125 aa, Triticum aestivum
  Clone ID: PAT_TA_59093.pep
QANPTPEPGEYVVFVSHLRRGLGFPTDPFVRGIMFYYGLEFHDLAPESILHIFAFIVVCEAFLRVTPHFGLWLKTFNVEPKMIGGCQAECGGAAVSKRADASWPEGSFQEELGLWFYITAPKSSR

SEQ ID NO: 164676 - protein, 74 aa, Triticum aestivum
  Clone ID: PAT_TA_59094.pep
YTKFFMVYGAEVVLPSDICHDSPRVAAYVEADNEKAQQEALDLLDEEREMAAARSAIYQQDLHRQQRKVELNTK

SEQ ID NO: 164677 - protein, 146 aa, Triticum aestivum
  Clone ID: PAT_TA_59095.pep
ITGRRVRLREDDRSDGASVFLLSAYQEFSEFGTDGGPAAKSLKPKFNLFVKQVSAGIGMAVPHIDIKSVIAFTMFLKAFGGLLFIISSSFGALVLLVYLAFITPVVYDFYNYEMESQQFAKLFTMFSQNLALFGALLLFLGMKNSN

SEQ ID NO: 164678 - protein, 131 aa, Triticum aestivum
  unsure (1)..(131): unsure at all Xaa locations
  Clone ID: PAT_TA_59096.pep
HWDLKRAIDVDIGANPSADGGGDDEGVHYQAVTVVDIVDTFHLHDHTAFDKKQFISHMMRXIKKLSAMLERDDLDVFKKNVESATXYLPIKLNDLQFIVGDSMHDDGSVVFAYYKEGAADPTYLYFAHGLK

SEQ ID NO: 164679 - protein, 87 aa, Triticum aestivum
  Clone ID: PAT_TA_59097.pep
LYGDVAPRLRATGLPCIASPEIKSSGNTQQHGIETTALLMLANYIGLILHRDSRPSRTHGATRQYVQYLMNMTGPRSHELHGTGRTT

SEQ ID NO: 164680 - protein, 74 aa, Triticum aestivum
  Clone ID: PAT_TA_59098.pep
LAQSSRGRFRRRNRHGWLSLEQATATQHATRVTRVRAHARSLLQVAAGLTNPFQSWLISDFVLDCTRVDSIDSV

SEQ ID NO: 164681 - protein, 62 aa, Triticum aestivum
  Clone ID: PAT_TA_59099.pep
CSTAIEGFINMKYSTLVGTASTSVVLVDEHAFGFHTMGISQTSTNRCLGTCGMSDQQNRCIV

SEQ ID NO: 164682 - protein, 66 aa, Triticum aestivum
  Clone ID: PAT_TA_59100.pep
CTCLWVYDRWAQNVAGPPVIQPKAGAVKTLELSPYYSIYISWSLSTCSLGFALSTLSLHYIYIYTL

SEQ ID NO: 164683 - protein, 104 aa, Triticum aestivum
  Clone ID: PAT_TA_59101.pep
PFVEHQRSICTPSSPLLRVGNPSTRLKPQRNQNNTRLPSANIFHAYRQCPYQKLLQTIEDRMHALRCSSVLSIPIPLFPRSQKEAGTFCITQGRFPYCTLLQSN

SEQ ID NO: 164684 - protein, 63 aa, Triticum aestivum
  Clone ID: PAT_TA_59102.pep
EDESTKEVAGFWGYLLQIIYQTNARAVKPTDCIIWVNNFPFLTVKEYSMDFLLIRMDSVKAVF

SEQ ID NO: 164685 - protein, 88 aa, Triticum aestivum
  Clone ID: PAT_TA_59103.pep
IKLESRYIHIMSAPFYLISNTDIQSPPKRQSNSMTSPVSSLILLAQNRDVLNDYYRHFYLFIWSKLRQTLTIFSHLQFSTVPSHPLWI

SEQ ID NO: 164686 - protein, 52 aa, Triticum aestivum
  Clone ID: PAT_TA_59104.pep
LKNLRGANSMWLLTVTRTWSVTVAHCCQLHKIDNYRSINNNASRHDVLLPAS

SEQ ID NO: 164687 - protein, 50 aa, Triticum aestivum
  Clone ID: PAT_TA_59105.pep
MARGRPDSIACLSLREGTAARSSSASFPCTINFSCLIRPSSIHHFAAEVY

SEQ ID NO: 164688 - protein, 81 aa, Triticum aestivum
  unsure (1)..(81): unsure at all Xaa locations
  Clone ID: PAT_TA_59106.pep
CPTSADQHAVVXPRLNREASMLIYILSAQGSWAHRPWHTCTLCTQPGADPPPNTRAASSRPTGRAPLNHCRQKSFRRIVRP

SEQ ID NO: 164689 - protein, 87 aa, Triticum aestivum
  Clone ID: PAT_TA_59107.pep
ASRIGPSCRPGTEQARACLEEQITNFFYQPVRSGRRLVPMAASHETNRKIQHVGNEQTFAGMFVAPCLAVGSSVQTSLGPKSCTDRN

SEQ ID NO: 164690 - protein, 57 aa, Triticum aestivum
  Clone ID: PAT_TA_59108.pep
MSSNIRRNGGDGVTIVGSNSSDIARGKVTHRIARGIGIIGHALTITVNCDGKVLIMQ

SEQ ID NO: 164691 - protein, 105 aa, Triticum aestivum
  unsure (1)..(105): unsure at all Xaa locations
  Clone ID: PAT_TA_59109.pep
VVQYDXVDTDSFTRGTHSPHASITQGPFPLTDRVPLPAPPIHPVQSRFANVIAIVADQHGDRPRAVSLPSPRSSGQRRHRTSSKVVRAATPGDAQDPALAAWHPY

SEQ ID NO: 164692 - protein, 74 aa, Triticum aestivum
  Clone ID: PAT_TA_59110.pep
SRLLPLRSLLPQPRPPQVPTLGSQLPPALVMSGSSRQGRWVASSVMDEDIAKLRIARYLTPKIFHQLPAQGKVI

SEQ ID NO: 164693 - protein, 66 aa, Triticum aestivum
  Clone ID: PAT_TA_59111.pep
RLIVYVHHVCTIYTVINSGTLSFAHIQQRSTKRRPALFKICTHFEKYRLIVSHETVKSDISIHHSV

SEQ ID NO: 164694 - protein, 51 aa, Triticum aestivum
  Clone ID: PAT_TA_59112.pep
DSVKTQKPVLIDMMDIHHLKKKQTKNYARYSVRCYHVLVRKRSCMTPIALM

SEQ ID NO: 164695 - protein, 74 aa, Triticum aestivum
  Clone ID: PAT_TA_59113.pep
HENLKKIHDQLCKLQEDFFKICEYYFELHDHFSLKKSELFFNYMNIFKIEVCVNNFYANYHYINILYYQEINNV

SEQ ID NO: 164696 - protein, 139 aa, Triticum aestivum
  unsure (1)..(139): unsure at all Xaa locations
  Clone ID: PAT_TA_59114.pep
TAARRRQKSRVNQCLEMYLRCAVHETPKQWRKWLPTAKFWYDTTHHSSLNTSPFKALYGQEPNLGGLPTLSLNLPDNKDADLDWATHNDRLRAQLAQAQNRCKQKADRNRTEHSFNVGDQVXLXLQPYAQSIVANRPCQ

SEQ ID NO: 164697 - protein, 126 aa, Triticum aestivum
  unsure (1)..(126): unsure at all Xaa locations
  Clone ID: PAT_TA_59115.pep
TDNILVAYECFHTIKXKRNGKEGMCAIKLDMHKAYDRVEWSFLKDIMLKLGFQENWVNLIMQCVSSVEYRVRFNTEETESFKPTRGLRQGDPLSPYLFLLCTEGLAALLANAEENGNISGVKICRD

SEQ ID NO: 164698 - protein, 72 aa, Triticum aestivum
  Clone ID: PAT_TA_59116.pep
TYASTYCNIIKFPLYVLKILKFCLFYLPMLVDSCSHKLFVHKIPMHRKWVRLKCASHMLNDAPVMFQFLSFM

SEQ ID NO: 164699 - protein, 54 aa, Triticum aestivum
  Clone ID: PAT_TA_59117.pep
GGTDMSKLERVRGIVRCHCAVRIRMYIRWKRKHLRIVASSSLAHLLDVPITVGA

SEQ ID NO: 164700 - protein, 57 aa, Triticum aestivum
  Clone ID: PAT_TA_59118.pep
DLPHLDLNACSNSMSYHEECICCYTCGVMLNECRVRNDHDDEFTDPHFVNGHVVVRY

SEQ ID NO: 164701 - protein, 124 aa, Triticum aestivum
  Clone ID: PAT_TA_59119.pep
TIMEKFVLIKDYIDGLPFIIAHDNFDRYNMHVLAAPTCNYYERGTTSPPLYVSNTIKLQESAYTMHWPLLCVHELFFYDMPMHRNRVGLRCCMIYVTLCSLLNYKSLLIKIGFDIPWDLGGFVT

SEQ ID NO: 164702 - protein, 58 aa, Triticum aestivum
  Clone ID: PAT_TA_59120.pep
VDLITDSSGTVIIVSGKLPMPVRNRNLNLIYTKFHVSMCTIRPKERHHSSNGTCRISI

SEQ ID NO: 164703 - protein, 122 aa, Triticum aestivum
  Clone ID: PAT_TA_59121.pep
ASQAWNIPVAFISVILLPIVGNAAEHASAVMFAMKDKLDLSLGVAIGSSTQMSMFGIPFCVVIGWMMGQPMDLNFHLFETASLLMTVLVVAFLLQDGTSNCLKGLMLFLCYLIVAASFYVHS

SEQ ID NO: 164704 - protein, 57 aa, Triticum aestivum
  Clone ID: PAT_TA_59122.pep
NKTAKNLKILYIKHEQVFCVRAKFHGNVTWEELGTEKTKLVLQIKKMNLSQYSIFFS

SEQ ID NO: 164705 - protein, 56 aa, Triticum aestivum
  Clone ID: PAT_TA_59123.pep
VSFEPFERPVFFFFFIFFFNFLIFFFNFFFFFFFFFFFFFFFFFFFFFFFFFVITS

SEQ ID NO: 164706 - protein, 97 aa, Triticum aestivum
  Clone ID: PAT_TA_59124.pep
SLLPTGQVCAGLCPDAVYHFPVRGQGTMKLGRMAKSAASTVNTRRREKGLLPRPVTQLICFASCLFFLYTCKLFVLKLFHKKRYTVQLGYDVIEVMF

SEQ ID NO: 164707 - protein, 126 aa, Triticum aestivum
  Clone ID: PAT_TA_59125.pep
DADLNLPVPPRACAASLTPRRIAGGLSFARSDGAEIGHLLVLAAQPAESRHRHGDSADGADCRVQHQGVPFWAPFPPGSFWVFVQCCEAVALHAGVGGPALQVMQEELKKLGLKVNHHEANITFLK

SEQ ID NO: 164708 - protein, 55 aa, Triticum aestivum
  Clone ID: PAT_TA_59126.pep
YIGSVVLANGKVSGSPVVTPSMRLCLPRVEARLRDIGALKAMSQVGNHNTTQVHI

SEQ ID NO: 164709 - protein, 127 aa, Triticum aestivum
  Clone ID: PAT_TA_59127.pep
ERVVIEQQAQFGNKWARIATYLPGRTDNDVKNFWSTRQKRLARLLRAPLRARPSKTRSSNTKAPASSLESAMGSCHDHVPSVGNSSGGQSFPAAPPMEHQDTARISHDQMCSGFLSFEPLPLQAAAP

SEQ ID NO: 164710 - protein, 63 aa, Triticum aestivum
  Clone ID: PAT_TA_59128.pep
YIYLFMNSISQHLSRAQVILCLHRSSCLNKCPRIREGTCYNILLCGDLATYHPERPYSVYMCC

SEQ ID NO: 164711 - protein, 85 aa, Triticum aestivum
  Clone ID: PAT_TA_59129.pep
EICANRVKEASIQIEGVTPEYIETDPLETWSEHIHHESYRDESDDRSISPRLSTHQRLKYRACNKVPCVRVSCQSEPVEYSSTEP

SEQ ID NO: 164712 - protein, 74 aa, Triticum aestivum
  Clone ID: PAT_TA_59130.pep
LSPRVLVGHSFGGKVALSMVDQAAKPLARPVRVWVLDATPGKVRSGLDGEDHPVELIDFLRRMPVQVGLLELSM

SEQ ID NO: 164713 - protein, 70 aa, Triticum aestivum
  Clone ID: PAT_TA_59131.pep
RKAECVRNHGYTVAHPWGCQRHPIHRLYGCHNRRMLWDAPVGTLIVLHQHPICHYRLILSYASSDDVCYS

SEQ ID NO: 164714 - protein, 102 aa, Triticum aestivum
  Clone ID: PAT_TA_59132.pep
KTDASRNGICWLQYRYHIATPMHFVAIVSHFFATIFVTNATSHRCCNIFLNIATNSYSVEIPSLYYNEMTALAQRNLFVAILVPYCYADTACCNMRPVLQQS

SEQ ID NO: 164715 - protein, 68 aa, Triticum aestivum
  Clone ID: PAT_TA_59133.pep
RLREDDRLRQRRRRSLGQLSHPPSERHLRRRTNLATSKQTASGTLESMSDILASEGSRRRHRPGRGRP

SEQ ID NO: 164716 - protein, 112 aa, Triticum aestivum
  unsure (1)..(112): unsure at all Xaa locations
  Clone ID: PAT_TA_59134.pep
LSSPLLPLSAASFVHSSSCAPSXDTAQFSVASNFCAGKSGLSVGYLWLKLARTALPCFQPLRDVQSPLPTFTFIIRFKQLTCFACCLKCLQGLIKVNRGSSRVIPDFGLPTF

SEQ ID NO: 164717 - protein, 114 aa, Triticum aestivum
  Clone ID: PAT_TA_59135.pep
YLKDRIWKHIQGWMEKCLSAGGREVLIKSVAQSIPTYSMACFKLPRGLCEHINGLLRKFWWGSKGGQRKPAWVSWRTMCKPKHMGGMGFRDIELFNLALLARQVWRLLQEPDTL

SEQ ID NO: 164718 - protein, 48 aa, Triticum aestivum
  Clone ID: PAT_TA_59136.pep
SFSLFFLCFFFFFFFFFFFFFFFFFFLFFSCINCELQPSIINISTATR

SEQ ID NO: 164719 - protein, 63 aa, Triticum aestivum
  Clone ID: PAT_TA_59137.pep
KGRYIVGLHSPRQSKYINSITTFKHSWPDYGAKMKDKPNMRHGPDHPNWAPLLIIRERHIVTA

SEQ ID NO: 164720 - protein, 91 aa, Triticum aestivum
  Clone ID: PAT_TA_59138.pep
LSTIRCSSTGLPMTVVPQGIETKGQMSIVSLRPRYPALHMNAFRISRSDECLIVKDWRKIVNDRREVLRGSNEKRNPRLGDRFICMPQYDQ

SEQ ID NO: 164721 - protein, 62 aa, Triticum aestivum
  Clone ID: PAT_TA_59139.pep
TILGRSSFEPKDHNKSALDEFSILYCESASPSSLAWVIWKKYVELVRHTNLCIHNSENRMFL

SEQ ID NO: 164722 - protein, 64 aa, Triticum aestivum
  Clone ID: PAT_TA_59140.pep
KLKCNVKYRMTELEKKKKKKKKKKKKKKKKKKKKKKKKKKKKKKKKKIKKKKKKKKKKGGPQRV

SEQ ID NO: 164723 - protein, 53 aa, Triticum aestivum
  Clone ID: PAT_TA_59141.pep
MNVISSNSKSDDLASLTGDYSSLIIRVLQLYDFVWITIFSIDILKGRIVCWDA

SEQ ID NO: 164724 - protein, 104 aa, Triticum aestivum
  Clone ID: PAT_TA_59142.pep
GQKNLNSISEDGHNSHALADCLGTYQTCTSPCPHGGEPARHGEHASMQKRRVPEASSIHFASILCSPWRAIRRFSSSKNHSSDPAHVLDLNRQGAQRVDSYMSA

SEQ ID NO: 164725 - protein, 83 aa, Triticum aestivum
  Clone ID: PAT_TA_59143.pep
GLRHGDRVTHTIYVITWAHKSRKISTDECKERTARMRAKKDCFVKACSSSFHDNNDEDLKVIDVAPIKPLFSNMNLDKYGTGD

SEQ ID NO: 164726 - protein, 95 aa, Triticum aestivum
  Clone ID: PAT_TA_59144.pep
KGMRCFLMACLLKVLSDMLQSPKPLSHIHICPKPNVKLSPTNLIYPEPPSSLDIATTRNPNQFDLTNGISVSRRWACKLSGSCCNNFGLTEICNR

SEQ ID NO: 164727 - protein, 58 aa, Triticum aestivum
  Clone ID: PAT_TA_59145.pep
QGEPCEKEQIRIQCPAHHCKGRPRRPYLCHCVFLHFWPPPLPVTNTTINMQIISFATL

SEQ ID NO: 164728 - protein, 54 aa, Triticum aestivum
  Clone ID: PAT_TA_59146.pep
TSGGPLFFLFIFFYFFSFISFFKFFLLLYFYFFLNLFFFFFFFIFFFLFFLFFF

SEQ ID NO: 164729 - protein, 135 aa, Triticum aestivum
  unsure (1)..(135): unsure at all Xaa locations
  Clone ID: PAT_TA_59147.pep
RPMLDDIISPEQSAFVSGRMITNNALIAFECIHYIKQEKDPTKSLCAYKLDLSKAYDRVDXNFLRQVMQKLGFXHRWIDWIMTCVTSVRCSVRFNGTLLDSFAPSCGLRQGDPLSPFVFLFVADGLSQSYDNVWM

SEQ ID NO: 164730 - protein, 108 aa, Triticum aestivum
  Clone ID: PAT_TA_59148.pep
DGDYPIIMLATRGIDRLDTALLLRTRIAVSIHMRQCCSEAFTMLAASSQHVTNHTLFLHMHGVLAHVHVIVIPGYVSKILLIIKKDCIALQLLTVFLHGTRIAVTQQG

SEQ ID NO: 164731 - protein, 68 aa, Triticum aestivum
  Clone ID: PAT_TA_59149.pep
QRYEVARPWTKALNLLGDPFMCWLFFFLFFLFFFFFFFFFFFFFFFFFFFFFALNGITTQGPHTRHPY

SEQ ID NO: 164732 - protein, 58 aa, Triticum aestivum
  Clone ID: PAT_TA_59150.pep
CTKMARKMYMCPWDACLGPTEGMRMNSTVSASWLETLQSRFGNIRKSKTHQKIMKLGM

SEQ ID NO: 164733 - protein, 57 aa, Triticum aestivum
  Clone ID: PAT_TA_59151.pep
CAILHVLLECQTVLILFALSFHTNCLFFQILAEFSSNISMVNVQIVTDCSVLDRFCY

SEQ ID NO: 164734 - protein, 81 aa, Triticum aestivum
  Clone ID: PAT_TA_59152.pep
EHKKAEEHKKKDGEHKKDGEHKEGMMEKIKDKISGDGHGDGKKDGDHKEKKDKKKKKDKKHGEGHKDDDGHGSSSSDSDSD

SEQ ID NO: 164735 - protein, 85 aa, Triticum aestivum
  Clone ID: PAT_TA_59153.pep
YKPWKSYNTVATVQKQNMNGFATILRVVICIIILTDLTVLSVEFCVDEVIKDRGGLDMRRRRRGKSSSLGMPKAPQVNIQGDSSV

SEQ ID NO: 164736 - protein, 73 aa, Triticum aestivum
  Clone ID: PAT_TA_59154.pep
GEVICTIIVPKEDAKERAEQFSKPALTLEELTSWSKDKLAPYKIPTRLHVWDSLPRNAMGKVNKKELKKLLEV

SEQ ID NO: 164737 - protein, 95 aa, Triticum aestivum
  unsure (1)..(95): unsure at all Xaa locations
  Clone ID: PAT_TA_59155.pep
LLGXALVTTKDAGDAITLLQSLAGSTFDSSQLVLTACMGFQSVKEMGLQELREKHRPEIIAAMEERSKDRKSWKDMKGLATKLYSFKHDPSFVCP

SEQ ID NO: 164738 - protein, 117 aa, Triticum aestivum
  Clone ID: PAT_TA_59156.pep
LIKDYVDGLHFTVAHDDFDECNMHVLAAPTCNYYERGTTSPPLYVSNTMKLQETAYAMYWPLLDAHELFLYDMLMHRKRVRLRHCLIYVALCSLLNAKSLLIKIGFDIPWDPGGSIT

SEQ ID NO: 164739 - protein, 94 aa, Triticum aestivum
  unsure (1)..(94): unsure at all Xaa locations
  Clone ID: PAT_TA_59157.pep
MVKTPCSEVVPWSRGEAQNMDGGWGIHAEGGSSMLSSALNYTALRLLGENVDDEQDMSVPKTRKWIHDHGGAMMIKLXSKMLGFFDRSGVNPTP

SEQ ID NO: 164740 - protein, 60 aa, Triticum aestivum
  Clone ID: PAT_TA_59158.pep
IMSSLQYLEVVFSFLPLMELTSFLLSFVLWSFQVLGKDSMDYGMRSGKEPNLGDTQCTPR

SEQ ID NO: 164741 - protein, 63 aa, Triticum aestivum
  Clone ID: PAT_TA_59159.pep
QKLDTKQTISLEVSGFRTKTHLLKRDFICSNVTAVIFYIKGIIIIVVDRKSSLFLRLCYVLIA

SEQ ID NO: 164742 - protein, 121 aa, Triticum aestivum
  Clone ID: PAT_TA_59160.pep
MPDSGTSEVASSKLKRKSDDMAWEFVVLIDPDDLQRFKCILCGKEMSGGVTRMKQHIAGIKGAIKSCMQATPEQKARCRAAHEAPKKRKREKQKQEEVRALVMIEANDNEMINKSSIKLAT

SEQ ID NO: 164743 - protein, 50 aa, Triticum aestivum
  Clone ID: PAT_TA_59161.pep
CGGGDDDDDKIDIVTGLRRRRRRRHPHGDAAAAMMTTSTPSNTGLWRRRR

SEQ ID NO: 164744 - protein, 52 aa, Triticum aestivum
  Clone ID: PAT_TA_59162.pep
FYPNLAHSVVACSRKFWLGIVGSKLCVTHFCLSLSYFSLPLTYGSQADVGLC

SEQ ID NO: 164745 - protein, 125 aa, Triticum aestivum
  unsure (1)..(125): unsure at all Xaa locations
  Clone ID: PAT_TA_59163.pep
CGACEAGKMTRAKHPSKTIMTTTRPFELLHMDLFGPTHYSTLTTTACLYGFVIVDDYSRYTXVHIILYKTEVXDVFRRFANRAMNNYGAKIKHLRSDNGTDFRNTGLDTYLDTLGSTHDFSAPYT

SEQ ID NO: 164746 - protein, 53 aa, Triticum aestivum
  Clone ID: PAT_TA_59164.pep
NTCSCYGGVNTYPDGVAVFNELSSVVRAVSACIVAATATMVVRNNHGHDILSD

SEQ ID NO: 164747 - protein, 122 aa, Triticum aestivum
  Clone ID: PAT_TA_59165.pep
NSSLTCAAVGSIPEAQLNYPAILVPLSKKPFKAKRTVTNVGPAKSMYTAHLDVPNWLKVKVQPEALEFTSAMEKKTFTVTVSSRGGDADANAGQLVEGSLRWVSEDHVVRSPIIADARVVPT

SEQ ID NO: 164748 - protein, 99 aa, Triticum aestivum
  unsure (1)..(99): unsure at all Xaa locations
  Clone ID: PAT_TA_59166.pep
KVTLPMTFESDLNYRTKRIVYDVSRIALPYNDIDRCVALVKFMAASHYAYXTLKMPRPVMIITIPSDKKDPMICEDQLYLQAGAAAATDRALAPAAGTV

SEQ ID NO: 164749 - protein, 142 aa, Triticum aestivum
  Clone ID: PAT_TA_59167.pep
GKMGALQYLNLADNKLEANDNKGWEFITSLANCSQLQKLILSNNSFGGQLPGSIVNLSTTLQQLYLDDTRISGSIPADIGNLVGLNVVLIANTSISGVIPDSIGKLENLIELGLYNNTLSGLVPSSLGKSSQLNKFYAYNNN

SEQ ID NO: 164750 - protein, 110 aa, Triticum aestivum
  unsure (1)..(110): unsure at all Xaa locations
  Clone ID: PAT_TA_59168.pep
TPSPXXPLLLLLARSPSFRRSLIRLRLSKSNIEPLSVAPPQLAKLWPLMLQAIAVTSAIRCSGLCSYLSSSLDPSSRILASPTFVEAVMDASLSHKLDAQLCGLRSPKRT

SEQ ID NO: 164751 - protein, 58 aa, Triticum aestivum
  Clone ID: PAT_TA_59169.pep
WGKLCVMYLRTNVFLGVTVWDVYTNRNVLLGLTVRDVHTNENVFLGLTVWNVHTKRNV

SEQ ID NO: 164752 - protein, 85 aa, Triticum aestivum
  Clone ID: PAT_TA_59170.pep
EVDTLNGRTLTWLNPRGHIFTRESCFHLSGDPTRKLNPTHYRHPTFYTKVFNECHSYDQDGNSFELSLVTSKCIGPYLTSTKIPN

SEQ ID NO: 164753 - protein, 121 aa, Triticum aestivum
  Clone ID: PAT_TA_59171.pep
ASCFRVSYWTSGRAPPGLDHDIATWHTRDGCSRLGIGTRHRRAKSYREERKGRLRLSVTRVHQIFTTRKIGTKALQILTCPHGVIHDSSQETKADAKGDPTYILQQRTPSSTVGHGRPVPT

SEQ ID NO: 164754 - protein, 100 aa, Triticum aestivum
  Clone ID: PAT_TA_59172.pep
TQWDRFAHLSETEVLQKGNREFTLQSRWDRSLISVRPKRYEGKQRDYNPISARPRSLSVRPICLRFVAVAMTFETWWRRIERIGGAKFEFWFKSYVGVER

SEQ ID NO: 164755 - protein, 41 aa, Triticum aestivum
  Clone ID: PAT_TA_59173.pep
DVKHDKHHMQSNSDMIWPISFCSFDLHLRGAMIILVTGMTP

SEQ ID NO: 164756 - protein, 80 aa, Triticum aestivum
  Clone ID: PAT_TA_59174.pep
YIKENIRSGVLSVSRSIIQIFFLGLAKVKSEKVLSSFAAASSIVIHHCSIYLYQHSWLRCWQTLMNMEFLKFLRAHACTK

SEQ ID NO: 164757 - protein, 123 aa, Triticum aestivum
  unsure (1)..(123): unsure at all Xaa locations
  Clone ID: PAT_TA_59175.pep
YQNHPKQLSGGQYHVFTTSLCKRDQKVHKRAVNSVESAIPHYLRWSEQPIIWSKEDHPPRVDNAGQLALVVAPQVGGYKSTKVLMDGGSSINILYYQTFQRMGLTDKNLRTSNTVFNGVVXGK

SEQ ID NO: 164758 - protein, 34 aa, Triticum aestivum
  Clone ID: PAT_TA_59176.pep
FAFFFLFFFFFFFFFFFFFFFFFFFFFFFFGGSR

SEQ ID NO: 164759 - protein, 68 aa, Triticum aestivum
  Clone ID: PAT_TA_59177.pep
KWLFKHHTTPLCATCMQAVVILARTFTCDTSICGPKRPSLMHVHHFDLHQERLINFTIDEDSFWVVLW

SEQ ID NO: 164760 - protein, 85 aa, Triticum aestivum
  Clone ID: PAT_TA_59178.pep
AINVISCEGMERMERPETYKQWQVRNQRAGFKQLPLDQEIMKRAREKVKCYHKNFIIDEDNGWLLQGWKGRILYALSTWKANPQF

SEQ ID NO: 164761 - protein, 55 aa, Triticum aestivum
  Clone ID: PAT_TA_59179.pep
AMKLYPAKEKVLANQPVVELVRWTVVSPTHQDSNPGARIMPGFISEFPAMRFQWE

SEQ ID NO: 164762 - protein, 84 aa, Triticum aestivum
  Clone ID: PAT_TA_59180.pep
SRFSEISELCLMNPRNICRVCRLIDCSLGKANIKSSDVNFCSLFCREKTALEVLIQSRTRLFVRCSLQETRDPPDGDTSPPPPP

SEQ ID NO: 164763 - protein, 94 aa, Triticum aestivum
  Clone ID: PAT_TA_59181.pep
DYDPLFAMFGRQPESQGILSIQSTPCVCGTVKYIYIYITLRTSKPLSRLVKASFNPLFADEILSTTVPIKVRCASEIAACSRRPINVSGCTSDT

SEQ ID NO: 164764 - protein, 75 aa, Triticum aestivum
  Clone ID: PAT_TA_59182.pep
HVRRLFQLDNTPHVVAGIGCYIRRDDTFGSNYFSGHFLYETLVFRLTICELKLTYSIIFAYSVVCMVHFNVGLFS

SEQ ID NO: 164765 - protein, 105 aa, Triticum aestivum
  Clone ID: PAT_TA_59183.pep
PTRHLFNTGIVSDEQIGTIIHHSYVYNEKKSDALEDLGINQIKIELMIKPRLASPTSMVLTGKPLDDFFLIGSLLLAWISEFHSIQSNSTVMKLTPSIPESMAHL

SEQ ID NO: 164766 - protein, 71 aa, Triticum aestivum
  Clone ID: PAT_TA_59184.pep
MDIELITPDHHLVSGHDELWQRCILGENNFILKFSERSSYNATVNQKQNKMHVRYCEVLSFSSRPPLWCPA

SEQ ID NO: 164767 - protein, 112 aa, Triticum aestivum
  Clone ID: PAT_TA_59185.pep
YVFCLERLVLFVSLCFCVPQSSLLYTPFERAIHELKFDRILYVLHLYLLSYVILLYVLHLYLLSYVVFLYVLHLYLLSVIILLYVLHLDILEHGGGFVLNKLLISHASLKLF

SEQ ID NO: 164768 - protein, 55 aa, Triticum aestivum
  Clone ID: PAT_TA_59186.pep
VFKLSHLINIVDLLYFKYALTAMVNVIIYFHVVINIYFLSYNCNGSLVYILVRYQ

SEQ ID NO: 164769 - protein, 68 aa, Triticum aestivum
  Clone ID: PAT_TA_59187.pep
RCYGHLEIMLILIRKRGKPCLSQQRSGTEKQLMLVKSCSAASNLIIQRSCLLPHGGESEQPLELVMSR

SEQ ID NO: 164770 - protein, 102 aa, Triticum aestivum
  Clone ID: PAT_TA_59188.pep
RLEAAADGEGVAYEFGLSIGAEEGGRRGSCGRMPELQQWGGAWRRGGAMEEDEDPRRQEFQIEGSLVLFPVFTWSEKFPNDNYFGTEGVYVSIEYFVFVLYA

SEQ ID NO: 164771 - protein, 100 aa, Triticum aestivum
  Clone ID: PAT_TA_59189.pep
LFVFILSCFCSFFFFFFFFFFYTPKGYISLWLNTYRITSIGTWEGFLYPDVQHTRLGLPLPRIHEHDLAHPTPVAIAHGMTYANTHLLSHDIAVVILAAA

SEQ ID NO: 164772 - protein, 83 aa, Triticum aestivum
  Clone ID: PAT_TA_59190.pep
HSLGHHTNAKNFYLGQPVSLTSQVPEIGVSKPDRKRLLRVTNSTKHPHPSNNPDMRFEVRSTNPAVDGASDIQTPTSASICLL

SEQ ID NO: 164773 - protein, 71 aa, Triticum aestivum
  Clone ID: PAT_TA_59191.pep
EQVNCHIRDIRMLGGKGQFRRQCIQGDASLLHHQRRLRSLDLSNCHYVVKSVNMQCPHHVIAHDLQHNTSL

SEQ ID NO: 164774 - protein, 50 aa, Triticum aestivum
  Clone ID: PAT_TA_59192.pep
NANYNLHKQLMQRKLRLQLAKAEHSTLGSYEEKQSSKAGHIRPSKMAMLQ

SEQ ID NO: 164775 - protein, 57 aa, Triticum aestivum
  Clone ID: PAT_TA_59193.pep
ACSSKWVLIFRYKWLKKNCMEKVTLNLRRQKIQPLLLWALNACFIAKEFFLSCINLC

SEQ ID NO: 164776 - protein, 68 aa, Triticum aestivum
  Clone ID: PAT_TA_59194.pep
WVIYSSNMPKYFLNQFKNNSPILLLHFSPEGHFVKEVSFILFCLLQTFWEFSYVQMIATCQNATSFSY

SEQ ID NO: 164777 - protein, 109 aa, Triticum aestivum
  Clone ID: PAT_TA_59195.pep
NACQRKSSVHALIYAPYCRCKIQGRCEHKMKRVTCVNLRLVLSVSRGRHPRRFDLFQLQSGRHIGGVGTHHPQRPSSTSTWMYYWQNQLPWSSLDTTNPPSTICFQATF

SEQ ID NO: 164778 - protein, 67 aa, Triticum aestivum
  Clone ID: PAT_TA_59196.pep
CAPIVLWFAAGLEWGDATRDMFDTLSLPLSGSLPFIWMRGTWIDYPLIVVCVGLWLSRRRVMGACLG

SEQ ID NO: 164779 - protein, 66 aa, Triticum aestivum
  Clone ID: PAT_TA_59197.pep
MSMQFPLLSRSGVLQRLISEYRPPSDGGGMCTLQLDDIPGGAKAFELAARFCYDVKIELNALNVVC

SEQ ID NO: 164780 - protein, 50 aa, Triticum aestivum
  Clone ID: PAT_TA_59198.pep
MILISNNFMDLKRNSKKKIINTKKAHGFGKKFIKLKKHKIEKVHVFERSS

SEQ ID NO: 164781 - protein, 68 aa, Triticum aestivum
  unsure (1)..(68): unsure at all Xaa locations
  Clone ID: PAT_TA_59199.pep
YVDNESMPLXILFISALKPSFGTSTNPCFXLRRAYLFTFMLSHHPLIKSTSWRALLSFASITINLYWV

SEQ ID NO: 164782 - protein, 78 aa, Triticum aestivum
  Clone ID: PAT_TA_59200.pep
NHAGAQQDKPQIRLLGDANLAQEGAGEEQKTQPRHEDPHDVVDDALIAPLTKRSPELQEATHFVDHISHTGRNHSFDD

SEQ ID NO: 164783 - protein, 110 aa, Triticum aestivum
  Clone ID: PAT_TA_59201.pep
MHAANDPIWPDPFKQPVALGFRFGTFLKFPEQVFLLYFFIVFYFLFSFFFSVSFFLFSFSVSFLLYFLLFIYLLTFRLPFLFYFSSPFIFKLEQKFQFFFGIPNMFSSSK

SEQ ID NO: 164784 - protein, 111 aa, Triticum aestivum
  Clone ID: PAT_TA_59202.pep
IDHHLNISNHMTKSIYAAAMRIIMMPSCPYFIFIDASTSKHEDIFFVIGFSLEDKRGLSLGELIRPFCIMLLYRHLLHYGLLFHGMSQYLWLFSLILQDLHKEGECRQLEF

SEQ ID NO: 164785 - protein, 64 aa, Triticum aestivum
  Clone ID: PAT_TA_59203.pep
QSYMNEVMNKMCTQLEHAAFRYYNCDRPLCLLLRWPDKITNCRCQDLIPTISAASEKDAHTSTT

SEQ ID NO: 164786 - protein, 56 aa, Triticum aestivum
  Clone ID: PAT_TA_59204.pep
DTPEVQGLGRLLLHAVTDLDAAVVPGEAGSSITRRIENFNCAFQNEFTPNLPQKLP

SEQ ID NO: 164787 - protein, 102 aa, Triticum aestivum
  Clone ID: PAT_TA_59205.pep
NVRTGSTLPASHLVCAWSPQARCAKRQPPRVGHEPAMPMFVHIDPTMEWIYTGSHSNPRCMTASEIASYDQLIHALDTRVITQLRSAMIMSGHNQATYYATC

SEQ ID NO: 164788 - protein, 149 aa, Triticum aestivum
  unsure (1)..(149): unsure at all Xaa locations
  Clone ID: PAT_TA_59206.pep
KEKFLDLEYDVQGSVKFGDGSNVEICGQGSVLFEGLIGEHRILTGVYYIPRLRNNIISVGKPDENGCKVDIENGVMTIFDNLSNVLARVNRTRNKLYILNLDQSQPECELAKSDDDSWLWQXRFGHVNFYTLNKMSKMEMVSGMPFIHH

SEQ ID NO: 164789 - protein, 86 aa, Triticum aestivum
  Clone ID: PAT_TA_59207.pep
FCCISQSYDTSQLLIQKVRMDIQHKIAFLARFSKDMFPLAKSLTWVCRFMLKNKDTTKESGHIKAYSKKKCTSIIAIAERNVFLYL

SEQ ID NO: 164790 - protein, 105 aa, Triticum aestivum
  Clone ID: PAT_TA_59208.pep
RTSTSSTRIEAKREVASQGPKMTKDLLVVIVIATIVEDPDTTPMSVRLPTRKYKIHQKGGVEEMNHLQERGVEMMVMSEYPLIEARIQKGRTSHQRATQGEDCKL

SEQ ID NO: 164791 - protein, 92 aa, Triticum aestivum
  Clone ID: PAT_TA_59209.pep
YTVLVGFSLSFMSGFHIVCLFGFYFALFHSYSLLSTILNMRSIFSEHRPNILLIYIFFIFTDRFIYGELFYYVMNIFIIHTQPFLIYGDFFS

SEQ ID NO: 164792 - protein, 136 aa, Triticum aestivum
  Clone ID: PAT_TA_59210.pep
GRNGAVRSPAMPAPSGALTRPPLRRTTVSCRAKGSPAVAYCTLPVLQLLYYVRTLERDESETAAPAAAKILLLPPHSYPAPAGPTPHRSQPQTGQIVIISELARYSTAQHSVYISLPASLSELLFETEFLNFLINM

SEQ ID NO: 164793 - protein, 55 aa, Triticum aestivum
  Clone ID: PAT_TA_59211.pep
SSACPTNEVNPAQVCRLTHSGSIPNFRPQCDLKWFMSICHKILYHRHVLVLGQLS

SEQ ID NO: 164794 - protein, 70 aa, Triticum aestivum
  Clone ID: PAT_TA_59212.pep
AHPSCYVHLDKGTRATKVGFYFMEQEKQCDGPKDFFDTLVVQLWADPYVWPLYAKAFERSTDKAASILNK

SEQ ID NO: 164795 - protein, 74 aa, Triticum aestivum
  Clone ID: PAT_TA_59213.pep
SDIWIIIINSWLPAALAMILKAQTVSTTSNVITMHNILLTENSLPCRLAANNKNMLTSWPTYQCISFRTCLEIC

SEQ ID NO: 164796 - protein, 111 aa, Triticum aestivum
  Clone ID: PAT_TA_59214.pep
PPGGRAPTTPAPPPCGRAPTTPRSTHCHLKTDRMPPPSVCLPVKNQTLVPAVTAFGVAYCGRAGAWRTWRATSSRWGLMRIWRVGSRWHWRRLGNSTYRGKVARWSSEFNA

SEQ ID NO: 164797 - protein, 70 aa, Triticum aestivum
  Clone ID: PAT_TA_59215.pep
YTHLPFRTMSVTLLKWTVVHHIMNTQWENKHDTCVMTNVVYVSHTSCIPDRRISGLMYAVMSVLLMHLLP

SEQ ID NO: 164798 - protein, 70 aa, Triticum aestivum
  Clone ID: PAT_TA_59216.pep
SIQINSDSCVSPPKCVYSKDDRGKLKSKYSNHTRRSKQNTYHVVNKNIASSKVTDRRRRKRGCLPGHTQA

SEQ ID NO: 164799 - protein, 56 aa, Triticum aestivum
  Clone ID: PAT_TA_59217.pep
SMIHSFCSVCSHLLKSLGKQIFRNRWSNTHASTCTCGSVHAQTHSRAHKGKIDVHT

SEQ ID NO: 164800 - protein, 72 aa, Triticum aestivum
  Clone ID: PAT_TA_59218.pep
ENSSEPHANFQNYWAYIYFIVNINPIQIASELIQRPKNNYFCDSKNIGLSFSSCQYFQRLAGTFCWGHLKIF

SEQ ID NO: 164801 - protein, 108 aa, Triticum aestivum
  Clone ID: PAT_TA_59219.pep
HRHEPSPWKRLRRETCRCPYTSQCPITRLGTGTAVHSRNQCVQLLTVWHLRDATLHVAMSIYIVMQTIRYDKSPARPKCDTDTRDDTRLHDRSYNMQSLQYMSFWCPL

SEQ ID NO: 164802 - protein, 112 aa, Triticum aestivum
  Clone ID: PAT_TA_59220.pep
VFSTPVLIVLGKETIVQIEERQTSIQLVRSMGLHQPSLNLTKEKIKPGSNKSTCQNLHIVALRETEGKQEGLVEREREEITIWRISSWRHPPRSTLLTHMSLPSHARGPDRC

SEQ ID NO: 164803 - protein, 57 aa, Triticum aestivum
  Clone ID: PAT_TA_59221.pep
CSRMTTEVAAVLVNYRYSRYSSRMESAGHELPCRLLSYYSSRTSRHRSTYFSGTRRP

SEQ ID NO: 164804 - protein, 75 aa, Triticum aestivum
  Clone ID: PAT_TA_59222.pep
SLPGYRHEYLMFTHRLLFFSREATSETYGARVSFSYICLCDLLFLVFIFRSIKPKILCCTLFYLLSIYSIYCILS

SEQ ID NO: 164805 - protein, 71 aa, Triticum aestivum
  Clone ID: PAT_TA_59223.pep
KKKQKQTSRGHGRMDGSRTNVHESIQTSPRASILFVLRPTLEMPLWIFACYLCMNYAIFYDYVECCVFKRK

SEQ ID NO: 164806 - protein, 101 aa, Triticum aestivum
  Clone ID: PAT_TA_59224.pep
NNSFTYRTRSLSIAIYYLGDGVVYKRPLVSLLRHMRNISPHPTRTIRLYCARSRVFPASCDFCLILTAGSGMPPRYIHLPGVGHAPPWVALGLLIAQIHHI

SEQ ID NO: 164807 - protein, 65 aa, Triticum aestivum
  Clone ID: PAT_TA_59225.pep
MMEGDQWSRKKKERGRSMEPATAVVADCYHLACDFPSTNCVHYFRESNEVAHELAQINVQGPILY

SEQ ID NO: 164808 - protein, 89 aa, Triticum aestivum
  Clone ID: PAT_TA_59226.pep
RVQEGENYSPGQLCQHQCWRGGVPFKGQASCEIVSIRIPVYSKISFVPHSAFLMPHSIRSPADDDLPAFSSGSLAPSDVDSLPTASTPR

SEQ ID NO: 164809 - protein, 91 aa, Triticum aestivum
  Clone ID: PAT_TA_59227.pep
RLGWPDVTVHAVTTFVPVCWHAKHALCVPRSALLSACWLPNRPKHAMLRHHRRLHPLNFPLALTDAGARRREHGHGLASDTVHGALCSSLS

SEQ ID NO: 164810 - protein, 52 aa, Triticum aestivum
  Clone ID: PAT_TA_59228.pep
YHHLYIANLLQGIKHIIFSDLQVLCRILRLTMWMSNSCHLSKPISIPTIKGR

SEQ ID NO: 164811 - protein, 68 aa, Triticum aestivum
  Clone ID: PAT_TA_59229.pep
ECCSHCGVNVFCKQQLNSHCNMEHSYICSMEQSCTSNSSIPIVRWKCQKCVIVFTRTSNISIHQTKLI

SEQ ID NO: 164812 - protein, 49 aa, Triticum aestivum
  Clone ID: PAT_TA_59230.pep
CLPRIKASIYLDNHCSGLLDSRARLFMHSLINRYNLGLFHSPPSVVFLL

SEQ ID NO: 164813 - protein, 131 aa, Triticum aestivum
  Clone ID: PAT_TA_59231.pep
LVITGWAPQLEILAHSATAAFMSHCGWNSTMESMSHGKPILAWPMHCDQPWDAELVCNYLKAGVLVRPWEKHGEVVTAKAIQEVIEEAMLSDKGMAMRQRASALGEAVRASVVDGGSSRKDLDDFTAYITR

SEQ ID NO: 164814 - protein, 98 aa, Triticum aestivum
  Clone ID: PAT_TA_59232.pep
NDEFTQDATEDYYEGGTYACKNCTNVKFPLYVLNVLTLCMCSLPMLLDFCSPKLFAHKITIHMKWVRLKCATNMLHDALILSQFVSFMRASLKSSCLS

SEQ ID NO: 164815 - protein, 107 aa, Triticum aestivum
  Clone ID: PAT_TA_59233.pep
QNYFKRFWCEELFQILCITTSIIFMYIEGDERGALLGLVSGVVANLQLMYSALGVCMYCGICFTSIDGAAQVGVSSGFGGGPGITKPPWSLVMRQRAYLSASWNAEF

SEQ ID NO: 164816 - protein, 93 aa, Triticum aestivum
  Clone ID: PAT_TA_59234.pep
NASCTSLISFEVWNCLFLFTYTTAICRMLFLFAYICYSMDISFVERIILSCFTYIYLERRQELAIHMVSHIILHTTCRSLNMICLIPCNSFAI

SEQ ID NO: 164817 - protein, 56 aa, Triticum aestivum
  Clone ID: PAT_TA_59235.pep
GMGRQALVGPAGLEEKLGRERERQGELGRPSTAEGFYFLISEKRNRWRGEKRKYLR

SEQ ID NO: 164818 - protein, 63 aa, Triticum aestivum
  Clone ID: PAT_TA_59236.pep
ITTPKSSSPRTNSPYAEKVDRERSAAHTHQLLCHRACVASSNTISPHRRRHRPPASRVRITSS

SEQ ID NO: 164819 - protein, 98 aa, Triticum aestivum
  Clone ID: PAT_TA_59237.pep
ALFPVLRLESSPSVGQGHVSLLFFLFTSHCPLIYSNYFHQRLLEMLDDVADTAVCWCSILWVEMCCLPGGCLKQSIPETSRYDDRNFYLSFLSLLLPD

SEQ ID NO: 164820 - protein, 71 aa, Triticum aestivum
  Clone ID: PAT_TA_59238.pep
TEVSLIPVKDVRTFTSVGETISSQYFDDLYWPFSIPTPSPTLSNSSLSSLLLGLYSTPSMFNLSITIYKHK

SEQ ID NO: 164821 - protein, 63 aa, Triticum aestivum
  Clone ID: PAT_TA_59239.pep
FCSKLLMRSKSIPFPVTSLYWKPSYLWILLKLGVIHMGTGQFNHGWGDTTSLAIKPSKFNVPT

SEQ ID NO: 164822 - protein, 49 aa, Triticum aestivum
  Clone ID: PAT_TA_59240.pep
RWIIFDNTQPCCHICVRYVFIVCENDLMLCYNMYLIGHLHKTSFCGREK

SEQ ID NO: 164823 - protein, 144 aa, Triticum aestivum
  Clone ID: PAT_TA_59241.pep
CLDEFDNFMVRQEDFNAYIGRQLKQNAYMIEHLGDYMSRVKGELKLITKHASMVTTQVGQVLKAQNDLLNELNSKNNDYAVRVATRTGRMTQEHLYPEGHPNRIEQDSQRNNIEAPSPSKKKKKKNDRTLHASSEPIAETPENP

SEQ ID NO: 164824 - protein, 138 aa, Triticum aestivum
  Clone ID: PAT_TA_59242.pep
RLRLLRRCSKLAANDSPPPAATKLHRHFLRLTVSSRSETLSSRLGSLFPADTTIATEALSSSSSSSPSVSCTLGPGKHVNVLVASLWYRLSRLFDHSPRVSPYPLSSCSGRRLPSLLRPTPAISARVVDFVQRATSRP

SEQ ID NO: 164825 - protein, 65 aa, Triticum aestivum
  Clone ID: PAT_TA_59243.pep
NTDSNCSKSLKKLYRSSYVFQNFWSYRSICMNQIATDCSVLTDSVFRVLFAYFNESMSSIGGYEP

SEQ ID NO: 164826 - protein, 62 aa, Triticum aestivum
  Clone ID: PAT_TA_59244.pep
MYVRMYERLHLIKTTTLTTTHHNGQGRDGTRSALRKSCADRYDVMYYTTHRLTRSVITINME

SEQ ID NO: 164827 - protein, 41 aa, Triticum aestivum
  Clone ID: PAT_TA_59245.pep
EHKKDGEHKKDGEHKEGMMEKIKDKISGDGHGDGKKDGDSD

SEQ ID NO: 164828 - protein, 140 aa, Triticum aestivum
  Clone ID: PAT_TA_59246.pep
FDYVFDWTALKYPHMSSSNKLVRQPSGRLAGVGPSVERTERLSVGQEIRDRFTGAVEAFARRNSSSGRHGHGDHSRHKSTADSFSSSREALAADTEKTHILSRTGSSSKMAGTQSSRPTSSGDCTGRLFSGSGGSSSRPS

SEQ ID NO: 164829 - protein, 86 aa, Triticum aestivum
  Clone ID: PAT_TA_59247.pep
CKDVRVTLNLQGTELGVGAKHEPCKLPSNRCLDTIVPSSKEQPSCRPYARPPSRHAGLFATLFYFLKNTSPCIMKWSVSHRRNRCI

SEQ ID NO: 164830 - protein, 94 aa, Triticum aestivum
  Clone ID: PAT_TA_59248.pep
PLIAPTVQCHCHGLVSASQFCSILLVMLCVVSGHVFPLCSPLFICCGVCGFLFYLFSSCGPGNSGSLEHILQKAAKPYRQMNTIQVGGFSPSPK

SEQ ID NO: 164831 - protein, 51 aa, Triticum aestivum
  Clone ID: PAT_TA_59249.pep
GVQSFEDAHRDRVCVHRGECMRVYMSTRICTVLKKDSKVPKIMNLIKNLCI

SEQ ID NO: 164832 - protein, 79 aa, Triticum aestivum
  Clone ID: PAT_TA_59250.pep
WSEKGKLPHYVYIGRSLRACLLGLLYSHTLILSRSKQDKGSNTVFLPSKNTGFLSSPLVTDPDVSPSVGKGEEEQRLGR

SEQ ID NO: 164833 - protein, 46 aa, Triticum aestivum
  Clone ID: PAT_TA_59251.pep
EEEEEEATDELDYCNTVPAAAAPSAMLTSNALYRSRRPLSKRWFSS

SEQ ID NO: 164834 - protein, 97 aa, Triticum aestivum
  Clone ID: PAT_TA_59252.pep
SHYLRVTTELVFSYLARTNSWLTHRLTDWFLKSAVLLPPRPPPRKTTKKWKMLPPPTLVRSLVVFLLVDWIFVSNSGFMLQLLIMSLISLMMKTRCH

SEQ ID NO: 164835 - protein, 64 aa, Triticum aestivum
  Clone ID: PAT_TA_59253.pep
CIAVHHYVRTRARIYMSPLVSRSSNGSYKYAIPIMQLYSRQGPDKELDYYQDNKVLMNKNRRCQ

SEQ ID NO: 164836 - protein, 82 aa, Triticum aestivum
  unsure (1)..(82): unsure at all Xaa locations
  Clone ID: PAT_TA_59254.pep
LSANVVLVFFSCSFFLNGNTNAINSFLLRKLCYFNLFQHLFYFLSMRVITLPLLHSLVRNFLCENFIIICLYLHIIXVTFFV

SEQ ID NO: 164837 - protein, 112 aa, Triticum aestivum
  Clone ID: PAT_TA_59255.pep
ISLCHEVVAFHRLSCWRCRAALALMHRGWDCQVTCLRCPCDRDQGCCWGCWHWCHVIIPTVIATVASPGHCYHYRLCHCCRGEYLPRRCRRWRLSSTSSLVWWLFAGGPRTH

SEQ ID NO: 164838 - protein, 100 aa, Triticum aestivum
  Clone ID: PAT_TA_59256.pep
FVRLFFFFFFFFFFFFFFFFFLKHQRVLKIWLQDYIPLTQHCKKEKCKTAPEHNKPFLFFCREPEHNKPTAERKSFNSSFHSSTHKLPQQPGHGNRSSWP

SEQ ID NO: 164839 - protein, 133 aa, Triticum aestivum
  unsure (1)..(133): unsure at all Xaa locations
  Clone ID: PAT_TA_59257.pep
GLEGKYCDNYLIHRKFHEVLLCVIKMAADYLKPKDPNFSVHPKIRKDRRAYPHLKDCSGALDGTHVRASIPVDDQVRYIGRSGSTTLNVLAICDFDMNFMYTSVGQPGFMHDTCVLYHAIEADXDTFPHPPKG

SEQ ID NO: 164840 - protein, 77 aa, Triticum aestivum
  Clone ID: PAT_TA_59258.pep
SGSFAGTFFALLFPPTWELAGLRVTLTVKDELEFTAQPPPGSTSNREPQSPPPMRESPSQPLPKPPPPRTGRAQGRH

SEQ ID NO: 164841 - protein, 143 aa, Triticum aestivum
  unsure (1)..(143): unsure at all Xaa locations
  Clone ID: PAT_TA_59259.pep
GALHYFLGLEVSRSSTGWTLSQKKYSTDLLGRAGMLQCKHAITPMSATDRLSALDGIXLSTDDATEYRSLVGGLQYLTITRPDVSYAVNRVCQYLHAPRTTHLSAVKRILRYVSSTASYGLLLQSAPSCDLSAFSDADWAGRP

SEQ ID NO: 164842 - protein, 96 aa, Triticum aestivum
  Clone ID: PAT_TA_59260.pep
YLVKYVLSAIKEKWPESNRWNTIYVQQDNAKTHIKPDDPLFLQEAARGGWDIRMIYQPPNSPNTNILDLGWFASIQAMFHRKMPKTLAEIVQKVLH

SEQ ID NO: 164843 - protein, 52 aa, Triticum aestivum
  unsure (1)..(52): unsure at all Xaa locations
  Clone ID: PAT_TA_59261.pep
PVINLIFSRECRVSVFQQNQINYHHSLSYRFYLAQTLIKTQXHXYTESRNKI

SEQ ID NO: 164844 - protein, 70 aa, Triticum aestivum
  Clone ID: PAT_TA_59262.pep
LCDQEVMLVLRHRLMIAMIRELRAPTQGFKQVNYLLWVWQLGSHGLGLPRASAYRPVPIFLVTNFSFSTN

SEQ ID NO: 164845 - protein, 77 aa, Triticum aestivum
  Clone ID: PAT_TA_59263.pep
AENNQRPSTSTTRDDERMHACMRPLGKVSFFTITIQGVSVKRLPKLMHHAYQVVYGEWMDQMHHKVRATPAVGPPGS

SEQ ID NO: 164846 - protein, 55 aa, Triticum aestivum
  Clone ID: PAT_TA_59264.pep
LTRRDGGTSWFADNLNRGHLDYFYLLLAALSALELLAFLYFSANYIYKRKLVNVH

SEQ ID NO: 164847 - protein, 131 aa, Triticum aestivum
  Clone ID: PAT_TA_59265.pep
LSENSNAALLFYWNEMNRQVRVEGSVQKVSEEESEKYFHSRPRGSQLGAIVSKQSTVISGREVLQQAYKELEQKYSDGSFIPKPDYWGGYRLTSNLFEFWQGQQSRLHDRLQYSQRELGGSTEWHIQRLSP

SEQ ID NO: 164848 - protein, 34 aa, Triticum aestivum
  Clone ID: PAT_TA_59266.pep
ASYHVRAHLAPLIVTSRIVVFMFALYSLFLPPLI

SEQ ID NO: 164849 - protein, 73 aa, Triticum aestivum
  Clone ID: PAT_TA_59267.pep
CPDGKVETSSRSCNASRLHQTASSSVPNRALSLGLPASSSLRTSDPPRTRGPPAPSGPRSSRTRRAPPAPPAP

SEQ ID NO: 164850 - protein, 78 aa, Triticum aestivum
  Clone ID: PAT_TA_59268.pep
ERGQVARGGCSWLRAAYVLCNFIFYFFGDSCCSVLEGGMNRGETGQGWVLSAHRDIEIIGTIVVKCFNGKKNPPFPCK

SEQ ID NO: 164851 - protein, 43 aa, Triticum aestivum
  Clone ID: PAT_TA_59269.pep
IVDVIDTRSMISLMRLGRMGHQHLPYTSCNADITGNVYPRLPQ

SEQ ID NO: 164852 - protein, 82 aa, Triticum aestivum
  Clone ID: PAT_TA_59270.pep
ASKELLSSSALDSPYVLSKLATPPHAINPDMSQVINDATSAMNDVDDDASTFLDKIVPLGESLDEQLARSKEIENAETNEST

SEQ ID NO: 164853 - protein, 94 aa, Triticum aestivum
  Clone ID: PAT_TA_59271.pep
MLITRSSSNSSSEGSSVSSIWRSSKSSSGVSVVSSIGKSLSESEGSVSVSEGSVSALESSVSASDGSMMLTTSSCFCTSDESSCSVSFSKSLLI

SEQ ID NO: 164854 - protein, 128 aa, Triticum aestivum
  Clone ID: PAT_TA_59272.pep
IAQAKEDLAAENTRMTMERAALDAQAQRIQADSFRLSLDQNASNEVLRRRHRSRLPPVYKVRNLFNTPSVGTSDPPGVNQAVAALGTGAPAQPCMTGPPSQNNILPQHVPTPPGHYSNPLDNMIVVMS

SEQ ID NO: 164855 - protein, 92 aa, Triticum aestivum
  Clone ID: PAT_TA_59273.pep
SSTWFCTQKHWKIGKARNGPSQPTQPINDPGSQLPTPIPNKHHDCLPYRAWSATPPVCLICLQKAFLRDSIDSISLTSSTHGSRLWLQPQPH

SEQ ID NO: 164856 - protein, 52 aa, Triticum aestivum
  Clone ID: PAT_TA_59274.pep
LVEILEQKNARYVPFDGWEKIDSKEKTAGELKNKPREKITRWNELLEAAREG

SEQ ID NO: 164857 - protein, 104 aa, Triticum aestivum
  Clone ID: PAT_TA_59275.pep
RSIGPYWAIRERERVCLGQAARPPRPSPNWTRGRGRTPSFLPFSLPFPSLLLLLHGRSPSWTRKGGSPTRPTPGGSRTPPWRALPWPAAPSPLLLYIRGQGGTP

SEQ ID NO: 164858 - protein, 57 aa, Triticum aestivum
  Clone ID: PAT_TA_59276.pep
FSLFSVFFKTSLHFYNRRNGGSSCLPIKKEIFQETQGGVIACCANGKTNPYHHIKCL

SEQ ID NO: 164859 - protein, 86 aa, Triticum aestivum
  Clone ID: PAT_TA_59277.pep
GNSNEAHQFCIPKYPDRIVWKTVWSSIQWESPNIHGPVRMSGIPHKPNRIDGCGGLAKKLLNGSTVQSHTHINHSITKNAMGVASH

SEQ ID NO: 164860 - protein, 120 aa, Triticum aestivum
  Clone ID: PAT_TA_59278.pep
MNDSKEKDEKKKEDGDSSQKEKAKTGKDKKSESKDKDKISVKETGSDADDSTPKNKKNDKDNAKKNDESDEKQEKDKEKEEHDNKKKHVEVGHAREIKLQDNESANKETGASEEKNDGTD

SEQ ID NO: 164861 - protein, 72 aa, Triticum aestivum
  unsure (1)..(72): unsure at all Xaa locations
  Clone ID: PAT_TA_59279.pep
LEVYKCFRMLKYIVRNNELRHISINMMSNIDDVSVGLKCLRHGAAVXLVKPLRMTHLLELWTHVWPVRQQLG

SEQ ID NO: 164862 - protein, 81 aa, Triticum aestivum
  Clone ID: PAT_TA_59280.pep
ERGDAFRGIPKIRLFGVLRLLGVPWAFPSLGFCHSLFHKPSNIYPKLENFTTQNSTENLISSVSERKQNTTSRYCTELALY

SEQ ID NO: 164863 - protein, 49 aa, Triticum aestivum
  Clone ID: PAT_TA_59281.pep
LGYQHYIMAYVILASKKPIIHVGPSGTFECNVSILMHLALMASVSPKRP

SEQ ID NO: 164864 - protein, 72 aa, Triticum aestivum
  Clone ID: PAT_TA_59282.pep
HHPEAGPHGSVLSTDALDVIVLLQWHVSSADVAIVIEDPDWDVAALIQITRLVSNSHLDRWINTEKVGNVHT

SEQ ID NO: 164865 - protein, 37 aa, Triticum aestivum
  Clone ID: PAT_TA_59283.pep
YRQCDGTLLDSHKHISIKLDENLNWVQYVIPSGCLHQ

SEQ ID NO: 164866 - protein, 103 aa, Triticum aestivum
  Clone ID: PAT_TA_59284.pep
TITGRELRSDNQSLQDGRAHRGQRGNNESVQRVRRRMEPVVGLREFVHVTPSIVMWTESRREVCQLVAQHMDYSMGGYKIENVTPTRGESSGDNEISHILGHD

SEQ ID NO: 164867 - protein, 125 aa, Triticum aestivum
  Clone ID: PAT_TA_59285.pep
KDSTYELWTTVNNLFASQSQSRITNLRIAITNTKKGTMSSSAYMAKMKSLGDELAAAGRPISDPEMVNYILAGLDRNYDSVVAVIGAVKNTITADDLFAQISAFDQRMEMLGDSSSGGFHSSANA

SEQ ID NO: 164868 - protein, 145 aa, Triticum aestivum
  Clone ID: PAT_TA_59286.pep
KNCLIYILQKITYIINWNFKIVVTFSIIVRVLSVCSNFDIYSRFSNIFKENRLHLFARIIGNFEGKKLICRCTLYFKICTSIGHIQELGQIVGVAASKHEVACSKLLCAHFFFESFLISLVAWLWAGPFARRVRENPIRRILPQV

SEQ ID NO: 164869 - protein, 45 aa, Triticum aestivum
  Clone ID: PAT_TA_59287.pep
LNKGRSLDNTIWHGSTCATNANQASTSSTPKHQLQGSTTSNITLE

SEQ ID NO: 164870 - protein, 94 aa, Triticum aestivum
  Clone ID: PAT_TA_59288.pep
IGDVGSSPRESDRTPGTFVLACVCCLIAHNGCRSLDLRRETFVTTVPCHESIELVSIPIRALTHDAQPRMKMLRMFATKGFLLAGSCLLHFALL

SEQ ID NO: 164871 - protein, 45 aa, Triticum aestivum
  Clone ID: PAT_TA_59289.pep
RLYFVHYIERLNEQVQYHTVIKFCLGLWNPGNNCTQLSVIIPICC

SEQ ID NO: 164872 - protein, 77 aa, Triticum aestivum
  Clone ID: PAT_TA_59290.pep
LNVFGCLLMNYKLCRVPIGKYLTKIRHLTNNLKGHRPLIRVLVLMAIVSRRLTMFRVCFEYIHHWKWNIKFVCDSLS

SEQ ID NO: 164873 - protein, 90 aa, Triticum aestivum
  Clone ID: PAT_TA_59291.pep
MSTYACTLISRTYLELVVNLHRPTLVWAMSELMKNPEEMAKAQIEVQKVLPRGRVVITNANLGELHYLQMIIKEVLRLHPPATLLVPLEA

SEQ ID NO: 164874 - protein, 81 aa, Triticum aestivum
  Clone ID: PAT_TA_59292.pep
FSFSSSTNLINQCFLDEFVVSCCLDVLCVCGIRELPIAASTEYSLHSKLLVVVLVQREYLPSCPISELDRLTSGPCAYVDD

SEQ ID NO: 164875 - protein, 55 aa, Triticum aestivum
  Clone ID: PAT_TA_59293.pep
VRKIMVALHVSMHYCIFCGFILILYIHIQVHSHIFSQKIRDIKYRIFQLSETMCL

SEQ ID NO: 164876 - protein, 145 aa, Triticum aestivum
  Clone ID: PAT_TA_59294.pep
INKPDRLIEECNIVSFALSVAEEIEGNAEPSSYSEAIISGDSNKWMTAMHDEMESLEKNGTWDLVRLPREKKHIRCKWVFKRKEGVSPNDETRYKARLVAKGYSQIPGIDYNEVFSPVVKHSSIRTLLSIVAMHDLELEQLDVKT

SEQ ID NO: 164877 - protein, 76 aa, Triticum aestivum
  Clone ID: PAT_TA_59295.pep
GHIKYGGWSSDNGGSGVAECKLGGFWLLRRLRELTRLLDMDSRPVSHGSDAGHELERRWVSASMELRPRARNRERC

SEQ ID NO: 164878 - protein, 97 aa, Triticum aestivum
  Clone ID: PAT_TA_59296.pep
EEEGLPKKSQTPDDRPGPNVRRLKHQPSPSQRTFGPGRMTGAPTPEANELTSGPDRTTGAPAPEPKSAEDRRLRTSGTPITERNQRTTGGHRTSGSS

SEQ ID NO: 164879 - protein, 68 aa, Triticum aestivum
  Clone ID: PAT_TA_59297.pep
KKYSCFISFGFELRKCVFQFLFKNIICGLRKYLGISKKGNRTSHFSKTVCNIYNTCVISKLFATLKEC

SEQ ID NO: 164880 - protein, 61 aa, Triticum aestivum
  Clone ID: PAT_TA_59298.pep
LFDRFFFFFFFFFFFFFFFFFFFFFFFFQYNIFFYNTPSVREKLSTGQCICFFSKKKPQEF

SEQ ID NO: 164881 - protein, 79 aa, Triticum aestivum
  Clone ID: PAT_TA_59299.pep
RWRIGVGVTPEAQRLFDALSKTLPVHWDKTDIVVMKEVRVCSPYLPENVSGGTSAANERVKKVLDFERKRQHVRVPGQF

SEQ ID NO: 164882 - protein, 51 aa, Triticum aestivum
  Clone ID: PAT_TA_59300.pep
TFSYGCLYRRETVNIVCLCMLVKWHDSFFLCVHATYSSKLFACICYCKCLC

SEQ ID NO: 164883 - protein, 139 aa, Triticum aestivum
  Clone ID: PAT_TA_59301.pep
MASKVLLAILLLAAATPASLAAIDMAQMLADKPQYATFLRLLKETKVADDVSRLKSASVLVVPEKAVKPLLAVPAAKQRTILQHHVLIKYFDPIQLGEMKTNVAKLQTMLSNTDKDMGTIDYSKDKDGQMYLRSPGADS

SEQ ID NO: 164884 - protein, 97 aa, Triticum aestivum
  Clone ID: PAT_TA_59302.pep
LGDAMFNEDDIFSLPSFDMQSCYDDSMPLTYDYIDESGSGRVSTLGSDDSTILGEVSIDYDENKVGTYDDYCDETYAIKNSDDYIYKTCHDYDYPFS

SEQ ID NO: 164885 - protein, 72 aa, Triticum aestivum
  Clone ID: PAT_TA_59303.pep
TAIHTHTHTHTHMRITYCVERLTRQSWPSGGCAAPQLTDTLNRSRLHYKLQAVQCSIMLARSGTCLTVQMWR

SEQ ID NO: 164886 - protein, 98 aa, Triticum aestivum
  Clone ID: PAT_TA_59304.pep
ISTTVIGWTSNSHCLCVNIFLRQPQVCGKQHTFHLPLFLIIYIPFANSYGFFGAQILFVSITTHIVAHVKPLYEILHNSVLSKLFLIPQFRVRFRLIL

SEQ ID NO: 164887 - protein, 95 aa, Triticum aestivum
  Clone ID: PAT_TA_59305.pep
TVTYIHSIFLTSESILHSATVLLHYMALIIFPNRLNNLASPVHCTSYIVFVWVGFVSACRLEKGRCGVCGLSAGFCGAPSWLHAGFAAVQLFVVL

SEQ ID NO: 164888 - protein, 73 aa, Triticum aestivum
  Clone ID: PAT_TA_59306.pep
RPDPSLINIHVTQKTVLSRIHNVSASVYVPLKHDNLHNQNSMSGSQAQDREIGAPAEDKYGQRYTSPLNEADK

SEQ ID NO: 164889 - protein, 74 aa, Triticum aestivum
  Clone ID: PAT_TA_59307.pep
FADHYVILYMLLPCSTWRYSKWVVPLYVSGLLLRVTQIGVKACIDATLYVILIISSISEKHIRIPLMIVLTAIW

SEQ ID NO: 164890 - protein, 85 aa, Triticum aestivum
  Clone ID: PAT_TA_59308.pep
NPMDGTTRYVQLHACKIESISTSKGCCMHMAASQPASVRAAAARQRAWMAPALFGLPEVEDHFSVNSKLKLLFSAQLTTFPPIGG

SEQ ID NO: 164891 - protein, 79 aa, Triticum aestivum
  Clone ID: PAT_TA_59309.pep
PYCIPTYLWFINYFISLGCFKLGNHPLKRGPCQNRTVFCHLHQTHTSGTPKIFPNLEDLRNVCTNPDQKEYDQNHVYVN

SEQ ID NO: 164892 - protein, 82 aa, Triticum aestivum
  Clone ID: PAT_TA_59310.pep
YIWKIYNVYKKVDIKIYIWETKCNHVFENFQMYVKIVAVYQKINVYEKENMHQDLYLKKMLIMYLKIVKHVLKNIPDIYEKY

SEQ ID NO: 164893 - protein, 70 aa, Triticum aestivum
  Clone ID: PAT_TA_59311.pep
EWQVGFSGSKRPRQAAKDPSSKRHSMGLRAGNPIPLGVGCIHTKKDQHRKIACFILKYCRVILHQLLLRF

SEQ ID NO: 164894 - protein, 120 aa, Triticum aestivum
  unsure (1)..(120): unsure at all Xaa locations
  Clone ID: PAT_TA_59312.pep
KTPCLWRKELINLPNWTPPTSKGTSPXPPASDQGTQPPSPARGGTPPPPPASDQGTQPPSPARGGTPPPSLPAPARQSSQHPPSPPRQQGRKRPAAAPAAPAHRSPSPPPRKQGKKTAAA

SEQ ID NO: 164895 - protein, 35 aa, Triticum aestivum
  Clone ID: PAT_TA_59313.pep
MIICCSVFILQIRPDLKQRRCWLVSTSLCNNLLGC

SEQ ID NO: 164896 - protein, 64 aa, Triticum aestivum
  Clone ID: PAT_TA_59314.pep
SNLVHVTYGLTKRLMYDVIKHRRIKMILDYVGTNMGTQVSLLVIDWRGVSVVHYIIFEPAGSHA

SEQ ID NO: 164897 - protein, 79 aa, Triticum aestivum
  Clone ID: PAT_TA_59315.pep
FSVTRSLLQKLQQHFPLRLIFCIKTLVAKVNATSPPHLIFYNMTHVAKTAKSISGRSHTCVVFHHSCNNTVVAEISMAL

SEQ ID NO: 164898 - protein, 93 aa, Triticum aestivum
  Clone ID: PAT_TA_59316.pep
AVSPSLDNLRYWLLGIDPVSITILMYLADKLIITGVRTCEDLLKICQSILQHITSGARSLRKNWHLARSVSMEILHLRNRHLLIAFCHHQTLV

SEQ ID NO: 164899 - protein, 67 aa, Triticum aestivum
  Clone ID: PAT_TA_59317.pep
VGTPCNTPDVTFRICTPTIAVSGVKLIYFPGFGSLSPCAVVVTMHLLSCRHVMCICIRVHLMHLSIF

SEQ ID NO: 164900 - protein, 54 aa, Triticum aestivum
  Clone ID: PAT_TA_59318.pep
ISKEFFQIVSNCVSTRDYQSGKLINGFIWQIIFRGKNVPKSILSVIKSSITITR

SEQ ID NO: 164901 - protein, 73 aa, Triticum aestivum
  Clone ID: PAT_TA_59319.pep
PFNHNTEESVINKLIIFPKDYTSLDQPTLHLITDVVQTDACIDDGLAGPQMEASHVRPRITTSCMHVAQRGVV

SEQ ID NO: 164902 - protein, 131 aa, Triticum aestivum
  unsure (1)..(131): unsure at all Xaa locations
  Clone ID: PAT_TA_59320.pep
MDLEDSTTACKLPQWGSASEPRKSEFRNFLASITVGESRDIAEATIGSIHFPAIHYFALFIGRCINGKDEACHMCVPDLXILRSAVLGDKSYNLGAIVARRLHHNSFNGDFFAXIYATRLANFLVWTYVMM

SEQ ID NO: 164903 - protein, 50 aa, Triticum aestivum
  unsure (1)..(50): unsure at all Xaa locations
  Clone ID: PAT_TA_59321.pep
GGPPFFFFFFFFFFXFFFFFFFFFFFFFFFFFFFFFFFFFFFFFFFYETK

SEQ ID NO: 164904 - protein, 59 aa, Triticum aestivum
  Clone ID: PAT_TA_59322.pep
LLVMFLAELLRCWTLCQRQGVISYATHRGIVYICLRFCLSLLSSMVCNSWVGNHNSCRS

SEQ ID NO: 164905 - protein, 119 aa, Triticum aestivum
  unsure (1)..(119): unsure at all Xaa locations
  Clone ID: PAT_TA_59323.pep
LNNKSKVPAVDAIKYIAMSAGEYQGVWLGRLHSDLMDRDPXVVLNVDSKSXFFLREDPARHDRSKHINTVYHYIKDCMEKGKVNYIYTNDQMIDMLTKTLDREKFLKIRRRIDVRVVIW

SEQ ID NO: 164906 - protein, 55 aa, Triticum aestivum
  Clone ID: PAT_TA_59324.pep
SFSSWAIPNIFLLGIFLFLLKESSFLPLVCETTYIFRHSPNSQIVLKILFGSYLP

SEQ ID NO: 164907 - protein, 74 aa, Triticum aestivum
  Clone ID: PAT_TA_59325.pep
PREPLFFYVRWVQAGISMIAHSYLYVRSMDRHRDAGPLISLRFVFKAKWRHACGFCAGRTVLLFFFSPHVVFAR

SEQ ID NO: 164908 - protein, 62 aa, Triticum aestivum
  Clone ID: PAT_TA_59326.pep
NARATVVKLSSLEARPQSSIFLEICLGLAARHVPFPSSPPSIARADLVAGTTVMSLLFLSSF

SEQ ID NO: 164909 - protein, 46 aa, Triticum aestivum
  Clone ID: PAT_TA_59327.pep
CCSGSISCYGINTKIQGPRVDHNPPMTDQGFLRTQICCDQLVELPP

SEQ ID NO: 164910 - protein, 92 aa, Triticum aestivum
  Clone ID: PAT_TA_59328.pep
ALCIYGNFSFGIEHLSSLTRVHAMISCKCAVASEVNTVKDAIREQAGNLSSKPTIEFTTINEHMIIPDHKAKTAAVSPKIWLNGCINFRQTA

SEQ ID NO: 164911 - protein, 73 aa, Triticum aestivum
  Clone ID: PAT_TA_59329.pep
VGGAMRGPRGWRARPLPRGLLDCFLTSTPSLLDHVCSKNNAPEGFIPFGLRLIFLFGETLKLAKNSNLGWASG

SEQ ID NO: 164912 - protein, 95 aa, Triticum aestivum
  Clone ID: PAT_TA_59330.pep
SPSSFPHMGQCSNDDHHTFIFLQLKNYNSILRTKYDSMSMPPAVYRDCDELRVTCMKKNYKWWLSHKYDVNYMIMQSNMTMMMHVIINGTVESCM

SEQ ID NO: 164913 - protein, 130 aa, Triticum aestivum
  Clone ID: PAT_TA_59331.pep
QSAAQVSAPTIIPEPTTPTKDGRLDAAPGAAIFTAIEPNTSLVLCKARDSKVPDSVPDSESSAPLPIKPDWAPIMEFTAADVFQHSPFGDILNSLKSLSLSGEPWPDYGQHGWDTDGEEIRGPPTTHFVA

SEQ ID NO: 164914 - protein, 50 aa, Triticum aestivum
  Clone ID: PAT_TA_59332.pep
EQMEHSHLLITSAGERARYCCYLHETRIIQADETTRRLAAMKSYYWGVQI

SEQ ID NO: 164915 - protein, 35 aa, Triticum aestivum
  Clone ID: PAT_TA_59333.pep
VPDDRHPEWFQGRASYALTKEEKVIFFECLSSLKV

SEQ ID NO: 164916 - protein, 78 aa, Triticum aestivum
  Clone ID: PAT_TA_59334.pep
AQWRQHFPRDIINERGFYAQRRAERDKMRAERTAYREDKRRRKVDAQFNMRLGAASPWELDDDRYLLAYSHTSEEDIT

SEQ ID NO: 164917 - protein, 61 aa, Triticum aestivum
  Clone ID: PAT_TA_59335.pep
QRLWSRFVALTGTNAPFSPGWCHQPGPKASLHPQNLTRLRSLLRYSRSPGRSGPVSGGAPA

SEQ ID NO: 164918 - protein, 131 aa, Triticum aestivum
  unsure (1)..(131): unsure at all Xaa locations
  Clone ID: PAT_TA_59336.pep
KHKFNYASSKIGKAHHVLPKKVQNCKPFFHDSIFSFFFQYSSFFLHEPIFGLFWILFFGYSLFWIFFIFNFSMETISWKSINLGSSFEYLKVINLTMKTVQYLDTWLKRLNILKNRNYEGKKRGNXQVVTS

SEQ ID NO: 164919 - protein, 59 aa, Triticum aestivum
  Clone ID: PAT_TA_59337.pep
TCSYLWIFANSSNHKCIKIQERNSMLAEASPTYKTTMTIIVLLSIASQNKSLYLSTTLY

SEQ ID NO: 164920 - protein, 110 aa, Triticum aestivum
  Clone ID: PAT_TA_59338.pep
LLISITRNRLSVLTGNIYKQPLFVIVLFHVAPLTRGWRVLVVVAEKKGNHQAGEREESYARSLEARQPGAIVEESEEGLDYAATEVSYEGLRRPCIGGGREAATAPRDSA

SEQ ID NO: 164921 - protein, 115 aa, Triticum aestivum
  Clone ID: PAT_TA_59339.pep
RGVQLRIADGAQVTVQYAHNVIIHNIHVNDLIVGKGGRIRDSPQHAGFRTQSDGDGVSVFGSTDVWLDHLSLATCQDGLIDVIDQSTGVTISNCHLTNHNDVMLFGSSDSNPKDE

SEQ ID NO: 164922 - protein, 128 aa, Triticum aestivum
  Clone ID: PAT_TA_59340.pep
KWKSFFISERMKLLRVLDLEDATSDITAGDLKKVVKRLCRLKFLSLRGHTEIDHLPSSLGDLRQLQALDVRDTSIVTLPASITKLKKLQYIRAGRGTTVSALPASSCWLPDFCKCRQLVDVQVPGEIG

SEQ ID NO: 164923 - protein, 46 aa, Triticum aestivum
  Clone ID: PAT_TA_59341.pep
LKYQKHLLFVNGGVLCKQAFLSPILSFSSLFICSSFQPLIHLDCEI

SEQ ID NO: 164924 - protein, 121 aa, Triticum aestivum
  Clone ID: PAT_TA_59342.pep
MSSVICSSVDADPNTLEPDLLIGCPLCIAPSYGFVWRISWHSLKKRLASSTSLGPSFQYNQFGSIVSFAAIVFCSLVTRPSRGQMGNVFTSLGSMNILRIQYVCFGCLHHGSTNGHPTVYA

SEQ ID NO: 164925 - protein, 52 aa, Triticum aestivum
  Clone ID: PAT_TA_59343.pep
RMSYLGRNFRVPELCVTYRLLQTFLFLTYSVFLVWFAYFEASMDIKLFYKQY

SEQ ID NO: 164926 - protein, 118 aa, Triticum aestivum
  Clone ID: PAT_TA_59344.pep
LDFVAFNENLRKKVPTNILVDRISELNDDFAIRNNELGYSLEYRLTKFCQKNAYNDELVMQYEGPKEEPIPPKVDLGDFCPIKFSPFDYFCLPQRKLAAERREYEMSFNDLSYYYGST

SEQ ID NO: 164927 - protein, 141 aa, Triticum aestivum
  Clone ID: PAT_TA_59345.pep
DLRPLHQLMHTAIFINLFSKGLTKTYVRSPEATIHTYKRDNVECSHSSYLKPVSLPIHPHNVSEPTAGAADLKRTPHAHVLQAAIIIKPLTRLQERDPHHPCQSGHPSTPLRRPTAPPPCARPSRREDSGRSVVRSTCCTG

SEQ ID NO: 164928 - protein, 133 aa, Triticum aestivum
  unsure (1)..(133): unsure at all Xaa locations
  Clone ID: PAT_TA_59346.pep
LAHIXNLRMFPNSHSHFMDGLVDASKEPFVHCWPLAENIKYEMCYPFTMSESLEDHRLLLVSEEDGSVFLLIVGTGEARVGRRPVSIVCVRGDAADANTDTRPMYRCVVSITTPLGHVGSDTSLIKWTWTLGM

SEQ ID NO: 164929 - protein, 67 aa, Triticum aestivum
  Clone ID: PAT_TA_59347.pep
FKFELHAHHWCASILNKQFFTPFRDDIWNRRQVSVGDRGGPSHTTQKPSGICPPGTHVWQNEVVSDR

SEQ ID NO: 164930 - protein, 70 aa, Triticum aestivum
  Clone ID: PAT_TA_59348.pep
NSPYPQPDDLDWTMVLGLDDDPDIFMGMIISQFFQLRSADAIMAITSEYLGQLHASHFRITKIPTAGISF

SEQ ID NO: 164931 - protein, 58 aa, Triticum aestivum
  Clone ID: PAT_TA_59349.pep
FRFFLYVFFFFFFFFCFFFFFFFFFFFFFLCAVLHCTTNVAVYCNISSWWILHTHALR

SEQ ID NO: 164932 - protein, 77 aa, Triticum aestivum
  Clone ID: PAT_TA_59350.pep
HQYRHKRSYTRAYTHPYERTHAHLTPMSTSERRIRKLMMMHGCGARLVRTLTMVPIFCSLHHILLTCIVFVCWAWQV

SEQ ID NO: 164933 - protein, 63 aa, Triticum aestivum
  Clone ID: PAT_TA_59351.pep
VLEFLIQTSLHLGISPEHNLFTMALASTVHYTYMYLNIGAHIVLFFTGPSSLALAFSSCFLIL

SEQ ID NO: 164934 - protein, 108 aa, Triticum aestivum
  Clone ID: PAT_TA_59352.pep
IQFLIPEPHQNSRFQLFHLLFPQFQALSIISSQRSIQVTTRIHLVLSTSLSFCLIILSLPEFFMKVLHDGFIKDLICSRSVHQDSFQRSSSILHLAIRSAISSTVSSE

SEQ ID NO: 164935 - protein, 136 aa, Triticum aestivum
  Clone ID: PAT_TA_59353.pep
QKKVKEAFEHAWSGYRNYALGHDELMPLSRRGVDGLGGLGATVVDSLDTAIIMGADDIVSEASKWIEDNLMKKISEKGQVNLFETTIRVLGGLLSAYHLSGGDQAGGGDSGIAVTPNKTNPDRLLAISKDLADRLL

SEQ ID NO: 164936 - protein, 141 aa, Triticum aestivum
  Clone ID: PAT_TA_59354.pep
MTTYSLVFGGEAVLPLEVQITSLRVATHENLSEEKSVQLRLDELDRLEGRRLEALQNLEAYQARMSRAFDKRVKRRSFKQGDLVLAVIRPMNITRRMKGKFEPKWEGPFVIKEVYSSGAYRIISPDGEYSPAPINEKSLSI

SEQ ID NO: 164937 - protein, 136 aa, Triticum aestivum
  Clone ID: PAT_TA_59355.pep
TIKCMHLFVNGTSTHHNRCCRTRLFPCISHQPCPFPSTNELQTGCILSVAAGYLRQPLKYPGKQFCGKIFVFCGYNLCIWKYTMKLSITNNRIQSFPWPHPSPCKLISGKPPIFNSQSIRASQKSCIMCIGCGARP

SEQ ID NO: 164938 - protein, 109 aa, Triticum aestivum
  Clone ID: PAT_TA_59356.pep
FSSYSSFLFSTRVFSTLFFFSLQLLFYLTLFHFHLVPKISGQDLLLVEESCDAPSPMRQVSSSYSPSLPCHSLACCSLTCHHVHFIFMFFKTCIRFLHYPFRNPTLSHA

SEQ ID NO: 164939 - protein, 61 aa, Triticum aestivum
  Clone ID: PAT_TA_59357.pep
VRYYPDGYSSPECNGYISVYLELLSRNAEVRANYTFSLIDSGGGSAQPWSPFIRRFAHIYT

SEQ ID NO: 164940 - protein, 119 aa, Triticum aestivum
  Clone ID: PAT_TA_59358.pep
CNAVMELPEMCTSCFVARRGVAVSECVRAVPWCVCLWMIVCCVAVGLVQVSCDVVCVVCGWVLYICVPLCVLTVMRCLSVLSLYILSVVCPFGIPAGASQPRDLARGEEEDPRWTWGCT

SEQ ID NO: 164941 - protein, 65 aa, Triticum aestivum
  unsure (1)..(65): unsure at all Xaa locations
  Clone ID: PAT_TA_59359.pep
WRSXGFHSELFLHQLLILLIHILPHMTSSETSLFYVCHVLKKVPHRKKFQNPGFAFSDRQLSILH

SEQ ID NO: 164942 - protein, 44 aa, Triticum aestivum
  Clone ID: PAT_TA_59360.pep
ADQVFVFLQGDVITSFDGVSVGCEGTVPFRSTERIAFRYLTSQK

SEQ ID NO: 164943 - protein, 45 aa, Triticum aestivum
  Clone ID: PAT_TA_59361.pep
IFSQALSWALIFLTKLATILFSIEMLNVIVITYYVLLFLMFFMLP

SEQ ID NO: 164944 - protein, 95 aa, Triticum aestivum
  Clone ID: PAT_TA_59362.pep
KTIKLLSHWSVAYNFTYEIKIHNNKARVKSGRWAMPPGFLLCRIGIDKRGENASNHRSYSCPRLLIRLSRFLLPLGVAASVTATAVAARCCPIPH

SEQ ID NO: 164945 - protein, 74 aa, Triticum aestivum
  unsure (1)..(74): unsure at all Xaa locations
  Clone ID: PAT_TA_59363.pep
WCTSGGHQEGAFRQILRREYRPCLLMAMAWGVFLRGIDVXVSAFFSPILFRTIRFGSHSALTGTIILRLIQHPR

SEQ ID NO: 164946 - protein, 47 aa, Triticum aestivum
  unsure (1)..(47): unsure at all Xaa locations
  Clone ID: PAT_TA_59364.pep
MFTGGPKNSNTRSYRCKCPTMIXLLRSNDNGWYISEHRPSHNHSLTD

SEQ ID NO: 164947 - protein, 40 aa, Triticum aestivum
  unsure (1)..(40): unsure at all Xaa locations
  Clone ID: PAT_TA_59365.pep
SXPXTRRPAANSYSDRRSSQASPSPLRQRTGHNHRRGSTN

SEQ ID NO: 164948 - protein, 77 aa, Triticum aestivum
  Clone ID: PAT_TA_59366.pep
CGSHCHNYSMYSHVACPWSHLSCSWRSWALSFSCCPKIAFIQEPCAHGKHILCLRGNSLPPPPPLLLLLLLLLLLPG

SEQ ID NO: 164949 - protein, 86 aa, Triticum aestivum
  Clone ID: PAT_TA_59367.pep
SLWCTLLIWFRRLLPLFLTLIDLCSLSRIPRVGARQVPSQVFFFLPAFCQVFREAPRSSPQVGASLLIRAPPVPRYEALGQGLGER

SEQ ID NO: 164950 - protein, 61 aa, Triticum aestivum
  Clone ID: PAT_TA_59368.pep
ENQNWRVTWSFRCFFTWSEKTPASCIRNGGSNTHHHAYYYSYNKLRRINNKLTCLGAKLFL

SEQ ID NO: 164951 - protein, 57 aa, Triticum aestivum
  Clone ID: PAT_TA_59369.pep
TAARRRQKSTVTAAKKQQNHRTAPIFATQLRTSAKLKVLGHLDHLSMRLSHSDFSGR

SEQ ID NO: 164952 - protein, 93 aa, Triticum aestivum
  Clone ID: PAT_TA_59370.pep
SGKLCTLWCIYKDSEMDICFLFSSCIACISFLVIDLYLWFRCYECSFTLALFLLTSLAKGPVRCTRRTKSHAPNPIRINLRNSHVIRVNRLHP

SEQ ID NO: 164953 - protein, 111 aa, Triticum aestivum
  Clone ID: PAT_TA_59371.pep
IPLGLYPLWAWSPGGCLAAPPEQPPPGLVPFGTPPRRRPQGAGRKPSEVKHYSHPTNPRSRSTNRQAEPWADCMIEFGVRKYRIIEERHKLFGYPDTYDFARGLTLDGYSS

SEQ ID NO: 164954 - protein, 81 aa, Triticum aestivum
  Clone ID: PAT_TA_59372.pep
LLGSALNMPKTISDDVRQASLQSVLPKLCHVYHHSGPDPFLCGHTSTSTCASPLSLTYEQCCLLVGQHSAPYSITGRMAIL

SEQ ID NO: 164955 - protein, 134 aa, Triticum aestivum
  Clone ID: PAT_TA_59373.pep
GNPQDPPGKRHAGDDYNAMARPLPGPRQDPCRRHQRGHCQARASQGSATVRIQLPAQPAGQAPAWQHAAYKPTHQAPTWWHADLREGPAIAPPQQPACLHGTAHIAGLGACRSEAERRRMGRASFPSPIKLMDT

SEQ ID NO: 164956 - protein, 80 aa, Triticum aestivum
  Clone ID: PAT_TA_59374.pep
ISFVWERDFTSEKGAAFSLRGEREREGRCYRDMGRPSRAGCDINHVHKMLPPKKNVHKMLKLTMYTKNVDSQKKKVKNVL

SEQ ID NO: 164957 - protein, 82 aa, Triticum aestivum
  Clone ID: PAT_TA_59375.pep
NTLFFRKNNTVDFHCMSEILNGKLLRRIGAPCTYHRGSVRRPSYHRGHQLFVGDEPGERIRGEAHLQLHAPCPSAALVDRDH

SEQ ID NO: 164958 - protein, 140 aa, Triticum aestivum
  Clone ID: PAT_TA_59376.pep
DSMQTPPLGVSCSARKGRGKTKRGARGGHGSGRGRKAGAPSLPPPPDDSPDHRTAPSEVDPSDMDLSRTPVHEPRTDEARAAEPLPQETPVPKSSSQWALEASDLADGGEDSFSDDSDSEGLLVEGGKKVYQRGGTKLPP

SEQ ID NO: 164959 - protein, 64 aa, Triticum aestivum
  Clone ID: PAT_TA_59377.pep
YVSNVSIIFDCSMLLYLLFWTILGFIFHFYITFGTNRLTGGPAQNCYFLQNIKRSPSGMKPSGS

SEQ ID NO: 164960 - protein, 84 aa, Triticum aestivum
  Clone ID: PAT_TA_59378.pep
PYKVIKNWNYTGLVDAIHNGEGNCWTAKVTCEEELMAAIATATEEKKDCLCFIEVVAHKDDTSKELLEWGSRVSAANSRPPNPQ

SEQ ID NO: 164961 - protein, 38 aa, Triticum aestivum
  Clone ID: PAT_TA_59379.pep
IELSNKKMASILASTKVSVFYSRIKKTFPKSSQRFYLA

SEQ ID NO: 164962 - protein, 134 aa, Triticum aestivum
  unsure (1)..(134): unsure at all Xaa locations
  Clone ID: PAT_TA_59380.pep
SSSSSSASSSSLSSSXTXLSSNLSSSSSPISPFSSSSSPSPCSCPSISSPTPPTAIATLPLLSGSASSPSPSSSTSSSSSSSSSSMPSSSSSLLGTSSTSTTVSSSSPSSSISSPKSSSSSYSSSASSSSSSTS

SEQ ID NO: 164963 - protein, 134 aa, Triticum aestivum
  unsure (1)..(134): unsure at all Xaa locations
  Clone ID: PAT_TA_59381.pep
TQFFXQNRAHILVRPVTKFAAARKPHAPTTISTVPRRVCGSKPYPPLPPSHAIPTPFSTFLAAGDHLPPPATMWGRMWSSRRSFGSRSDSGSDPERERRVRSDGARKWTNYGLSPPPSFRLRETEEYDRRHGCT

SEQ ID NO: 164964 - protein, 50 aa, Triticum aestivum
  Clone ID: PAT_TA_59382.pep
VARGRPASIACLSLREGTAARSSSASFPCTINFSCLIRSSFIHHFAAEVY

SEQ ID NO: 164965 - protein, 67 aa, Triticum aestivum
  Clone ID: PAT_TA_59383.pep
ANRAIKPSLIIELLNYRQYISAPCMHAMHARWDRSLFYEGSYRIEIEHADAVPTNIITLHGRRYEGY

SEQ ID NO: 164966 - protein, 76 aa, Triticum aestivum
  Clone ID: PAT_TA_59384.pep
LPLHFCDHLSSTSTAAAAARDGVPNAARRQRLLGPHGDVLGVTTQRMHACVDRSSSLRHAYRLYVFLFPPFVLFQP

SEQ ID NO: 164967 - protein, 145 aa, Triticum aestivum
  unsure (1)..(145): unsure at all Xaa locations
  Clone ID: PAT_TA_59385.pep
TATLACINHPNPSSSSXDAXDQSIWDLIWKAKVPEKIRIFGWRVATNTLATKSNKFKRTLEVDSTCDICGNGVEDEHHAVINCSNSRALRVAMRKEWSLPSEKSFRHTGXDWLQALLDKETEEVRAKILMLLWRCWHLREDILRH

SEQ ID NO: 164968 - protein, 72 aa, Triticum aestivum
  Clone ID: PAT_TA_59386.pep
GIYACRNCNNIKFPPHVLKILKLCLFYLPMLVDYCSPKLFAHKIPIHRKWVRLKCASHMLHDAPVMFQFLTF

SEQ ID NO: 164969 - protein, 71 aa, Triticum aestivum
  Clone ID: PAT_TA_59387.pep
YVGVLEYVRRVGPGSAVRCGCLPPLWPCRIIAYMTHRGNQPLIKAKERDAADLKGAQADRHVLPSSELISY

SEQ ID NO: 164970 - protein, 72 aa, Triticum aestivum
  Clone ID: PAT_TA_59388.pep
QQVGISRTVIGRLLHILYNWGQGGGLNLLCILSSFGTNPGPKNYSIPNLFVNLLFPKLVTFLPGAIPPEDSP

SEQ ID NO: 164971 - protein, 102 aa, Triticum aestivum
  Clone ID: PAT_TA_59389.pep
EVSSAYIKPSLMQGHRLVGEVRNSFDRCIGNGVGDGASEAASVSTSLPPLYYQWLSIFNRRGTGAQNLGMKARNEGLAAHLMLFLLGGEEEVSAAQARSRTS

SEQ ID NO: 164972 - protein, 63 aa, Triticum aestivum
  Clone ID: PAT_TA_59390.pep
NLTKSCKYSKLLAVMHERYVVVDPMTWFSGTLIGYDIRGRPVLTAITPRHRWCHAHPIQRSDT

SEQ ID NO: 164973 - protein, 67 aa, Triticum aestivum
  Clone ID: PAT_TA_59391.pep
VPLHIHLGCRVHPNLDLHAFLPCSHIETLLISRTLHPHKIPTENFLILVCIIMQSCTSRTYSNQVLL

SEQ ID NO: 164974 - protein, 84 aa, Triticum aestivum
  Clone ID: PAT_TA_59392.pep
SLNLSLSLSLSLSFLRDSFLPLNSASQWQKTLCGREIPCGCSQIALLIFLEPDKCGVLSVVVGDGIIRTCICNLFYFGRYVQVN

SEQ ID NO: 164975 - protein, 82 aa, Triticum aestivum
  Clone ID: PAT_TA_59393.pep
STMSVYQIVLCGITCQWFSTSDHLRNFCTVLQPCYAAFHLLLVKIVHQPFMWEKPIVVRCCVENRHTGNLTTTFSASRSIPC

SEQ ID NO: 164976 - protein, 49 aa, Triticum aestivum
  Clone ID: PAT_TA_59394.pep
ANFEIGPDLNKYYVQVVKQQVKMHQDDLHEILVMLHTKFIKFGATALKM

SEQ ID NO: 164977 - protein, 83 aa, Triticum aestivum
  Clone ID: PAT_TA_59395.pep
TKESGGRMLSVWGPSSTFSTGSCVEPVLKAVLYKPFVHPCSVLPFFLELITHSAQILSRFEGPHPFKCSQRLATLSFHLSLLD

SEQ ID NO: 164978 - protein, 33 aa, Triticum aestivum
  Clone ID: PAT_TA_59396.pep
LYFVFLCFFFNKQATSIYGHSPSCLSMLSLSVN

SEQ ID NO: 164979 - protein, 105 aa, Triticum aestivum
  Clone ID: PAT_TA_59397.pep
PGSHEEFRNGPEVKNYIWEVEFRPFGKFRGSPVLYRDHRKGPGGPPGGATHLEGPRGLKWEGNQPIVGWCTPLVPPSAPRVGNPRGGGASTCLGGQVSPLGRRPP

SEQ ID NO: 164980 - protein, 137 aa, Triticum aestivum
  Clone ID: PAT_TA_59398.pep
MDREEDLFLSSLLSKLETLENDDDPDGAELSSINPHPESGEEAGPGDVAKDLSKIKRQNMITHILLGTVMVMIAAWQFNEVSFLLAVQKKLTNPFKSVGDMVKSTLKIGKKPVVEAIEASPLPPVGVPDVGRADLPM

SEQ ID NO: 164981 - protein, 72 aa, Triticum aestivum
  Clone ID: PAT_TA_59399.pep
LIVENRNYVPVDFVVLDIDCNHTCPIILGRPSLRTIGAIIDTKEGNIRFQFPLRKGMEHFPRKKLNYLMNLL

SEQ ID NO: 164982 - protein, 82 aa, Triticum aestivum
  Clone ID: PAT_TA_59400.pep
KPCSGLVAKAGNGNALLCRPLLEGIDMEKLQTSIRYLQGKPYTSRLDDVGALVSSSLGASFLEVCIGSRDQWTVSMVKQHFM

SEQ ID NO: 164983 - protein, 94 aa, Triticum aestivum
  Clone ID: PAT_TA_59401.pep
FIISPIIIKIHIAKHRSNKRRINNFKILIIIFMETRRTRFYKAIFFSTQSSGSFLTLINGNSHYFERLIDIMLRRRRSKFKRININQKFINVPG

SEQ ID NO: 164984 - protein, 63 aa, Triticum aestivum
  Clone ID: PAT_TA_59402.pep
DINHQEYKYREGYVDFVSTTCVNMCQVKPLESLKGGYHPIIPHHNHFNSMLARKINHYKLLAN

SEQ ID NO: 164985 - protein, 60 aa, Triticum aestivum
  Clone ID: PAT_TA_59403.pep
RFKVFKLGNVRYSMVDTSHRYSYGNSISSRGVTCQCKSKVQLKPCPKRHNLVNKTMEHPI

SEQ ID NO: 164986 - protein, 81 aa, Triticum aestivum
  Clone ID: PAT_TA_59404.pep
KEILNGLQKFRNKFSRASKIKPHKVNIYLGPKCNFEKRTFFLNSNKTPKKSYLIFIIKSSIFLYFGKVILFPLSYFCNRNN

SEQ ID NO: 164987 - protein, 94 aa, Triticum aestivum
  Clone ID: PAT_TA_59405.pep
ATDGPCTIIRSREFRVVERVVREESGASMMHTRTKLPKVGACHASQAASRSCLENGDQRWRRPERLPARTAAYSHRHSQEIQINVLKIIKGRKK

SEQ ID NO: 164988 - protein, 114 aa, Triticum aestivum
  Clone ID: PAT_TA_59406.pep
AAAFFFFFFFFFFSYYEYVLQPHGSTQVATHTLVNLQAANSLTRGSQLVEYVYVSYQYLARAHSTGKLHKHARPISHSHYSCRYSVGWGLKPVVRSDGRPTRITGTWASSWARR

SEQ ID NO: 164989 - protein, 74 aa, Triticum aestivum
  Clone ID: PAT_TA_59407.pep
LSLSIYLLCVYLGANALCGSAHFRVKHNNEHAIVIGNVHVTPLMVFLYGCIIMMTPKHSFSIGQTLHNHKDALF

SEQ ID NO: 164990 - protein, 55 aa, Triticum aestivum
  Clone ID: PAT_TA_59408.pep
LTDLTDRKSVTTIAVKYNTQYHRGASLLLKDRNYINALAVPFVHQYMHLSINLFT

SEQ ID NO: 164991 - protein, 63 aa, Triticum aestivum
  Clone ID: PAT_TA_59409.pep
SCHFLQLHLSHISIRYFLPSFSSSCCLARTSSCSDRLRFCYSVSTSAVSAAEASSEACVHILT

SEQ ID NO: 164992 - protein, 61 aa, Triticum aestivum
  Clone ID: PAT_TA_59410.pep
VLNKLHLNRGFYKFGIMEFLLFLMRTSFHERFSLFFFFSFCKWKRNMEIERSHDSAVYTLV

SEQ ID NO: 164993 - protein, 69 aa, Triticum aestivum
  Clone ID: PAT_TA_59411.pep
TFSISVIIIAVKYYTHDHRGSRLLCKVHNSSTSDTCKHDSHYVSYGTSSLLQGAPYVHGTGFTNYDTII

SEQ ID NO: 164994 - protein, 72 aa, Triticum aestivum
  Clone ID: PAT_TA_59412.pep
VKFGIQLESQNRDVIAEERRANGMSSSMTRYSPIQINMGGRSSTWRVCRLFSLFLKRSLGVKLALRGRATRK

SEQ ID NO: 164995 - protein, 65 aa, Triticum aestivum
  Clone ID: PAT_TA_59413.pep
PEWATVGLRHVSTYHRRVPSIRWMTTVRTPSRHMDLPDNENFTHGKSPLVYAVNGLSDPNRNPIA

SEQ ID NO: 164996 - protein, 124 aa, Triticum aestivum
  Clone ID: PAT_TA_59414.pep
MQKIVCGCSGKPEQQNSRSCRCECPAMVRLLRAADNGWYIAEHRASHNHSLSLTCGEKVHWPSHKHTDVYTKDLVKQLRENNLNLNKVYSIVGSFFGLTQSVPFTKRSLRNLCGRISRDQVDDD

SEQ ID NO: 164997 - protein, 96 aa, Triticum aestivum
  Clone ID: PAT_TA_59415.pep
VDPGTGAMQRSSRDLERVKTRWQWHACRRRHRGSPWLARMLPSWRFIITTLDVSPVSTFHLGTNTQHHRRSNPSIVLHTKAGEKTGTTATSSCTGS

SEQ ID NO: 164998 - protein, 50 aa, Triticum aestivum
  Clone ID: PAT_TA_59416.pep
FLTFCVIFFFFFYFFFFLFFFFFFFYFFFFFFFFFYPTREHQDYVPTDFL

SEQ ID NO: 164999 - protein, 56 aa, Triticum aestivum
  Clone ID: PAT_TA_59417.pep
MYIRLWSIQINYEACTAEISYCEIGNAPVRLLVSGILNRATTAEDRNSICTISLST

SEQ ID NO: 165000 - protein, 66 aa, Triticum aestivum
  Clone ID: PAT_TA_59418.pep
EDQLLGKSHRSSYDRQPSLTQQTSVPSCIPFSAYLSTSLQSTGFTISNTRIRLPSLNSHQARRLIS

SEQ ID NO: 165001 - protein, 82 aa, Triticum aestivum
  Clone ID: PAT_TA_59419.pep
FPLPIMGCASGVNNQGIVLRNATRTRIKWPFQQLAVEAVVAAASAVRGSGGSGGAGFETGRLGFYPRTGRRLIKVEPGGVRA

SEQ ID NO: 165002 - protein, 124 aa, Triticum aestivum
  unsure (1)..(124): unsure at all Xaa locations
  Clone ID: PAT_TA_59420.pep
VSVQRIALDIHVFLEVHPIVILISDHVILHILYRGRCLDGHNQLXSPHLSRFKQQVCIAIKLTLERWHARLGHPSFFXTKHVLSRNKLSVVGEHNSETIYDSCQIAQHHQLPYPVSTTNSVKPL

SEQ ID NO: 165003 - protein, 46 aa, Triticum aestivum
  Clone ID: PAT_TA_59421.pep
GLSRTSDWHSPGGRHDWQYQKMNPSPHPLPWMCASWSPRHARRGDE

SEQ ID NO: 165004 - protein, 53 aa, Triticum aestivum
  unsure (1)..(53): unsure at all Xaa locations
  Clone ID: PAT_TA_59422.pep
MLFLFLFMFVYFLFFFXFFFFFLFLFFFFLFFFLFLFFLIFPRRLLSSSRQPY

SEQ ID NO: 165005 - protein, 83 aa, Triticum aestivum
  Clone ID: PAT_TA_59423.pep
LAEHLSQILPLIREWGRYRCQAGYGEIQCRCLTTAVGRATRASVQRRQERSGNDGRRPVYAYYGLTVQFCVFHINMIVLPSIF

SEQ ID NO: 165006 - protein, 117 aa, Triticum aestivum
  Clone ID: PAT_TA_59424.pep
LQWRRVRSGGSLRYTSGDETGSDKLIVERGNEESKRCGWRSPYGSDNVRRRRRSVALPREIGFFLIEACGERKNREKGCGVPRGVLPVYGVSEEHGIEHGRRSIWAPLGLFALCVRP

SEQ ID NO: 165007 - protein, 74 aa, Triticum aestivum
  Clone ID: PAT_TA_59425.pep
TMLRPYKVTRSEQNFTCRIPPMELCTASLSTLCRKTTHCQFSWRENHSMSVEYTLFLPKKKNYGLYHVWQTVEA

SEQ ID NO: 165008 - protein, 101 aa, Triticum aestivum
  Clone ID: PAT_TA_59426.pep
PPTGLIPWFSKTWGITKVTFWNLLFFLGESQGSVPELPGGFFAGLPGGLRKSQHTKYPSQSLSPALHYLPFASRFPLPHFTLAVLFTLSLYPPSLSLFASF

SEQ ID NO: 165009 - protein, 143 aa, Triticum aestivum
  Clone ID: PAT_TA_59427.pep
LPLITLFAICLSFSSPPVHPCRFIRPLFPVCLPLSLASCMLVVMASSVFIPSSPDIEVLHFKHRQGENLKDAWFRMLESYRGCNIEGDFKILLHNFYVGLTISHRQLLDFAAKGSFIEIDPSFAYEIIRGIVGVLPLQNGSTL

SEQ ID NO: 165010 - protein, 110 aa, Triticum aestivum
  Clone ID: PAT_TA_59428.pep
CIHTNKSREPAEPEKKKMSARQRTNIFDSQSHGIYMNICYSTPSVKNVHEPIVVVVASGLVRALDRLLFCRRSAGGFLHQPAVSYSMTSRRFLGLAPSGAPFLIIATNSL

SEQ ID NO: 165011 - protein, 45 aa, Triticum aestivum
  Clone ID: PAT_TA_59429.pep
GTTHVPPTRQWGPADPNTILRVLCHRDDEAANQFLKRTFQLAKRR

SEQ ID NO: 165012 - protein, 82 aa, Triticum aestivum
  unsure (1)..(82): unsure at all Xaa locations
  Clone ID: PAT_TA_59430.pep
AKPRAPGXYTLLQYSYSAHTAIAHEGNLLRAPGLGLGPGSATACTGYPMHGAAVHLVRDLVTHAYASPFCTSSINADSFCHS

SEQ ID NO: 165013 - protein, 55 aa, Triticum aestivum
  Clone ID: PAT_TA_59431.pep
MSQADPGEEIYYIRAKQHSGYIRVDTSSHKTQDVLKHTGERSRNCSRLISFSTTA

SEQ ID NO: 165014 - protein, 66 aa, Triticum aestivum
  unsure (1)..(66): unsure at all Xaa locations
  Clone ID: PAT_TA_59432.pep
LGRXPSLDQYLPYLLVPPLVPVTDRVWFSKLLTPYQSTHRTERPWWKIPEASGRHATWSXGMGVSG

SEQ ID NO: 165015 - protein, 142 aa, Triticum aestivum
  Clone ID: PAT_TA_59433.pep
PFHLQGKPTQAQDVARRISGTIVGEVFAQVKTFQVPITNSSPSHLHYFPFASRFPLPHFTLAVLFALSFPISSSLFRLLSSNLLLFAVMLEIGEIIVDTGNNDNMENSEAPAEEPLSCILKSFESVVVTLLERMLFKISLLV

SEQ ID NO: 165016 - protein, 143 aa, Triticum aestivum
  Clone ID: PAT_TA_59434.pep
SIAVEVGGVEIGQGLYTKVKQMTAFGLAELCSDADELLDKVRVIQADTLSMIQGGFTGGSTTSETSCEAVRLSCATLVERLKPIKESIESKSGAPAPWKALITQATMASVNLSAQAYWTPDPAFVKYINYGPAVSEVEIDVLT

SEQ ID NO: 165017 - protein, 65 aa, Triticum aestivum
  Clone ID: PAT_TA_59435.pep
MLLLTISGRVHKLRHQFHVLVALVNVYVQCTLIWNYIKCMQILSRILFVCYYVISTIFGMKLTTR

SEQ ID NO: 165018 - protein, 62 aa, Triticum aestivum
  Clone ID: PAT_TA_59436.pep
KKLVKKKQVKTVTAIHRATLADLTTRVKRYTLSRREHRCFVEIVMKCHCRHFSTRQRLRLHH

SEQ ID NO: 165019 - protein, 100 aa, Triticum aestivum
  Clone ID: PAT_TA_59437.pep
RLREDDRSRRGLTCSNIVLVRTKSIRTFLNQKKKLKAIRGNGYRFVPKGGTFPTENHHACCEKLRFVRSVYPNLPQMGQNLYHGMLMPLHDSMPSFLNFR

SEQ ID NO: 165020 - protein, 90 aa, Triticum aestivum
  Clone ID: PAT_TA_59438.pep
SSRNCLSTRPTLRRSPSASHLTMHGGTRSTMTRVGLSKRMSARQSRRQRIILEGDGFGRRTIFSSCMTQGRCAFLCVWGGARGWDFSLAE

SEQ ID NO: 165021 - protein, 54 aa, Triticum aestivum
  Clone ID: PAT_TA_59439.pep
VLYHLLWDYMNKLFFSRCYGPKAFIHISLLSSLFVSCYCHEKLLYLCTLKFCNL

SEQ ID NO: 165022 - protein, 47 aa, Triticum aestivum
  Clone ID: PAT_TA_59440.pep
TMINTSSIYDWIDNQRIIRQRKKNNQGGLHQMQTKKERSVFSDKLSH

SEQ ID NO: 165023 - protein, 91 aa, Triticum aestivum
  Clone ID: PAT_TA_59441.pep
ARPRPEHLRRLRCCHGERTPTLFVVFLTLARDHEDPEGFFLVVCFSASSSSRNRRRPCQRPPPPSPVSLDLVRLQQHPHGEALLLPISLSG

SEQ ID NO: 165024 - protein, 47 aa, Triticum aestivum
  Clone ID: PAT_TA_59442.pep
NKLIMDQWKFASNVHAVRSGRSMFQKGTVLVRSSSCYISVFLLRTII

SEQ ID NO: 165025 - protein, 113 aa, Triticum aestivum
  Clone ID: PAT_TA_59443.pep
SKGWHEGKIYFAPTYKYKLNSDTYAGETTKSKRKRRTPSWCDRILWHGKGIEQLQYIGGEHRFSDHRPVCSVFVVEADANNGSRIRNGYSTLDSRVHCESPLPIPQRHSFYDF

SEQ ID NO: 165026 - protein, 123 aa, Triticum aestivum
  unsure (1)..(123): unsure at all Xaa locations
  Clone ID: PAT_TA_59444.pep
LSHLSAFCEAVSLAHLVEAEIMSPYHGILINTGVGNPTVPMITGLGGKASFARLVGTHSLIRPYKGIRIHPFIHAFFLLCSSIFAHSSSSAQVRISHLNLLQPCPEWEAXGWSPPSRXETSRS

SEQ ID NO: 165027 - protein, 133 aa, Triticum aestivum
  Clone ID: PAT_TA_59445.pep
SIGADVSDAEQGKAVEVSDAEQGKAAKVSDAEQGRAAGDIILEEDPVEGVVETRGSAAAGQEKSPAAEPSVDVDAGSPTLPSAGEPMVFVVSDSPAAPAAGGVLPDNAAMSTGDDDEETESDIYEAQKKTTQG

SEQ ID NO: 165028 - protein, 52 aa, Triticum aestivum
  Clone ID: PAT_TA_59446.pep
GSARHRHHGRNPHVSHRSRNEGRNNSRISSSIGHVPYDTVKSHRVPVMSCRL

SEQ ID NO: 165029 - protein, 54 aa, Triticum aestivum
  Clone ID: PAT_TA_59447.pep
VDTDKDGRLNYNQFVSIIKTGTYWRKASPHYPRGIFRSLIMTLVTDGSVKLDVN

SEQ ID NO: 165030 - protein, 116 aa, Triticum aestivum
  unsure (1)..(116): unsure at all Xaa locations
  Clone ID: PAT_TA_59448.pep
YVALDYDQDLDTAKSSSSVEKSYXLPDGHVIITGAQRFRCPEVFFEPSMMSIESSGIHDTTYTSITKCDVDISKDLYXNIVLNGGTSMFTGIADRMSNDITALAPNNMKIKFSLHL

SEQ ID NO: 165031 - protein, 129 aa, Triticum aestivum
  unsure (1)..(129): unsure at all Xaa locations
  Clone ID: PAT_TA_59449.pep
GRPLKGVDAAGRQDGLLWYKDARQLVAGEFSMAVVQANTLLEDHSHVESGSLSTTDPKLQGSFVGVYDGHGGPETARCINDHMFSHLKGYASEQKCMSVEVIRKAFRATXMDFSSLVSNQWSVRPQLAA

SEQ ID NO: 165032 - protein, 74 aa, Triticum aestivum
  Clone ID: PAT_TA_59450.pep
GAVSLARAFSYHNAPSTTKPDDIFQVHLAGSAPRAALFPGPVGLSPRHVSLFTSLAYFTGGAPRVASSTGHVGP

SEQ ID NO: 165033 - protein, 46 aa, Triticum aestivum
  Clone ID: PAT_TA_59451.pep
SYNKTLPSSGGEPSLMTSKSPRVEVQGVHLRQTPLSLNNSISGLVC

SEQ ID NO: 165034 - protein, 76 aa, Triticum aestivum
  Clone ID: PAT_TA_59452.pep
PYKAPHASECPMTTTDCMWPKHVCMEGLCNVLNNKFMTLMWHLHHKRANPRRWLTTHSVLAAPLPPNTHTAHPPPL

SEQ ID NO: 165035 - protein, 79 aa, Triticum aestivum
  Clone ID: PAT_TA_59453.pep
QSSPKAMSSPSSTRAARDHDPSSDHFMHHPLVQSVCGTTCGRICALNRQRVQFTIDLQATIDMRLLLMLLDASQSYVTV

SEQ ID NO: 165036 - protein, 61 aa, Triticum aestivum
  Clone ID: PAT_TA_59454.pep
VANNESMDMHLSFCKHTSCLGDKSINVSSFQLVNILLWSWFSIFGVHASYCNLIDSVVKRY

SEQ ID NO: 165037 - protein, 104 aa, Triticum aestivum
  Clone ID: PAT_TA_59455.pep
VMLHPYMIHQHHLETIYISCRCTCPYIWCKLWPPLSNIIITLTYLSRLLYRVTVSGRWRSQEKLVVDFFYACCSIHLASSCINASALRSINQNKAQAHTLGEFQ

SEQ ID NO: 165038 - protein, 49 aa, Triticum aestivum
  Clone ID: PAT_TA_59456.pep
KYYVPIARQTITESLQLLSLAYRGAIESLQMEIPITWMATNCLVRALTV

SEQ ID NO: 165039 - protein, 107 aa, Triticum aestivum
  Clone ID: PAT_TA_59457.pep
APHGGTEREPEKGGRRHGESARPGRVRGIADGVQGDERKQEVARGSRRWPRPLGRAPRLGPSGEEEDDRGSGDGLGRAGPGKWAPGNFLLSLSFISFLFLLFFFDLI

SEQ ID NO: 165040 - protein, 78 aa, Triticum aestivum
  Clone ID: PAT_TA_59458.pep
PLLLPSAMAAHQITEFEVKRQTQELQAKDAEHRAKDVELRELKEERSPMLLHYVQEFMDLQKRQASTTKMLEASATLL

SEQ ID NO: 165041 - protein, 53 aa, Triticum aestivum
  Clone ID: PAT_TA_59459.pep
KDQRNVREEHERHENTWECETSGVVVERVVILALDGTKLLDIERARILWLHLF

SEQ ID NO: 165042 - protein, 70 aa, Triticum aestivum
  Clone ID: PAT_TA_59460.pep
LMDLSRFDEAAGRPLRPREQAARPRRRDSRVRFPLPAHGFQVIHFMLALLSRFDRVISCLHFFLCRTGTE

SEQ ID NO: 165043 - protein, 66 aa, Triticum aestivum
  Clone ID: PAT_TA_59461.pep
SFAHPYESSPRERLRPLRRRSFLDSRPPSWEDLSRIPSRPPLGDELYLVSFSLLFMYLVDLVCLIV

SEQ ID NO: 165044 - protein, 31 aa, Triticum aestivum
  Clone ID: PAT_TA_59462.pep
MPFPYTLVGVVNWLVVNFCVDRIALPSHDPS

SEQ ID NO: 165045 - protein, 40 aa, Triticum aestivum
  Clone ID: PAT_TA_59463.pep
VLQSFLRTICCQCPHTLKAYYEDVYMSGRNRTWAVRDTAD

SEQ ID NO: 165046 - protein, 100 aa, Triticum aestivum
  Clone ID: PAT_TA_59464.pep
LNQPKRALQQVFCARRLARLLEMLSISVLKGRCQLLGMEEHRQRTASAWTNAHPPLLLAIQLTTSWFIGPLSILCQTLTIGLAKKIIIHVTKNNITRNYV

SEQ ID NO: 165047 - protein, 137 aa, Triticum aestivum
  Clone ID: PAT_TA_59465.pep
ENCLMNSPNCNFSDRLGAISSRNINRRKVSFQEMGTVAPNSTWKTLRYQDQFVHSPARKRYYPYPPEHYYSPHTPAMRSPLAPSKTPFTSTTARRKMIFWTEAEEVALREAVAKFAPNGEAAKEKRSISWVRIHEYC

SEQ ID NO: 165048 - protein, 71 aa, Triticum aestivum
  Clone ID: PAT_TA_59466.pep
AFAIFFSLFALLNYRLHRRVELLVLVSSSFRVSSSVHISHIAAASLSFPLSTTPSINFHHVLPIVHCHNHS

SEQ ID NO: 165049 - protein, 63 aa, Triticum aestivum
  Clone ID: PAT_TA_59467.pep
EVIHMHHFCPDQSEPLQVSFHCMHDRIIGCIVMSCCCSYDIARLQVPNSVQTTHMLQQHRDPL

SEQ ID NO: 165050 - protein, 114 aa, Triticum aestivum
  Clone ID: PAT_TA_59468.pep
ECRKGIPVFHYHDYTRRQESYRERHCKNEPWVHAKHVTQCFFITDPSNPSRVVVRRGKRNIIGMDGVSNEEDYDQYGNPMREDDDDDEVYVKRRISTTLPKKDHTPWKRKSHNE

SEQ ID NO: 165051 - protein, 81 aa, Triticum aestivum
  Clone ID: PAT_TA_59469.pep
KVYQYLYLKKNACEQQRGSRIHYHSSHGPGLKGNSKLTLAGEMTKPAHTQMPIVELSKDQTSKTKRHPKNIYSKGVCLALV

SEQ ID NO: 165052 - protein, 67 aa, Triticum aestivum
  Clone ID: PAT_TA_59470.pep
CFQVFGEITMDEGIRSGKSLRLGMPEAQQVNIQGLPSNQAWGCPGRHSLFLLTIIGNFTWSYILFVT

SEQ ID NO: 165053 - protein, 48 aa, Triticum aestivum
  unsure (1)..(48): unsure at all Xaa locations
  Clone ID: PAT_TA_59471.pep
FLFFFFFFXFFFFFFFFFFFFFFFFFFRSNYTFYSKRSSSIRLEHGDR

SEQ ID NO: 165054 - protein, 138 aa, Triticum aestivum
  Clone ID: PAT_TA_59472.pep
QVDGPSASRRPILVFFAGGDHGPVRPLLLQHWKGKDTDVQVSEYLPRGVSYINVMRRSKFCLCPSGYEVASPRVVVEAIYLECVPVVIGDDYVLPFSDVLNWPAFSVRVAMADIPNLKTILAAMSPRQYIRMQRRVRT

SEQ ID NO: 165055 - protein, 56 aa, Triticum aestivum
  Clone ID: PAT_TA_59473.pep
QKSSTELRPIHPLTGSNKHGKNAFGKQISDLVKLTLVWNFRSGSPLRSMKTICYRT

SEQ ID NO: 165056 - protein, 109 aa, Triticum aestivum
  Clone ID: PAT_TA_59474.pep
FSFNLVISKARGLTTLLPCWVQVCILFVCRCVYIVSMEAFYRIDNLCSLTEGNTLLLFYIILPLWGKPNNSFGRQHTTVEKLKIARKLKVDKQSPLLMVVYSTPPDYVK

SEQ ID NO: 165057 - protein, 107 aa, Triticum aestivum
  Clone ID: PAT_TA_59475.pep
SGGEMEEEEGGTGVHSADASAPSPYKGLLLSDWRMGPENPLKSRNSRAQCTWQKRQHRNRGIVVYPLRPLRRSPSRALPRNFLSREIRDTQQSIAPKTLRSNTTLGA

SEQ ID NO: 165058 - protein, 73 aa, Triticum aestivum
  Clone ID: PAT_TA_59476.pep
VHEFFRFLRCFGYLGTSLHHLGFYIKNTAIHHRRTVTSISSWYRGNPPLYIPLAIALLTPSPFCVTCLSRLAI

SEQ ID NO: 165059 - protein, 68 aa, Triticum aestivum
  unsure (1)..(68): unsure at all Xaa locations
  Clone ID: PAT_TA_59477.pep
VSNEVKMARNLTGGLPVVNQGRMASLGQIRKCLTPAHEKXGRKGHRVTXERRIAKRTTGKMLGCMKRT

SEQ ID NO: 165060 - protein, 74 aa, Triticum aestivum
  Clone ID: PAT_TA_59478.pep
QIQAIWIRHGTKLKLCTSLLYLFINVSSCLAVIWVSMYLIDAFLIFMCSIYVDMFLPINVFMSLLRFYCFPTSI

SEQ ID NO: 165061 - protein, 46 aa, Triticum aestivum
  Clone ID: PAT_TA_59479.pep
LAPAAQGSAGRVACSCFPCPVLFRRRLHGFLLFPPLARTSLYSPTP

SEQ ID NO: 165062 - protein, 104 aa, Triticum aestivum
  Clone ID: PAT_TA_59480.pep
SPNYTITEKFALIMDYIDGLPFTVAHDDFDEYNMHVLAAPTCNYYERGTTSPPLYVSNTIKLQETAYAMYCPLLDVHELFFYDMLMHRQRVRLRHCMIYFALCS

SEQ ID NO: 165063 - protein, 133 aa, Triticum aestivum
  unsure (1)..(133): unsure at all Xaa locations
  Clone ID: PAT_TA_59481.pep
YCLWAKNSDDGVKSNSLAAWEIVCRPKCCGGLGVIDIKTQNAALLLKHLFKFYNHEDVPWVELVWDAYYRDKIPHASEAVGSFWWKDVMQLSGIFRGITKVTPGDGSSALXWKDVWFDNTQDSXIMDIYPRAF

SEQ ID NO: 165064 - protein, 78 aa, Triticum aestivum
  unsure (1)..(78): unsure at all Xaa locations
  Clone ID: PAT_TA_59482.pep
CWSFVLFRALGMFFLHENCTYVKHSTMFTVKKNQKILYFNLIFIFXLFMTSAFELGRRMVLSDTDYFLMFTSIRNTII

SEQ ID NO: 165065 - protein, 92 aa, Triticum aestivum
  Clone ID: PAT_TA_59483.pep
HGPQAGKSGNPRSQNADKHVRPFIDLFFIEITSKNVELIKNTNNFVWCLALFIQGHELLRGGGDFKRCQETKCSQTESSGLPGHPPLNISYF

SEQ ID NO: 165066 - protein, 53 aa, Triticum aestivum
  Clone ID: PAT_TA_59484.pep
RLTYRCSHFSDIKITVKKTKLTYVSGCVYLIRRNRQVYNVLCCTLLLWYLDAK

SEQ ID NO: 165067 - protein, 117 aa, Triticum aestivum
  Clone ID: PAT_TA_59485.pep
VRRADCLRHCKAGSSSEYFIEDFEHEDRVWLCKTSSTYNRRENNIFTNLICRRILQCDITPQPGYHSNRFSQPTSACFARRFPWHVLSKQRSCPLITGFLSIRTWVTQPRHQLLSHP

SEQ ID NO: 165068 - protein, 134 aa, Triticum aestivum
  Clone ID: PAT_TA_59486.pep
YVPTPPGHYSNPLENMIAAAARLAALPVEGDSPTAVETRRVTELLQTALAQQEAYSYSRDRIHSTPRPSRSPSYSRHMDSAAVSSNARRRDQPCGHDPTRDGAPNLVDQDRTRPEAERAVQQAAERAAYQSFLV

SEQ ID NO: 165069 - protein, 54 aa, Triticum aestivum
  Clone ID: PAT_TA_59487.pep
ACFILKYRWGLGFQRQRPNKAHYWKGIFLLKCFDVDDNATYRLNACLSYACILY

SEQ ID NO: 165070 - protein, 83 aa, Triticum aestivum
  Clone ID: PAT_TA_59488.pep
IIPPMWTWKTHGINSILYPPTRCTGAPRRFTWTYALSSALRKHVVRVWALMARVFAAFDSVSLSLNLSRFRRSPSFELLLSVS

SEQ ID NO: 165071 - protein, 132 aa, Triticum aestivum
  unsure (1)..(132): unsure at all Xaa locations
  Clone ID: PAT_TA_59489.pep
HEAHHTVLQNSSSVAPYFEQYKNILRSDNPGKPESWIRKAHMETFGSWLRKHLMNDNDVGDQLYMLAKKPSSTITTFQGYEINGNTFYTIAQDKKSTNQNSGVRFDAATENGQKVTYYGYIXEIWELDYGPS

SEQ ID NO: 165072 - protein, 132 aa, Triticum aestivum
  unsure (1)..(132): unsure at all Xaa locations
  Clone ID: PAT_TA_59490.pep
PTIKIRTKDHEYYALCDLGASVSTIPKXLCDLLGFREFDDCSLNLHLADSTIKKPMERNNDVLIFAYRNYVPVDSIVPDIDCNPSCPIILGRPFLRTIAAIIDMKEGNIRFQIPLRKGMEHFPRKKIKLPYE

SEQ ID NO: 165073 - protein, 85 aa, Triticum aestivum
  Clone ID: PAT_TA_59491.pep
RSCGAISRPGRSRLHSRQQSSVCNVPVQCQRQLRGLGPVERSRHQEGYHGGHSASNPPAMVSSPSDVINLSYSVQPVVFHLGVRE

SEQ ID NO: 165074 - protein, 47 aa, Triticum aestivum
  Clone ID: PAT_TA_59492.pep
LCSVKAFETPLTISKPSKSRGVSPNPSSQRQPSDHTLVPSDNPQYWS

SEQ ID NO: 165075 - protein, 70 aa, Triticum aestivum
  Clone ID: PAT_TA_59493.pep
SITGYFCYLFLLNYSDFSMQHIVHSIFLLTYAALYQGDELVVQHKGEQRGGFPANCHAWHSSTGQSGLHA

SEQ ID NO: 165076 - protein, 85 aa, Triticum aestivum
  Clone ID: PAT_TA_59494.pep
DKEKEIKEQALKIRELSKDFADYLYQVKSTSSEIHRPAKGSVCSANSISGCELHKAAIDIHNAIAHLGQLSENPMQGNQNTSVYP

SEQ ID NO: 165077 - protein, 81 aa, Triticum aestivum
  Clone ID: PAT_TA_59495.pep
TTPISILWENFKLDSCYMQILSSRLWISHCMYSPLWCHLMILSNYIYIIDSSYLQLCNILHTTCPSIAGNTNISWQSWTEN

SEQ ID NO: 165078 - protein, 60 aa, Triticum aestivum
  Clone ID: PAT_TA_59496.pep
ERCSVLVMLLGSKACATSGHRHYRKNARHTCRTRTSFTDALTFSVVIGKSKLLHLLNRPP

SEQ ID NO: 165079 - protein, 77 aa, Triticum aestivum
  Clone ID: PAT_TA_59497.pep
KDKFGWIFRISWVRDNLFQFILGASKRTDSYSCVTAITLKNLLLLFCEKTSYLFICNHGSTTNTRNNENMHPVSLTT

SEQ ID NO: 165080 - protein, 38 aa, Triticum aestivum
  unsure (1)..(38): unsure at all Xaa locations
  Clone ID: PAT_TA_59498.pep
VYGSPRPGDYFTDSRRGIPSIRHRFDSXEQLYQLSRSF

SEQ ID NO: 165081 - protein, 73 aa, Triticum aestivum
  Clone ID: PAT_TA_59499.pep
SQVCLAQTQASPLLLSPSMPHSHHSFHHSRTRTLLHPRYSMPLVPPPTCIPLSLSILLLVPHLLLTHTCMYTD

SEQ ID NO: 165082 - protein, 58 aa, Triticum aestivum
  Clone ID: PAT_TA_59500.pep
TCNMYTLYIFTKMQHYVLGCGRKSLVSRHSAQQLTNSQVLISNHDLQYPGLSQTEIEA

SEQ ID NO: 165083 - protein, 51 aa, Triticum aestivum
  Clone ID: PAT_TA_59501.pep
GMSCDFEGVRNVHMSGRRHRTVIMGITLKSAGVVAVQQRLRELAGAIMRRR

SEQ ID NO: 165084 - protein, 89 aa, Triticum aestivum
  Clone ID: PAT_TA_59502.pep
IGVGLHMPISSMMLNHSGFGWGIPYLDFQARQSMGCSPLILVNLSLGAANQQMVRGAMYSQGRPDVLIRHKCRFGHDSCQDKNPLDSWR

SEQ ID NO: 165085 - protein, 76 aa, Triticum aestivum
  Clone ID: PAT_TA_59503.pep
VCVIGQNHRVYVPVCYVMFEYPMHNFNVAHASQTGNALHHDAYLPHFKPVGEPHVYARARTLIWNLTMIHTTRMPR

SEQ ID NO: 165086 - protein, 70 aa, Triticum aestivum
  Clone ID: PAT_TA_59504.pep
LSVRVCQPARTISESNASFGEGFMAIRFSSCSTPVSSRDYSTDHTVIMPCRIVFSSLHGARDDCAMIKIR

SEQ ID NO: 165087 - protein, 85 aa, Triticum aestivum
  Clone ID: PAT_TA_59505.pep
TATPSAHKYNIFYNIDYIYIELNEQSRQNSSTYISIRKEKEHLTIVNGDAYFGDTLQMLALEIIVAAALRSSPKIEKKISSKRKI

SEQ ID NO: 165088 - protein, 52 aa, Triticum aestivum
  Clone ID: PAT_TA_59506.pep
TADEKTTEVNGNAAKTPQKTGPFQLRMLEKNKKLATRKEGKIPTKTPPPLRF

SEQ ID NO: 165089 - protein, 39 aa, Triticum aestivum
  Clone ID: PAT_TA_59507.pep
DLRHKSDDDQPIRKNNQVESRKEANFYISRENQQVGRVM

SEQ ID NO: 165090 - protein, 78 aa, Triticum aestivum
  Clone ID: PAT_TA_59508.pep
GAVFAHAIVIERPRAWRGVRWVLGYFGRGVGLQQKRPFTVTRLTVGVSNDLQMARNLTSGLPVLYQGRLANLGSFRES

SEQ ID NO: 165091 - protein, 134 aa, Triticum aestivum
  Clone ID: PAT_TA_59509.pep
SIIYLCYPEQKYFTHFCVLSNCRCMGHLYNPHMKIGEKEKFRFCSKSPLTSLLGQEKIESMSLTFWIQIRTAQTYLTQNANNFFIRTPNWVILSLLESRFHTLSNPIGFTFKFVRSVEIWTKQSDAAAESESNN

SEQ ID NO: 165092 - protein, 40 aa, Triticum aestivum
  unsure (1)..(40): unsure at all Xaa locations
  Clone ID: PAT_TA_59510.pep
KYSYFKKNLISFKKHVLKNVSLKKPFYKKENINIFSRSXK

SEQ ID NO: 165093 - protein, 76 aa, Triticum aestivum
  Clone ID: PAT_TA_59511.pep
HVSGVVTVLLEPSPPLEASSLALVTVRPRTRCSRPSFPSCIFFVPVSPWLSLVRACYIELSSHSSPLPFSLSVFRG

SEQ ID NO: 165094 - protein, 61 aa, Triticum aestivum
  Clone ID: PAT_TA_59512.pep
KIMYLFNNLFNNSPCIFCYFYLLNIFKYYFGRYLNKTNAFLNYLYLLNCNSNFNMLYMKFD

SEQ ID NO: 165095 - protein, 121 aa, Triticum aestivum
  Clone ID: PAT_TA_59513.pep
AQQDGADVSGLISMIIQAVLTARHNRFECEQLAHRVLMIAQLLPNVKEPEAAQPLAGLDSTLRRAHELVVSCQERSAAYQFFMASRTAERFREVESKIDSYLILFPVISYIGITRRLERIY

SEQ ID NO: 165096 - protein, 63 aa, Triticum aestivum
  Clone ID: PAT_TA_59514.pep
YTNIHFTTYLLLKSSWKYIDAWSKLCIISPSLIVEKQLENCNLRNLRALIQISPIIAHTITNI

SEQ ID NO: 165097 - protein, 55 aa, Triticum aestivum
  Clone ID: PAT_TA_59515.pep
CYVCQSLIKFSTYTFPYVVPSPTIRLVYDLLDLFLFFCLFLFFLFLSFLLIATRK

SEQ ID NO: 165098 - protein, 100 aa, Triticum aestivum
  Clone ID: PAT_TA_59516.pep
FFGDTPLTREVMRKENGLVILCAHFMTRLKLLNICCVVANRHNCVKTCWCCLWNFVLSLGARWCSGLFLLEIVTVTICLFAGKKMQFFYITLYPQQQTNR

SEQ ID NO: 165099 - protein, 107 aa, Triticum aestivum
  Clone ID: PAT_TA_59517.pep
PTIRRSGSTTSWPSRTTGKPWRSSFKSTLTSPKPLPLHVPLPDKQSKSSIAIINLASCKDEGGLLMYPIWLPYVVCCIIVVEPRTTTYVCISVLRYLSAIESVLTLE

SEQ ID NO: 165100 - protein, 71 aa, Triticum aestivum
  Clone ID: PAT_TA_59518.pep
QLGCIPIVLCLRQSLESHICFNPHMVTTIIECTLSNMFHHIALINQAINYLQHFMFQSLVNHHIAHYNTLL

SEQ ID NO: 165101 - protein, 92 aa, Triticum aestivum
  Clone ID: PAT_TA_59519.pep
AMSRFSGEFWIYGDLKTEILLIKCFQIAHGSLTKAVCLQNRGRCPPPAARVIWVVRSDWREPKPHGSYVYTVGCSQIERQSSSLSIAHAVYG

SEQ ID NO: 165102 - protein, 45 aa, Triticum aestivum
  Clone ID: PAT_TA_59520.pep
GPLFFSFVGFFFGFFFCFFFFFFCFFFFFFFFFFFFFFFFLAKDH

SEQ ID NO: 165103 - protein, 141 aa, Triticum aestivum
  Clone ID: PAT_TA_59521.pep
DAGRPPIEAIMFNQEDIMRLQSLDHVAYNENLRKRVPTDILVDRISELNDNFDIQNSGLGFPLEQRLMTFCQMNAYNDELVVQYEGPKEETIHPELDHGGLLSIKFCPFDYFFLSQKKLAAERREYEMSFQDFPYHYYGNT

SEQ ID NO: 165104 - protein, 49 aa, Triticum aestivum
  Clone ID: PAT_TA_59522.pep
QMSHIKIQGNLVQGLGTLGDTPDVLKLCVQKYDHKSPPAIVRYDPHQFL

SEQ ID NO: 165105 - protein, 144 aa, Triticum aestivum
  unsure (1)..(144): unsure at all Xaa locations
  Clone ID: PAT_TA_59523.pep
RSEKLLACAGRETLLKSVIQSIPTYPMSTFLLTKKVCKSLTSXMAKYFXSSSLDKKALHWVSGKELAIPKCKGMMGFRDPHLFNLAMLGKHGWRIITNPNSLCARVLKGRYFPDTDFMRATIPKSASATWRAIVAGRSALQMGL

SEQ ID NO: 165106 - protein, 62 aa, Triticum aestivum
  Clone ID: PAT_TA_59524.pep
LRNWDYVVVALLVLKNPTKPTFPAYRAGKDPGHDVLFGITRLLVLVSMNRIKQQVSFRGRRT

SEQ ID NO: 165107 - protein, 105 aa, Triticum aestivum
  Clone ID: PAT_TA_59525.pep
NQKEMNRCTLTHNPLPAKVKIINLRTGLASATYRYFVHQNTYPFGPSGAMSHASFRTLICQSIVHVDLHNTVKPLDLTFEYLALILYHIIRLRRPYFSYFLHILI

SEQ ID NO: 165108 - protein, 109 aa, Triticum aestivum
  Clone ID: PAT_TA_59526.pep
DEQAMDGYLEDDNYMPPSEDEVSLNGDKFGIPEDPIEQERFKRRLTATARSLKKKQQQLQADQDLLTDRQTKARAAEEYELERRTKYYPKRRLLPQFEEAALKIKRSPI

SEQ ID NO: 165109 - protein, 50 aa, Triticum aestivum
  Clone ID: PAT_TA_59527.pep
SPIMCYDPLTPKVTIIGILTGDDHSLRSSCIHYVLMLCSGTLLKGGLNIP

SEQ ID NO: 165110 - protein, 138 aa, Triticum aestivum
  Clone ID: PAT_TA_59528.pep
YGINTYVFFGSKLPWCLCISYHTRGVYFTLPFRQKLIAVYFQQLFPKSKVSTVFVCELSTLWCVKYHGIYIEVTRDMFSTTNNPGSKVFTVFVSVLSALWCITMIFTHKLPKVCFQRFFSVCSSLLYLGTGGVQNRSN

SEQ ID NO: 165111 - protein, 53 aa, Triticum aestivum
  Clone ID: PAT_TA_59529.pep
TKLGANLVPYAPYSTPREQNKLFFTQLFSTLLHPEFMLGQIVTFMLTHNAIKP

SEQ ID NO: 165112 - protein, 107 aa, Triticum aestivum
  Clone ID: PAT_TA_59530.pep
MINGGIADVNNADGAGAVNGAVPILVDHADVESENPENTVVPEQVDEYVDIDDEMPTATYRSVEIEKGAEATSVSGGSGSGSSSSSGSGSGSSGDSASEAGDARSLV

SEQ ID NO: 165113 - protein, 46 aa, Triticum aestivum
  Clone ID: PAT_TA_59531.pep
VAVLLAVTVAVAADVVHDLIHDALSVHSRRSCAPRPSSCAPPPFCG

SEQ ID NO: 165114 - protein, 65 aa, Triticum aestivum
  Clone ID: PAT_TA_59532.pep
NRVTGPPVIISPIISYQLHRQGSQTLRLTQLTIAVGSNLYSECDACCEIYLYVLALLSKLFGLSQ

SEQ ID NO: 165115 - protein, 81 aa, Triticum aestivum
  Clone ID: PAT_TA_59533.pep
KGGNGGLSKILSQWVVNSEVAVARSRKHATAKLAIAHSGIHATATPFSFFPFSFIFLHILFFPFTLFDFFHSQLPFYLLSI

SEQ ID NO: 165116 - protein, 64 aa, Triticum aestivum
  Clone ID: PAT_TA_59534.pep
NILIRIFGFCRSKCPTSHDKSYLVTHDLTRFAPHCTWVPHVARMRRVRGTFVHFPWASGFSPRL

SEQ ID NO: 165117 - protein, 56 aa, Triticum aestivum
  Clone ID: PAT_TA_59535.pep
FLEAMFSNNFNSSVLSSLVINFYFCSIILGGCWTRKHNLIGNFLRKILGVLCCEFF

SEQ ID NO: 165118 - protein, 92 aa, Triticum aestivum
  unsure (1)..(92): unsure at all Xaa locations
  Clone ID: PAT_TA_59536.pep
SAVSLEPPVFSTGTSXASRPANTSIKDTHQMSGNTMASRTVPSASPAIGSSHRAYQNQSTNKPSDLPGANVARHDKPSTSHLTVLVDTDKVL

SEQ ID NO: 165119 - protein, 44 aa, Triticum aestivum
  Clone ID: PAT_TA_59537.pep
PSSYSPCLHRMDQWTGTQVTAIAFWLTSTTSWDSPLAGLLTQTI

SEQ ID NO: 165120 - protein, 80 aa, Triticum aestivum
  Clone ID: PAT_TA_59538.pep
IKIWGPFKKVLNSHNPEIKLEPLETPPFFYFYFFNFPLFFFIFFFFLFFFFFFFFWFFFFFFFFFFFFFFFFFFFFFFFF

SEQ ID NO: 165121 - protein, 95 aa, Triticum aestivum
  Clone ID: PAT_TA_59539.pep
DTEWFLEGNFESYVRKMRKPHAWGGEPELLMCSHVLGMPITVHMYTKGTDNPRIIAEYGQEYGKDNPVRVLYDGYGHYDALQPSLVRTQPRLRGA

SEQ ID NO: 165122 - protein, 101 aa, Triticum aestivum
  Clone ID: PAT_TA_59540.pep
KLDLQDQTVTASYGRILPGRLGVLASAVSLVDCSSTWWSPAYHQGAWSSLGWSFQCPAIFMVCALSVVVECVCIFLLECCGDGCFIYKAGNPFFAKKKKKS

SEQ ID NO: 165123 - protein, 59 aa, Triticum aestivum
  Clone ID: PAT_TA_59541.pep
QDSGEPGCSGLTGLRYSSRDISPKGQTQERRRTHAGQPKCSGAVASYHGSVETLGDISR

SEQ ID NO: 165124 - protein, 54 aa, Triticum aestivum
  Clone ID: PAT_TA_59542.pep
LSAFSHAPVWDIFFHEPRGSRHCCEPTVEHKAAVYTITISRNTIHPVPLAAVAP

SEQ ID NO: 165125 - protein, 92 aa, Triticum aestivum
  Clone ID: PAT_TA_59543.pep
GLAGVDDSGEAGPFQQLQQHHRGQWSTTNTQERSKEDEGRRRKQNAEARSAASSRARRRPEARLSWTRLSRGSVGAIGGGWCGRTGSEGSYL

SEQ ID NO: 165126 - protein, 59 aa, Triticum aestivum
  Clone ID: PAT_TA_59544.pep
MFTLSVRFLEEGENLFQDFWSPFSISFLCFSKWNYFLFLKKSTDLTGPCPPGTLARPTL

SEQ ID NO: 165127 - protein, 70 aa, Triticum aestivum
  Clone ID: PAT_TA_59545.pep
PGNNQIPPWRHQFVTSWLLSRKKTNSKGECFSGFRIRYVCYKLRCYGNELTPLIMHNSSCGTWCCLILIV

SEQ ID NO: 165128 - protein, 74 aa, Triticum aestivum
  Clone ID: PAT_TA_59546.pep
LAGTPVPAELLSKAHHTTIHFLHLQGCFMGDGLTCCWWAFLYFFFGPDSLMYFFKKKKKTKKKKKNNKRKKNTK

SEQ ID NO: 165129 - protein, 123 aa, Triticum aestivum
  Clone ID: PAT_TA_59547.pep
QEEQRSTGLAGRDVAHIVVVAIIVGSALLGCECSHVVSKSKLLNQVVKMIVHPSRQVALYDPGQGGYRGVEVKIRIQAEKVAEDARECTPREIPTLLLNELTSPSGPAFMAGHDLGKEVQVAG

SEQ ID NO: 165130 - protein, 38 aa, Triticum aestivum
  Clone ID: PAT_TA_59548.pep
LLFLLFCSFFFFFFFFFFFFFFFFFFFFFFFFFGEKGY

SEQ ID NO: 165131 - protein, 39 aa, Triticum aestivum
  Clone ID: PAT_TA_59549.pep
FLVSLVFLALTDVWSENVCNFKLFCVTFSCCVYIFFLSM

SEQ ID NO: 165132 - protein, 48 aa, Triticum aestivum
  Clone ID: PAT_TA_59550.pep
NIGVNNMVKLNLPGKLMKMLTLLETLINYSLLQENLYSQTLHSHKQQS

SEQ ID NO: 165133 - protein, 58 aa, Triticum aestivum
  Clone ID: PAT_TA_59551.pep
VYPAKLARIPQLIHSIVKFSHTILEVYFKKNRLVALVILLPNECTSSFSSSKSNKTFP

SEQ ID NO: 165134 - protein, 34 aa, Triticum aestivum
  Clone ID: PAT_TA_59552.pep
DSLILSLAFNLEMTKNMSTMGHLLALSSIITSYF

SEQ ID NO: 165135 - protein, 102 aa, Triticum aestivum
  Clone ID: PAT_TA_59553.pep
VNKKKKKKKKKKKKKKKKKKKKKKKKKKKKKKKKKKKKKKKKKKKKKKKKKKKGGPPKGSNFFFPSFALQTPPNGPPNFISRALFLKPFSGKTPGFPQFNPF

SEQ ID NO: 165136 - protein, 78 aa, Triticum aestivum
  Clone ID: PAT_TA_59554.pep
KLTRAGKGQRNNGLLMGIKPYTIHYGSVSPWAFSGPIVTKDLAWAERRYGPYMGRKLQLIVIILDGPDDVAGPNSDRP

SEQ ID NO: 165137 - protein, 71 aa, Triticum aestivum
  unsure (1)..(71): unsure at all Xaa locations
  Clone ID: PAT_TA_59555.pep
LENSRSHGGCLVPEGAFRFNDLALAIETNGVVLQYILVRTHEKVGDLHGGQTCVVTPYPTSADLXXKKKTD

SEQ ID NO: 165138 - protein, 42 aa, Triticum aestivum
  Clone ID: PAT_TA_59556.pep
GVLYMHLEVYSLHDTCSRLQHHSRYESPRLDSTQSFCALATF

SEQ ID NO: 165139 - protein, 63 aa, Triticum aestivum
  unsure (1)..(63): unsure at all Xaa locations
  Clone ID: PAT_TA_59557.pep
VLEXQISQIDATILDLRHFREWKIFRPKLQYVSSSCVQIGFLTQGRCSNNKNDYHVYRRVGGY

SEQ ID NO: 165140 - protein, 97 aa, Triticum aestivum
  Clone ID: PAT_TA_59558.pep
QCIKIIVRDHKFFHTILKIKGHLFKFLTNNILELHLYLEELLSYILRLTSHRLSLLPNIIHTNKPDFHSLSRPVSEPRSISCHWERLDHSSLPTKSQ

SEQ ID NO: 165141 - protein, 88 aa, Triticum aestivum
  Clone ID: PAT_TA_59559.pep
SFISRYSIVPECSRYLKRLVSSFKISSKYFEVVISFKPFNSTGALSLFKQSFYGVSFEWALTHMSFPGSYLTLLIFPEVFANSFQSLT

SEQ ID NO: 165142 - protein, 39 aa, Triticum aestivum
  Clone ID: PAT_TA_59560.pep
PSSSPYPWPPTTPRPSDELRSSVPTPWSCTPTHATRGGL

SEQ ID NO: 165143 - protein, 79 aa, Triticum aestivum
  Clone ID: PAT_TA_59561.pep
FNKGSVAEAFATELVLRKHLQQRLCCGSLQQSSCNGNICNKDCVAEFISHGLVDFCNIGHVSETSRHSGYLVLQLCRSC

SEQ ID NO: 165144 - protein, 59 aa, Triticum aestivum
  Clone ID: PAT_TA_59562.pep
YILDKSNNGVAWTKGCGNSFKMLRTRDWLKLQAQDSSFYILVIQDHIESIGKASTIKEG

SEQ ID NO: 165145 - protein, 61 aa, Triticum aestivum
  Clone ID: PAT_TA_59563.pep
PPCADPLISWPDPAVIPPSHFFLTASGSSRRRRPHPHSLPLDQAGAAWGGRRSPSRSVSRV

SEQ ID NO: 165146 - protein, 79 aa, Triticum aestivum
  Clone ID: PAT_TA_59564.pep
QSDAHFFLLLFFQPTLGQPAISPGHFFFKASQPLTFFSSTRLWALGHFFSSRLDGSSRELFLSRPAPDFSLPVTSVVFS

SEQ ID NO: 165147 - protein, 130 aa, Triticum aestivum
  unsure (1)..(130): unsure at all Xaa locations
  Clone ID: PAT_TA_59565.pep
LLSARRRDDGFGDVNAIAKNEPWVHAKHVTXCVFITDPINHSRVVVRRSKRSIAEMDGVANEEDHDQYGDPMREDDADDDETYVKRRTKITLPTKDRNPWRRKTHDHGLNYSTMNKRGKNISLKRHRRPS

SEQ ID NO: 165148 - protein, 129 aa, Triticum aestivum
  Clone ID: PAT_TA_59566.pep
IYNGACLPGLSLFRVSHTRLRWPLSLSPLITDPAASRPPRERECGGLSLSHRWSLIRPHPVRQGKGRKCIVSPFDGAEAACPDLRYTPFSLTKLWRGRAYATCSQILPAAAHLVTSRRPPGIPSGLVPL

SEQ ID NO: 165149 - protein, 57 aa, Triticum aestivum
  Clone ID: PAT_TA_59567.pep
NWKISKSCLYTQSIGPGSWHQPGPMPPFSPGVCHEPGPILCVHKQDLENFQFHRPFS

SEQ ID NO: 165150 - protein, 76 aa, Triticum aestivum
  unsure (1)..(76): unsure at all Xaa locations
  Clone ID: PAT_TA_59568.pep
LFPGGQISSRETCVQQSGNSNQGINLMYXRQPWFYTMVVMEXQSYEQHSNSFELSRIASKWIESYMKCRTIQPQIC

SEQ ID NO: 165151 - protein, 80 aa, Triticum aestivum
  Clone ID: PAT_TA_59569.pep
ASRPCSSPWARASFSRSSLSAASSSPPTFRLASRCATFASNSFLAASAAAAASFASWSVPPSARSRAASSSSWLSRFTFR

SEQ ID NO: 165152 - protein, 68 aa, Triticum aestivum
  Clone ID: PAT_TA_59570.pep
KSMSRSSVSQTSCSAKIPTEEIKSCGEKCANLYKVYKLIMVSRVPGYGRLEYLVLGLSCESHHVTLFN

SEQ ID NO: 165153 - protein, 77 aa, Triticum aestivum
  Clone ID: PAT_TA_59571.pep
MFNIGATEVNYSVTQMCCKCLLLCILVPLSCAIPAHRQDRAIDSHGQKFGNLAKPCWQRISGSACRVAGSYRCLCHL

SEQ ID NO: 165154 - protein, 130 aa, Triticum aestivum
  Clone ID: PAT_TA_59572.pep
FPLFSFTLAFLPSPTHGTVGERVGDGADGGAGGSEHHACPGRSARRREKFARQSEAAKGGEVQEGVVLRWLGCWRWAWRSWRLRRSARPSRTPPDGRAHSTDGVVAGALQTTVLLRRQAARNPRRYVCLT

SEQ ID NO: 165155 - protein, 119 aa, Triticum aestivum
  Clone ID: PAT_TA_59573.pep
NKYRCINLHPFQAGSKMCLNKSESKKSKIIEHLISVNGESNKHRTTRFSKSAPSPLLQTLTVDSPYTVTCVATARLFALRCVVRARSMSRPRLSRLQRTTPTTAGHVDASPRGAFPLDR

SEQ ID NO: 165156 - protein, 102 aa, Triticum aestivum
  Clone ID: PAT_TA_59574.pep
DICMFPFEGAELFFSFSFEKTELFLCRPKRRTRERKKENGRNHSGLLTQRGPAQLPLSFVPLYSPPLQTLNPQPSFVSSRNPPSSRVLHAKSHQPLAVSPRI

SEQ ID NO: 165157 - protein, 82 aa, Triticum aestivum
  Clone ID: PAT_TA_59575.pep
VTCALSPTGLIPWFSKLREILMLLCCINLSSSRENQRMLKRQQEGFLAPLPGRSTPSQDIPRTHHKLFSIALHYLPFASHFP

SEQ ID NO: 165158 - protein, 101 aa, Triticum aestivum
  Clone ID: PAT_TA_59576.pep
DANRYVSVGYKEISVGQEYNNSKDNFAKKCTLAKVRRMARFIIDNKTTIRIVDVTTMIMTTIAKITMQPTTMIMMISLPSTMEIDFTTMIMTIKNKRKITT

SEQ ID NO: 165159 - protein, 76 aa, Triticum aestivum
  Clone ID: PAT_TA_59577.pep
LLSRACVSVFFVCSLHAPGAKRPYRLGCTRLLTSRRGVGICYASYAQNALRHGGYRSKPHCSNMSRLLSNPYVGRI

SEQ ID NO: 165160 - protein, 67 aa, Triticum aestivum
  Clone ID: PAT_TA_59578.pep
MVIRREINLYMTIRQHAPISYEAARQDPSLVQRAWYVRNHPEAEGISSHSMVLLTRHYSEHQYLSVS

SEQ ID NO: 165161 - protein, 91 aa, Triticum aestivum
  Clone ID: PAT_TA_59579.pep
KFIAHLMCWLEISLWVLVGASHLASVMHSEIKQPARVMLFPLVGICYNISLKIKQMASHLPCFKENMTVTAELKRAGTSNSNLQTVQKYEG

SEQ ID NO: 165162 - protein, 116 aa, Triticum aestivum
  Clone ID: PAT_TA_59580.pep
KELDQQKQRTMCSRLRTELLRPLRVALVNRGPDAELLVANPVEVSGKGRPLVFYDITLALKNLHRRVFLAEIGRHVVDDREWEVYRVHLGEDDHELSCSVRSKIVDGVTNMLMGWD

SEQ ID NO: 165163 - protein, 104 aa, Triticum aestivum
  Clone ID: PAT_TA_59581.pep
KKVEKKTTKTKTRMGKFTSHKKNHAVHLSLVMKCGISSEAVRSSFLVRQKIRLNKKKPCSALAHLMQCGILSEAMRLSEAMRSSVRCSTYDDFGLAQNRVSAFR

SEQ ID NO: 165164 - protein, 76 aa, Triticum aestivum
  Clone ID: PAT_TA_59582.pep
KKRMLSSVQICCDFARPTGGKAQMYQGGVCKKITELIPSLACRSNTPWGLGAAYHEMDRSTRYFPLAVHQAKSTLD

SEQ ID NO: 165165 - protein, 80 aa, Triticum aestivum
  Clone ID: PAT_TA_59583.pep
HAKLHEFQTSVGFTRFYKLGISMFVAGCLTLIPISCMGPKHAPKDKRFDFSTNLYAPEHVHVVPICIMHINALKTHLMHK

SEQ ID NO: 165166 - protein, 122 aa, Triticum aestivum
  Clone ID: PAT_TA_59584.pep
IVAERAALDAQAYRIMLDQSASNEVLKRRHRSHLPPVYDARNLFNTPGAGTSNPPVVNRAEAPGAGAPVQPRLVDPPRQNNIVAPHVPTPPGHYSNPMDNIVAAASRLAAIPIEGDSPAAFE

SEQ ID NO: 165167 - protein, 76 aa, Triticum aestivum
  Clone ID: PAT_TA_59585.pep
ASRGWGAPPFPSPPLSLPSPSPTWTRKGRGVLLPVGVGVLLPVGVGLLLRASYQGRPHPPLAPLYTEAGGTPRHTS

SEQ ID NO: 165168 - protein, 55 aa, Triticum aestivum
  Clone ID: PAT_TA_59586.pep
YCLLDVWCVPLIVRHGRTRDPADTEIFRGSSFCKKQVMTNLRACTFQLKANLQNI

SEQ ID NO: 165169 - protein, 135 aa, Triticum aestivum
  Clone ID: PAT_TA_59587.pep
HVRVSTRLLLTADPERVLKGIRRPPPPPATSRSVPAASFVSATSPADALPPDDLLTAGDAKVEPGAILLMDQDNHAMNIKNDAILFDIDEPYAKNFPTWRVEIIVSCKESPNVFLPLRLKDVNHDDKADIGRDLK

SEQ ID NO: 165170 - protein, 56 aa, Triticum aestivum
  Clone ID: PAT_TA_59588.pep
GPRKYWIIKNSWGAGWGEAGYMRLQRDAGMPTGLCGVALLASYPVMWVCHSGWWCV

SEQ ID NO: 165171 - protein, 78 aa, Triticum aestivum
  Clone ID: PAT_TA_59589.pep
MYCVQQVDGNVIWYMLSVEKKKKKKKKKKKKKHKKKKKKKKKKKKKKKKKKKKKKKKKKKNKKKKKKGGPPKGLTFFF

SEQ ID NO: 165172 - protein, 119 aa, Triticum aestivum
  Clone ID: PAT_TA_59590.pep
TTSRNSASLCRPLLLCYVTTPECRALRSATSGPAWGLGPHPDVSSDCVINAKHKNQLSRSYAQSFKNLNFVRFDQALYFFGKELFVKNFLVKTLFVTHKFKYPVYLGASFMKPSILHMI

SEQ ID NO: 165173 - protein, 137 aa, Triticum aestivum
  Clone ID: PAT_TA_59591.pep
ENVFGLSNFVPILFGSKQLCFELERIQDALCGSSKYKSANGEFPGITSDPCEHWKLQQTAMSGFLIEIGWLIKKPSPDEFKNLLSKTNVKRWICVLEFLIQNNFINVLEMIVKSSDNIIGSEILSNLESGRLEHHVT

SEQ ID NO: 165174 - protein, 103 aa, Triticum aestivum
  Clone ID: PAT_TA_59592.pep
LIVSVEETDPRTPMGIGGPSPIQFRGGRRSHEERIEAMHTSSLPSFGALRRDNTPTAACLIVLSSRSGAMNATRPSVRVFLVFRMSRTPSTLRMGLLLYAQGG

SEQ ID NO: 165175 - protein, 45 aa, Triticum aestivum
  Clone ID: PAT_TA_59593.pep
GSKMLNNPQLSKDRALPDVVDGHGEAHNTRDPGDDQARVPRLRRI

SEQ ID NO: 165176 - protein, 69 aa, Triticum aestivum
  Clone ID: PAT_TA_59594.pep
YCLCRAITYCKSGGDLPASVLTLMTTVVFTVRLRGLVYINTLELHCLHELFIECKKVTPRVARFFLPTI

SEQ ID NO: 165177 - protein, 85 aa, Triticum aestivum
  Clone ID: PAT_TA_59595.pep
KEILNGLQKFRNKFSRASKIKPHKVNIYLAPKCNFEKHTFFLNSNKTPKKLRNKILFDFIIKSSIFLYFGKVILFPLSYFCNRNN

SEQ ID NO: 165178 - protein, 55 aa, Triticum aestivum
  Clone ID: PAT_TA_59596.pep
SAAKGINAKARSCDLLNFFRECKVSVFPQNQINSYHRLSYRFYLAQTLIKRRKHI

SEQ ID NO: 165179 - protein, 93 aa, Triticum aestivum
  Clone ID: PAT_TA_59597.pep
ISCMMNYLHKLKRISTSTTCHVHLHSKSKLLICTSSGGALATYEDNTLSFTISHTSFPLKTSTSLSSITKKGEIVSASSATPSWFWSIDDKVG

SEQ ID NO: 165180 - protein, 101 aa, Triticum aestivum
  unsure (1)..(101): unsure at all Xaa locations
  Clone ID: PAT_TA_59598.pep
VSRRACEADRMHAXCRACTADSSHASRRACTVDFSGSSRLIKQLHAHHQVWLNFDMVNIIQPFAILTCQIFVSKRTLLATNVCASSQTGRFFLPRHICAMS

SEQ ID NO: 165181 - protein, 108 aa, Triticum aestivum
  Clone ID: PAT_TA_59599.pep
YSWHCLVRKWRFLEFLGHIVIIYFWFVTYKSNVQQRKIDVERKIYGKYWKRDRKGGLLVETHDSTMSQWLNALDPVDPSSLFHYQPTEGSFFRREASHVQKGLISSLK

SEQ ID NO: 165182 - protein, 53 aa, Triticum aestivum
  Clone ID: PAT_TA_59600.pep
AILKDIHQGECGHHAASRSLVAEAFRHGFFWPTTLEDAKELVKCCKGCQVFSS

SEQ ID NO: 165183 - protein, 55 aa, Triticum aestivum
  Clone ID: PAT_TA_59601.pep
RQSSSGPIAAAVENRTKLFAVAHDTGASLTIMNRSNTDARLNKDETSVGLLNTGH

SEQ ID NO: 165184 - protein, 72 aa, Triticum aestivum
  Clone ID: PAT_TA_59602.pep
QWCGTVMSGNQEEAKKLLFYILIRRHLRTCGYGPGGSPLSSSPSKVISSSSCSLTMLITRDGYATTNATTPK

SEQ ID NO: 165185 - protein, 124 aa, Triticum aestivum
  Clone ID: PAT_TA_59603.pep
SPSLHPGLRATPPVFARAMPSRLGSSSVPASPPPAPGSISLIPARFVRRIRRIRFGFARPWGSWFIWFCSSSPSFVQKSRLVLSILLVLAVVRSEIASGSFDSILLVLAVVRLGMASGSFDFAL

SEQ ID NO: 165186 - protein, 74 aa, Triticum aestivum
  Clone ID: PAT_TA_59604.pep
GRGVAECGRHAKHVWIYAFFVLVSEISYVTIRNLDVLILGWIVDPTPPTFCPFSTKRPVRPTSLFPFPTKRSVH

SEQ ID NO: 165187 - protein, 89 aa, Triticum aestivum
  Clone ID: PAT_TA_59605.pep
PGSSVPFVPGSRLEPGPMCLAPGPPPLVPAGGLNRDQRVSFSPGSSHEPGPMRCLYIPARRPAEDSTLLYFFWTTRGGLCGALAHLLYT

SEQ ID NO: 165188 - protein, 130 aa, Triticum aestivum
  Clone ID: PAT_TA_59606.pep
FGNLLLELITGQTALEFGKASNQKGAMLDWVKKMHHEKKLDVLVDKGLRSSYDRIELEDMVQVALLCTQYLPGHRPRMSEVVRMLEGDGLAERWQASQRADSHKFTVPEFTFSRCYSDLTDDSSLLVHAV

SEQ ID NO: 165189 - protein, 50 aa, Triticum aestivum
  Clone ID: PAT_TA_59607.pep
MHWAKLDAEKLVKDGPPEGKVHRYPEKYYDGIMKGARLMADECTKDTIFE

SEQ ID NO: 165190 - protein, 53 aa, Triticum aestivum
  Clone ID: PAT_TA_59608.pep
GDKDHLQAQGAGGCCCGNRLLLISFTHANRGHRSMIYLYLCGGWMITVCCLTR

SEQ ID NO: 165191 - protein, 72 aa, Triticum aestivum
  Clone ID: PAT_TA_59609.pep
ALALTSVTCLWRTAFLHCHPGKGMANIVFIAVKLNMKHCYSNSKYKDYCTDDNVGQYDDVAHAPEFDIYREM

SEQ ID NO: 165192 - protein, 64 aa, Triticum aestivum
  Clone ID: PAT_TA_59610.pep
RGSQMCLTSCPVSVNFFNFSCLFRGVPNVFCSRISRMFLPQGGGFSRRGGRSCWSTIWLFHLIR

SEQ ID NO: 165193 - protein, 101 aa, Triticum aestivum
  Clone ID: PAT_TA_59611.pep
RRADDDDDRRFPSPDPQTGSTSGLPMKNRRWRWLRIVKHDQTSSLIFLSKRQVFIELELGLVKPCGTHYPPGPARGGWRALMPGGQPSGRSWFHKSSFIPT

SEQ ID NO: 165194 - protein, 62 aa, Triticum aestivum
  unsure (1)..(62): unsure at all Xaa locations
  Clone ID: PAT_TA_59612.pep
AALPTFVXASCLSRTASYFPIFVNISKRRKIALRNVFESVYLPFQVPIPFSESETFWKVSLM

SEQ ID NO: 165195 - protein, 113 aa, Triticum aestivum
  unsure (1)..(113): unsure at all Xaa locations
  Clone ID: PAT_TA_59613.pep
FILIACFFQGNLESTQEVQVNPTSLSQYRDIQRKIVEFIRKRYHILEKCLDIEYAVIKTNTPVPDDLTEQNVPMGHSPAVPDISEVLRELPPLVPISAKEVASDGSTDXAHLS

SEQ ID NO: 165196 - protein, 45 aa, Triticum aestivum
  Clone ID: PAT_TA_59614.pep
LSQHRRPNAKHCFPNSAWLYMRLTKLHEEHDFYRYVLSEVLSQME

SEQ ID NO: 165197 - protein, 116 aa, Triticum aestivum
  Clone ID: PAT_TA_59615.pep
ALMQFHQGGHIKSRGLFVLGLPIPLVPWGSVVGLDKRCRVCVCLQVPWVPTPPSFYWGEATPGAVENSRGGTYPQIKMQEFNRGVAIGQDGQPPPTVQCLSISLSFNLSCTSSTAA

SEQ ID NO: 165198 - protein, 127 aa, Triticum aestivum
  Clone ID: PAT_TA_59616.pep
VRLRKDDRSDGEAGWPTQAEPGQIGVGVQEARDFNEGMIRVCSSGKGTPLMPNRTFETYLFSLFDENQKPGPIAERHFGLFNPDFTPVYDLGLLRDGASVAPTPSPNPSPNPSPKPAPSGGRKWCVA

SEQ ID NO: 165199 - protein, 132 aa, Triticum aestivum
  Clone ID: PAT_TA_59617.pep
RVAALSRFISRLGEKAMPLYQMMKKTDDFVWSDAANSSFEDLKRQLAEPQFLAAPVEKEPLLLYVAANSRAISVAIVVECKEAGKEHPVQRPVYYVNEVLIESKQRYPHWQKLVYGVFMASRKLKHYFQGHP

SEQ ID NO: 165200 - protein, 65 aa, Triticum aestivum
  Clone ID: PAT_TA_59618.pep
FNLVANKSYSFVVGKIGFMQTLNLEPPPAKYACSDSYYSSLLYSVILPAYSMYCNIPNFQFGMLY

SEQ ID NO: 165201 - protein, 129 aa, Triticum aestivum
  Clone ID: PAT_TA_59619.pep
KQQPTYQKLIIKHANLKKLSLWGCSAIDALYVNCPELSDLNLNSCINLNPERLLLQCPSLKDVHVTGCRDMLIGAIRNQVLNEFAAGEPRMPCKRLADGSKRVQVPQFMPEQQFEDEKWCGESRRSQCA

SEQ ID NO: 165202 - protein, 136 aa, Triticum aestivum
  unsure (1)..(136): unsure at all Xaa locations
  Clone ID: PAT_TA_59620.pep
SCCDYSEKFMSYAAKEVHVKSVVQALPCFTMGVFLLSKGFCDKYEKMVRDFWWGDEEGHRKVHXMSWEHMTRPKRADGIGFRDMHLFNLALLAKQGWRLLQHPDSLFARVXESKYYPHGNLLDTVFASDASPVCRG

SEQ ID NO: 165203 - protein, 70 aa, Triticum aestivum
  Clone ID: PAT_TA_59621.pep
RITPHGISIAAQKGAPEISPWPNHEYSKTRRIHISASLLHNFNMLNHVLALRLVPPSSDPHLRGTRWTQR

SEQ ID NO: 165204 - protein, 90 aa, Triticum aestivum
  Clone ID: PAT_TA_59622.pep
RTSPPGAVPLPTSAHGALRDRWPHPVEPRNPSSGPGTIPVTTETFLVAEIGLPIYNSSPLDHFGTPRDVRDLIRDSEKLSGYHILISQQP

SEQ ID NO: 165205 - protein, 67 aa, Triticum aestivum
  Clone ID: PAT_TA_59623.pep
GCKHLESSNGSTLLNLRVWQGTLQAGERIKGQRASKNMVAIQTIKLDQNEDEVDTLKFFKQHHWVFA

SEQ ID NO: 165206 - protein, 130 aa, Triticum aestivum
  Clone ID: PAT_TA_59624.pep
GRAPSPIEIWRSTSSRWGNLPIAAGSSPISGATSCSSSTGRGRHGSSSAIPLCGTTRKSLAQRGSTAATCWALSPRRRGCGRGRGHQPLKLQGDVHGLSPSGPQRQGLCLLFRWMVGDNTVIVLDKDVVE

SEQ ID NO: 165207 - protein, 97 aa, Triticum aestivum
  unsure (1)..(97): unsure at all Xaa locations
  Clone ID: PAT_TA_59625.pep
MLYGKSCHLPPKIKKTAXSATYQLNYEFKPTGEKRLLYTTSPYEXSSQAYKYATLFKEQVKTWHEXQIHKRDFNIGDYVXLYNSHLKFFAYHHRSKL

SEQ ID NO: 165208 - protein, 144 aa, Triticum aestivum
  Clone ID: PAT_TA_59626.pep
VSKDAPCADYQADKPITVKAAVEMDLVRINDNLLLERNSALYPLKPDGTFSDLPCSVLLEEAQIIDFPSEDVFKMLVQSDAAELNTSDEIFKDDFDPARRFYESVVSSELVLVDDTFRSLPTPILSDDDMTLRSMVPSIGEVLC

SEQ ID NO: 165209 - protein, 113 aa, Triticum aestivum
  Clone ID: PAT_TA_59627.pep
CLTFRSNVQQVMAAPVHDNNNCSKEEKNRDITQDMPFTEAEEQAPDAKVRDNGDSMDEEVTIAVDTDEGRGLAQEVEAKLAVEPAEGGLKETKEGRPRPAKKTEKAAAKGVVV

SEQ ID NO: 165210 - protein, 111 aa, Triticum aestivum
  Clone ID: PAT_TA_59628.pep
LPWPISNYLIDTDYCQDDTGASQAVEEEVTISSDSAPLPRQKLRMVTRKVRFSHHLAYLDPHFLLKSSNMRVTVRPGLMMMMMNHLPNYKKLIKNARMRFLSPLSFCFIHE

SEQ ID NO: 165211 - protein, 91 aa, Triticum aestivum
  Clone ID: PAT_TA_59629.pep
YSSLGINIGTGYPEFPCLDGQGISPPNWPQILGGPLRKPASLFPNSEGASSIFGDIREPARDLPLRPLQKRKRCTRAGEKVSTTAAHVRQL

SEQ ID NO: 165212 - protein, 59 aa, Triticum aestivum
  Clone ID: PAT_TA_59630.pep
NRTSANYEYIIKARSRSQTRHKLQNRGQDNQNHGTTLIQTPDPAVPGRGRPVTRCCRWP

SEQ ID NO: 165213 - protein, 80 aa, Triticum aestivum
  unsure (1)..(80): unsure at all Xaa locations
  Clone ID: PAT_TA_59631.pep
MPKNSTPAVVVASAAMVALAVANRVLEKLALVPLKSYAFFLAHLSMFGYLGLYVSIRXVMYRAGVVTLDMLELPQIRFAV

SEQ ID NO: 165214 - protein, 31 aa, Triticum aestivum
  Clone ID: PAT_TA_59632.pep
KEGVTSSTSTIITGTCYNDGAMIPLRSRGHI

SEQ ID NO: 165215 - protein, 61 aa, Triticum aestivum
  Clone ID: PAT_TA_59633.pep
MQPDGVSVVPDATVYGWKDLKTPEIQVSLGTPRREAVLIRSSWTSAILLKDILLQRSFRSG

SEQ ID NO: 165216 - protein, 62 aa, Triticum aestivum
  Clone ID: PAT_TA_59634.pep
ETHSQSMFAAIRGFGMPPRYRMQDCVRMHAKFILFKNVCEMQVRGRRLISYQRGTIYAHLYQ

SEQ ID NO: 165217 - protein, 111 aa, Triticum aestivum
  Clone ID: PAT_TA_59635.pep
YRNREEGRWAAAAMAPSDPSRRMRTPFQIRFYTSSRRPSSTHVAGRLHVAASRELCAWKRAAGCENEMKHVPRALLQMYAVPVTGWVPWVQVATVCQSTQLQRVWDLGCTP

SEQ ID NO: 165218 - protein, 51 aa, Triticum aestivum
  Clone ID: PAT_TA_59636.pep
VNLLSQVILDGNLFYNTTTPFLNQIRTVCVKFCSIAIFGWLSLFCFMLYSQ

SEQ ID NO: 165219 - protein, 135 aa, Triticum aestivum
  Clone ID: PAT_TA_59637.pep
HIHMFLGILMDPNVVLQNAARKILGSVNLPTLHMCKSALDGLIAGLDKFPEDQDIYGVLFSIGNNHGSFSANIAKHLANDINMASDGELILDKPRIKALLMASVVAAYDDKDIKLDIPAVILSHAIPLFGMISCA

SEQ ID NO: 165220 - protein, 38 aa, Triticum aestivum
  Clone ID: PAT_TA_59638.pep
TLSSPMVGDSPPTTSRLVLRSSGLSQTNTQPCTECDRF

SEQ ID NO: 165221 - protein, 92 aa, Triticum aestivum
  Clone ID: PAT_TA_59639.pep
EKKMVQHPLYFVSNLLQGARSRYSGVQKLLFGLLMASRKLRHYFQAHEITVVTRLPLQRILHNPDAMGRIVEWVLELSSFGLKVLKYLHDSE

SEQ ID NO: 165222 - protein, 56 aa, Triticum aestivum
  Clone ID: PAT_TA_59640.pep
IGVHVLASFVADIPSCLNRLLVACIVKFAFGEGSLMHLGALSDMVLESNHIILRRK

SEQ ID NO: 165223 - protein, 82 aa, Triticum aestivum
  Clone ID: PAT_TA_59641.pep
GSMLDAVVHLIHDFFSLHYQALRCLTTVLNAGSMTRYAQCSQLMWRKCDTLNVSLCDLLCPAVDPNVDNDVKSHGQNWQDHV

SEQ ID NO: 165224 - protein, 72 aa, Triticum aestivum
  Clone ID: PAT_TA_59642.pep
TATPDSTGRCTIRISCLLKGKIKHCPSLDQSSYAYTLNVQSSFEDTNDTYAIHDLDACGFRIVNLISHHVSA

SEQ ID NO: 165225 - protein, 75 aa, Triticum aestivum
  Clone ID: PAT_TA_59643.pep
SVLNIIIMLPQGFTRTGVGYGDLLFIWDICKYFYCFNIFTVERLFYGFRFKKKVQGWSCVDAYIPGPISSCFSGP

SEQ ID NO: 165226 - protein, 34 aa, Triticum aestivum
  Clone ID: PAT_TA_59644.pep
VIQQYYSIDPSALTKLRINHVCITYCVTDVRSLI

SEQ ID NO: 165227 - protein, 44 aa, Triticum aestivum
  Clone ID: PAT_TA_59645.pep
FYLLFLLQLVVDKVVEVHKRGSIIPSLCRIHTKVGPDVVQHHEL

SEQ ID NO: 165228 - protein, 96 aa, Triticum aestivum
  Clone ID: PAT_TA_59646.pep
CDHINIFHALSASYNYLCEHRGKSLILAILLGYEASIFYIASKIMINSQIILIPIKHLSTQFGIISLSHLITIIIPSLCREEMFVRQVPVWLCQMI

SEQ ID NO: 165229 - protein, 90 aa, Triticum aestivum
  Clone ID: PAT_TA_59647.pep
QDGTPQACTRPAAIRPSKHRDLPLDVRRQLPCMHDASNMVCELTKEEATYIMEVPGYIDSARSITYSWISTLIYLDLRPSKNIFRFMLLQ

SEQ ID NO: 165230 - protein, 64 aa, Triticum aestivum
  Clone ID: PAT_TA_59648.pep
AGRDDTQQIHLSSLATAAIFLHLTDSAGGPVLRPVYAANSPRLPSITPARFTPSTDSVWSPSSR

SEQ ID NO: 165231 - protein, 59 aa, Triticum aestivum
  Clone ID: PAT_TA_59649.pep
SRKPLFKGVAISLCFTDNVLNYQLLPAISPIGDFGILGLQQLLGVCIAYYNLQIPMPRL

SEQ ID NO: 165232 - protein, 116 aa, Triticum aestivum
  Clone ID: PAT_TA_59650.pep
RRNEYEIAPRLGEVWAVYKDWKAGWTARDFSSCDYELVEIFCHTNSSIRVRLLRKVDGYRAVFTRETTVETIGKDEYLKFSHQIPCFHLTNEGGGKLRGCLELDPYSVPEEFLLTD

SEQ ID NO: 165233 - protein, 64 aa, Triticum aestivum
  Clone ID: PAT_TA_59651.pep
MQYQQRFVMIFKFDIAPEYGSRAEFSGHYYTTSHHCLQPSFSVTEPIKSILFFINVFLEVVVVH

SEQ ID NO: 165234 - protein, 51 aa, Triticum aestivum
  Clone ID: PAT_TA_59652.pep
TAFASLQVRLMQCSLASPYVSCQGLLISDSPVNIVNAHVGALFVWDLYVEL

SEQ ID NO: 165235 - protein, 88 aa, Triticum aestivum
  Clone ID: PAT_TA_59653.pep
EFTSRKLGFGHRAIFTLVPVQSRTGTNVSIVPGSCGQAHAGPRGGIGPGSSGPFGPGWWDKPGPMGLAPGPPPLVPVGGLNRDQRLTL

SEQ ID NO: 165236 - protein, 47 aa, Triticum aestivum
  Clone ID: PAT_TA_59654.pep
EVHIIKVEKFDDYRKFRFSLLLKNGNKKFKNEIIRISTFKNRALQNS

SEQ ID NO: 165237 - protein, 60 aa, Triticum aestivum
  Clone ID: PAT_TA_59655.pep
DNNTPDSSEDNPLQQDSTQEDGEASPHKRAADREVEDDNYMPPSEDEASLNDDEFVMPED

SEQ ID NO: 165238 - protein, 138 aa, Triticum aestivum
  unsure (1)..(138): unsure at all Xaa locations
  Clone ID: PAT_TA_59656.pep
TRTALGHLXFPDPARXEEKLREGSGSTTTWWWSLQFSGRASPSTTEEEVELERGRAAPGARVKLPCASPLYIGLEGAGFLPSKSIGALAKVGGKKSHHFLPHRLLSPLFRDLDLIPSWYDLIPSKRGSWCTLTRGVGP

SEQ ID NO: 165239 - protein, 136 aa, Triticum aestivum
  Clone ID: PAT_TA_59657.pep
LPSMGSSILHGTCSLADAIARLVVELERQFMHKHPCIQRIFLEFSNIEHSSVKRAATIFLAHEFRFIIKEAKEIFAHYRVDACRPPIESILFYQEEIMRFQSLDYVSFNENLRKRVPSNVLVDRISELNDDLGNSK

SEQ ID NO: 165240 - protein, 44 aa, Triticum aestivum
  Clone ID: PAT_TA_59658.pep
PLLVFFLVYIKYSAVIIGDLVTSSTMSTNSASVTPDLRGLIACA

SEQ ID NO: 165241 - protein, 49 aa, Triticum aestivum
  Clone ID: PAT_TA_59659.pep
SSVAMTSHHASYLTIMQGNMTMNAQVMYMMMMEVAWQYISEWLWKFHDR

SEQ ID NO: 165242 - protein, 61 aa, Triticum aestivum
  unsure (1)..(61): unsure at all Xaa locations
  Clone ID: PAT_TA_59660.pep
LQSNEQIRXTETLPCTHREPFATIWCCISENFFTSSPHSLKMDNISNNQLASRSATEPDIQ

SEQ ID NO: 165243 - protein, 55 aa, Triticum aestivum
  Clone ID: PAT_TA_59661.pep
RGLKSPSMWMYDSTTYQNHAKNLRVYIAFSPSKLLPLPSYAIVLHSTAILLELHV

SEQ ID NO: 165244 - protein, 94 aa, Triticum aestivum
  Clone ID: PAT_TA_59662.pep
LNKGQAREKVVKGSGHDGILDLWAMILVRTEWQTQFCAYRCCCMCQRWHSHERSPACKGTSQMQVPRWKILLHIGVRFLSQLRMHIVMPESYYR

SEQ ID NO: 165245 - protein, 76 aa, Triticum aestivum
  Clone ID: PAT_TA_59663.pep
PGCSLHAASAALIDWLVRPFRSDRIGSMRLVRTGLQIQTCPASCRQQRRGCFASATRKLRQATCTRRERKMLSSTR

SEQ ID NO: 165246 - protein, 77 aa, Triticum aestivum
  Clone ID: PAT_TA_59664.pep
TFEPCTLHEGGDEYKGVDYQSVNVGDIVDNFRLQEQTAFVWKHFSSHINHYNSNHSAKHSRDNIECFQDQCSGLRYT

SEQ ID NO: 165247 - protein, 130 aa, Triticum aestivum
  Clone ID: PAT_TA_59665.pep
MDDVLHVRCGDRAGSEAPRSPKVPPSPPAEYVHLVVARRSIGSLSPPTASSYGIRIGSWCRRTSSSSADKKLVASMHAINQGTPVARAENARTYLGPFGCRHPGVRVAVAGFDGAVAAVGVPEGRRDAWP

SEQ ID NO: 165248 - protein, 108 aa, Triticum aestivum
  Clone ID: PAT_TA_59666.pep
PRLFFFFFFFFLIFFFFFFFFFFFFFFFFFFFFFFFFEKNPNLHKIHTQEQHPVWITDLIGDDLRTNFISEEARGNPTGSMATEECSFGTKADHKLSQLTVICGSRIH

SEQ ID NO: 165249 - protein, 64 aa, Triticum aestivum
  Clone ID: PAT_TA_59667.pep
LLKIPRIYNQFSKCNFPTNVSVVSLLIPMRAGSVRRPLIGDKEEVVTIPDESHVVDLGAVARFY

SEQ ID NO: 165250 - protein, 73 aa, Triticum aestivum
  Clone ID: PAT_TA_59668.pep
RIRGMMRRGRTILRCIRRIRRRRLTMTPRRLSRRTLRTRLLRRPLPRLICLSMMITIIIFTTMNMHIEEDIYD

SEQ ID NO: 165251 - protein, 59 aa, Triticum aestivum
  Clone ID: PAT_TA_59669.pep
VSCFITSLVNNSTIKYGTKGASYASSFTIVHEDHDSNNCAKVLSEDCINMFGTKSLNDE

SEQ ID NO: 165252 - protein, 99 aa, Triticum aestivum
  Clone ID: PAT_TA_59670.pep
MANCGEQIGQRHMKECTAAGSGSYRCDKHPFLTHRSHCNINQSVTNGIAEKVKKKWMQKNFLMTARYIVKHSTIWPPEFIVPVWISCDDCPRLDDADGI

SEQ ID NO: 165253 - protein, 91 aa, Triticum aestivum
  Clone ID: PAT_TA_59671.pep
TIATGIWCATYGLCREWACMFRHESTLTLVESKSHTHYGRLHSVGILPRRANGRSSWLQPERMDSTVDGGYERQDSNNAFSKQVVAEGPSE

SEQ ID NO: 165254 - protein, 72 aa, Triticum aestivum
  Clone ID: PAT_TA_59672.pep
ITSWTANGLDYGSAANLLMLQKCITNMIKKNTCLTNMIQVMLFCRILPCQLRSSHMWEFNLEYPPTLKHFFG

SEQ ID NO: 165255 - protein, 49 aa, Triticum aestivum
  Clone ID: PAT_TA_59673.pep
ENVFKHIFQGYILPKDKQNIISTTRYNVENPLGKVREISCHYPYKRCLG

SEQ ID NO: 165256 - protein, 126 aa, Triticum aestivum
  Clone ID: PAT_TA_59674.pep
TTEDLPDDLVELYKTDPEENYHQRKTRIQRIRRYWAEQWFKCKFVTQEYAEKNAIKSPWGDILYRGLHPKNRAEAIAQGFYHCMVHGPQPENAYSTSLLWCRDDNLFKRNFQHAKASAKEYKKSLG

SEQ ID NO: 165257 - protein, 62 aa, Triticum aestivum
  Clone ID: PAT_TA_59675.pep
CSDHDQDGIANSTWLVARSEVGQGRCMIFTRFGIDLLVPRSTGFISGTCLILTLLFISQNWH

SEQ ID NO: 165258 - protein, 128 aa, Triticum aestivum
  unsure (1)..(128): unsure at all Xaa locations
  Clone ID: PAT_TA_59676.pep
RQDTFASIKPTTWKVLKAVMRQQFXPPYYRRELRRKLEKLKHGSNTVHAYYQEFKSYMHHCDIEESEDDTMNRFFGGLNHDIHARFQYIPRCITDMYVRACTFERHIQEDALGDYNNYYSSSCSPPPV

SEQ ID NO: 165259 - protein, 58 aa, Triticum aestivum
  Clone ID: PAT_TA_59677.pep
RQTDQRPGQVSSSGGQEQLGHCKSSHGHVGDVWPPQVERECGVRVVMVPLKQPLPLVV

SEQ ID NO: 165260 - protein, 53 aa, Triticum aestivum
  Clone ID: PAT_TA_59678.pep
FGPVYGSQEEFNWLTTEHRTKDHQKIMQSDINDRDSSACPNSIFFCMQISWAP

SEQ ID NO: 165261 - protein, 42 aa, Triticum aestivum
  Clone ID: PAT_TA_59679.pep
RQRHSIDFQMYEVVCTKKRRSRINSIGHLHTACQITSSHAVM

SEQ ID NO: 165262 - protein, 102 aa, Triticum aestivum
  Clone ID: PAT_TA_59680.pep
VGTGEARAGRHPVSVMCVRGDATDTDTDTRPMYGCVVGVTTPPGRVGGDTGLIERTWTPGSWDYPANVDLENPWHPLPADAVHGDSKEVHLDICIIKLNVDH

SEQ ID NO: 165263 - protein, 49 aa, Triticum aestivum
  Clone ID: PAT_TA_59681.pep
AVGECCRKLKKILRFHQDPSMSSSKQRVMGDASTYHFVDRERKRSKEQG

SEQ ID NO: 165264 - protein, 61 aa, Triticum aestivum
  Clone ID: PAT_TA_59682.pep
RSRHLLIICVITRLILGELGLFGNDCSMRANLLDTSSKVLLIKKSSIFLETGIPTGYVRRI

SEQ ID NO: 165265 - protein, 51 aa, Triticum aestivum
  Clone ID: PAT_TA_59683.pep
SDLVVFLCLISACAKYNRWEDLGKIFLISPYQNRNFSAHDNCSHFYFESDT

SEQ ID NO: 165266 - protein, 71 aa, Triticum aestivum
  Clone ID: PAT_TA_59684.pep
ETVDDHQKNVKCIRELEAPGRTASLLCRPCIKLNFIIHNGLPLPATSVILFFRKNFQSIHLQSWQYNECQK

SEQ ID NO: 165267 - protein, 97 aa, Triticum aestivum
  Clone ID: PAT_TA_59685.pep
SIDMASLSNTHTLPDTEGVGWHLDLDSNLSTPLSNTHTHTHTVASCASMPTAHTLDTPFSPSPFPPPNNDSRRVITQSDRNLSIGSSQLCLRASLSS

SEQ ID NO: 165268 - protein, 63 aa, Triticum aestivum
  Clone ID: PAT_TA_59686.pep
FSHSMFFKETHCDVTFRHDCKDIFFCLHVYFFFIFFCFFFFFFFFFFFFESTSNISNTYLIHT

SEQ ID NO: 165269 - protein, 59 aa, Triticum aestivum
  Clone ID: PAT_TA_59687.pep
KVSVIKIHKVSMGMNKVQGRPPLSQCSSISLSLFFLKKFWVPLLIFLFLNYIKADNRNK

SEQ ID NO: 165270 - protein, 48 aa, Triticum aestivum
  Clone ID: PAT_TA_59688.pep
LEVVDGEVVVLGEIDRAFRFRSFARVRPLRRPCERWSSLTLPDHLLAS

SEQ ID NO: 165271 - protein, 61 aa, Triticum aestivum
  Clone ID: PAT_TA_59689.pep
FLQRPNPVKHLHCLFRSKPHMPPGDVFVFKIYVPSQVSKRILLPLVVNFGLYYLQHSVKQG

SEQ ID NO: 165272 - protein, 45 aa, Triticum aestivum
  Clone ID: PAT_TA_59690.pep
NNADYCALSAPRCRACADHLDHGEERCSLFCSISDRSRKRRPALY

SEQ ID NO: 165273 - protein, 57 aa, Triticum aestivum
  Clone ID: PAT_TA_59691.pep
FQNLPLALLNRTHFRSKVYHRLMSTSSQVIIIVRISQTERLLLLEFHIRLYILSCEF

SEQ ID NO: 165274 - protein, 76 aa, Triticum aestivum
  Clone ID: PAT_TA_59692.pep
IFFYQNPMNLLKFVNYFFKIDELFYKRNIFFSKSTNFFSKSMNFFKNRRTFFKINELFFKSMNSFSKLMNFVSQNR

SEQ ID NO: 165275 - protein, 75 aa, Triticum aestivum
  Clone ID: PAT_TA_59693.pep
QKPMNDQRKVTTGDKKKLHLTTKKASSDNEKSFNCEAVSHGRQTKKLQPAVAKATTALKMSHSHSKMLLQLKHFC

SEQ ID NO: 165276 - protein, 64 aa, Triticum aestivum
  Clone ID: PAT_TA_59694.pep
YNFPHYFPPFLSSLNHVLDSCYTTFPLPFLFEPRPRFMLYNFSHYFPPLLSSLNHVLDSWYTCN

SEQ ID NO: 165277 - protein, 46 aa, Triticum aestivum
  Clone ID: PAT_TA_59695.pep
MKLYLPDSCKIHTFPSSVYHDCNNHLSEDTRVDKKSGNSISLTHTL

SEQ ID NO: 165278 - protein, 79 aa, Triticum aestivum
  Clone ID: PAT_TA_59696.pep
KGTRRFKRIYNGYALLSNTGKRAMYDSWLAACLYDYNQDFSNLMHEMLSMIYTVTNDSSDTLQDLETMLHEIIKGKGRS

SEQ ID NO: 165279 - protein, 137 aa, Triticum aestivum
  Clone ID: PAT_TA_59697.pep
PYNCNNVMTRIISLTRNRKMELTFMALHSAIQANVYVNLDFISSNATRTGTIYYVYGEITAHHQLYNGQSVLLFSRGEENKAEVIDGELPLLRKCAVVPIYLEPLLILKFDLHVPINCDHDDGGCTIAFRDYVTFYR

SEQ ID NO: 165280 - protein, 134 aa, Triticum aestivum
  Clone ID: PAT_TA_59698.pep
VNHLDVEDVYDQPDTVVGKFLLNSHPVLVLFDSGATHSFISRVVVEKYGLPTRTLRTRFQLFPPGGGMTAGLGCHSTLSIGNHDFSADLIVLESQSLDVILGMDWLTKFEGNIDCARKTIFLTTPKQKRIKYVS

SEQ ID NO: 165281 - protein, 61 aa, Triticum aestivum
  Clone ID: PAT_TA_59699.pep
LKTLTQFVGSQVEARMKIYAVSTRHYFAFGALVSEEHSYVINALPKLRWVRPESHVNVKLP

SEQ ID NO: 165282 - protein, 70 aa, Triticum aestivum
  Clone ID: PAT_TA_59700.pep
AETRVVWQAHQAERHLSTSPDIRSPRILLCIFSRVVLTWPQQLTMHIVMVISTVPFHIMSAPTVQGVQIH

SEQ ID NO: 165283 - protein, 86 aa, Triticum aestivum
  unsure (1)..(86): unsure at all Xaa locations
  Clone ID: PAT_TA_59701.pep
RLPQVPSSCKCHTMLANENSIYGVLHSRSQFXDLFMRRGTFHNIFEGTLTAFKTGRTIANDNAIDFSSPFADVIEQFFGCHMTIKP

SEQ ID NO: 165284 - protein, 133 aa, Triticum aestivum
  Clone ID: PAT_TA_59702.pep
VFFKQEPILKHNLPVETLGDPPPKGDPVFELKPLPDTLKYAYFDEKKIYHVIISANLLEHEEERLLKTVKKHRVVIGYTLDDLKGISPTLCQHKINLEEDAKLVCDHRRWLNPKMKEVVRKEILKLLEAGIIY

SEQ ID NO: 165285 - protein, 120 aa, Triticum aestivum
  Clone ID: PAT_TA_59703.pep
HARSLISFLILFLSSSSFMFCQTVSSGQQHNYTSNANARRYYNHALEVRLGSSQWPRMVMWVSNDGSSSSSSVSPSPSRPIHRRPPPSRRSRYPDVVVQCNRNRNTLKDLAAEAEAELPP

SEQ ID NO: 165286 - protein, 76 aa, Triticum aestivum
  Clone ID: PAT_TA_59704.pep
WTPIEVTRSCTYPAMRSRHPRFYMCVPSEFASIGEYLAVCTSGQILLTPATSMTFSKVDYCWLSHSRSDFGSRTWQ

SEQ ID NO: 165287 - protein, 58 aa, Triticum aestivum
  Clone ID: PAT_TA_59705.pep
WRTMCWCSISVQILMAHHVHGAPLVILKKLKKITNGAPWTWCAISICTLMEHQHMVRH

SEQ ID NO: 165288 - protein, 54 aa, Triticum aestivum
  Clone ID: PAT_TA_59706.pep
FLELGKYGCCSILYRLSCLGRLLLCLHCLHMFASLMIRFEDRTIKYAEAFSMQC

SEQ ID NO: 165289 - protein, 57 aa, Triticum aestivum
  Clone ID: PAT_TA_59707.pep
QWTATRSVGLPIEGSQLLSSETRARIHARILVDESGMWCKDVTFIIYRVFTVSNFSK

SEQ ID NO: 165290 - protein, 57 aa, Triticum aestivum
  Clone ID: PAT_TA_59708.pep
WYYETLHHWHIGCMIIDLTSYLSQSHRFIVIIHVTNASLHIPVQRGTHSHSSTCCSN

SEQ ID NO: 165291 - protein, 53 aa, Triticum aestivum
  Clone ID: PAT_TA_59709.pep
AHENYILPIFAEGIFLNIFSSFSKLKSLLIKVFHVHTRVPKLFRQQHVALKVI

SEQ ID NO: 165292 - protein, 51 aa, Triticum aestivum
  Clone ID: PAT_TA_59710.pep
SPHGVVDCVGPFAASNVAVPSFLESSRSKIHVPPKLIVFFLCLSCKWVLHC

SEQ ID NO: 165293 - protein, 75 aa, Triticum aestivum
  unsure (1)..(75): unsure at all Xaa locations
  Clone ID: PAT_TA_59711.pep
CIEGGRVGDKGVKLLVKIAVMMMAXAVFRRHRKQRGESXPSSSSSLTSSLDGRKVSPMILGXNGWEGREPLRDWI

SEQ ID NO: 165294 - protein, 73 aa, Triticum aestivum
  Clone ID: PAT_TA_59712.pep
SRHICREISCRCNRSAMTSSQRNDGAKGYWNHGYNTNSKSSLLFKAKSDKTRKIDVSLTHCWKLCSGKKDHVA

SEQ ID NO: 165295 - protein, 83 aa, Triticum aestivum
  Clone ID: PAT_TA_59713.pep
LSLSHRSLKLGGEQVAPCLVFGDSQGQAVNTSANVMNGPSFNIAIGSLTGLCFIMAVSFRLSPPRCLTMRAGSTIAVVILLHT

SEQ ID NO: 165296 - protein, 73 aa, Triticum aestivum
  Clone ID: PAT_TA_59714.pep
IITLFLNAGLAGALAIQFTRGLLGCFMYVVIIEALHSSVGGVASSVFHTLAYVEFDLLVRHIATVVCISWRYS

SEQ ID NO: 165297 - protein, 94 aa, Triticum aestivum
  Clone ID: PAT_TA_59715.pep
FNFFPFAGFLVFSVFLFLFCCAFFCFCFYFFPFIYPFSFLFYPLFSKTFSFFLYTIDSAMVDDYINRIEQLLAGDKYKVVGIDLQYTAGRPGID

SEQ ID NO: 165298 - protein, 50 aa, Triticum aestivum
  Clone ID: PAT_TA_59716.pep
RSHETEDIRGMMTATIETGSYSVQMSDEDGASSTYFLTTVRAIVHRDRFQ

SEQ ID NO: 165299 - protein, 45 aa, Triticum aestivum
  Clone ID: PAT_TA_59717.pep
ERRLLEAVKHWFAVGFHAPASVVARLFSVERVTRMVCSVTVSSSA

SEQ ID NO: 165300 - protein, 87 aa, Triticum aestivum
  Clone ID: PAT_TA_59718.pep
MTAIMKSLPRPDQILTIARPTWRAREVSGNDTYGVTGIPFMVGGCEVVRRAGLQEAHISFTQVRATKMRNTVVLLWWMYSSVLVFLS

SEQ ID NO: 165301 - protein, 44 aa, Triticum aestivum
  Clone ID: PAT_TA_59719.pep
CQCSIDSRSQMYLILMWGQMFAVTMTSSLGYDAAGNVGVGVDDR

SEQ ID NO: 165302 - protein, 146 aa, Triticum aestivum
  Clone ID: PAT_TA_59720.pep
IKDYDGPPMLKHLTFENQTIYHLLTYTICPLDGMNTDGSISDVLRNTIYAISHRFVFDVEDLFLRILKDSAHHPMCLKFFAPWIQQVIDHSLKTTYLAKVAHKSFIPPVRDTIQALEDFSSGKASDSSPSNYHNKFDGPRLPQRDT

SEQ ID NO: 165303 - protein, 96 aa, Triticum aestivum
  Clone ID: PAT_TA_59721.pep
NLRQHDHLPALTITRRSLGSFSTEVLNHARPLQRRRASHRANLMSVMVSKVPPDANMADQGGETGHDSEPMHIVLSIRCDPTVTVFRLNRPYFVVP

SEQ ID NO: 165304 - protein, 119 aa, Triticum aestivum
  Clone ID: PAT_TA_59722.pep
PAGSGLPRSLTVSNLVNTMKGGSMVYTIALLFIGCLVMVGQCRPEPESTYEDGHRNVATVVSSLDDNKLTLQWCVARDCVTKGEPHANHCFCCLNAPGAPCFNSRLDCQSQCPTMPPGK

SEQ ID NO: 165305 - protein, 120 aa, Triticum aestivum
  Clone ID: PAT_TA_59723.pep
ERAAAAGGAAASAKEDRDERQGDQQHPAPRGRHPPRTEGRGRDDSPRRRGTRTRRRAKGRPTPRRPRRTTPAKRTTRGRSAHTAQSQGQSAKPTRRHQQEAPEENQDTQRPRTPAKETST

SEQ ID NO: 165306 - protein, 102 aa, Triticum aestivum
  Clone ID: PAT_TA_59724.pep
QLPMPVPAKWLAGCSRVYRRVPAQIAARQFQHGRLPACNFSARPFQHGWLVIPARPHGEATSDETLLPIVRRWSAKMLLQSLFVVDDRGSGSSRMAGSSAHP

SEQ ID NO: 165307 - protein, 131 aa, Triticum aestivum
  unsure (1)..(131): unsure at all Xaa locations
  Clone ID: PAT_TA_59725.pep
AGRVGKGPFGLSTLIVGFDPYTDKPALYQTDPSGTFSAWKANATGRNSNSMREFLXEKNYKDTSGKETIKLTIRALLEVVESGGKNIEIAVMTKKDGLRQLEETEIDEYVAEIEAEKAAAEAAKKSGPKDT

SEQ ID NO: 165308 - protein, 80 aa, Triticum aestivum
  unsure (1)..(80): unsure at all Xaa locations
  Clone ID: PAT_TA_59726.pep
MSCCGGNCGCGSXCKCXNGCGGCKMYPEMDEGVTTTSQTLIMGDTPSKGTPSFEAAAETGADNGGCKCGSNCTCNPCTCK

SEQ ID NO: 165309 - protein, 121 aa, Triticum aestivum
  unsure (1)..(121): unsure at all Xaa locations
  Clone ID: PAT_TA_59727.pep
ASVAAADLAPLCYRSRFSSPTRPLPQLLPFPHAAAPPPPPQGTSPPLPPRGTSPPLPLPPRGRGPSPMRPPPSAARSDEKKPXGMRRSPPGAXRPPPPPPPRAIRFGETLGTVRACMNPAG

SEQ ID NO: 165310 - protein, 93 aa, Triticum aestivum
  unsure (1)..(93): unsure at all Xaa locations
  Clone ID: PAT_TA_59728.pep
PRRAAAAAEPEGHHADKAQQTDKPXRKKTKGDHRTKKEDKATRPGKAGNRHRKRDAPGHKNPREANDGTNNDQKRPNTGTAATRAGKKAGTRH

SEQ ID NO: 165311 - protein, 162 aa, Triticum aestivum
  Clone ID: PAT_TA_59729.pep
AGRVGTQENCKPSSRDTRPPSVMRTLQVSASRAIWRRPGPSMRTAALLVAAEAAHALLQSELSDIALAARKIMHAHHRPLAVPRHTAVTSSHASSFIACRIPACSLQPTNWKTYMRDLTLVSLHIPHPACGGAIPPDDQGRCLYCFQEKITEATSSPYYATD

SEQ ID NO: 165312 - protein, 148 aa, Triticum aestivum
  Clone ID: PAT_TA_59730.pep
AGRVGKEINHRPLMHACLFPILRRRNLWQPVHGKGRAPTDVLHRRLLDDEYAYDLHLGLRVADERLRSPPEGQRTYYQLSCAHLRLSRYTTNDVLKENCAIIEELRTLPHEARIATTGIYKWSGSASNASCRYSTSSTERMQAKSSDA

SEQ ID NO: 165313 - protein, 153 aa, Triticum aestivum
  Clone ID: PAT_TA_59731.pep
AYTDRRFFTSKVDSKTDPTNQITTTTREKKESTRPDGYPIRQYYMKQLVDWSEGKQTAGVMRWMDRSALDGLDLVPRLLAEVADDPDALEHRHLHLHGPLLHLPLEPSHLFSLLFLVGEDSCGSLEETKKTMAIGDLPGRVAKMSCGCENRPA

SEQ ID NO: 165314 - protein, 249 aa, Triticum aestivum
  Clone ID: PAT_TA_59732.pep
MSGAADREAVFPTRQSLGIMKAKLKGAEIGHSLLKRKSEALTKRFREITKRIDEAKRKMGRVMQIAAFSLAEVTYAVGGDIGYQVQESAKSARFRVRTKQDNVSGALLPAFESYLTEGNNDFGLTGLGKGGQQVQRCRETYARAVEALVELASLQTAFVILDEVIKVVNRRVNAIEHVIIPRTENTIKYINSELDELDREEFYRLKKVANKKQRDTAAADAEMKARREKGAAAQSGQTSQKDDDAPYRR

SEQ ID NO: 165315 - protein, 70 aa, Triticum aestivum
  Clone ID: PAT_TA_59733.pep
MASLKAVKPTGLEGQAKEPTKVSATKGPAKLSATATKPAAAKGGIKKAESKPREPKKRQVKSSKPAAAKN

SEQ ID NO: 165316 - protein, 56 aa, Triticum aestivum
  Clone ID: PAT_TA_59734.pep
RTKFILSSFCHLKLCFYSGWLAGLLLVFIYLLLKMVVYCLIFIYACTYKVATQHWF

SEQ ID NO: 165317 - protein, 59 aa, Triticum aestivum
  Clone ID: PAT_TA_59735.pep
HTGNGHLLVTWNVTPPTVTTAGPGRASTKMQDRSRGGRRAISQLRSIELRRRPESVNGR

SEQ ID NO: 165318 - protein, 92 aa, Triticum aestivum
  Clone ID: PAT_TA_59736.pep
QSSKHALFGDLLHLAFSSQLTVHNLALVIFLCLRTSKDLSVGELDRVFPHIIFLAFLHQIVIIFSHYLLERYSNTHIMSHLQHYSIFCRKGR

SEQ ID NO: 165319 - protein, 70 aa, Triticum aestivum
  Clone ID: PAT_TA_59737.pep
GAFFFFFFGRKSKIFFFFFFFFFFFFFFFTNCALHQVSTILTSNQANTGSRNKLMYHIGLNKTVDTSVTS

SEQ ID NO: 165320 - protein, 89 aa, Triticum aestivum
  unsure (1)..(89): unsure at all Xaa locations
  Clone ID: PAT_TA_59738.pep
IIPILKHYLRHHLFSPSSISPQMLQMHGPKRDTRSKASSSVLFIHSVLTAAAGIQSTSEHVQHGRISPCSCKPSSLQKSXLKRKIIYIQ

SEQ ID NO: 165321 - protein, 125 aa, Triticum aestivum
  unsure (1)..(125): unsure at all Xaa locations
  Clone ID: PAT_TA_59739.pep
MXGRGKGGKGLGKGGAKRHRKGRRDNXQGXTKPAXRRRARRGGAKRTPGPTHEETRGXXKXPXENATRDAXTXTEHARRKTGTARDXXXAPEGQGRTPHGXGGQAEGPPTQPATPPTDREQQRNP

SEQ ID NO: 165322 - protein, 206 aa, Triticum aestivum
  Clone ID: PAT_TA_59740.pep
MVSPKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMESIHKSKAEKAREKTLSDQFEAKRAKSKASRERKHARREERLAQGPRDHAPAPAAAAPAPAPAAAAP

SEQ ID NO: 165323 - protein, 172 aa, Triticum aestivum
  Clone ID: PAT_TA_59741.pep
RPVFEKREKKKKKIKKKKKKKKFMNTMNTSTVRIERTWVNIDDDCFSPKPNSSDLYVNTMYCNGTHGQSMGSLGQYKGEVSNVHDVHIENVWMLNGDYSGARIKVWAGNETGTGFVNNVTFKNFWVARMDYGIFLDSCYFNKSADECNAHPSGMQITNIHFENFKKKKKKKK

SEQ ID NO: 165324 - protein, 93 aa, Triticum aestivum
  unsure (1)..(93): unsure at all Xaa locations
  Clone ID: PAT_TA_59742.pep
MAGRQRIGRQYYEEPRGFRDGPPPRLARERSISPRRIEGELSRRRGEIRRIHDDNQHLXDEIVGLRKEMSRLKEDIHSSSQGIPKLRGEKEIE

SEQ ID NO: 165325 - protein, 55 aa, Triticum aestivum
  Clone ID: PAT_TA_59743.pep
KWGRDGGPEGNHCDVNALNPAKKIVRIHIWSTDSSCKGARGVIKGISYSYLDMAG

SEQ ID NO: 165326 - protein, 231 aa, Triticum aestivum
  Clone ID: PAT_TA_59744.pep
MVYKTSLLLGLAAIAFALPTDKDSKQGLVAGKFIVALKPTANVDLDLHSRWVSDVHGQALARRGVESGGIDKTFSFPGFQGYSGSFDEDTIEIIKANSSVLLVEPEQVFTIASPVTQQSPPWGLSAISNANPPSSKASYTYDSTAGAGTFVYVLDSGIYLEHDEFQGRAVFGADTSAVSSKKQHGTLVAAIVNGATYGVAKKATVVDVQVLGDDGGSSSGVLAGLSWTGND

SEQ ID NO: 165327 - protein, 152 aa, Triticum aestivum; identical to SEQ ID NO: 126264
  Clone ID: PAT_TA_59745.pep

SEQ ID NO: 165328 - protein, 198 aa, Triticum aestivum
  unsure (1)..(198): unsure at all Xaa locations
  Clone ID: PAT_TA_59746.pep
LDRSETLGPFYNYYLKENLSFLHIHPSIHSGYGLSNYQGHIHSTHTHKGHHGQSMGDRASKPHAHAHAPWLDSIISYSHYSRILSHQHTYVRVHASYQFQGFHLQLSPHLHPXPDYPASASNSSSLFSGSTPRSTSAATWAAALPCSVRSGYIFPHLQSDPHLQPDPQLQYILQICVTQKDFKEKKMSFGIGDDDDHN

SEQ ID NO: 165329 - protein, 232 aa, Triticum aestivum
  Clone ID: PAT_TA_59747.pep
LTRISSHATMSALTEISLPSFQKIASGKVRDLFELPDKSTLLFVASDRVSAYDAVLKNAIPDKGKILTLLSAHWFQVLTERIPDLRTHFISLNVPEGVSAEEAQTIKNRSMVVKKLSVIKIESIVRGYLTGSAYKEYKKNGTVHGITVESGMEEAQKFKQPLWTPSTKADAGEHDENIHPDDAWKEVGDRETADRVKELSLKIYDEASKYAEEHGILLADTKFEFAKDQEGT

SEQ ID NO: 165330 - protein, 74 aa, Triticum aestivum
  Clone ID: PAT_TA_59748.pep
PARSLSETVSAAAAAITADPNFTVALAAAISSIMAGQHAAGNSNANNSNNNTSNNNVTTTSNNTTSNNTNSETQ

SEQ ID NO: 165331 - protein, 255 aa, Triticum aestivum
  Clone ID: PAT_TA_59749.pep
RPVRDSPFPLPELRHQPAAPPSSPPSASPASYQEGGMVRPLEVRFVPLSGFAPGGDPPQGPRAKKVSKAAPVFEVPGLWTPDVPLENAYRDCINMTVVYLDLHLPRKMKPKLSLRETFYMIYGGNTIKELAELVCGRLNLEVGHPMKFTIDGTLLPEDCVLSSVYNKYIWDGSILTLCCCVDNVKKIFNVDLSVKVPVIPPVHVIEDEVPLPTLRICSVRDARRASMMSKVGTYSPEDGAPSCAGARPLWGRPGH

SEQ ID NO: 165332 - protein, 159 aa, Triticum aestivum
  Clone ID: PAT_TA_59750.pep
MFARTVASSLRQAARPMAVRSTASAFRTPIAPLSPFQIRLLSDQTRSAIDKAVSSAPVVLFMKGTPETPQCGFSRAAIQILGLQGVNPDKFAAFNVLEDPELREGIKEYSDWPTIPQLYVEKDFIGGTDILVSMHQNGDLAKLFDEKKVILEGEPEQKE

SEQ ID NO: 165333 - protein, 68 aa, Triticum aestivum
  Clone ID: PAT_TA_59751.pep
MAKIKPKALLAQSKQKKGPTQIGLVRIITYIVLGALAVSSVYYAYQYWQSKGAAVAAAAGVAEGVVGN

SEQ ID NO: 165334 - protein, 71 aa, Triticum aestivum
  unsure (1)..(71): unsure at all Xaa locations
  Clone ID: PAT_TA_59752.pep
NNPGRGMSTPATRSFFXPTPXXXRPPPPXXLDXSRTXSRSATARRFXIANLVREVQSCXPLGDSCVCVSLW

SEQ ID NO: 165335 - protein, 78 aa, Triticum aestivum; identical to SEQ ID NO: 132157
  Clone ID: PAT_TA_59753.pep

SEQ ID NO: 165336 - protein, 70 aa, Triticum aestivum
  Clone ID: PAT_TA_59754.pep
DIKLTISTWVHVGITLDDIMLTITTSSATSYESMDLKQKKKTSTIDLHLRTRRNRSAEVVVCSFFFETGR

SEQ ID NO: 165337 - protein, 175 aa, Triticum aestivum
  Clone ID: PAT_TA_59755.pep
MAPTVMASSAISVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 165338 - protein, 113 aa, Triticum aestivum
  unsure (1)..(113): unsure at all Xaa locations
  Clone ID: PAT_TA_59756.pep
MFFFFFLFYILYIFFFYFYIFXSLLYLFIFYCLYFYFIFVFVVLFLLFFYVFFILLLYXYFFFLFFFLFFFFEFLFFFFFIFLFFFFYYFFXFFXFFLFVIFVFFYMICFFLG

SEQ ID NO: 165339 - protein, 64 aa, Triticum aestivum
  unsure (1)..(64): unsure at all Xaa locations
  Clone ID: PAT_TA_59757.pep
MXXRGKGXKXLGKXGXKXXRKGVXXNXXGITKSXIRXXARXGXVKRISGXXYEEDRXVFKIFXE

SEQ ID NO: 165340 - protein, 223 aa, Triticum aestivum
  unsure (1)..(223): unsure at all Xaa locations
  Clone ID: PAT_TA_59758.pep
MARKGGERKKAVTRSTKAGLQFPVGRIGRFLKKGRYAQRVGSGAPVYLAAVLEYLAAEVLELAGNAAKDNKKTRIVPRHLLLAIRNDQELGKLLAGVTIAHGGVLPNINPVLLPKKALEKAEKESQSPKSPKRKXPAPAPAAKKTPKKKAADKKTAAADKKTAAADKKKAAADAEEEARRRRVKRAKLRRVVLHLRGERRKRSCDPEWNGCSGVQLGTSCKVD

SEQ ID NO: 165341 - protein, 153 aa, Triticum aestivum; identical to SEQ ID NO: 106678
  Clone ID: PAT_TA_59759.pep

SEQ ID NO: 165342 - protein, 228 aa, Triticum aestivum
  unsure (1)..(228): unsure at all Xaa locations
  Clone ID: PAT_TA_59760.pep
MSNNNWQEEAMRRLRQMQQARGGGGGGPQMPRAAGGALAGGLLLAGGALFLSNSLFNVDGGQRAIKYQRLTGVSKEIYNEGTHINIPWFETPIVYDVRAKPRNVASLTGTKDLQMVNITCRVLSRPQIDALPQIYRTLGTDYDERVLPSIVNEVLKSVVAQFNASQLITQRENVARLVRENLARRAARFNILXLDDVSLTHLAFSPXFTAAVXAKQVAQQEAQRACLR

SEQ ID NO: 165343 - protein, 237 aa, Triticum aestivum
  Clone ID: PAT_TA_59761.pep
PAGSGRCVNLSGMGCSAGVISVGLAAGLLRAAPHGVAAAHALVVSTETITPNLYLGRERSMLLSNMLFRVGGAAVLLSTSKDRARFRLAHLVRTITGGEQDSSYRCIFQEEDDEGNLGVKLSRDLMCVAGAALEANITGLGPLVLPFFEQLRFVADKLLLKLGRRGGVKVKPYVPDLCKAFHHVCIHAGGRAVVDEVQSSLGLSEEHVEPSRMALHRIGNTSRSSVWYEMAYLEANG

SEQ ID NO: 165344 - protein, 223 aa, Triticum aestivum
  unsure (1)..(223): unsure at all Xaa locations
  Clone ID: PAT_TA_59762.pep
MAPQKSLLQYICSFLLLISSVSALKFDLIAGSKERCVRNFVGKDTLVVVTATVDGYKGDGMVVNLYIRDAVGNEYGRPRDVVGESRTVFTSHADAAFDVCFENVPSGSQRLNSPTRHIELDIDIGADAKDWSAIQATEKLKPVEAELRRVEEITSELVTEMEYLRAREQKLRDTNESTNNRVKWFGIATTWLLVGLWAWQXMYLRAYFRXQHLIKSVFTCAST

SEQ ID NO: 165345 - protein, 172 aa, Triticum aestivum
  Clone ID: PAT_TA_59763.pep
MALMLSPAATFLPVVAGKPTTAMRNLLFGTTTSTTSGHRSTRKVVAMADILGDFGARDPFPEEIASNFGEKTLGNVDTLHRILIPTLSVLSLSRVPLDADPAPLSEEDARRLLFKVGGWRLLFPSKGDSDVLKLECVWKVRDQACGDELVARINQGARRCRSRPRRAPVRGA

SEQ ID NO: 165346 - protein, 96 aa, Triticum aestivum
  Clone ID: PAT_TA_59764.pep
PAGSGTPRHQPPLSSQSQHPLSPHLPPLATTHQGKEDVLLRRQLRMRRRLQVRQRRRRPAAAAPARPTPAARWRRPNLTAHERQARYHLPKLPAGQ

SEQ ID NO: 165347 - protein, 132 aa, Triticum aestivum
  Clone ID: PAT_TA_59765.pep
TTHARAQLRRISSSPPSRSKERKNGGQAQRGSTGGRSPRGGVPGSCDGGGREWRQAARGAGGRRHSACGDGGIAGRRCYPDGGEGRRAQVIGRRRHAPRDQGLRAQPRRRALSAGHAIPCHGCHWNSGGGVG

SEQ ID NO: 165348 - protein, 130 aa, Triticum aestivum
  Clone ID: PAT_TA_59766.pep
AVLARPTPGNVQCFGRKKTAVAVAHCKPGRGLIKALEPILLAGKSRFKGIDMRICVSGGGKVSQVYSIRQAIARALVAYNQKYVDEAAKKEVKEILGRYDRTLLVADPRCCEPKKFGGRGARARFQKSYR

SEQ ID NO: 165349 - protein, 146 aa, Triticum aestivum; identical to SEQ ID NO: 135007
  Clone ID: PAT_TA_59767.pep

SEQ ID NO: 165350 - protein, 103 aa, Triticum aestivum; identical to SEQ ID NO: 107316
  Clone ID: PAT_TA_59768.pep

SEQ ID NO: 165351 - protein, 143 aa, Triticum aestivum
  unsure (1)..(143): unsure at all Xaa locations
  Clone ID: PAT_TA_59769.pep
LTCDMGHIRALLDAHEHGHPFEYCDRITTTTDQSLRGPRRGMIFXLKGHIAAKNDHPVHAAYDYHHKIKFDRFPSLLRGHHHQQKAGLEARLNRNPTPGHNGYQHQVMANXMSTGKQLMSQRYEMVIHGTDQHLVLCHHIHKA

SEQ ID NO: 165352 - protein, 142 aa, Triticum aestivum
  Clone ID: PAT_TA_59770.pep
GVFSQIFRGFFQNIYAFNFPFPLWVCNCFERGSVWASFLFYHLWKKGYVPQRFCWGSPKNFPSRRFLKPPPERAYYASLYGEFGVRAPPEVSGVDKLYIEFSHPRGSPIFLAPPPPGAPFFFFFLFFFFFFFFFFFFFFFLL

SEQ ID NO: 165353 - protein, 131 aa, Triticum aestivum
  Clone ID: PAT_TA_59771.pep
MSYYDRRGESSVLEAFTLSPLPYPVILILMMVTLLLGASWFFSYEEFMEEASEQFSWFLLGVPIALVLLIRWISSVDTFEGYFGFYPTESRWRGYPAAPSEGSSPWGVAMVVLLLLVLASFHSTFQDMWKA

SEQ ID NO: 165354 - protein, 111 aa, Triticum aestivum
  unsure (1)..(111): unsure at all Xaa locations
  Clone ID: PAT_TA_59772.pep
FGTEGVLRTQLEPYLEMIADRKDREEKMGMMDPRGARGKXXVYYSYVGSLTTPPCSEGVIWTIXKRVGTVSRXQLELLREDVXDEMEKNXRXSKEVNXRNIRMXRXFENRN

SEQ ID NO: 165355 - protein, 98 aa, Triticum aestivum
  Clone ID: PAT_TA_59773.pep
MQISAISSPFTEPSDLFETGGARGLPAHALRRLPAIKVGADTAVDEAGEALCCSVCLQDLEVGESARRLPGCRHVFHAPCIDRWLVRHASCPLCRRDI

SEQ ID NO: 165356 - protein, 107 aa, Triticum aestivum
  Clone ID: PAT_TA_59774.pep
MAEAAQGGGLRGRGALLGGVQDAPAGRENDLETIELARFAVAEHNTKANALLEFERLVKVRQQVVAGCMHYFTIEVKEGGAKKLYEAKVWEKAWENFKQLQDFKPAA

SEQ ID NO: 165357 - protein, 171 aa, Triticum aestivum
  unsure (1)..(171): unsure at all Xaa locations
  Clone ID: PAT_TA_59775.pep
PAGLGRVPDKTWTLCGXPDYLAPEVVSNKGYNKSVDWWSLGILIYEMLCGYTPFWDSGSPMKIYENILKGKVKYPAYVNADAQNLLERLITADLTKRLGNLYGGPADVKNHPWFAEVTWDRLARKDIDAPYTPPVKAGAGDASQFDRYPEDPEKYGMVGGTDEYGHMFTEF

SEQ ID NO: 165358 - protein, 154 aa, Triticum aestivum
  Clone ID: PAT_TA_59776.pep
RPGSGQSSSSANRLVTILMYLSDIKQGGETVFPRSEDTQAKEGTPSECAGYAVKPVKGNAVLLFNSRPDGVADKDSQHEFCPVVEGEKWLAIKHMYASKIDKSKPSPASEDDDCTDEDGNCVSWAAAGECDKNPVFMIGSSDYYGTCRKSCHAC

SEQ ID NO: 165359 - protein, 135 aa, Triticum aestivum; identical to SEQ ID NO: 130416
  Clone ID: PAT_TA_59777.pep

SEQ ID NO: 165360 - protein, 143 aa, Triticum aestivum
  unsure (1)..(143): unsure at all Xaa locations
  Clone ID: PAT_TA_59778.pep
MSTPARKRLMRDFKRLMQDPPAGISGTPQDNNIMLWNAVIFGPDDTPWDGGTFKLTLQFTEDYPNKPPTVRFVSRMFHPNTYADGSICLDILQNQWSPIYDVAAILTSIQPLLCDPNPXNSPANSEAARXLSENKREYNRKST

SEQ ID NO: 165361 - protein, 166 aa, Triticum aestivum
  unsure (1)..(166): unsure at all Xaa locations
  Clone ID: PAT_TA_59779.pep
MARGLNNDREQALLPRCHCMLDKLARSCLAPSPSSVPHQAKSRLPLILILRXRLKYVLTYREKIIILMHSCIMSDEKLLTDHTYPAXYMDVTSTAKTGDNXTLLSHCNGRFHLHSVSPDDVKXPLQGLDMSSSEQKDIPYLNRYDVRSIQISQPLITCNDTIYSHL

SEQ ID NO: 165362 - protein, 71 aa, Triticum aestivum
  Clone ID: PAT_TA_59780.pep
QYRYFGCYQRGGEWQTPPVGNQNSQALNTCSDGQLLTNRGTNRQNTGWVQEGMSMTTKKTSKVIREKDLVA

SEQ ID NO: 165363 - protein, 212 aa, Triticum aestivum
  Clone ID: PAT_TA_59781.pep
RPGCGLASLSPAPLLPVAFRFVSLLCLSPSTPQREQRARRSGGDQDERPQVRLPLPRARLLPGRAIPGAGRPVPGAAGDGAAAVRRAAAARPAQLPRRLFGCALLLLPDRRVLLRPLHHLRRLDQLARPGHPAWHAVNCTNRWPHQGYLPRCCHAIYDDLSLYIYIYMYVWICLLLSLLTNGAACLCNSNPSISNRGFMILPSSIRLHFLWL

SEQ ID NO: 165364 - protein, 271 aa, Triticum aestivum
  unsure (1)..(271): unsure at all Xaa locations
  Clone ID: PAT_TA_59782.pep
MSARWFDLPLESKMKVVWTTPEANRGYSAPGREKVSQLTDLADVEKMRAALPDIKESLEIGRENEAGHPNYWLEESGELVGFRKDMLGFFEQCRQLHVEVMKAIAVGMGLDDGFFDGFVDVGDNTLRLLHYPSVQSNVFKMNPGTVRAGEHSDYGSITLLFQDVRGGLQVKSPTGQFVDATPIEGTVVVNAGDLLARWSNDMIKSTIHRVVEPPQKEAESYPPRYSIAYFCNPNFKSFIEAIPGTFETEKGXKYDGIHSGXYLXQRLTATY

SEQ ID NO: 165365 - protein, 261 aa, Triticum aestivum
  unsure (1)..(261): unsure at all Xaa locations
  Clone ID: PAT_TA_59783.pep
RPGRDPLHLGVGAKRTDLKYVFEGSEDFQVLPTFGVIPPFNTEMPFDFDNIVPNFSPMMLLHGEQYLEIRKFPIPTNARLVSRGRLLEVVDKGNASIARSSTTTVDANTGEDVFYNEASVFLRGTGGWGGPKRGADRGSATAANKPPARAPDVVVESPTNDDQAAIYRLSGDYNPLHIDPEFAKVGGFKAPILHGLCSFGVAGKAVYERFGAFKNIKLRXFAGVCIPGQTIVTEMWREGKQIFFQSRVKETGKPAIDGAAA

SEQ ID NO: 165366 - protein, 58 aa, Triticum aestivum
  Clone ID: PAT_TA_59784.pep
VTIKLSISYGISDTKLTCTRHTRADNKHPIRQITPKQKLLADCTEHKLCCVIHSYQFS

SEQ ID NO: 165367 - protein, 217 aa, Triticum aestivum
  Clone ID: PAT_TA_59785.pep
GRVAKLHKHKASVNGKQSVEAVEAHLIDPQEKVEESASVDTKKSLFKNWPLMSSIIVYCIFSYHDMAYTEEDARADQEDTLLHLGHHTRLTPGEARAMSSELLLLLPDAPVAKPPSIPSTATTTTLATAADGTTTISWLGQDQLLEIFLRLPSLPALVRAKLTCRSWLRSFRNLFRALHPGAPHQDLPRCRRRQCPACLPPFSRSDPDVNKDITLVD

SEQ ID NO: 165368 - protein, 115 aa, Triticum aestivum
  Clone ID: PAT_TA_59786.pep
TTGGGGGGNTYIHTYKLLMITTTEIRHYYYLLPSFLPTECSHHRHTAAKPSHHMKAPVCLSNKTMMVCSCPPPHGHPHHPHYHGQQQQQEEAWPSAGSPDGCTRAPAHPEPDPAG

SEQ ID NO: 165369 - protein, 269 aa, Triticum aestivum
  unsure (1)..(269): unsure at all Xaa locations
  Clone ID: PAT_TA_59787.pep
AGRAGKSKDRPSDEMLEAIRQYVAMSRDEHKTVRNASEEHAQSIITAIFNGSNPALATQLDDQKHAQCLEYYSALLSVRDREGITTAFCRQPPDLFTATIKDLFAAYEPMIRTMHSQIDLREHMESAQLFIDEFIKTSKPNESGSLPTVDDYVGLFMRNRELMYRWVHAFAKSCPDVWKEMKNWTQDAVLKFRQERNPVSVTKGEDSDKTNNGTADMSVMDEKLNKLFQSIPEKSQKDVLNALDXHAAYLAQVEALSLCRLHVSSTLTT

SEQ ID NO: 165370 - protein, 190 aa, Triticum aestivum
  unsure (1)..(190): unsure at all Xaa locations
  Clone ID: PAT_TA_59788.pep
MAAAARRALLLLLAAAAVVLLAAPPASAARPCGRAQTLLISFSSFSRPNPDPADPSPLTTTVVTVLRVRRLGPHRFHAHDQNHLQIRRPAESLPAVGTPETDADAASSFQERAKDILVVVSGLLFGFGCGALTAASMYLVWSLVASTGAASPYEELYRDDDDEDVSDDGXESPKKAGYVIIHGAQGRRWR

SEQ ID NO: 165371 - protein, 186 aa, Triticum aestivum
  unsure (1)..(186): unsure at all Xaa locations
  Clone ID: PAT_TA_59789.pep
AREVVLRLSDGSPCSDDSNAYDKDQAVKDAQVVKCGSITKTAKNIRTSVTFHRPQTLSKXLRIPSYPRISTPAINTLQLYHILKHPLTTDPAMNNIDHHXTPLVFTRPPVRPIKEKIYAASLNMYXLQPDRDNTLITPDGQNKAHPNLTPYYDALDVRNNIAIISVRRTDLQIGTCVVNTYGIVAL

SEQ ID NO: 165372 - protein, 155 aa, Triticum aestivum
  Clone ID: PAT_TA_59790.pep
MSRPLPPMLSVPEKKTAAAELFRDRHFFNSPVFTDLRDARASVSAPNPQTQPPSSSRALLLRYHRLLSSARDDPCAFDDNLAFTWHDAFRPNLKHTSASLRFEKAAVVFNVGAASSRIAAAVDRAAEGGVKEACGEFQRAEGAFREEGQMMEGGE

SEQ ID NO: 165373 - protein, 62 aa, Triticum aestivum
  Clone ID: PAT_TA_59791.pep
GSKEQGMLLWRFSMSKMCNGVSRTLLIRNFTIYDVDSVGAANRRRSSPSITGIFRSLGGRRW

SEQ ID NO: 165374 - protein, 143 aa, Triticum aestivum
  Clone ID: PAT_TA_59792.pep
NARTPMQWDASPNAGFTTADANPWMRVNDNYTDINAASQTSDSNSVYSCYRQVLGKRKEYKDIFVYGNFQLVDESNDKIFAYSRRADSGETALVVCNFSVDSVAWKLPGEAREVLTSPAGRTLNDLNSGEIKLAPCEAFALLK

SEQ ID NO: 165375 - protein, 168 aa, Triticum aestivum
  Clone ID: PAT_TA_59793.pep
MAAATATTTMSSATHPLVTKWSSRYRGATVEDLDPPAALSLNPSDAISLALLSAFERDYTHLTIVDSDNRALLGYISIPHLQSLLDSGKVKPNDPLSTAMTRFQRKGRTYKVITMETTLEELEDFYRGGVPEGPWEQEFAVITDEKRRFVLGVATVQDLEEFVKRRPE

SEQ ID NO: 165376 - protein, 206 aa, Triticum aestivum; identical to SEQ ID NO: 150041
  Clone ID: PAT_TA_59794.pep

SEQ ID NO: 165377 - protein, 255 aa, Triticum aestivum
  unsure (1)..(255): unsure at all Xaa locations
  Clone ID: PAT_TA_59795.pep
MREIVHLQTGQCGNQIGAAFWQTISGEHGLDSNGVYNGTSELQLERMSVYFNEASGNKYVPRAVLVDLEPGTMDAVRAGPFGQLFRPDNFVFGQSGAGNNWAKGHYTEGAELVDQVLDVVRREAEGCDCLQGFQITHSLGGGTGAGMGTLLISKIREEFPDRMMATFSVVPSPKVSDTVVEPYNATLSVHQLVENSDETFCIDNEALYDICMRTLKLSNPSYGDLNYLVSXVMSGVTTCLRFPGQLNSDLRKLAV

SEQ ID NO: 165378 - protein, 175 aa, Triticum aestivum
  unsure (1)..(175): unsure at all Xaa locations
  Clone ID: PAT_TA_59796.pep
GSTQFPXTPSXPPPGPSPARHPPLQSNEERHRAATREQXTQARHGRMRXRRSXXTNEEAPXHKTHRXRRTTKEATRRTKRERAARTPKEDTTKTXPGRTTAGDAEPTHQTNTTPRRRSQRATNRPRATGPRDTAKXEEPRRRTRSHQPRRPTRTQARQPRRETARPPNPQPKTTP

SEQ ID NO: 165379 - protein, 104 aa, Triticum aestivum
  unsure (1)..(104): unsure at all Xaa locations
  Clone ID: PAT_TA_59797.pep
MVKXVVVLTGREGVKGTIFFTQEGDGPTTVTGSVTGLKEGLHGFHVDALGDTTNGXMSTGPHFNPVGHVYGEPEDEIRHVGDLGNVTAGADIGVCYHTMLLNAQ

SEQ ID NO: 165380 - protein, 65 aa, Triticum aestivum
  Clone ID: PAT_TA_59798.pep
GINTDRYHSLLANYNASFVQNFFCILKSRAAGCLLVAHTEGRPEDKNLQQDDGLIHKDDDSGLIC

SEQ ID NO: 165381 - protein, 60 aa, Triticum aestivum
  unsure (1)..(60): unsure at all Xaa locations
  Clone ID: PAT_TA_59799.pep
MXXKWVRAEVYPLXAXTGVXIXICAFXLLRNITXNPEXRXXKMGRVVGVVENHEEGRFLK

SEQ ID NO: 165382 - protein, 110 aa, Triticum aestivum
  Clone ID: PAT_TA_59800.pep
LIQSSPPRRICIQLLTSLVPSLFLIPVLPLICSSGCEASKVAGAPRSAGASAATGSRPLPSHPLCVCMFLSFPHIVLCFQVVGACPAMARSRQTLSWIRSPYSLHASVLL

SEQ ID NO: 165383 - protein, 145 aa, Triticum aestivum
  Clone ID: PAT_TA_59801.pep
MMFIKKKKNIKKKKKKNKIPLLTPLSSLRPPPPSPFPSPIPTPTPPPPPPPPPSLPFLPSPSPSSSHLPSPPPTILPPLPIPPPPPPPPAPPPFPPSPVCRPPPPPPPPPPLPLSPHPSPPTPPPSLLPPPPLPPPSPPPSPPHS

SEQ ID NO: 165384 - protein, 80 aa, Triticum aestivum
  unsure (1)..(80): unsure at all Xaa locations
  Clone ID: PAT_TA_59802.pep
ILRLSSSCLCHHPDLXMCXKXVXXXIXRLXDKWXGKCPVXDSYVXPTILVXIXDEWSFGNYQXKCVVCXGEGISXXFYCX

SEQ ID NO: 165385 - protein, 88 aa, Triticum aestivum
  unsure (1)..(88): unsure at all Xaa locations
  Clone ID: PAT_TA_59803.pep
KIQSXHDSSKXPQLYKAVRTXRGQTIQPPHIGQPLLXNRGXHHXHVXHSLYELRVSPAPTTVSSLSLSPSLTSPXPGPXRTPHSDTPG

SEQ ID NO: 165386 - protein, 106 aa, Triticum aestivum
  unsure (1)..(106): unsure at all Xaa locations
  Clone ID: PAT_TA_59804.pep
TASISSPAMPGRGKGGKGLXKGGAKRHRKVLRDNIQGITKPAIRRLARRGGVKRISGLIYEETRGVLXIFLXNFIRDSVTYTRHARRKTVTXMDVVYPLKRQGRTL

SEQ ID NO: 165387 - protein, 275 aa, Triticum aestivum
  unsure (1)..(275): unsure at all Xaa locations
  Clone ID: PAT_TA_59805.pep
RPVRNKADPIPTYASRTDRSQGSLVLLPKIFVNTLTGKTITLEVESSDTIDNVKAKIXDKEDISLDQQRLIFAGKQLEDGCTFADYNIQKESTLHLVLRLRGGMQIFVKTLTGKTITLEVESSDTIDNVKAKIQDKEGIPPDQQRLIFAGKQLEDGGTLADYNIQKESTLHLVLRLRGGMQIFVKTLTGKTIMLEVESLDTIDNVKAKIQDTEGIPLDQQHLIFAGKQPEDGRTLADYNIQKESTLHLVLELIAGKYTTCSCNGSVPLFQFFLQV

SEQ ID NO: 165388 - protein, 134 aa, Triticum aestivum
  unsure (1)..(134): unsure at all Xaa locations
  Clone ID: PAT_TA_59806.pep
FELPALMSIICPLRIDRQAAQHPPALHWRSRQTQAVALEAMHALMCTSFFLNFGVVKGDFCSLASSWVWSGRRRVGVKDGFACRSSSGQSNSSLVSSLDVALNVLYRKXPVKCTGTSIFFFKKKXKGKKXKKGP

SEQ ID NO: 165389 - protein, 101 aa, Triticum aestivum
  Clone ID: PAT_TA_59807.pep
MASDGVVALYGNNKAVVEPSAKPAAATFSVKVGLAQMLRGGVIMDVVTAEQARLAEEAGACAVLALERVPADFRAQGRAARLSDAALIRRLPRAVTLPPTA

SEQ ID NO: 165390 - protein, 100 aa, Triticum aestivum
  Clone ID: PAT_TA_59808.pep
QQQHILLPKESSFVVQPLVRYVITDILELTLRYFAKEGETTDDDLVQKPHPSAYYIGAIGSALGGLVLHADDAADALALRHEVERLVDLRERHAVCRPGR

SEQ ID NO: 165391 - protein, 41 aa, Triticum aestivum
  unsure (1)..(41): unsure at all Xaa locations
  Clone ID: PAT_TA_59809.pep
MXQESWKEXEETVQXPEEPILSVNNXGFLGRSMTNXMXSKC

SEQ ID NO: 165392 - protein, 45 aa, Triticum aestivum
  Clone ID: PAT_TA_59810.pep
ASWGFFFFFYNFVYFFFFFFFFYFFFFFFFFFFFFFFFFQRRTEF

SEQ ID NO: 165393 - protein, 72 aa, Triticum aestivum
  Clone ID: PAT_TA_59811.pep
RPGREAMANTSILQVFIVFIIAQVCLLMMMATPIAQAAGRLMGYNPVCCPRDIYCCGFGGVMANGTASSTKP

SEQ ID NO: 165394 - protein, 80 aa, Triticum aestivum
  Clone ID: PAT_TA_59812.pep
MAEKFAESANNVIIEEVNKGLNPGMIVLLVVATTLLLFFVGNYALYLYAQKTLPPKKKKPVSKKKLKREKLKQGVSAPGE

SEQ ID NO: 165395 - protein, 96 aa, Triticum aestivum
  unsure (1)..(96): unsure at all Xaa locations
  Clone ID: PAT_TA_59813.pep
MDYGFNRALQLPPLIRFHPTDKELWMYYLCRKXATLSIAGTAIAEVDLHNIEPWRLYGERXLGGPYSKEWYFFSTWDRKYPNGSRPNRADGTGILE

SEQ ID NO: 165396 - protein, 254 aa, Triticum aestivum
  unsure (1)..(254): unsure at all Xaa locations
  Clone ID: PAT_TA_59814.pep
RPGWELIFPPSSIHNPRLITNLFRKTPHNLLAHRIPGSDPRHSAPESPPISALTSSRSDKAVNNSKIMATQLITLPAVERLSPTCIRILGGNPGKFTLQGTNTYLLGTGRSRLLIDTGEGRKAWITSVRETLQRENAIIDTALITHWHHDHIGGIKDLLSTSPKTRVYKHTPEEGQLDIKHGQRFEVEGATLTAAYTPGHTKDHVVFVLEEEDAMFTADNVLGQXTAVFEDLVIYLQSLEEMKPLXQGRAYPGH

SEQ ID NO: 165397 - protein, 171 aa, Triticum aestivum; identical to SEQ ID NO: 141927
  Clone ID: PAT_TA_59815.pep

SEQ ID NO: 165398 - protein, 74 aa, Triticum aestivum
  Clone ID: PAT_TA_59816.pep
SRLPSDLDTMRCGHKDDSCPSIEYLSLDAGIATATLSQNKWRHWTESTRARVISLDTTRNYQSRLYFVMPLSAT

SEQ ID NO: 165399 - protein, 88 aa, Triticum aestivum
  unsure (1)..(88): unsure at all Xaa locations
  Clone ID: PAT_TA_59817.pep
YCPQMTMXIMIPFFQQXKXINFIMFYAXVVXETXGXKXDXSLMXXXXSGLVNVFAKLVYVFTVERLGRXRMFLYXGSHMLVRQLVVGT

SEQ ID NO: 165400 - protein, 150 aa, Triticum aestivum; identical to SEQ ID NO: 123265
  Clone ID: PAT_TA_59818.pep

SEQ ID NO: 165401 - protein, 100 aa, Triticum aestivum
  Clone ID: PAT_TA_59819.pep
MSRGGSAGGGQSSLGYLFGDGEPAKPAAAPAAKPAPAEKPALAAADVTKQIPAGIPGSRANNYYRADGHNTGNFLTDRPSTKVHAAPGGGSSLGYLFGGK

SEQ ID NO: 165402 - protein, 175 aa, Triticum aestivum; identical to SEQ ID NO: 115797
  Clone ID: PAT_TA_59820.pep

SEQ ID NO: 165403 - protein, 104 aa, Triticum aestivum
  Clone ID: PAT_TA_59821.pep
RPGSGTRTTPGHGAPPPPDPAPATNHPTPPAAGHHPAPPATRPLPPHLLLRHRLPSWPPRPPPTTTFFPLEHKPTPTASYPWRAACRPPFPIFSLIPSSFQAAT

SEQ ID NO: 165404 - protein, 194 aa, Triticum aestivum
  Clone ID: PAT_TA_59822.pep
MGMEKTHINIEVIGHVDSEEATTTGHLIYELGGIHQCVIERFENEAAEMNKRTFEYVWVLDKLKAERERGITIDIALWKFESSDYYCTVVDAPGHRDFIKNMITGTSQADCAVIIIDSATGVFEAGISKDGQTREHALLAFTLAAKDMICWCDEMDATTPNDSKARYEEVDEEVSSYLQRVGYNPEPVPFVPIS

SEQ ID NO: 165405 - protein, 84 aa, Triticum aestivum
  Clone ID: PAT_TA_59823.pep
MKVKILQWHAVASWTWDAQDETCGICRMAFDGCCPDCKFPGDDCPIIWGACNHAFHLHCILKWVNSQTSIPLCPMCRREWQFKG

SEQ ID NO: 165406 - protein, 99 aa, Triticum aestivum
  Clone ID: PAT_TA_59824.pep
CAALGPAGSGLLSSAFYQSDISHSSIKKWALHVLQRRLSHYNHRSDNSSNRHAHHQYIPPFSQTDFDERQRLWQWDRWLILLRWVMFIRRLRGGNQSCE

SEQ ID NO: 165407 - protein, 218 aa, Triticum aestivum
  unsure (1)..(218): unsure at all Xaa locations
  Clone ID: PAT_TA_59825.pep
MQIFVKTLTGKTITLEVESSDTIDNVKAKIQDKEGIPPDQQRLIFAGKQLEDGRTLADYNIQKESTLHLVLMLRGGMQIFVKTLTGKTITLEVESSDTIDNVKAEIQDKEGIPPDQQRLIFAGKQLEDGRTLADYNIHKESTLHLVLMLRGGMQIFVKTLTGXTITLEVESSDTTDNVKDKIQDNDGIPPDQQRLIFAGKQLEDGRTLADYIIQKEST

SEQ ID NO: 165408 - protein, 78 aa, Triticum aestivum
  Clone ID: PAT_TA_59826.pep
MSCCGGNCGCGTACKCGNGCGGCNMYPEVVAAGATLLVSATATHKASSGGMEMAAENGGCGCTQCKCGTSCGCSCCSC

SEQ ID NO: 165409 - protein, 89 aa, Triticum aestivum
  unsure (1)..(89): unsure at all Xaa locations
  Clone ID: PAT_TA_59827.pep
MQIFVKTLTGKTITLEVESXDTIDNVKGKIQDKEGXPXDQQRLIFAXKQLEDGRXLADYNIQKXEXTLHLLLRLPRRNNPXLLXGPLPP

SEQ ID NO: 165410 - protein, 158 aa, Triticum aestivum
  unsure (1)..(158): unsure at all Xaa locations
  Clone ID: PAT_TA_59828.pep
MAASVACSFFFDAELLGEAGMPAMDACALCAKQLARDRDVFMYRGDTPYCSEECRHEQMHLDAVSAKQAAXGGSSGSRRRRSPTVCSGSPGRCRSQANRLAAECFVWIDKICILKNHRRLRLSGRCSSLVRWRQLGAAYRRQGRAAASGGTKHVSMAS

SEQ ID NO: 165411 - protein, 51 aa, Triticum aestivum
  Clone ID: PAT_TA_59829.pep
KTRAMNQVRQRVFQQAVQGALGTLNSCLNTELHFRTIRANIGILGSLEWKR

SEQ ID NO: 165412 - protein, 251 aa, Triticum aestivum
  Clone ID: PAT_TA_59830.pep
MSGKTFNVGIVGYGMSAKIFHIPFLTQTPQLKLHAIVQRSPKEGNSAPADYPDIKHYTDYKQLFADSDVDLIIISTPPNNHFELTKAALEAGKHVLTEKPFVPTSAEADKLIEIAKQNGKLLIVYQNRRWDSDFVTLKKLISEGTLGRIFQFDNHFDRYRMVPSNNWKLDLPLSQGGSALFDLGTHLIDQAYVLFGKPQSVHGRLLSQRSGKFDFEKPDGVSAELTYPDGLIVNIRISVLSAELEQPSLLG

SEQ ID NO: 165413 - protein, 130 aa, Triticum aestivum
  unsure (1)..(130): unsure at all Xaa locations
  Clone ID: PAT_TA_59831.pep
LFSAIAARRAHAASSLALLVVALVLSAAPAPAEGAVANCGQVLIYLAPXISYVMGRVSVPGAACCSAVRALNASAATPADRKTTCTCLNHQAIGMSGIKPNLVAGIPGKCGVNIPYIISQGTDCSKVRYA

SEQ ID NO: 165414 - protein, 134 aa, Triticum aestivum
  Clone ID: PAT_TA_59832.pep
LASRPSGVYKYASERFPGLFYEPTWVLDGNRRSPRKGTRVGIPPNGLSALLPRRPTLGREGGHCAREIDASVHVERRGRGSEDAVRARQRARRRKEGLPVRMRELRLAGGPGAMAIESGDTAVTRFWDGSDPAG

SEQ ID NO: 165415 - protein, 159 aa, Triticum aestivum
  Clone ID: PAT_TA_59833.pep
MAKRITKEFAEISQNPPEGFSVSLPPNESIHTWHVTLSAPASTVYHPGKFGILLSLPTDYPFKPPVVKFVTRIYHPNVTNDNLGNICLGLLKPDAWKPSTKLYGVLEALRNLLEEPQLDSPLEDRIAQQYQTDRAAFEQAAKQNVQNHAMDPPVFPPVA

SEQ ID NO: 165416 - protein, 79 aa, Triticum aestivum
  Clone ID: PAT_TA_59834.pep
GMLLIRTAALGPRGLFFFLFFFFFFFFFFFFFFFFLPEISCIAIHYNKQRGNHPYHSYASHSSSNVTTTCVFTLTRTGR

SEQ ID NO: 165417 - protein, 62 aa, Triticum aestivum
  Clone ID: PAT_TA_59835.pep
MGKVHGSLACAGKVKSQTPKVEKREKSKVPKGRALKRLKYTRRFVNVTLTGGKRKMNPNPGS

SEQ ID NO: 165418 - protein, 226 aa, Triticum aestivum
  unsure (1)..(226): unsure at all Xaa locations
  Clone ID: PAT_TA_59836.pep
MLAIRALRTPASRQALRTAAPRAAIFYNRCYSTSGDRVAKYNGTKDAKGNFLVSLIEGDGIGPEIAQSVKDIFAAAKTPIAWEPVDVTPIIKDGKTAIPDAAIDNIKKNKIALKGPLATPIGKGHVSLNLTLRRTFNLFANLRPCRSVAGYETPYDNVNTVLIRENTEGEYSGIEHVVVDGVVQSIKLITREASERVLRFAFQHAESIGRKKVRVVHKPTXMKLSD

SEQ ID NO: 165419 - protein, 99 aa, Triticum aestivum
  Clone ID: PAT_TA_59837.pep
YLQLYQHIVLSGGSTMYPGLPSRLEKEILDRYLDVVLKGNKDGLKKLRLRIEDPPRRKHMVYLGGAVLAGIMKDAPEFWITKQEYQEEGVACLRKCGQA

SEQ ID NO: 165420 - protein, 136 aa, Triticum aestivum
  Clone ID: PAT_TA_59838.pep
MARTKQTARKSTGGKAPRKQLATKAARKSAPATGGVKKPHRFRPGTVALREIRKYQKSTELLIHKLPFQRLVREIAQDFKTDLRFQSSAVSALQEAAEAYLVGLFEDTNLCAIHAKRVTIMPKDIQLARRIRGERA

SEQ ID NO: 165421 - protein, 101 aa, Triticum aestivum
  Clone ID: PAT_TA_59839.pep
LVWMTNGNCTAFHTSPPIFSELLRHMRSLFKTSGSTTIPSLIFPDNRTRNEEVEYQLGNGNHDQIARTAIPFVDTPDIRTMRHYEPLLPDHDSGKIDVATD

SEQ ID NO: 165422 - protein, 114 aa, Triticum aestivum
  Clone ID: PAT_TA_59840.pep
ARFLEPNASGKTADERWRPTIVISAVQRTMVLHNYLCMTISQNIAQCSACAQYHRQQLSATFVFSTVALHTLSCTAPQDPSGYNGLLMNMRLRGTVRAGGVLLLARGGQEKPGR

SEQ ID NO: 165423 - protein, 31 aa, Triticum aestivum
  Clone ID: PAT_TA_59841.pep
GPFFFFFLKKRLLNPMGIYRNSPMRGSNPQP

SEQ ID NO: 165424 - protein, 65 aa, Triticum aestivum
  Clone ID: PAT_TA_59842.pep
DCPHWAPRIACGPRCARRVRLGECDRQLVYERQLATTINNMCNSKQACMGARRPSIIIYIVSLLN

SEQ ID NO: 165425 - protein, 271 aa, Triticum aestivum
  unsure (1)..(271): unsure at all Xaa locations
  Clone ID: PAT_TA_59843.pep
RPGLDFFPPKHPSPFLLFPSQANPLRSPRILLLPLPLAVFGSGPKWHSTTRRRCCSGSTPPWLKPLLATSFFGQCKMHADAHKCECNMYCLDCVNGALCSQCLAYHHGHHAIQIRRSSYHDVIRVSEIQKVLDITGVQTYIINSARVVFLNERPQPRPGKGVTNTCDVCERSLLDTFRFCSLGCKIVGTSGEFRGRKRHAGGKKMKLKLKKAAASDSDDSSTITSGGSDKSSVXRSFSPSTPXXTANSYRSAKRRKGIPHRSPXRSLIVEF

SEQ ID NO: 165426 - protein, 117 aa, Triticum aestivum
  Clone ID: PAT_TA_59844.pep
AGRVLLPCRGSSRIARTASARARPTPAPPRRQPTRARRTSRRRPPRGSGWPAPTAPSRSDPDGRTDGARRLARSPQDIVCRALSILMYSLGKKSNSERKKERNKIEFIAKKKKKKGP

SEQ ID NO: 165427 - protein, 57 aa, Triticum aestivum
  Clone ID: PAT_TA_59845.pep
FMFIMNHLIRHRNKYYKKFTGKSLSKNASNQSRNNEILIKKKYYTMYTTKKKKKMDY

SEQ ID NO: 165428 - protein, 142 aa, Triticum aestivum
  Clone ID: PAT_TA_59846.pep
AGRARESTSPHSAYPSSISHHSLSLSLSSVHGDHGQSSGRGGGRRQQRGQSSGSGSGGQQRGQSSGGGTCGCSSSECRRRSARRAAHRLEEEGQEGCNHISSRSGDRPGSDCGAVPPTLEKVESVACSECFCGIEGHDRVRG

SEQ ID NO: 165429 - protein, 153 aa, Triticum aestivum
  Clone ID: PAT_TA_59847.pep
RPGRDTTSMLTPPAEVSTDRKIASNMRPGIRQIADLVINFLNQVSIINSEQRASELLVEKERLLNSLNDWYKDFEMAQTVGEIMTVNHCFLKLLHTVMRVVLLGTLDYETDFDGRLKDENESIQALTDEINERLRDYDMRRGIEGGLRQQSEV

SEQ ID NO: 165430 - protein, 57 aa, Triticum aestivum
  Clone ID: PAT_TA_59848.pep
VPNLYFIINNANFNSTYLLLCLAKKRSSPKAQIKLTCRGACYNKIWLTFIISPSPAG

SEQ ID NO: 165431 - protein, 110 aa, Triticum aestivum
  Clone ID: PAT_TA_59849.pep
KPNRRPNTLKSVLVPFPAAAAKAYHHARTRTEASRAEKTTAKTTVRLPAPDVASALFLLVVPVAAAAAAGEVVAAFLPSCSRAYCLKISASLESGDMLMTLVVAAETGPA

SEQ ID NO: 165432 - protein, 96 aa, Triticum aestivum
  unsure (1)..(96): unsure at all Xaa locations
  Clone ID: PAT_TA_59850.pep
XXRDAKHRDAYPVFSPGASMEDCVPLETMLGLLIPYEDLAPAHDIPGNHWCSRCGQVDHVKHPPLRQHVRPHLSNYCRASAHVSNPECCINRVAQA

SEQ ID NO: 165433 - protein, 99 aa, Triticum aestivum
  Clone ID: PAT_TA_59851.pep
GAFFFFFFGYEPNRRLIKFDCIISTTEIHVYIKLQRIKVKMSPVQKLASIYSKPEASVNRISLRRTAPSRIMKQITLRNENGLSLNSMSFFASKPNPAG

SEQ ID NO: 165434 - protein, 42 aa, Triticum aestivum
  Clone ID: PAT_TA_59852.pep
LLLSKPFPSQLLVSIFMETHTSDEIHGMSTLVTQKKKKKRPL

SEQ ID NO: 165435 - protein, 117 aa, Triticum aestivum
  unsure (1)..(117): unsure at all Xaa locations
  Clone ID: PAT_TA_59853.pep
MAPDTFLFTSESENEGHXPDKLCDQVSDAAVNACLDQDPDSKVACETCTKTNMDMVLGEITTKATVDYEKTVRDTCRNIGFFFAHPARDADHCEVLDNIEQQSTDIDQGVNGHSTKR

SEQ ID NO: 165436 - protein, 143 aa, Triticum aestivum
  unsure (1)..(143): unsure at all Xaa locations
  Clone ID: PAT_TA_59854.pep
AXPGPGTPLFIQQKHLQTTQHHQQTPKTAIKMVRLSLFAVLVTAITSATAFSVTQACQCLFQDGSHCCVTLKTEDCQAECLSSGRNGVKCNANGKYSNVSWFTGVGRTSAILRTKDLWKRVHGGRLSSCISLRLSGRPMDCGI

SEQ ID NO: 165437 - protein, 69 aa, Triticum aestivum
  Clone ID: PAT_TA_59855.pep
RPGWDCLLNNLFFLSPPIVPDNKLQLQLSRYGYVVDFCLLLALAFHMPPQAPSHHHILDRYLSVDSFTL

SEQ ID NO: 165438 - protein, 136 aa, Triticum aestivum
  Clone ID: PAT_TA_59856.pep
TSSACRSVAPPHEYPPQTFSCQHSPKQPPKWPADPPSASTTETVLAAPPLQSPNPSSSPPRPQAPRPSASNAVTTNAAASLALSCKEAFFTLQNNMEFGSFIRKCCRFWRRILERTMKNELRCYGKASRCDNNLIN

SEQ ID NO: 165439 - protein, 64 aa, Triticum aestivum
  Clone ID: PAT_TA_59857.pep
RGLFFFFFSKKSLYFICSKHNTMLPSHPKLDNQYLIMKTCQHQLKLHGMLPIVVISSQTLHRLN

SEQ ID NO: 165440 - protein, 132 aa, Triticum aestivum
  Clone ID: PAT_TA_59858.pep
ECGMIIGHRRSGGGGNCFRYTSQSRRQATMAHSCRRAATHWWPRQVGCVYAAASDLVSDTTTGAGAITGSLGAAAELSVGVLTGGGTSSVFSPSELRQREHPQYPPPPTSPEEGHQPQQCWASTELSERYWS

SEQ ID NO: 165441 - protein, 211 aa, Triticum aestivum
  Clone ID: PAT_TA_59859.pep
PAGLRITRTSTTASISLPAAIMSSQVAKAASNVVSIAKKQTVQSTGIWETFRRFLAIDPERSNGVPLNPHFRNPPPGANDPLQYEDPVTLPAGDIADNPYWKRDNRRNYPQLSVVNQSQFAQLLTIGSAEAPKVDLIGEAGEKQLVAVKQESETGLAKALEKASNATKDVFVNGMPPLPSGQTLNTGKWDVHKYELEESSYGEGYPCRSFK

SEQ ID NO: 165442 - protein, 146 aa, Triticum aestivum
  Clone ID: PAT_TA_59860.pep
PAGSEEGQAAGFYYADPAIRPNKPYRQFNTWMGDPARAILFKAIVDEINKNDLVNHTAKVGDQLFKDLEGLSKKYPGQIENLRGKGQGTFIAFDSPKRDKFLAEAKTLGVNIGGSGADAVRLRPMLIFQQKHADILLDAVEKIVKQ

SEQ ID NO: 165443 - protein, 155 aa, Triticum aestivum
  unsure (1)..(155): unsure at all Xaa locations
  Clone ID: PAT_TA_59861.pep
GGLFFFFFCRSXGLPLLXRCXALASGLAVXSRXXCVPRFXXXLFXLLXFXSLVGPRWGRXGEAPRXLLGPPVRGRRRGWXLAPAXCXXAXVVGLFAALFPRPXPAVAAXGVVLRVVAVRLVPVXVSSWSVGGLVVSXLAWSAAPSSSRSXSXFLL

SEQ ID NO: 165444 - protein, 136 aa, Triticum aestivum
  Clone ID: PAT_TA_59862.pep
MGRPKRNVLAAAEAALTPPDALEPNQSLVRVVKPEGNNLYTCELPNTKTLMLELAQRFRNTIWIKRGGFVLAEIYQDSKEDTRADGEIVNVVRDEKAWRKQSYWPKEFVKKSTYDLGDSEEESNVGKMPPSDSEDE

SEQ ID NO: 165445 - protein, 139 aa, Triticum aestivum
  Clone ID: PAT_TA_59863.pep
AGRVPGIRIHTGSHLDDTSTSAAAAYSYLPASQSKERKNGGQAQSGSTGGRSPPGGVPVSRDGGGREWRQAASGAGGRGHCACGDGGIAGGRCYPDGGEGRRAQANVRRRHAPRDQGLRAQPRCRALSAGHAMPCHGCH

SEQ ID NO: 165446 - protein, 70 aa, Triticum aestivum
  Clone ID: PAT_TA_59864.pep
RPGCDFASSMCVHFRLKTICMMISPNFSLTCGCLVSLKWEQQSISCSLTDGRALLCREPESPGRYSITLP

SEQ ID NO: 165447 - protein, 78 aa, Triticum aestivum
  Clone ID: PAT_TA_59865.pep
AGRAAIVDVVLGGYLGWFGAIDKIIGRRLIDPARTPLLARWEERFRAADAAKGVVPDDADKMLEFLPTVLAWIAGKAK

SEQ ID NO: 165448 - protein, 44 aa, Triticum aestivum
  Clone ID: PAT_TA_59866.pep
GAFFFFFFNFFFFFFFFFFFFFFFFFTHEYKFVVKAAFQKYIFT

SEQ ID NO: 165449 - protein, 258 aa, Triticum aestivum
  Clone ID: PAT_TA_59867.pep
MALPPPFGVGVPFQRKPSFPFEVDGRSRYSIYSFTAKLTMYSFIECIAGALFVLGCVVVTLVVIGVRALLYNFRNRPAPPLSSQLGQNAPHVTIIRPVKGLEPRLYDSIAASFRQDYPQDKVSIRLCLEDDTDPAYPVLQKVIEDFPTIDARIMLEKEDHVLSETVNMGPNPKIRNLSRAYREAKGDIVWIIDCNIWMAKGVLGRMVDKLMGYRVGGAAKPYKFVHQLPIVVDLMDFSTSLAAEGRSLLDASPREDTL

SEQ ID NO: 165450 - protein, 88 aa, Triticum aestivum
  Clone ID: PAT_TA_59868.pep
AGRAGLLFRNCGGGGRDGTGGMTQLRWLLLSSVVYFPFPRTGGDVGGATIGASSAAPAAFYGIRLHPRRLIAWEGEETREKKKKKRPL

SEQ ID NO: 165451 - protein, 89 aa, Triticum aestivum
  Clone ID: PAT_TA_59869.pep
PAGLGVLSFEASHQVQSLGKPNDMVERIKKTDFFKPIWADLDDMMKPELYIGRSAQLVDKFCGPGGKLEKKLQPYQEVIQKAKAAELNV

SEQ ID NO: 165452 - protein, 61 aa, Triticum aestivum
  Clone ID: PAT_TA_59870.pep
RPGHPHPRVQKPSLPSENLTSLAGVVEKEHRRLLARKSIIEKRKEDHERQILEKKKKKRPL

SEQ ID NO: 165453 - protein, 125 aa, Triticum aestivum
  unsure (1)..(125): unsure at all Xaa locations
  Clone ID: PAT_TA_59871.pep
MSDSDQSTVVFGLHLWELVXIGVGAAFVLLLVLLSLLCLLANRRRXXXPGXPPAAPVLHLATVAPSTHPQNPTKPPKDIQEVPSRXARRAPAGGTAPKVPLAQNSQASPQEVIQIETGKEHRITF

SEQ ID NO: 165454 - protein, 80 aa, Triticum aestivum
  Clone ID: PAT_TA_59872.pep
GPFFFFFLQRTRKQNHEAKHHTSAAHKCLSRQMHLLLGYHKGSNNTFKSQAFALAFFFFFFFFFFFFFFAGPAGASKRPH

SEQ ID NO: 165455 - protein, 176 aa, Triticum aestivum
  unsure (1)..(176): unsure at all Xaa locations
  Clone ID: PAT_TA_59873.pep
MAGRKGGDRKKAVTRSVKAGLQFPVGRIGRYLKKGRYAQRVGSGAPVYLAAVLEYLAAEVRTDVSRPFLCTPVLSVLDGXLTDFVSESQVLELAGNAAKDNKKTRIIPRHLLLAVRNDQELGRLLAGVTIAHGGVIPNINSVLLPKKSPAAAEKEAKSPKKKTTTKSPKKKVAAKE

SEQ ID NO: 165456 - protein, 98 aa, Triticum aestivum
  Clone ID: PAT_TA_59874.pep
MAITSAINDLFASIYELLASVFNTVYAIIHSILSAVLGFVQGLFNLIGDVVSGLVDVTGGVGKFVASNAAILAVGALGAFAYVRYTAQGKQVANKKTQ

SEQ ID NO: 165457 - protein, 112 aa, Triticum aestivum
  Clone ID: PAT_TA_59875.pep
AALEAGRASSRLSPPSVFPPSSRLQLGFLAPGLPPHRRPRPPCRSKDLRASRSSRARSPRRTTTRIELAYLPKKKDVNKRPEGAEGPGKPQGCAGMIRAPEQWEEMSLPTHS

SEQ ID NO: 165458 - protein, 121 aa, Triticum aestivum
  Clone ID: PAT_TA_59876.pep
GAFFFFFFDNVSSSFKSNWVPVNVSKTQSGPCNLLKKSNRVPISGKSIPPAIPASIPPAISILGRRRTPWRCLETLQQAMGRCQPLPLPRGRRDPAQAAPPRAARAGREKGGEEEKKDAHG

SEQ ID NO: 165459 - protein, 72 aa, Triticum aestivum
  Clone ID: PAT_TA_59877.pep
PAGLRIAPKYAGSLHGMTNGIGTVAAIVSTVGAGYFVQWLGSFQAFLTLTAVLYFSATVFYNIYATGDLVFD

SEQ ID NO: 165460 - protein, 68 aa, Triticum aestivum
  unsure (1)..(68): unsure at all Xaa locations
  Clone ID: PAT_TA_59878.pep
FRGFCRNFISRLSITSTLRGGPGTHSAHSEAXNRGSWAAVLXRRDWEKPGGSPIKRLGTHSPFRRWRK

SEQ ID NO: 165461 - protein, 46 aa, Triticum aestivum
  unsure (1)..(46): unsure at all Xaa locations
  Clone ID: PAT_TA_59879.pep
GAFFFFFFPFFFFFFFFFFFFFFFFFFFXAVKSKSHFLFQVTLDHE

SEQ ID NO: 165462 - protein, 110 aa, Triticum aestivum
  Clone ID: PAT_TA_59880.pep
DHPPPEPCRAVHDFLLDGGSTRSPGFLMTVASAAPLLATTPSAVAAAPAFSFLLAHVRQGPSAFFVYPRTEFFFFHRCTSTPPLSSPSSSPASRPPVPSGDGRCRLPSLS

SEQ ID NO: 165463 - protein, 179 aa, Triticum aestivum
  Clone ID: PAT_TA_59881.pep
RPGWQHPAGISELMSASESTVCYAPLGPGQEFPFTVLLRTPARPGKVISYWRLTTPTGEKFGHRLWCDVNVRVVKEESKAKPEPEVKEEEITHVEETKQEDESQASSQMIFPKLDKESPMASIHEAAVPVPVEEPKRSVNIDDEWDYSEEGFMTDEEYDILDASDEEYLEEQKKRLATK

SEQ ID NO: 165464 - protein, 178 aa, Triticum aestivum
  Clone ID: PAT_TA_59882.pep
PSRERRIPISAVVDKQRDGRSTQPVGSSPSPIHSGGDHRCQGIGSCGFLLLAYQRDADERKRASPKLCLGDAQATATLPVIASMAGCSSPGTSSPLTCVIKLEHRYLGQGVVTLQEARSSAKLSRPCPASRRNTCIYKSRKKTCSFLYFSVCYFVTLCFTCPELYLYSCCQIHRYTDT

SEQ ID NO: 165465 - protein, 73 aa, Triticum aestivum
  Clone ID: PAT_TA_59883.pep
LFIYTFQLPNAPPKVLYHTVYIRVMSYCIVLLYFHKLFVHIVKNGNREVESCIRVCIFISWFITSKKKKKKAP

SEQ ID NO: 165466 - protein, 243 aa, Triticum aestivum
  unsure (1)..(243): unsure at all Xaa locations
  Clone ID: PAT_TA_59884.pep
MPAPTALKQAESAPLANDISLPVEGADEEFLLDAPGAEDADANVLVPVEDSNDMQIDEEGRPRFAPARDIDPVTRVETRKIPIPPHRMTPLKQSWTSIYPPLVEHLKLQCRMNIKRKTVELRSSKHTTESGALQKGEDFVKAFTLGFDVDDAIALLRLDDLYIQSFEIKDVRTMHGDSQARAIGRIAGKEXKTKFAIENASRTRIVLADSKIHXLGGFKNIHLARESVVSLILGKHXXQCMAT

SEQ ID NO: 165467 - protein, 81 aa, Triticum aestivum
  Clone ID: PAT_TA_59885.pep
GPFFFFFLFFFFFFFFLQVKSTFLNVTHDKFEQACCQISNYSMMRSFLDPPQNYSDKIGYSNFGFREHSFFFYLSTTGPAG

SEQ ID NO: 165468 - protein, 232 aa, Triticum aestivum
  unsure (1)..(232): unsure at all Xaa locations
  Clone ID: PAT_TA_59886.pep
MIGVPSDRTNYSGDASGEVADGGLSVSSAPQRENVILPRLGDICMEGPSVRRQTADRGFPRIISSSSMDARGDFSAIENQVRELINDLGSDSIEGQRSATSEIRLLAKHNMENRIVIANCGAINLLVGLLHSPDAKVQENAVTALLNLSLSDINKIAIVNADAVDPLVHVLETGNPEAKENSAATLFSLSFIEDNRARIGXSGAVKPLVXLLXNGXPREEDAXTALLNYHTY

SEQ ID NO: 165469 - protein, 220 aa, Triticum aestivum
  Clone ID: PAT_TA_59887.pep
PAWPDCPILSCPTCSPKFLGDSLANKDHSLFTHTLHLHYHIYALSSSLPPFSTNDSLPQEYSFTRKTSTDQLFIMRFFTAAALLLSSVALAAPAQEQTKDCCCCDISQPAIVCQKNVKPEDCICAAVMCPVNAPTYWPATATATSTPTPTATVVKRQEDKKPATTDPAKTPCCCCSVADQAIVCEVRPEGADNTCVCPKVMCPVGAPTLTKNVGAQKTGN

SEQ ID NO: 165470 - protein, 140 aa, Triticum aestivum
  Clone ID: PAT_TA_59888.pep
GAFFFFFFLFCLAPLQIKNLRFYHATKRHGVVAQAPNPQSLGAQSRTKPAACLPTDRAHPISDPCGGKAAAPLEIPARDGGSWVGSTCLAPNSAGSPTPHGFGLGMDSFRGFPPSLAGGRKRPPPTQIESSPTGRLERRT

SEQ ID NO: 165471 - protein, 79 aa, Triticum aestivum
  Clone ID: PAT_TA_59889.pep
GYEVSSLGGYRPSRLNLTHGRRLPSTVTTLPPKTTLAGLRLQLDYVGLHLPFRYDWIYVHPRTELRERWLRMWLFVLHC

SEQ ID NO: 165472 - protein, 95 aa, Triticum aestivum
  unsure (1)..(95): unsure at all Xaa locations
  Clone ID: PAT_TA_59890.pep
VGRITGKVAFAATAAYQFRIHWVNSIIPHTLTSCISDHSFTDLIDAFLDPDLVRRLVLGLLGGGDEQERGGGDQQEEKKPRLRHGCSWGCRGXES

SEQ ID NO: 165473 - protein, 79 aa, Triticum aestivum
  unsure (1)..(79): unsure at all Xaa locations
  Clone ID: PAT_TA_59891.pep
HCGLSVLPSFQQLFIHALRWRRTDYSHDTLRLMLLFYTGTGSWELQRPLDSLCQYTYKYDNFIYIYLFMXXKKKKKKAP

SEQ ID NO: 165474 - protein, 42 aa, Triticum aestivum
  Clone ID: PAT_TA_59892.pep
AGRVPDLHLGKLGVRLTKLTKSQSDYISIPVEGPYKPAAYRY

SEQ ID NO: 165475 - protein, 48 aa, Triticum aestivum
  Clone ID: PAT_TA_59893.pep
QWHLKEYITECSEISLAHNSSASEETADQLILSHRPSKTEEFDIPTFR

SEQ ID NO: 165476 - protein, 51 aa, Triticum aestivum
  Clone ID: PAT_TA_59894.pep
GPFFFFFLLQHNFSEHNKFRQMSADLLQCWAVLRIHRATWSLTDNPPGPAG

SEQ ID NO: 165477 - protein, 162 aa, Triticum aestivum
  Clone ID: PAT_TA_59895.pep
METIYLIIGLFILFTVGRAIFADRSPIPETSGKVNKVTEASELDTVLSSNKHVVVDFYADWCPPCRAIAPVFSTLADKHASTGHLAFAKVNTDHVKEVAAKYGISAMPTFVFFTDGVPKGVSVEGLPSGHSVNVNKDGLVDRIRGADRRALEAVVQVLASKE

SEQ ID NO: 165478 - protein, 201 aa, Triticum aestivum
  Clone ID: PAT_TA_59896.pep
MAPIIPILQAERPHDKPVPRGPKSPARTAQIQSQNRRREYLARHPSYFENLEHELADPVLYERLVKRLQTASEREAEGKAKGYGRTLEADLQRGESKLSQLKESDGAGNSIGDLEHPWEKPAADKAHGILLWHAFLEERFVHGLDEDFDYRPVDANEDLDTMLRRDAQDAWFDDEEPSWIDEDEPSVQAARRQGETGVQDF

SEQ ID NO: 165479 - protein, 123 aa, Triticum aestivum; identical to SEQ ID NO: 122909
  Clone ID: PAT_TA_59897.pep

SEQ ID NO: 165480 - protein, 119 aa, Triticum aestivum
  Clone ID: PAT_TA_59898.pep
MVQRLTYRKRHSYATKSNQTRVVKTPGGRLVYQYTKKRASGPKCPVTGKKIQGIPHLRPTEYKRSRLSRNRRTVNRPYGGVLSGPAVRERIIRAFLVEEQKIVKKVLKIQKTKEKTTKS

SEQ ID NO: 165481 - protein, 71 aa, Triticum aestivum
  Clone ID: PAT_TA_59899.pep
LTVLNNVQKTNERLSVPVTKAEFAVMRTALSFALPHIMGWDQALSTHPQSTSTSASKPRFERPNPASEWDR

SEQ ID NO: 165482 - protein, 151 aa, Triticum aestivum
  unsure (1)..(151): unsure at all Xaa locations
  Clone ID: PAT_TA_59900.pep
RGLFFFFFSYXKCVPDEIMFCXYRKPPATTATYPLPATTATYPLPASNARHAPPLAAGGVHSGEAKEGVMRRGGRRRRVSPRMGRGVGERGGQEVAGGGLGRHEGELAGALAAGEPSPQVLLLLGEASGLHDEIKLAQPTTSGVMIYKLLK

SEQ ID NO: 165483 - protein, 129 aa, Triticum aestivum
  Clone ID: PAT_TA_59901.pep
MSSQPLLQTTPGKRIALPTRVEPKVFFANERTFLSWLNFTVILGALAIGMLNFGDRVAFISAFLFTGVAMCTMVYALVTYHWRAQSIRMKGQAGFDDRFGPTVLAIILLLAVVVNFVLRITDKSKNHSN

SEQ ID NO: 165484 - protein, 120 aa, Triticum aestivum
  unsure (1)..(120): unsure at all Xaa locations
  Clone ID: PAT_TA_59902.pep
MGLNLPPPPVGVQTQASRASPPMFFAPGKSRVRSPLFPNPLPPGKQRTRDFLFFSSPPPFSPPPLGKKKGTTGFFFFFFFFFFFFFFFFFFFFFFFFFFFLFIFFFFFXSFGSPAGLRAA

SEQ ID NO: 165485 - protein, 71 aa, Triticum aestivum
  Clone ID: PAT_TA_59903.pep
CGAQAPVPKFRMAHICCAITIPDSNGAPNSAPLLTLTCAISNKAKCATSNLRGAPLAKKLDAPSIKAEMRH

SEQ ID NO: 165486 - protein, 40 aa, Triticum aestivum
  Clone ID: PAT_TA_59904.pep
RPGLNRREPSMCHPCRLTCECCWFQIRRVKLIIELSRLAN

SEQ ID NO: 165487 - protein, 98 aa, Triticum aestivum
  unsure (1)..(98): unsure at all Xaa locations
  Clone ID: PAT_TA_59905.pep
AGRAARSHRANAAHLRMAATMKLTITFLLLVSALVVFGDAKKAPCAVVCVQGGHITCDNYPGQKLDGCDCQCAPKDGKGCXAPPQQRAPHPTQWHHPR

SEQ ID NO: 165488 - protein, 104 aa, Triticum aestivum
  Clone ID: PAT_TA_59906.pep
LAHSQSQCIVLYTYKRTDIMQKSQLGATFNYYTLIFRTWHVLEARANLPDDPENNAPYELILSGFHLMLMAPRTDVSSLKLAPESNGLHCLVHHYFSLGCCCRC

SEQ ID NO: 165489 - protein, 91 aa, Triticum aestivum
  Clone ID: PAT_TA_59907.pep
MSYYNQQPPVGAPPPQGYGDKAGYPPPGYPPAGYPPPAQGYPPAGYPQQGYPPQYAQQPPPHQQQQQSSGPSFMEGCLAALCCCCLLDACF

SEQ ID NO: 165490 - protein, 223 aa, Triticum aestivum
  unsure (1)..(223): unsure at all Xaa locations
  Clone ID: PAT_TA_59908.pep
MGDRAYGPSSKPVPVAAPRSANGTANGGGVGTPRPPSMVPGRVPPPPMYRPKPMQPPPGRRRSGRGWCCACCLWLTLVLVGLVFLGAIALGVFYVIYHPELPTFAVTSLRLAALNVSDSDSVTSRIEFTVTARNPNEKIAFVYGDIGAAFAADGTDIGDGTVPGFLHPSRNTTVIKGSASAAAATVDSVQAASLRSKKSHAMSVEMDSXXGFPXRQFKSKRIS

SEQ ID NO: 165491 - protein, 119 aa, Triticum aestivum
  Clone ID: PAT_TA_59909.pep
KGDESYTPIGHLPEDEHEHSSSTLLYRGGIRLVNKPLSVADIICCNTNLHKDVMSGELRPYELCSPFFYRPAIHDNCCYLYDLDCLEPFCLQCLSGKVTLVLCLYDPHNNQQDCSRASA

SEQ ID NO: 165492 - protein, 125 aa, Triticum aestivum
  unsure (1)..(125): unsure at all Xaa locations
  Clone ID: PAT_TA_59910.pep
DNKRQSRTGANKKKPKKGPHTNHPTPAAAPRRKAGGAGRRADHGQRARTRDRSERPDRKKGXSPRTTNRGTNKGGEDDKAKGNGAGHKGKPHKTNHARTGRGRNDTKRDNGAQTNKQEGNRNNRK

SEQ ID NO: 165493 - protein, 110 aa, Triticum aestivum
  Clone ID: PAT_TA_59911.pep
AGRFRVPQLNLSRRLLARPSPKSLLPHQPQPNPGGVTGDGVRHRRGRPRLRGRGGGHVRRAEQRGAWSSSYRIVCRIFVLYMSTFLVSHCGSLLIKDSFRREKKKKKRPL

SEQ ID NO: 165494 - protein, 252 aa, Triticum aestivum
  unsure (1)..(252): unsure at all Xaa locations
  Clone ID: PAT_TA_59912.pep
NIHHSFLLITTQHIPPVINIFSISITEARTNSTQCVCQLLPSCWALPLRPWAWSSILGGDSKPLIDLDVNAWTKPLEKFFGEISSEAKAVWDEVTLLAPDAVEAFKKQVLTEPKKVNRRPDSHWDHVVKGADVQSLWTEKNGEKHREVGGKLENYNLRAKKVDPSKLGVDKVKQYSGYLDDEEEDKHLFYWFFESRNDPKNDPVVLWLNGGPGCSSLTGLFLXAXPASVXQKIEIXHNPESWNNXASVIFLD

SEQ ID NO: 165495 - protein, 79 aa, Triticum aestivum
  Clone ID: PAT_TA_59913.pep
PAGSRLYEPGSRVVTNVEKDRLSLAVFYAVDAETMLEPAPGLLDDKRPPRYKKMVAKDFVAGLFEHFRQGKRFIDTLKI

SEQ ID NO: 165496 - protein, 173 aa, Triticum aestivum
  Clone ID: PAT_TA_59914.pep
MCGGAILAGFIPPSAAAKAAAAKKKQQQRSVTADSLWPGLQKKAADEEDFEADFREFERDSSDDDAAVEEVPPPPAAAGFAFAAAAEVAPPAPARLDAVQRDGPAAKQVKRVRKNQYRGIRQRPWGKWAADIRDPSKGVRVWLGTYDTAEEAARAYDAEARKIRGKNAKANFS

SEQ ID NO: 165497 - protein, 82 aa, Triticum aestivum
  Clone ID: PAT_TA_59915.pep
PAGSGGGQQQLSASGKEAAAPARMQRSGSSGGHGGYRAGHVQPALDPPSPRVAACGFCSLFGKQAPQPQHRAGGGSAKGKRR

SEQ ID NO: 165498 - protein, 56 aa, Triticum aestivum
  Clone ID: PAT_TA_59916.pep
TNNITGRCELLGGVVVISLLQLINIGLPFSTVSTHASVPKDERQGWNILPAVCQAM

SEQ ID NO: 165499 - protein, 111 aa, Triticum aestivum
  Clone ID: PAT_TA_59917.pep
PAGFRTSQNHGYAIDASTLPSDFKEYFVNLNDGSNEGMLHKTRPIFSTQFHPEAKGGPMDSSYLFDKYLQNVQLAKSNQVVFKDNRPTPLMLDIMSRERVGVEPTPLAASA

SEQ ID NO: 165500 - protein, 61 aa, Triticum aestivum
  Clone ID: PAT_TA_59918.pep
RRSGGRLLWGLPVKAKPGSSLLRRLAIGYGYNFLRRNCRSPDVVLRVPPASLLEVGMVYVL

SEQ ID NO: 165501 - protein, 54 aa, Triticum aestivum
  Clone ID: PAT_TA_59919.pep
SMILCHVIVYLESETSCCFGSCLSCVFYLWTHFARHVILHALSSSEKKKKKRPL

SEQ ID NO: 165502 - protein, 51 aa, Triticum aestivum
  Clone ID: PAT_TA_59920.pep
AGQACATSEECTVAWGVCNHAFHFHCISRWLKTRQVCPLDNSEWEFQKYGH

SEQ ID NO: 165503 - protein, 71 aa, Triticum aestivum
  unsure (1)..(71): unsure at all Xaa locations
  Clone ID: PAT_TA_59921.pep
TPATSSQVSATSRTIRERPWSPPSRWPSRTCPQSSPRGTVPWEPREXXXRGAPWAPTSSGPLRPPPPRPAP

SEQ ID NO: 165504 - protein, 215 aa, Triticum aestivum
  Clone ID: PAT_TA_59922.pep
MATIATMTMLKPAKITARSAPSSPSSSAKVASPSISLRSLQKNAAKKGALAVSPAAAAMASAFFTSLASSDAAMASQRIADVAAAAPADDNRGLLLLFVVAPALGWVLYNILQPALNQLNKMRSEKALVAGLGIGAAAAAGLAAVPEPASAAVQELAALAAVAPANDNRGLLLLFEVAPALGWVLYNILQPALNQLNKCDPTERAYVVVVASHAV

SEQ ID NO: 165505 - protein, 92 aa, Triticum aestivum
  Clone ID: PAT_TA_59923.pep
RFYLSSAFQRAAASLPRCCCCSPPAPPTPPPMDREQVTEFLGQVPLLQCLPGSSIRRIAEAVQVKHYGESRAPSPVLVLWRPRSIARPTGFA

SEQ ID NO: 165506 - protein, 261 aa, Triticum aestivum
  unsure (1)..(261): unsure at all Xaa locations
  Clone ID: PAT_TA_59924.pep
MRPILLAGHERALTQIKFNKDGDLIFSVAKDQQICAWFSHNGERLGTYHGHVGAIWTVDVNPTSTMIASGSADNTIRLWEVKSGRLIKTWEFPTAVKRVEFNEDGTKLLGVTEKRMGYLSNIVVIDINPDLNAEQNDEKSLTIVCDESKATVAGWSALSKYIIAGEDGSVSRYDAKTGDLLDNVPVHELNQPIVDLQXSPDRTYFITACKDKTSKLISARDLEGPQTYVADTPLNSATITPKKDFVILGGGQPAWMSPETS

SEQ ID NO: 165507 - protein, 154 aa, Triticum aestivum
  Clone ID: PAT_TA_59925.pep
AGRFGKKAPAFKRRRRGRAGEMAAAIPAVSADSVTGEGARTGVGAAMCAQARSGLKAKAWQPRGKRGEMAAPIPAVSPAGEDARTGVGTHEGPFSAQEWDNFKVGSREILRRFANRKRCWERMKRRAERLISGHPGEIVSDRSGGRGVGPSQFA

SEQ ID NO: 165508 - protein, 78 aa, Triticum aestivum
  Clone ID: PAT_TA_59926.pep
RGLFFFFFYEVVSTDYPKYTQNTLTAAKVSTKTNICRFNLVIATQQRDRTETAATIHGGQNGDTVCVQYNSGYILHMI

SEQ ID NO: 165509 - protein, 74 aa, Triticum aestivum
  unsure (1)..(74): unsure at all Xaa locations
  Clone ID: PAT_TA_59927.pep
RAVMVSRKSLLGVEELSKISTLREQRIKQAMLTVVLKEKKKKKRPLPPAPRLYNYRLSPFLFFFFXSSLYPSPL

SEQ ID NO: 165510 - protein, 96 aa, Triticum aestivum
  Clone ID: PAT_TA_59928.pep
FPDTLDSMTSHPLDLRTLELSGKLLKIPEWLPRLSELIKLTLSATALRTDNLALLSKLDSLFSLTFSISEANKDPDLAAILEKNKSDSRGEIFLPN

SEQ ID NO: 165511 - protein, 130 aa, Triticum aestivum
  Clone ID: PAT_TA_59929.pep
RPGRAAKAVNQALRTGAPVETVRKAAAGTNKNASAAAVAAPARKLDEMTEPAGLGRVGGDVRAAIQKARVAKGWSQAELAKRINERAQVVQEYESGKAVPVQAVLAKMERALEVKLRGKAVGAPAPAGTK

SEQ ID NO: 165512 - protein, 87 aa, Triticum aestivum
  Clone ID: PAT_TA_59930.pep
SRPAGRDLYLSVYSILKGGRRIEWGAELSSLQRELSPWPWRPPPSPPTRSRSSPSSAPSPTASTSSPSRASAPTAASPPPGRPPAGR

SEQ ID NO: 165513 - protein, 88 aa, Triticum aestivum
  Clone ID: PAT_TA_59931.pep
VLEMAETETGDHVVADSFDFPPLFVPEQRPPPPPLVFTLTIRVARYVYKLDDGSEQVVDKHDVVFDFNISGMSCFNFSDLIFKAVPIP

SEQ ID NO: 165514 - protein, 65 aa, Triticum aestivum
  Clone ID: PAT_TA_59932.pep
RRSSRPAQHHPPHNDIFSTPILINPSPPPPPQISPPTDRSDGRLHRRRQRRGEPCFILRRIEVFC

SEQ ID NO: 165515 - protein, 50 aa, Triticum aestivum
  unsure (1)..(50): unsure at all Xaa locations
  Clone ID: PAT_TA_59933.pep
CGARAXXPKTHSQQASFASVLAQFSYTSWXVEVMMEYEPQSFSWPVALSS

SEQ ID NO: 165516 - protein, 270 aa, Triticum aestivum
  Clone ID: PAT_TA_59934.pep
RPGSLTVLAEFIGGSFVEGNALAMNYFKSFGYVTCAHAVMFSNDLKLAHYVKIPPRHTFFAQIIATFISTFVCVGVLNFQMTQIDGVCTEDARWKMTCPSVNTFFTASVLWGTVGPSKIFGKNGLYTEVLIGFPLGVVVVLVVWAINKRFPHWTWTRQIHPVAIMYGGIVWAPYNMSYVWPSVPIAYFSWIYLKSRYLVSWSKYNFVLSAAWSCGIAIAGIIIFFSLQLEGTEFKWWGNTVGYTGCEDDACPLQPLDGSDYFGPSSGEFH

SEQ ID NO: 165517 - protein, 153 aa, Triticum aestivum
  unsure (1)..(153): unsure at all Xaa locations
  Clone ID: PAT_TA_59935.pep
PAGSGLPIPTSTSSLTEKTXSCSHISSYYKLNHTSTKAGSHHGRCGVLLALFAAVAAPQAADNRVRLLRLAVVARQRRREATHPRRQEQVEATRDRHGGVQVRPAQLRAQLRRRRWRRRRRRRRGRRLPAQKLQLAPASLAGAGLPSRQNRLK

SEQ ID NO: 165518 - protein, 81 aa, Triticum aestivum
  Clone ID: PAT_TA_59936.pep
SVALILLEEPGLPPSFHSHTGRCGYFDGKSVSKRDQTASIACSVAAAHYCSSPTPTYGIRALLDTDNMRHEAPPLSRWHAR

SEQ ID NO: 165519 - protein, 173 aa, Triticum aestivum
  Clone ID: PAT_TA_59937.pep
PAGFKHKKIAIQPAQTYYTMSQRQQQRSAPAPSQTQTETPTQTPETREQAPQILRLRGAHTSNGRSVQWAEDVVDNEGLGRKSSKVCCIYHKPKAVDESSDESSSDSDSDSGSDRDGAQPAGGKRQGCGHGHGHNHGRGRGSGKDKEKRAPSPNAYEKVPKPKPKDGSSETKP

SEQ ID NO: 165520 - protein, 76 aa, Triticum aestivum
  Clone ID: PAT_TA_59938.pep
ISHTGGDPIFIERPGLGGPFFFFFLFFFFFFFFFFFFFFFFFFFFFFYNCRRTNLFFEANIIVAGSGTRMRSITVP

SEQ ID NO: 165521 - protein, 124 aa, Triticum aestivum
  Clone ID: PAT_TA_59939.pep
AGRFHIAGGGAPVIEIAAQLSKQARSLTGTEAICWKAFADALEVIPTTLVENAGLNSIKVVTELRHRHEMGDKNAGVSIKSGGVNTNISKENVLQPLLVSTSAIELAAETVKMILRIDDIALTR

SEQ ID NO: 165522 - protein, 134 aa, Triticum aestivum
  Clone ID: PAT_TA_59940.pep
PAGLGLQGFFHEGPEGERGDLQQGSGGRSSPLLSSPHFRILPDPPALSEFDLDIFKDSHSFVVLRCLEKSYSNTPTTHVTITHASHIAAMLDSSHAHAPHHTTPHHNPATTLYPPSLVLRWIDRDSKGQRGFLR

SEQ ID NO: 165523 - protein, 160 aa, Triticum aestivum
  Clone ID: PAT_TA_59941.pep
LSEECQSAVLDIAQGVPTPAPEIVSDLLKNPQTDPCSFSTPASLSSEYADYSSSIIAWYGKNQDDIMSAVKECPELASLASLVPVCEASATGAPASTGLTATTTGVVPPVVSSADETAKTPAATPTSGGSSPVETNGAVAREGGLLYVAAAAVAGVVAAL

SEQ ID NO: 165524 - protein, 49 aa, Triticum aestivum
  Clone ID: PAT_TA_59942.pep
GPFFFFFFDAVGIYIYILHGSNIASWIPNLYISESSVKSREWCQKQTGS

SEQ ID NO: 165525 - protein, 98 aa, Triticum aestivum
  Clone ID: PAT_TA_59943.pep
PDKRKLHQLNTRAVNHRMSLHRSSVGVHGTEGTLMFSSIALLQQRFSELERIKEKREVRLYQILAPHGPDFTHIVSNKTRIEQSRRSDDLPPRPDPAG

SEQ ID NO: 165526 - protein, 136 aa, Triticum aestivum
  Clone ID: PAT_TA_59944.pep
SCDNSPWSISHTTRDPVCLNAQGTERDRAVYGAPLREDPRIRSSSSWRRLSFTPSPTLRTPTARAPPSCTSTTRSRALDTPSTVSPTRPRRTSGILPRAAEFTFNYPSLVSLSLRLRRTAIWPHRLLLIAASMTYY

SEQ ID NO: 165527 - protein, 215 aa, Triticum aestivum
  unsure (1)..(215): unsure at all Xaa locations
  Clone ID: PAT_TA_59945.pep
MVSAPCCEKMGLKRGPWTAEEDMTLVAHIEQHGHSNWRVLPKQAGLLRCGKSCRLRWINYLRPDIKRGNFTSEEEEAIIQLHAMLGNRWSTIAARLPGRTDNEIKNVWHTQLKKRLQSSSKSSGQAAPKRKANKPAVAASTLEDPTSDPVSAEQSLAMSPEQSLSTSSATDYSMXSSLENTGSSSSEEFQIDDSFWSETLCDVGEQAPGPGMETS

SEQ ID NO: 165528 - protein, 236 aa, Triticum aestivum
  unsure (1)..(236): unsure at all Xaa locations
  Clone ID: PAT_TA_59946.pep
MPEIAEVARIVHFLRLHVVGKRIISASATDDKNVFGKVGTSGEEVEAALKGKKIMSAGSQGKYFWIALEKPPHLVMHFGMTGWIHIKDEQTAYTNYYKKMKEGEHEQWPPRFWKFQFKTEGSPEVEVAFTDSRRFGRVRLINCPGDEIRQHSPLVENGPDPVVDVDRFTEEYLHSKMRARHVPIKALLLDQTMISGIGNXVADETLYQAKLHPEQYCDQVSDAQITTLYKMIRYVC

SEQ ID NO: 165529 - protein, 101 aa, Triticum aestivum
  Clone ID: PAT_TA_59947.pep
CLDCLFLHTKAGYMYMLPWFRNTVQPIYLEPLPPTQQQTTRPGQCYFPRSVVHPPVLRQRLIKISVRSLLPFNSSNKGLLRNKMGKELVEWFRFLDPRPGR

SEQ ID NO: 165530 - protein, 125 aa, Triticum aestivum
  Clone ID: PAT_TA_59948.pep
AGRFGNSPSPSPSIPHTRRRRALHRASALHHGVGLSLAPPHLYFTLSTSPPRRPPLHLLQRSVALRNGVTAVAAHVPEVLLLVVSNPVDDLTYLACSCFPASSVGGSGTNLHSSRFRFLVNTQDV

SEQ ID NO: 165531 - protein, 195 aa, Triticum aestivum
  Clone ID: PAT_TA_59949.pep
HTMASATSFRELIGVQPSSASPTDSVLIIIDAQNEYAEGKLRVTNVAESRKVIAALLEKYRAANGSIVHVVHATPEGAPVFTPGTKLAQEFDELKPKDGEAIIQKNYPGSFAKTDLQEVLDKTGKKKVVLTGYMAHVCVSTTARQAAERGFDVLIPEDAVGDRNIPGVGADQLVKVALSEIGDAFGTIIKSSDIA

SEQ ID NO: 165532 - protein, 148 aa, Triticum aestivum
  unsure (1)..(148): unsure at all Xaa locations
  Clone ID: PAT_TA_59950.pep
IFSPIPAVRMNTYSTKEEQMNVYYLNERDRNSPDDLPVSAXHTQILVCDLVPFTNKADYXSLDKLICISAIICILXQNVSDHNVNRYDXSYSIYFSYYAHFAPDWTYLSYKDAYLELTGXSQDFEGAYGRSSFSPIVFPFYIFYTFYL

SEQ ID NO: 165533 - protein, 144 aa, Triticum aestivum
  Clone ID: PAT_TA_59951.pep
GPFFFFFLSRPINVFDANSCWNKHLVSQASIPSSTSTLYKLHCNVHLQISQPLQTLTTVVVVPKYGLCYPPICPAPPNALTGYLVRDGHTSTPTPPMGWHPGITAIVWLWINQDASPTQNGSDRPAETCKHGNKLTPTPRNRPA

SEQ ID NO: 165534 - protein, 206 aa, Triticum aestivum
  Clone ID: PAT_TA_59952.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGR

SEQ ID NO: 165535 - protein, 76 aa, Triticum aestivum
  Clone ID: PAT_TA_59953.pep
TPRKTTTIILAPSFGWFIRILLHLSLQSSVTLTRTASLSQPACSNNTWRHIKTMLSVGSIHAVTSVSLLCSSGRRG

SEQ ID NO: 165536 - protein, 91 aa, Triticum aestivum
  Clone ID: PAT_TA_59954.pep
PLFTVSRLVTCMHCGQDMREEIALRMFPVLLRKTSHRTSTGATDTVWQQPCQPSNDWRVCTHDLGISKVFAVNDLCPRKRHTCYPNMSNGR

SEQ ID NO: 165537 - protein, 257 aa, Triticum aestivum
  unsure (1)..(257): unsure at all Xaa locations
  Clone ID: PAT_TA_59955.pep
PAVKSTYWGNFIPVTIFFQSIFGYLVLCIIYKWSVDWNGLKLNPPGLLNMLIYMFLQPGTIPEGQELYSGQGFVQVVLLLLAFIQVPILLCLKPFYLRWENNRARAKGYRSIGETSRVSALDGDEDEPNGHGNSFDEDGEGVAMISQNIDEEHEEFEFSEVMIHQVIHTIEFCLNCVSHTASYLRLWALSLAHQQLSIVLWSMTLGPALKTPGVMGVIMIVVCFTMWFFLXIAILVCMEGTSAMVHSLRLAWVESFS

SEQ ID NO: 165538 - protein, 49 aa, Triticum aestivum
  Clone ID: PAT_TA_59956.pep
AGRSGKKRDSPPLLLQRAFLSQGYSTHHRADTVKTTSPSPKKKKKKRPL

SEQ ID NO: 165539 - protein, 203 aa, Triticum aestivum
  Clone ID: PAT_TA_59957.pep
KKEKKKKPSTKYGIDTFGPSLWDGATPELAVTGPNVGSNIWLQVPFSGTVGAACYAAHEVGIPAIAFSGASGGNTAFNAKPVPERSLVYAELATTFVKKITDSGKPYLPKDVYLNVNFPKVEGKCTDASKFQWVLTRINSGLLSERDTEWCGEDRLPTETEIALKSGCYASISVGDAADKTTADAARQKIVLEKIKDMLVCVD

SEQ ID NO: 165540 - protein, 93 aa, Triticum aestivum
  Clone ID: PAT_TA_59958.pep
AGRTIQKRLKTKPIFKKDKPKGLSSLSQEQKADYTNGDLVEVAPKKAVSKGISPVKKLKMNKPQLGSPKPKSNLIREATGESESSDTLSSPPQ

SEQ ID NO: 165541 - protein, 129 aa, Triticum aestivum
  Clone ID: PAT_TA_59959.pep
AGRSPVSYDLWLAPSVGANNKYEIMIWLGSYGGAGPISDHGSTPIATLTINGSQWKLFRGPNGDTTVYSFVSTKNLGNFQGDLLPFLTYLTKSQGVPSSYVATSFQAGTEPFVGSNCVFTTSAYSLSVN

SEQ ID NO: 165542 - protein, 42 aa, Triticum aestivum
  Clone ID: PAT_TA_59960.pep
LGAFFFFFFRTAACIRLTRLFRGKVPVLLGPGQSFYDPRDHS

SEQ ID NO: 165543 - protein, 83 aa, Triticum aestivum
  Clone ID: PAT_TA_59961.pep
ADLHHLRGKQNARCAAYLICTVPRHSPSSIQQNSCHDDASDGNSNTTILWLKSRQECAAAALAVAPESHAAVGFPVSVLAKRQ

SEQ ID NO: 165544 - protein, 88 aa, Triticum aestivum
  Clone ID: PAT_TA_59962.pep
AFDKKKKKKKKKKKKKKKKKKKKKKKKKKKKKKKKKKKKKKKKKKGPKARGRSKKREPPGLKKFKIKLIKTANPKGGPGTKSPQKGVK

SEQ ID NO: 165545 - protein, 75 aa, Triticum aestivum
  Clone ID: PAT_TA_59963.pep
KEIPQTRGIHNFKNAPALRALFFFFFNFFFFFFFFFFFFFFFFFFFFFFFFFFFFFFFEMNAHKSYFIICLTFGK

SEQ ID NO: 165546 - protein, 265 aa, Triticum aestivum
  unsure (1)..(265): unsure at all Xaa locations
  Clone ID: PAT_TA_59964.pep
PAVLSIEWWDEGLVEGGSYDVLDDPSKLKFTTPDTIITEYIQHPVALEPPQDGHVPAAKPMFLVKKERQKLRRQRRMAELKETQAKIRLGLVPAPPPKVKKGNLMRVLGDVAVKDPTAVEARVNREIAERHQKHVESNEERKLTKDEKHEKLAANQQKDAEKGIHMLVFKIGSLANGQHRYKIGINADQLALTGTCIMHPEFNLVIVEGGEWGIKKFKKLMLNRIDWTENSPSRDRXXKASATRDWLLAEKTPASSRYHERMQLI

SEQ ID NO: 165547 - protein, 253 aa, Triticum aestivum
  Clone ID: PAT_TA_59965.pep
MASDAPALKPIHSLVLDTGPLIKNDPPANTLRAKAEHLYTLPVIISEIRDAATRSRVETTLLPFVTLRSPTPASVKVIRDFARRTGDLAVLSKPDIEVLALGYELECERNGGDWRLRNTPGQKGLNGKPPKPADKEESLESATDKLTIESTAETAGEPTAESEPVAESGTEKTETKDTEATAETTQTGETTEATQAAETTQTTETEAPKEPTTESTETAEPVKESADTESPQVSGEKVDETIEAVEEASGGEV

SEQ ID NO: 165548 - protein, 118 aa, Triticum aestivum
  Clone ID: PAT_TA_59966.pep
MLYELIAIVRPGSLLEVKEIAQTVGSLVLKNGGVVRGLANWGVFSLPKPISVHQMKHTHGHYFVMRYDAAAKVHHDVRNTLRLEPRMIRAAHVKLGDGKLESLSRFGPPKWKTTGSEA

SEQ ID NO: 165549 - protein, 196 aa, Triticum aestivum
  Clone ID: PAT_TA_59967.pep
PAVIQDTSLEMSVHVGIRHFSSFLKQVHDMLDDDGVFFLQYAGIRKAWQYEDLTWGLFMNKYIFPGADASTPLGWVVDKLEGTGFEIKHIDTIGVHYSATLWRWYRNWMDNRDKVEAKYGKRWFRIWEFFLAYSTIISRQGSATCFQITMVKNINSTHRIDGVETQFNLHGALDNCRADLQSWAAKNNVKTPSELL

SEQ ID NO: 165550 - protein, 162 aa, Triticum aestivum
  Clone ID: PAT_TA_59968.pep
MVRKTKPHIRNGILNLVLTARRIFVYSVCSSSISNSSADHDLRLPNGTYALTAQDCIQCRCSSNTFQLNCTALQGKKGCPAVRPCGEGLNLGQTSGAGCDSKMCAYSGYSNSSSLSIHTTVFKNQTAPACEKAGSSRSVLAGSMWRIPAISFHMVLILVCFL

SEQ ID NO: 165551 - protein, 92 aa, Triticum aestivum
  Clone ID: PAT_TA_59969.pep
AYTPSFIGGVSLGLLDIAIGCYLPWFEAIGRLAGTPPFLDAARTPKLVAWAGRFRAAEAVVALLTPVDKVEEYITSVLYPKWEVALTAPATN

SEQ ID NO: 165552 - protein, 78 aa, Triticum aestivum
  Clone ID: PAT_TA_59970.pep
RPVSDFLAAGPAFGEAPEAICLAVVSDVSSASGGAGVSGGGGPAIILGSFQQQNYQVEYDLEKNRLGFRPQPCSSSSS

SEQ ID NO: 165553 - protein, 58 aa, Triticum aestivum
  Clone ID: PAT_TA_59971.pep
GPFFFFFLKHQPYIVVHVLFFFFFFFFFFFFFNNQQLYHRYYCLHQKAIYIVFLLSTS

SEQ ID NO: 165554 - protein, 89 aa, Triticum aestivum
  Clone ID: PAT_TA_59972.pep
VAVASSSKLADTLVLQYITRTQDKLTPLFFIYSLHSSPNSNPVRERRGRAEQPTDERLDQSRPPTGVAVLPCWWLMRCRRQPPPFGWSS

SEQ ID NO: 165555 - protein, 100 aa, Triticum aestivum
  Clone ID: PAT_TA_59973.pep
QPGGMVQGMAGQSMLSLGSRDIIRRRDKRRVLGADDGRWRVSWIPMGIWLSVRSLGVVTDGVGSLEVNTRGHGAVLLVLLGELGLCWGRRRLDKVTALIV

SEQ ID NO: 165556 - protein, 109 aa, Triticum aestivum
  Clone ID: PAT_TA_59974.pep
SWLAKRGLPRILPCRVAQAQANSSLAAQVNSSSLMTLVIMIAAVPRVQIHRILRPGLFWLHLVTIGAATNLSAVVGWRERRGFQADFRPAWRTTKLARALVFSESRTGR

SEQ ID NO: 165557 - protein, 81 aa, Triticum aestivum
  Clone ID: PAT_TA_59975.pep
AGRSSSETELYKLYPEWTSRARHFFGCCHVFVVKLGIAVPAFTCTYIYIVGDCNLVHQLLSEMSSAGSFWWREKKKKKRPL

SEQ ID NO: 165558 - protein, 160 aa, Triticum aestivum
  Clone ID: PAT_TA_59976.pep
MAESELALKFAPFIGMAGIAAAMIFGCIGAAYGTAKSGIGIAGVGTFRPDLIMKCLIPVVMSGIIAVYSLVISVLIAEDLDPSKNYSLFSGFMHLGCGIAVGMTGLAAGYCIGIVGDTGVRAYMEQSRIFVGMVLILIFGEVLGLYGLIVALILNTKSKG

SEQ ID NO: 165559 - protein, 71 aa, Triticum aestivum
  Clone ID: PAT_TA_59977.pep
KQIGEGKLKGGQSPGENWANTPPPAKLFFVSFSWRFFGHFFFFFFFFFFFFFFFFFFFFFSPVININKSTW

SEQ ID NO: 165560 - protein, 66 aa, Triticum aestivum
  Clone ID: PAT_TA_59978.pep
QHHKHVLEIWLISHLIPFSLVIELDLYSLVLVVMIVVVGRRLCRAWSRACYSPPWGFIWRSRERLT

SEQ ID NO: 165561 - protein, 283 aa, Triticum aestivum
  unsure (1)..(283): unsure at all Xaa locations
  Clone ID: PAT_TA_59979.pep
VRRSRRPFQIRDRPTSCSRSFEVAFKNRYDPLHFLFLDSFVLSSILKDLTQQSSQTILLILFLLPRTNPLPSWLPPSLYISNNTQIMLTSTFLLSLIGLAAASPVQPHIVKDPKYPSRLTSKGFKLVVNVTDPSLDFDPPIQNFELTGIHTGAGLALLGITEKDGRIFYQNGTKEERQNGEATVISDGGTPLTPNGIALVADKKNKNLFGATLNFEPGTAGVQLNRLDDPYTYLLPETFVACNKSIEYYRGQKVVVIEQARITIDKTTRSSATSPRXVRHPPR

SEQ ID NO: 165562 - protein, 103 aa, Triticum aestivum
  Clone ID: PAT_TA_59980.pep
PAGHRTRAHPRKMSPIKMRPLWSKTLLRRLKGNRMKMTPRLHKRVASEPDLTHLYMMLLPRTPQRYLGRRRALADSGRLWDLPQRIELSSDFVNYLRQSEPRT

SEQ ID NO: 165563 - protein, 109 aa, Triticum aestivum
  Clone ID: PAT_TA_59981.pep
SKTGRGRVLDTLQEIQERHDTVKEIETKLLELQQIFLDLSVLVEAQGEILNNIEVQVTGAVEHVQTGTNLLQKARVLQKNTRKWTCIAIIILLIIVLVIVLSLKPWAKK

SEQ ID NO: 165564 - protein, 34 aa, Triticum aestivum
  Clone ID: PAT_TA_59982.pep
GPFFFFFFFFSFFFFFFFFFFFFFFFFFFFFFFF

SEQ ID NO: 165565 - protein, 87 aa, Triticum aestivum
  Clone ID: PAT_TA_59983.pep
EKLLLLPDLSPAIKRSDRFVTQSAQAMHGTLPLPLEAKIKRRAVIYRILDRGISTRTRRAIIFRVLCCVFCTELQTHNGTSQTTNIT

SEQ ID NO: 165566 - protein, 234 aa, Triticum aestivum
  unsure (1)..(234): unsure at all Xaa locations
  Clone ID: PAT_TA_59984.pep
LLKISPPIMPSATRQDQILLVPWDPSSTEHVNRIYEQRVQCGWDKQRVDGWKTKQTSGEKCIFWITLRPENPQTRESLELHFDAFPAEKEPLVDTADSLRAKPRTPSHTKFYPVGHISLDHTNEKMGDFVLDLPKKGVYWIKTFYISKALRSKGIGRAAMDLVESMAIDEPLCAKTLAIDTAQKDTQKRIYREKGVELASTNQEWYERRGYRLIHTEPDFYTDPEEPPXDAVFL

SEQ ID NO: 165567 - protein, 74 aa, Triticum aestivum
  Clone ID: PAT_TA_59985.pep
MAQGYAVFIGLAVIAVLCVASWFFAPKGENQVLWRSSAILAIVSCYLMWAITFLAQLHPLIAPRKGGIREEYLD

SEQ ID NO: 165568 - protein, 68 aa, Triticum aestivum
  Clone ID: PAT_TA_59986.pep
LTSTLLISQYGIVTKRATIATSYTAKELSFPLPSKRNTHLLGSSSNSSDAKFSRTRPASVVPIEERGG

SEQ ID NO: 165569 - protein, 66 aa, Triticum aestivum
  Clone ID: PAT_TA_59987.pep
RPGSGVVDDEICCELFVTVRRCLEQSPSSPPLGVHASEYLLLCKISARMAFGWCCLAFVKNLKCSP

SEQ ID NO: 165570 - protein, 110 aa, Triticum aestivum
  Clone ID: PAT_TA_59988.pep
MGNCAASRHAGESWADDGEWEEASSTSEDGDHHHHNHHDASEEHLSEVTIRITKRQLHELMERKTPGGRGSSTRQLLADIMDSGEVHHHDVHREEHWRPALQSIPEAVES

SEQ ID NO: 165571 - protein, 68 aa, Triticum aestivum
  Clone ID: PAT_TA_59989.pep
GAFFFFFFQTKAHNSIQLNVPHYSGQGQESHIQHEVKLNYTSHFSIQLCAKCLLLTLSTTSAVAFTRS

SEQ ID NO: 165572 - protein, 39 aa, Triticum aestivum
  Clone ID: PAT_TA_59990.pep
PAGPGDLYSKSDGVPDAEKLKPYYMDLIAEYFPNPVIKW

SEQ ID NO: 165573 - protein, 101 aa, Triticum aestivum
  Clone ID: PAT_TA_59991.pep
MKHVGHVQGASTSSVHDDLGVFRHIGGGAAAGAVQRDVEGVDLVAHPAAAVVDLAALLRAAVVAELGQRHRDALRARQRREVPRALRQAVDGDERRVPNRP

SEQ ID NO: 165574 - protein, 146 aa, Triticum aestivum
  Clone ID: PAT_TA_59992.pep
AGRFRIRGTDYRSPHGLPLDFLDRVAIINTHSYTPEEIKQIISIRAQEEEVDVHPDALALLTKIGQEAGLRYASNLITTSQLVSAKRKAKQVEVSDVQRSFQLFYDPARSIKFVAESEKRLIGNTGAVDFSVGAAVSNGEEKMDLS

SEQ ID NO: 165575 - protein, 49 aa, Triticum aestivum
  Clone ID: PAT_TA_59993.pep
MGPDELPKAAAAGAEEAAPFSFSIWPPTQRTRDAVVRRLVDTLAGETLG

SEQ ID NO: 165576 - protein, 69 aa, Triticum aestivum
  Clone ID: PAT_TA_59994.pep
LLLACGVVVVGRAVFPLWGPASPLGPPLLGWGWFPFPAGWVRPSFFPLPLPRVMVVSRSPLRCWVCSGA

SEQ ID NO: 165577 - protein, 234 aa, Triticum aestivum
  unsure (1)..(234): unsure at all Xaa locations
  Clone ID: PAT_TA_59995.pep
MAEEQIAVDPDFDSALDVPLEEPSTSSLRSSLLQFAQENGRTYHKLSEGKYAFPNDDAESDXLDLQDNLYLITLDGKRALNPGAEKATRVLDMGTGTGLWALEFADEHPAAEVIGVDLSPIQPPFVPPNCTFEIDDLEKEWTWKQPFDFIFCRMMTGSFSDPQAMAHKAYEGLSPGGWYEIQDIQIPLFCDDGTLDFNTSPSMXWQQGLIEXSRKLGRPLGESXQYKSIVEKAG

SEQ ID NO: 165578 - protein, 66 aa, Triticum aestivum
  Clone ID: PAT_TA_59996.pep
LYPKHPALPVSDVRKTTPDARDRRTSYGCCEVPPHRDHLYLLSLTNQSAEIIEGYDRHMTSERRPT

SEQ ID NO: 165579 - protein, 103 aa, Triticum aestivum
  Clone ID: PAT_TA_59997.pep
MSGRGKGGKGLGKGGAKRHRKVLRDNIQGITKPAIRRLARRGGVKRISGLIYEETRGVLKIFLENVIRDAVTYTEHARRKTVTGMDVVYALKRQGRTPYGFGG

SEQ ID NO: 165580 - protein, 55 aa, Triticum aestivum
  Clone ID: PAT_TA_59998.pep
NSKTKLIIPIYKILIPMAFAIVTFPTTIFYSTPFSYFNIRELQITWLWHSRFTHH

SEQ ID NO: 165581 - protein, 37 aa, Triticum aestivum
  Clone ID: PAT_TA_59999.pep
IKKNKCFVQEVKQSSKATEPTRSHVLTPSKLNQTRPA

SEQ ID NO: 165582 - protein, 69 aa, Triticum aestivum
  unsure (1)..(69): unsure at all Xaa locations
  Clone ID: PAT_TA_60000.pep
RPGPETGXTTWRELRVLTVFGRYCGYAAGMFTSYVLARMATGWIVELEPDEKQWIKKKREEARKRSEAK

SEQ ID NO: 165583 - protein, 128 aa, Triticum aestivum
  Clone ID: PAT_TA_60001.pep
RPVFGQVKLHKVSTSGQWTIDLLCRKYFKTGVQISMVYSICTGNNGIVSSTNTSSELLVNWEYSELLTVEIFFSLGFIEGINYCGWLAGWLFIIIREKKSRGVTKKKKKKKKKKKKKKKKKKKKKKGP

SEQ ID NO: 165584 - protein, 61 aa, Triticum aestivum
  Clone ID: PAT_TA_60002.pep
PAGSRQGSSCNFSCSCNVCGIVSCSLSSIVPFGRCCLVASCNPGRLMASLIQSRAPLEPSF

SEQ ID NO: 165585 - protein, 100 aa, Triticum aestivum
  Clone ID: PAT_TA_60003.pep
LGSSRRSGRPSAGGRGLFRCCLLSRPAFARCAAGPGRLLAVCGGVPGGGGSVPVCVAAGLVVCWGFCRRSAGSRPSRSGSLPSSGRRRPSRPGKGSLSGG

SEQ ID NO: 165586 - protein, 52 aa, Triticum aestivum
  Clone ID: PAT_TA_60004.pep
PRAFSNYETPTQLIHLTTRLSIMLSLSAYALLASANLSADDDLIGRSRTGPL

SEQ ID NO: 165587 - protein, 84 aa, Triticum aestivum
  Clone ID: PAT_TA_60005.pep
KNVYSCSRLASFLRAKANRQSEFIYRDQNNLETTHQTLACSNKKEILKQMWGKKRTPTAANRGENLAGSPTIASGAIRLSDPKQ

SEQ ID NO: 165588 - protein, 106 aa, Triticum aestivum
  Clone ID: PAT_TA_60006.pep
PAGLRYFLIPAAELGRPLSSADMAALAVRASAAIAAKSPEQRGGKKNLRVVPVREEMEDCEDVMFNEKLNERTLGEFAVSLSPVKKSNGKLAARSRLMLKRALSII

SEQ ID NO: 165589 - protein, 108 aa, Triticum aestivum
  Clone ID: PAT_TA_60007.pep
MAQVLVVYPSGPSFDMDYYLKTHMPLVASKWGPLGLKSYKILNFQEGAPYQVQATLEWEGVEVFDKAAANEVAKEIFGDIKNFYNGEPMLLKGPVVAHESVSSSHAKL

SEQ ID NO: 165590 - protein, 152 aa, Triticum aestivum
  unsure (1)..(152): unsure at all Xaa locations
  Clone ID: PAT_TA_60008.pep
MAHLKHTIDIITCLQDARYYMATTAEIKYYPPTGVENNALRLRPATVLFRIYLKNLRRTELVIRKLPCHGLERDIAHDFKNYLMIQSSDSSVLQEAAEAYLALLFEDTNLCGIHAKCVTIMPKXIQLARRIRGERAYSFYCRRCNWRSLARV

SEQ ID NO: 165591 - protein, 95 aa, Triticum aestivum
  Clone ID: PAT_TA_60009.pep
KAGQTFLTIQRIMPHMSSFPSDFSLAFTLMLMAPRTDVSSLKLAPESNGLHCLVHHYFALGLLLQMLEVARKVKKRLVGCCWEDLRIHCLSEPGR

SEQ ID NO: 165592 - protein, 131 aa, Triticum aestivum
  Clone ID: PAT_TA_60010.pep
VDVEPGDSPTHYSSRRKATPPLLFTPYIRLTPLHPDENSTPSHPQCCFNDNLHATTIQITMPQVGALNAPLHADNLLLLTSARTPSQACSYAHTGAELELQHCRRLCKHSKNILCFEHVGLTSPADGYLTA

SEQ ID NO: 165593 - protein, 74 aa, Triticum aestivum
  Clone ID: PAT_TA_60011.pep
LTIYKIICTWWHVINIYVQGMNTLDIRLLRTNRDMTPMELPPDEGGSGGEFLTSSSSGCALLRKQKRIPRDRQS

SEQ ID NO: 165594 - protein, 112 aa, Triticum aestivum
  Clone ID: PAT_TA_60012.pep
LHSEQALLRRYKCCPPPPQGQGEGRCLCGSSAARSEDCCVQPAQECQEVLLGDVSHGACFCHDFLWLDFVDLGVEKLWAVDAGLRTCTCTTTRDLGCFFVASKLEMFVWKLV

SEQ ID NO: 165595 - protein, 64 aa, Triticum aestivum
  Clone ID: PAT_TA_60013.pep
AGRFPDLPGKDMAFVQLKTVAAAVVRNFEVEAVPGHVVEPKISIILHMKNGFKARIKRRHVMNS

SEQ ID NO: 165596 - protein, 43 aa, Triticum aestivum
  Clone ID: PAT_TA_60014.pep
PPVLKGVHRVWMMGSLREGTICQVCLSVHIGLNEDVVRSLFLF

SEQ ID NO: 165597 - protein, 133 aa, Triticum aestivum
  Clone ID: PAT_TA_60015.pep
MMEKSFSRVTGPHHTLLLSNNNIFSMFRTWELTSPWTGAEIMVPTKFIVGDLDLTYNIAGAKDFINKGGLKKFVPLLDGVVIMKDVGHFINEEKPDEISALIISFIKKFNKTEVYRIIMNKAKMCMVIGKFIF

SEQ ID NO: 165598 - protein, 128 aa, Triticum aestivum
  unsure (1)..(128): unsure at all Xaa locations
  Clone ID: PAT_TA_60016.pep
MKAESNTVSRSSKAGLQFPVVRIARHLKIGKYAQTRHAIGAPVYLSAVLEYLPAEVLXLAVNAARDNKKTLIVPRHIQLXSRNDEELIRLLGAYTIAADGLLFNIHTTLVRKKDIEGKDNIVSASQEF

SEQ ID NO: 165599 - protein, 150 aa, Triticum aestivum
  Clone ID: PAT_TA_60017.pep
TAELRAAKSPSYYKRGDYVPGLKVDGMDVLAVKQACKFAKEHAIANGPIVLEMDTYRYHGHSMSDPGSTYRTRDEISGVRHERDPIERVRKLLLAHDLATPAELIDMQKEIGKEVHAAIAKAKESPMPDPSELFTNVYPNAFLLQPLPRP

SEQ ID NO: 165600 - protein, 99 aa, Triticum aestivum
  Clone ID: PAT_TA_60018.pep
MATLGGYLNKKVLIVTADSRILVGTMAACDQTTNLVLNNAVERIIRTPDNSEPSAQVPLGLYLVRGDNVCSIGLVDEALDDSINWTEVKGSAIGGIKHV

SEQ ID NO: 165601 - protein, 221 aa, Triticum aestivum
  Clone ID: PAT_TA_60019.pep
MHFYALIPAFITAVSAHGVVISVEGANGVSMPGLSIADGTPRDCSSNGCGSQADTAIIRDRELGTSEASALGRTQGNGPVDASVMIANFLGTSGSNNVPTNNGSDSGVGVEDDLSGLNRGGRNNNRKQRRQLGNLLGGLFGGGRGGGNGEKADKPNESSVAATAGEGATSGLPTCSENGEITMTYRQINQDGAGPMRADIDATSGGTDPDAFKSAEVTNDV

SEQ ID NO: 165602 - protein, 184 aa, Triticum aestivum
  Clone ID: PAT_TA_60020.pep
VAVAVEVLVDEAVSVATVLERRLLLMHVAHHRVVLIVDPLEVVGVVLASVSASAAHVVRVVLQREAVEVLLALAPGGVRLQPQSAVVVFLQHAVRGRRSASFGVSLPHFTSRRRTDLRSHPLLYRPSGRAGSAALLIRRRPWMFCALAPGKKRNRFQGRSPGMNRGGAVGAWEISDPDCVVPYG

SEQ ID NO: 165603 - protein, 142 aa, Triticum aestivum; identical to SEQ ID NO: 134568
  Clone ID: PAT_TA_60021.pep

SEQ ID NO: 165604 - protein, 135 aa, Triticum aestivum
  Clone ID: PAT_TA_60022.pep
MAPGTTIHGCSSTSSRRRRRSRRTHRRGTCPPPRAPSRGPRSCAPRSSPRPPAPARPARPPPRPPPARQPSPSPSSSSSRRSGPGPRPSCHRTPPPDPAARRRTRLSRGAVPARSLGRGRGAVCRLNRGAPNPAG

SEQ ID NO: 165605 - protein, 92 aa, Triticum aestivum
  Clone ID: PAT_TA_60023.pep
PAGLRIMPERFLDSTVDFRGADFELLPFGAGRRICPGMTLATRMVHLILASLLHQFKWSLPAEMERDGIDMEDKFGLTLTKVVPLCIVATPV

SEQ ID NO: 165606 - protein, 75 aa, Triticum aestivum; identical to SEQ ID NO: 106874
  Clone ID: PAT_TA_60024.pep

SEQ ID NO: 165607 - protein, 254 aa, Triticum aestivum
  unsure (1)..(254): unsure at all Xaa locations
  Clone ID: PAT_TA_60025.pep
AGRAATCGATFLTEGLAAGATGMASLSRARFALPTQLAAAFRFSRKFALCLTSTSAAGVVVFGDAPYAFQPGVDLSKSLLYTPLLVNNVSTAGVSGEKDKSSEYFIGVTAIKVNGRAVPLNASLLTIDRQGGGGTKLSTVAPYTVLETSIHKAVTDAFAAETAMIPRVRAVAPFKLCYDGSKVGSTRVGPAVPTVELVLQSEAASWVVFXANSMVAAKGGALCLGVVDGGAAPRTSXVVGGHMMEDNLLEFDLQ

SEQ ID NO: 165608 - protein, 83 aa, Triticum aestivum
  Clone ID: PAT_TA_60026.pep
LRQMQIFVKTLTGKTITLEVESSDTIDNVKAKIQDKEGIPAEAGRLIFFVRELVHELAGLAFLLAPSHGVALQMEGDACPYAR

SEQ ID NO: 165609 - protein, 67 aa, Triticum aestivum
  Clone ID: PAT_TA_60027.pep
GSLTLFLTSDLIDNLSSPLENLLFCSVRRYKALYITSGLRPTIQPFPPTGGGREKKIQAVNILSRGR

SEQ ID NO: 165610 - protein, 237 aa, Triticum aestivum
  Clone ID: PAT_TA_60028.pep
MAGGGSDEVKLLGMWASPFVLRVKLALSLKGVGYEYVEEDLKSKSELLLKSNPVLQKVPVLIHDGKPICESSVILQYIDEAFAGVGSSLLPEEPHGRAVARFWAAYIDGTLVKASSEASMAKTEEEKAEGKKQVAAAVETLEGALRDCSNGKPFFGGDTAGYVDVMLGGLLAWVHAADKMKGVKTFDPTTTPLLAAWADNFGSLDAVEAVMPDVSKLVEFAMAMHARAAAAAAGATN

SEQ ID NO: 165611 - protein, 83 aa, Triticum aestivum
  unsure (1)..(83): unsure at all Xaa locations
  Clone ID: PAT_TA_60029.pep
ILFSMINKXLWLTQHSTTTKLNSERYRGNTKERIQFQREKHSGNLLKQNSLLWQAASSPAYEPTLSRTRRLLLYLYRVRRPGR

SEQ ID NO: 165612 - protein, 69 aa, Triticum aestivum
  Clone ID: PAT_TA_60030.pep
MGFLATSAIFFLAGFIACLFSLLCCNRGASTNIFHLTLVITATVCCWMMWAIVYLAQMKPLINPILSGE

SEQ ID NO: 165613 - protein, 99 aa, Triticum aestivum
  Clone ID: PAT_TA_60031.pep
RPGWERTIAEVPYWADALFRVRYMPYQWPNMNRLKSIAQPKPNFDRDGNKTKGFSYFVALVFGLGSKKAKGALLRWAFLVVAAAVLEAKKGTLSQLLTR

SEQ ID NO: 165614 - protein, 80 aa, Triticum aestivum
  Clone ID: PAT_TA_60032.pep
YARKGCENQPLSIKSDTTHQADQVTYISDSIGLHRVHNPHPTNVAVSLHIYTPPNAADIGYNIFDESTGRASFVPKAQVH

SEQ ID NO: 165615 - protein, 145 aa, Triticum aestivum
  Clone ID: PAT_TA_60033.pep
PAGSRWGQAHSQARFSILKCFLEAEDDFCKLDYKQDDLSDLTIKLDRSKILTAGRDAVAKYLQKLHIYKSTADVKTGTDFYVHMTTVDPEFWGKKVRDIVLKNKQPRKVFVQANTSLDESSGKVSIKHYEPSLTGMVQSWVDRAL

SEQ ID NO: 165616 - protein, 87 aa, Triticum aestivum
  unsure (1)..(87): unsure at all Xaa locations
  Clone ID: PAT_TA_60034.pep
PAGFRKKSLNAYQXVIARGGKPIVICNPDDEEFKASEAEKIEIPKTVDVLQGLLNVIPLQLIAYWLAVLEGLNVDFPRNLAKSVTVE

SEQ ID NO: 165617 - protein, 81 aa, Triticum aestivum
  Clone ID: PAT_TA_60035.pep
RPGCEPHTLLSFSHKAPNGRRSLEREDVILVFRSCYLRAADNMASHTQTVPDGMENFIVGLIGMGDMGKMYAERLSAAGWR

SEQ ID NO: 165618 - protein, 75 aa, Triticum aestivum
  Clone ID: PAT_TA_60036.pep
EHHPHAEGLHGVTFDTRPPKDITGRSRDVDTKYYAPSPMFASDTLSTKGYDYMVSPWTDYRITSAKFPIDESIFR

SEQ ID NO: 165619 - protein, 61 aa, Triticum aestivum
  Clone ID: PAT_TA_60037.pep
PAGPRSSFQEILILDGVIVGVVASYLSSPDMFQLLIESSRKKKRDFKASLCLSKGIMIRAA

SEQ ID NO: 165620 - protein, 65 aa, Triticum aestivum
  Clone ID: PAT_TA_60038.pep
AGRVGLHMWQPNLDPSLPEGQSPDSWSTASGPGQAVPTTLNVEDWFQFFGINGTDPNFNFDVPLG

SEQ ID NO: 165621 - protein, 93 aa, Triticum aestivum
  Clone ID: PAT_TA_60039.pep
PAGFSKTGMFYFGLCFIWAVWIFFFLPETKNRSFADLDYLFQKKVNARKFTTTPVDLFEIVGPGRDDKLQGVEVITPVNTNTAGQDIEGGKKL

SEQ ID NO: 165622 - protein, 133 aa, Triticum aestivum
  unsure (1)..(133): unsure at all Xaa locations
  Clone ID: PAT_TA_60040.pep
GPXFFFFFXXFFFFFFFFFFFFFFFFFFFFFFFFFFFFARVISEFRLDWRKEVKQDDKAMAKGESKGCYRNQSSSNSIVPAFACLLLMEKWHAHSNESTLQCVRTLAKTPRAGPVAVAVGEAGRKPEKPGING

SEQ ID NO: 165623 - protein, 68 aa, Triticum aestivum
  Clone ID: PAT_TA_60041.pep
RPGCIDAHANKPESLLTGCNTFLKNLNVTFRRDPTNYRPRINKNGSQLDQEQKMSGNYFFLEENPESS

SEQ ID NO: 165624 - protein, 104 aa, Triticum aestivum
  Clone ID: PAT_TA_60042.pep
KCHEIDLSGLCRCRPMFRPPSFSFLLLFYFAWVRMTAWVIGKETPRMGLLVQFWRSKSRQFLRSRTPKTSKTIDGNVMIPRKKWGCRNLKGCHETLFCMFYIRT

SEQ ID NO: 165625 - protein, 80 aa, Triticum aestivum
  Clone ID: PAT_TA_60043.pep
RPGRLPTIIIRREYLHFIQKYSRYEKRHKNVAAHVSPAFRVQEGDQVTVGQCRPLSKTVRFNVLRVLPRTGKSVKKFSKF

SEQ ID NO: 165626 - protein, 67 aa, Triticum aestivum
  Clone ID: PAT_TA_60044.pep
GAFFFFFFDRSVSFIDDSRIIYIRNRHHEWTRPIMGAWVCRPVAIPKPAAVYTKGGLSLIPRPAGLL

SEQ ID NO: 165627 - protein, 132 aa, Triticum aestivum
  Clone ID: PAT_TA_60045.pep
RLALDMLDLNFQVFFMTDLSQKLVARTTGVEPLTLSRDDCTNFEQYQARIAQVLEIVEKADKATVDKRADEIVTIGLGPGKSADMKSRDFVQGFAIPNIFFHLTTAYAILRKEGVEIGKQDFLGPFIGQYLQ

SEQ ID NO: 165628 - protein, 224 aa, Triticum aestivum
  Clone ID: PAT_TA_60046.pep
AGRAAENHQQTLQTQSQLPTTFKLFHHSKFLKMASAMTFPQQQQQSLPIQTTNSGASVDNNLLSALAQYVTTGAHARSTTEQEIQELAQDAISKPGGRAHLEALISYDCPEHQVWKNQASADGTITITKTNLTVSLGVSTLELNFEASGAGFFVPYSGSLNVGTLFYNEFAQLAPGNATFKLYVSGLDFYVSIYRNQVYIGNFHFTNITFVFPPGGVNLNGRII

SEQ ID NO: 165629 - protein, 83 aa, Triticum aestivum
  Clone ID: PAT_TA_60047.pep
DFNTQEREVEAQILFYHHSRYDRQSWILVNVDMQRSRWTCCSSSSPEMHHPLARCQGFLLVTRIHNGYSAKVLPRGRRCNQFW

SEQ ID NO: 165630 - protein, 122 aa, Triticum aestivum
  Clone ID: PAT_TA_60048.pep
QKATISEHVYGSCLVVCGERERVMNMAHSCSEMPSRVERKKRIELDRRKRGPGATHRGGGCGGHGEIQSTDQSMTKDKRNSWNKPAHFEKLCVILMSGGRDCMQLVVSAMSKQARGLWEPGR

SEQ ID NO: 165631 - protein, 121 aa, Triticum aestivum
  Clone ID: PAT_TA_60049.pep
LEREIPAEYRYDILAVTSTLRHQHPYHVTPHQQGSASKEDLKHPIPYASSDLAEKNGEVYKFNCVQRSDANFTENQISFLGDLLISGLRYPAASAVLSAVWAVSRAFYDIGYSAETPQGRM

SEQ ID NO: 165632 - protein, 156 aa, Triticum aestivum
  Clone ID: PAT_TA_60050.pep
MATPPIPANRLKQIATDACNSAIGNAEFYDHAKTEQWNSTIISSVLKAVISESTPEGASAPSFKFACNSTIVQHLVPTSALNKPRGGTETQAQEPHISTSSEATATDGKPHVGRRGMHSATGAYWDEKKDGMWTFKYDGGEGKGLDVVVMLIWVAI

SEQ ID NO: 165633 - protein, 108 aa, Triticum aestivum
  Clone ID: PAT_TA_60051.pep
PFIFYTLCCILSSTLPIHRKSWYTFYSSQKAKPQISYLPSASSASCSNTRPHSSNLPTRPLLAPLITHYEHFYHRSRPIPRAFFLFVYPTDHWPNDLSISVFSHLSLL

SEQ ID NO: 165634 - protein, 136 aa, Triticum aestivum
  Clone ID: PAT_TA_60052.pep
PAGLPIAFTYDTTLAQLINNPPFRRVKKRRRGGTAIRSHKSRNTKTVLYSLPYGEHGFFTPSAQNEHSDEAGWAICDFKSVQWSPGSDRFCPYLNKKKREYHVEPKGEKTKNLGSSRYIPDKKSHYSFATKHTYLQ

SEQ ID NO: 165635 - protein, 122 aa, Triticum aestivum
  Clone ID: PAT_TA_60053.pep
VPTAKRAQRGEQTRRAVAFAPGSYLQHMRLRAFKSRRFYKISDTKQLVTSTKVRPPSILKFYASRARALCLQSQVSPSLVARFFKDFSGLGLVGGRPQLLPAPTPQISSFGPALGSLPPAFF

SEQ ID NO: 165636 - protein, 114 aa, Triticum aestivum
  Clone ID: PAT_TA_60054.pep
PAGLSHGILTKRPGVLSNDFFVNLLDISTEWKPVGNGDLFEGIDRKSGNKKWTGTRVDLVFGSHAELRATAETYAEAGGSEKLVRDFVAAWTKVMNLDRFDVKNGKAPNVSPRL

SEQ ID NO: 165637 - protein, 68 aa, Triticum aestivum
  Clone ID: PAT_TA_60055.pep
RPGWVTWDRRKVYGKAPSGRGYHGTVLYDSRLIIIGGFDGSEVFGDVMLLELAVHAYYSQISHFTIEV

SEQ ID NO: 165638 - protein, 91 aa, Triticum aestivum
  Clone ID: PAT_TA_60056.pep
GPFFFFFFFFFFFFFFFFFFFFFFFFFFFLEERATSALRVQGSKNKRINPAGQAPAPGSPCTTARPGTTPASLDTTPPPSLPFPMRIRPGR

SEQ ID NO: 165639 - protein, 56 aa, Triticum aestivum
  Clone ID: PAT_TA_60057.pep
RGLFFFFFYEKSNYYYIDKPGRCPAPLIQLQKPSDNDTFFQLSANNTCLISRARPA

SEQ ID NO: 165640 - protein, 100 aa, Triticum aestivum
  unsure (1)..(100): unsure at all Xaa locations
  Clone ID: PAT_TA_60058.pep
NSIQLPNLYPVGXQYQKSSPNKMSNLLPFPVVKGHLVLLSVKYGSNSFWSDNLSNLPPSTSPFFSLLCRLKSRFFPSRNGGSVILLAQRWRNTWGPARPA

SEQ ID NO: 165641 - protein, 53 aa, Triticum aestivum
  Clone ID: PAT_TA_60059.pep
AGRAWISTIDDELRFVSVFARISFEHRFKTHDLHAILSKISTIKEKKKKKRPL

SEQ ID NO: 165642 - protein, 72 aa, Triticum aestivum
  unsure (1)..(72): unsure at all Xaa locations
  Clone ID: PAT_TA_60060.pep
RXGWDLPSRGSRSPMGXAAVYGENNDSVIFALSSSEVRSTFPLSTSPPSGRATSSASTNNRSLTEERSLEDA

SEQ ID NO: 165643 - protein, 275 aa, Triticum aestivum
  Clone ID: PAT_TA_60061.pep
AGRVGCNLLLHRPPAGLLDQALMKHNCLAPLSPIEKLSLELISSIYLYLHPTDCIALGLCSQTLWIRAMDFIRHSRRSTTWVDTPIFIASGKQLLALREASHNNESELQDPQDGTQDAVCMLMKPQRPHLFNVLKQARSQNQLCDYASLNSSDINPPYLQELIRLSPTSGISKGFHRLMESCLFPEEFGGQGQWCLRDFTTNEYIRMEPVRDRSISEHPTISLTRNPWMTLDILLIWLITWEAGRNRSPENVTREILRDQINKIMSNRGASVTAS

SEQ ID NO: 165644 - protein, 59 aa, Triticum aestivum
  Clone ID: PAT_TA_60062.pep
DQNGFFDWIRNSLFFNPFLLFLFYISNPRAFLILSFLILYNFPSFFFFFFCYGPPDRPA

SEQ ID NO: 165645 - protein, 135 aa, Triticum aestivum
  Clone ID: PAT_TA_60063.pep
HYMDNMIEKNVEQTKEARASNTRQTTADLSKEKLSVPASGHPTQSCDHETSIYCITAAARRDTSAEDTKANADTPAAAPASGAGAGAEEGPMKSCADAEAKKTATARISTAMRGAITTLRCSLRVDRRIGEEGSE

SEQ ID NO: 165646 - protein, 77 aa, Triticum aestivum; identical to SEQ ID NO: 127442
  Clone ID: PAT_TA_60064.pep

SEQ ID NO: 165647 - protein, 106 aa, Triticum aestivum
  unsure (1)..(106): unsure at all Xaa locations
  Clone ID: PAT_TA_60065.pep
RVDGCNAAKRSRGLGEGGATRHSEALRDNSQGCTKTWIRTMETTPASNRISGLIYEETRGVLXIFRENVIRDDVTYNEHARRKNVTGMEDGYTLKRQGRTLYGFGG

SEQ ID NO: 165648 - protein, 168 aa, Triticum aestivum
  Clone ID: PAT_TA_60066.pep
RPVRVLYQKSPCGKYANGKDPSTGEKCAPADINVWAQCLPYIFIGLGEIFTNVTSYEYAYSKAPENMKSLVMSVNLFMSAFASAIGQAFTPFSDDPLLVWNYVIVAVIAFVGGVAFWFQFKHLDGEEDKWNMLKASEYQGEYQPNATENKVADEHEEPTNAPRDIEKM

SEQ ID NO: 165649 - protein, 127 aa, Triticum aestivum
  Clone ID: PAT_TA_60067.pep
AGRFGSASTFVTSLFPSRSLLVTTPCCSSLRRSSKNRRPRTPIWSDDRRLEVFSSPRSWTTKSYDSTKNYGLSLRPKLLMKPGRRMQLGMDGSFMDFEDFSRVTARQLIPPPHARRSTSFKRISFLL

SEQ ID NO: 165650 - protein, 123 aa, Triticum aestivum
  Clone ID: PAT_TA_60068.pep
MPPLTTPKSGDALFASVERILFTLTYGTIVRQLLTDLEEVEEVNKQLDQMGYDIGTRLVDEFLAKSNVSNCADFKETADTIAKVSVKTEVTWVRDMLRGDDAYEMRVKLTKQVPEEYPYKDDD

SEQ ID NO: 165651 - protein, 65 aa, Triticum aestivum
  Clone ID: PAT_TA_60069.pep
GHLCRPHLSPTWEAREDSGFYLFSSSRFKFYPWYTEEEEERACLGLSDVLHVQGGGHSSYYKSLV

SEQ ID NO: 165652 - protein, 72 aa, Triticum aestivum
  Clone ID: PAT_TA_60070.pep
MRPQALLLALAVLTDITALPLAHGQGTRPRSCCKKCGTCTKSIPTQCTRHDVSTTGCNTPCKRCVRATAGFQ

SEQ ID NO: 165653 - protein, 114 aa, Triticum aestivum
  Clone ID: PAT_TA_60071.pep
MVTLFCAAAATSCRLTFPLAAPAPAPGLGRGRVRRGTVAVRADGDTAAAGSGINPAIRKEEAKVVDTVLAGELSKPLTPYCRCWRSGTFPLCDGSHVKHNKATGDNVGPLLVKK

SEQ ID NO: 165654 - protein, 161 aa, Triticum aestivum
  unsure (1)..(161): unsure at all Xaa locations
  Clone ID: PAT_TA_60072.pep
MQIFVKTLTGKTITLEVESSDXDNVKAKIQDKEGIPPDQQRLIFAGKQLEDGRTLADYNIQKESTLHLVLRLRGGAKKRKKKTYSTPKKVKHEREKTPLAVLGYYRVDDATGKVERLRKECPNPDCGAGTFMAAHADRHACGKCGLTYAYAEAQSPEIDSD

SEQ ID NO: 165655 - protein, 54 aa, Triticum aestivum
  Clone ID: PAT_TA_60073.pep
TTKRWLFTILTEWTVFFVTRRRSTGYHLSLLALKRNRGSVTSGHYLIFILLILP

SEQ ID NO: 165656 - protein, 75 aa, Triticum aestivum; identical to SEQ ID NO: 106874
  Clone ID: PAT_TA_60074.pep

SEQ ID NO: 165657 - protein, 191 aa, Triticum aestivum
  unsure (1)..(191): unsure at all Xaa locations
  Clone ID: PAT_TA_60075.pep
MAAAAISGGHLVLSTPTSTRRPRSLPLRPPSARPIDASSASAARRGVAAAAVSSPAAVPSTGKDAKQLPKDFLHINDFDKDTIMKILNRAIEVKAMIKSGDRSFQPFKGKSMAMVFAKPSMRTRVSFETGFFLLGGHAVYLGPDDIQMGKREETRDGARVLSGYNDIIMGRVFAHQDILDLXKYAPVPVIN

SEQ ID NO: 165658 - protein, 87 aa, Triticum aestivum; identical to SEQ ID NO: 142125
  Clone ID: PAT_TA_60076.pep

SEQ ID NO: 165659 - protein, 210 aa, Triticum aestivum
  Clone ID: PAT_TA_60077.pep
RGLFFFFFCALIKQLLHVHRRHTNLKFYLVHNELHRWYEEQTAYIGWTYVVVLLNHAHDQVPRSHRSTQSTPRILMHRFSTFSRVGGTAPQPEPGRSPERQRYDCKLLVLLLPGGVPRGARCSGVVRCWSSRRCCRRRIGHVVGCCRRRRIGNVVGCCRRRRIGHVVGRRRGRRIVHGVRARLQRGRESGERWRRVCAVGRSALFRTRPA

SEQ ID NO: 165660 - protein, 126 aa, Triticum aestivum
  Clone ID: PAT_TA_60078.pep
GMRYSRRCSAPLMYGSWKSHERPHAAGEWAHQSAAKRSTSDALRIGREVEDVLNQVLVKQLRTVTSPSTVSRAWRLASPWGGLGLCLCPRRRLPWRAAEPGAAHCSHENGCELKSEHSTLSAKEGC

SEQ ID NO: 165661 - protein, 77 aa, Triticum aestivum
  Clone ID: PAT_TA_60079.pep
PAGPGTFRDEACLRGYCTFSGTKPHISVSAVVWFGYLCPCILYPFWTHASSEGKVEPIYVQEAVLILSVDFVFKFLI

SEQ ID NO: 165662 - protein, 36 aa, Triticum aestivum
  Clone ID: PAT_TA_60080.pep
MFDDQDLGFFTNFLGIFIFVLVIAYHFVMADPKYEN

SEQ ID NO: 165663 - protein, 69 aa, Triticum aestivum; identical to SEQ ID NO: 164397
  Clone ID: PAT_TA_60081.pep

SEQ ID NO: 165664 - protein, 169 aa, Triticum aestivum
  Clone ID: PAT_TA_60082.pep
PAGPGLTHITILFARIVQPARFVLHPTITSVSMASGLFANLSGISAWHIPAIFIGTAFTLGGLLPFRSPARAMREYGLPEGIARSEPAQTAFAVYGSRVSAYGLAIWLFYLRRQYDVVDTLLSLLVWWGTADLWICMRAGALSTGIWRFTSSLLLGGWGYLGLTAKGAL

SEQ ID NO: 165665 - protein, 236 aa, Triticum aestivum
  unsure (1)..(236): unsure at all Xaa locations
  Clone ID: PAT_TA_60083.pep
MDTARRSPVCLDLMVGLPMVCEPSSARCTGMRAQADIASSACGRATSMTSSEANKIMEAKFTEVTEENRRLTEMIGYLYANSQNFARQSPEGEGEQPASTAASPTSPVGKKRSRESMDTSDSGDVNSDKKMGTAEAEHIDVESPLSNGTCRRIKVKRVCTRIDPSDTSLVVKDGYQWRKYGQKVTRDNPSPRAYFRCAFAPSCPVKKXGSEKRGGQLXLVEATYEGEHNHPRPTGA

SEQ ID NO: 165666 - protein, 138 aa, Triticum aestivum
  unsure (1)..(138): unsure at all Xaa locations
  Clone ID: PAT_TA_60084.pep
RPGRVTWISNATCLQDXWKGSYLQQEDEDMQELRSRIRHEPAVKSLTEDMQQDDSQEALKKFICLSNVQSKQHQPLVQECQFTCTPEQGRCTNAYELLTSYNYNARTPLPMNIQYLLYTFTWKFKLISHPKKKKKKAP

SEQ ID NO: 165667 - protein, 211 aa, Triticum aestivum
  unsure (1)..(211): unsure at all Xaa locations
  Clone ID: PAT_TA_60085.pep
MTDSTAKPKNEMKVLSLGLPRTGSASMAEALTRLGYKNVYHAIQAIDSPEDWKILERACDASFPNLPSYTGKPFTREEWDELWGHCEGTTDVASIFAPQLIKAYPDAKVILAIRDFEPWFKSVDQSVFHHLWNPMAHFSVNVIEPLVGSVAGRSARKQLLGLFQAQTVDEARANARETWERHHRVIREMVPEGQLLEYRMGQGXGPVCEFL

SEQ ID NO: 165668 - protein, 189 aa, Triticum aestivum
  Clone ID: PAT_TA_60086.pep
RPVRVSAIPLNVLNDVKFDPPLATGKKAAADIGHVNQCIKVHAEVSDKDLRSMTSISYPHNKLAYGFGDGTTPAGNTHIVAFGGQNNHFHPEENIQTTLDAFQGFTPMKIERLVFHNWSKDEFAKGAWFFSRPGLLADHLGDMRASQGNIIFACSDWALGWRSFIDGAIEEGTRAAMVLRSTLSERSHL

SEQ ID NO: 165669 - protein, 167 aa, Triticum aestivum
  Clone ID: PAT_TA_60087.pep
AGRSGIQVIQKVGNVAYKLKLPETSTVHPVFHVSQLRSALPPSENALEELPHEAAPQPEPVEVLDSRIHHRAGVDVPQVLVRWTDQPAALATWEDREELRLYFPAATAWGQAASQGRGNVTAPPTSSATPGAATSTTKAQTEIEAHGRPTRARKGSERYPAHSWVTG

SEQ ID NO: 165670 - protein, 97 aa, Triticum aestivum
  unsure (1)..(97): unsure at all Xaa locations
  Clone ID: PAT_TA_60088.pep
YRCFDGGLTWATDNQSLQNAFSKYGDVIHSKIITDRETGRSRGVGHATYASNXAKHRASDARNGQDXLEGRVMPRHEAEYRRSVGGGGGEFGGGGAG

SEQ ID NO: 165671 - protein, 256 aa, Triticum aestivum
  unsure (1)..(256): unsure at all Xaa locations
  Clone ID: PAT_TA_60089.pep
RPVPGIVNSGVRTDSDSAVALLADHEKLNHPDPLVRTACIMGLGLAYAGSNREDILEHLQPMISDSSCDMQISAMAALSCGLIFTGSSHPEISEAIVTTLMDDDRKSQLTDKWTRFLALGLGLLFFGRQEEVDVILETLKAIEHPMAKSTAVMAEICAWAGTGAVLKIQELLHICNEHQEETDEKKGDELLQAYAVIGIALVAMGEDIGQEMVLRQFGHLMHYGEANIRKAVPLAMGLISPSNPXQMKVYDTLSRY

SEQ ID NO: 165672 - protein, 134 aa, Triticum aestivum
  Clone ID: PAT_TA_60090.pep
MGAHPDAKDDPRFPCRRRACVHPPIPPNTPPQVPKPNTSRLVDAPSSYATAGKVLFVAAGAFAGVLLALIFLHLYNSGRRQRARDRRRLNRSLAIYVGDADEEAPSPRGLDPAVLRALPVVAVAVGAEYCAVCV

SEQ ID NO: 165673 - protein, 152 aa, Triticum aestivum
  Clone ID: PAT_TA_60091.pep
MAPKADKKPAAESKVEKAAEKTPAGKKPKAEKRVPAGKTAAKEGGEGKTRGRKKGSKAKKSVETYKIYIFKVLKQVHPDVGISSKAMSIMNSFINDIFEKLAGESAKLARYNKKPTITSREIQTSVRLVLPGELAKHAVSEGTKAVTKFTSS

SEQ ID NO: 165674 - protein, 147 aa, Triticum aestivum
  Clone ID: PAT_TA_60092.pep
MAGRKGGDRKKAVTRSVKAGLQFPVGRIGRYLKKGRYAQRVGSGAPVYLAAVLEYLAAEVLELAGNAAKDNKKTRIIPRHLLLFVRNDQELGRLLAGVTIAHGGVIPNINSVLLPKKSAAAAEKEAKSPKKKTSTKSPKKKTAATKE

SEQ ID NO: 165675 - protein, 103 aa, Triticum aestivum
  unsure (1)..(103): unsure at all Xaa locations
  Clone ID: PAT_TA_60093.pep
MSGRGKGGKGLGKGGAKRHRKVLRDNIQGITKPAIRRLARRGGVKRISGLIYEETRGVLKIFLENVIRDAVTYTEHARRKTVTAMXVFYALKRQGRTLYGFGG

SEQ ID NO: 165676 - protein, 96 aa, Triticum aestivum; identical to SEQ ID NO: 122319
  Clone ID: PAT_TA_60094.pep

SEQ ID NO: 165677 - protein, 130 aa, Triticum aestivum
  Clone ID: PAT_TA_60095.pep
AGRAVSPHLPSPGSPPRFPHPASPSRRASSSSPPWRPSPVYPPRCGLHLRTPLLRQQLQSPPPQWNESLPRDGGRHAVDHGIRGGPEDFKLVGSSPRWNTHMRARTHTKDGIGCIRPHRWVGHAYWVRAV

SEQ ID NO: 165678 - protein, 75 aa, Triticum aestivum; identical to SEQ ID NO: 106874
  Clone ID: PAT_TA_60096.pep

SEQ ID NO: 165679 - protein, 48 aa, Triticum aestivum
  Clone ID: PAT_TA_60097.pep
GPFFFFFFHGTYLVDNPERFFETGRTPAFPLASEKNRYRKIFISRPGR

SEQ ID NO: 165680 - protein, 200 aa, Triticum aestivum
  Clone ID: PAT_TA_60098.pep
MADDSAPLASLSVTHVYYDPEDHLSLVCAYLALLPQALCVVYATLVLFTREVEVGLMFLGQLACEALNFALKRLIKEERPRRIHGKGYGMPSSHAQFVAFWSVSLALFLLVRHKPPRVLKSRADSGVHRPWSVIERMAVSMAGMAIAAATAWSRVYLNYHTPKQVVVGCAAGAVSAIGWFIIVAIVRQTGLLGWALETPL

SEQ ID NO: 165681 - protein, 73 aa, Triticum aestivum
  Clone ID: PAT_TA_60099.pep
PAGPADCYCNDIDQPCARGLPRRHTFTVRDGCDDLVLLLASGGAENNRAPTSTVLTASALPCARRIAWSFLVG

SEQ ID NO: 165682 - protein, 102 aa, Triticum aestivum
  Clone ID: PAT_TA_60100.pep
GPFFFFFFVGRPTMTRARHVMDPTRHATTARFWPVARPFSAKMRPDTEPNPIRRPQRPILFILLTGAHPLITVGPTHFDLFFLFPKLQKLRQICDSIPRTAT

SEQ ID NO: 165683 - protein, 127 aa, Triticum aestivum
  Clone ID: PAT_TA_60101.pep
RPVREDLIPHSSYQTDIMKFTTLATTILSITLGADLASAACCDLKVCDGFNLKGRCKTACYPYTNTPVAINGDGLRGPIASGKTDTDCKCTLGKDHGSCMLVKSNKKGTNAPNHCLTGIAFAQCQRA

SEQ ID NO: 165684 - protein, 235 aa, Triticum aestivum
  unsure (1)..(235): unsure at all Xaa locations
  Clone ID: PAT_TA_60102.pep
MASPPPSSTVIQMPPSPQTNGQPTAGTVPAMPNDAGDVTIAPAAAAGPASKATDKVMSSAANLAQLLPTGTMLAYQALSPSFTNHGKCEASNQWLTAALVIILAALCILFSFTDSVLGRDQKLYYGVATPRGFNVFNFSDEEEKLKWTPAEFRRLRIRPLDFLHAIFTALVFLTVAFSDVGLQNCFFPNAGRNTAELLKNLPLGIAFLSSFCVMVFPXKXKGIGYTDTTPRKKLT

SEQ ID NO: 165685 - protein, 53 aa, Triticum aestivum
  Clone ID: PAT_TA_60103.pep
MAPAAKKQKKKWSKGKVKDKAQHAVVLDKTTSEKLYKDVQSYRLVTIATLADR

SEQ ID NO: 165686 - protein, 203 aa, Triticum aestivum
  Clone ID: PAT_TA_60104.pep
MEKSVFMLHRLLFLICLILAARTIGEGNGQLLYSGFTGANLTLDGAATVTPDGLLELTNGTDQQKGHAFYRTPLRFTGSPGAVVQSFSASFVFAIQSIFTDLSAHGMAFVVASSTNFSSALPGQLLGLTDVQNNGNGSNHFFAVELDTIQNKEFGDLNANHAGANVNGLRSLQSYYAGYFDDEDGSFRNLSLVKHVSFCIRVR

SEQ ID NO: 165687 - protein, 90 aa, Triticum aestivum
  Clone ID: PAT_TA_60105.pep
LGIFFIMAMVQTRLVSKSMVVEQWEENIGISIAYTPQSSYPILRRHLCHDRASILNFPLFTRTHSVLSYDVPINPKRAQVIYWEGPDRPA

SEQ ID NO: 165688 - protein, 90 aa, Triticum aestivum
  Clone ID: PAT_TA_60106.pep
RTGTWLLPRNRRRRTAAGGPATSARQRRPTGSSRRDRRRRPRSTRSSSQPPPHRRSWWPPHRSSRPRPRPRRRSRTRRPRRSSRWRCATI

SEQ ID NO: 165689 - protein, 61 aa, Triticum aestivum
  Clone ID: PAT_TA_60107.pep
MAPKRISVEPRSRRAPKGFVGSTYDALTSPENAAVVRSIALFGAVVTFLSSSWGEILLPPQ

SEQ ID NO: 165690 - protein, 142 aa, Triticum aestivum
  Clone ID: PAT_TA_60108.pep
AGRAPGPKSHLFTFSVKATCFYASSVSQWCFTVSLSVNVCLPSASVSSPPEDHRTCFLFFSSWRKSRVMMGGVLWGTPGYMYSRQIGCRVCSLKKMHYLQILYEYSRKPWRTGTSIICCFFPFPFHIALGNMTMMINSSNEE

SEQ ID NO: 165691 - protein, 106 aa, Triticum aestivum
  unsure (1)..(106): unsure at all Xaa locations
  Clone ID: PAT_TA_60109.pep
AGRVGLTPIATAGISYGYGFVFVXNNLAAAALVWFFLFESRALSLENVDLMYGQEGLKPWNSHKWVPPGYITREQRDEVHFQRGNEKPRNSESHSGEDSRVESVMA

SEQ ID NO: 165692 - protein, 88 aa, Triticum aestivum
  Clone ID: PAT_TA_60110.pep
LCCIGSGVGLAFQVSLSDEVMSVSSILVCHEASDISVAGEGGGSSISWISICVFSGDFSFLTGSSFLFFTFSFHTDNSCSRNDGTTTI

SEQ ID NO: 165693 - protein, 84 aa, Triticum aestivum
  unsure (1)..(84): unsure at all Xaa locations
  Clone ID: PAT_TA_60111.pep
RPGRDATRFLLKRSVWKGXHLVPLPIVWPKSTSDKVPPVRTQARSATILPNFVGLKFEVHNGKDYHEVTITEDMVGHKLGEFAP

SEQ ID NO: 165694 - protein, 166 aa, Triticum aestivum
  Clone ID: PAT_TA_60112.pep
MAQSTAHRRLLQEYRALTNNPPEGITAGPISEDDLLHWECLIQGPEGTPFEGGVFPAELKFPKDYPLAPPSMRFLADVWHPNVYPSGLVCISILHPPGDDPNHYEHASERWSPIQSVEKILISVMSMLAEPNDESPANVEAAKMWRERRTEYENKVREGVRRMLGL

SEQ ID NO: 165695 - protein, 246 aa, Triticum aestivum
  unsure (1)..(246): unsure at all Xaa locations
  Clone ID: PAT_TA_60113.pep
MDTYIDGRFERLEESTCYFXYDSDTKFHPSIHHGDELNAADKELTKGLEEVQTHQNDYLRIXRLRESSTALDTQIRETLSNLATTRKDIVTTHTTTFPAGPTYAIAYEELLNYARRISKTTMPPAGTIKAVPATVAPPTPEGQTPGVQTPGPDSQTASVMTPSAPPSSQVQSPAVMNGTPHVSQDPATQQSAMSANTSLPSEWTQFLNPLTDQIFLPWPNDLQLGAGALAAHQVLLEQGINPQGYD

SEQ ID NO: 165696 - protein, 238 aa, Triticum aestivum
  Clone ID: PAT_TA_60114.pep
PAGPGPFFSYQFLTASKMHCLLLLTAASLAAAHVPSVSVPACPKYGTIKFSKSVPDGDPFPRTEVDLCYTDTALSLQFTAFDEKYFYFNESQGTNDDIWAYEVVEAFIYKGTDDPQTYLEYEINPNNVTYQAFVYNPSKVRAEGAPFDHFFISDPEGDGFTAETQLNKRAKKWVSKAQIPLGLFNVDPGCAWGTKWRMNFFRTVTSPKMFPDQDLGGWSSPDKASFHITKFFGHVNFV

SEQ ID NO: 165697 - protein, 132 aa, Triticum aestivum
  Clone ID: PAT_TA_60115.pep
RPGRENLFVIKAMQSLNSRGYVKTQFSWQYYYYTLTPEGLDYLREWLHLPAEIVPATHIKQQRSHAPPRGMLGEGERERRPFGRGRGGDRGDREGGYRRRDAGEGKEGGAPGEFAPQFRGGFGRGRGAAPPS

SEQ ID NO: 165698 - protein, 104 aa, Triticum aestivum
  Clone ID: PAT_TA_60116.pep
MTTRRIVATEKTFLDKDDPIDETSSTAPAVPSQVIYKLLAFTFAMVFIPIGSYFLTVNTVFNGNSSFAGGLAAVLANVVLIGYIIVAMKEDQSDQLKAENKKDK

SEQ ID NO: 165699 - protein, 115 aa, Triticum aestivum
  Clone ID: PAT_TA_60117.pep
RPGWETPRRLEELPIEIKGLIMEEVSLLPSPYNNLLNLAQTCKQLSSHAISQLYLNDVRDSMEVDPESNMPLILQWACWFGALEAAKMSLEGLRRAGVDVKCKINQSFKNEKKKF

SEQ ID NO: 165700 - protein, 35 aa, Triticum aestivum
  unsure (1)..(35): unsure at all Xaa locations
  Clone ID: PAT_TA_60118.pep
DGGHYLAEFSISYKPVKHGRPGIGATHSXRFIPLK

SEQ ID NO: 165701 - protein, 42 aa, Triticum aestivum
  Clone ID: PAT_TA_60119.pep
RVVWLFCLQFCADYADLGVELLVDEYLYGLDVDVSDTLGPQD

SEQ ID NO: 165702 - protein, 134 aa, Triticum aestivum
  Clone ID: PAT_TA_60120.pep
PAGPRSGFFFTSHHISHFHINSLLVSLIHLCISCWSIPNTLKIPRLQPIRLPPPDKLCYSSNSLPQPATPAAPASFGAAEKPSSPQHTTTPISCPITNRPIRTRIELNLTKRRRPLKIKNTTLVIGKKKKKKAP

SEQ ID NO: 165703 - protein, 143 aa, Triticum aestivum
  Clone ID: PAT_TA_60121.pep
PDIPFGQPVSADTALQTSDYYLMSQYTGPGATILRNLRFNVLVSLVTKDEKPALQLRLLPRAKDGFIPIDKVDNISFLLALADINRWDGKTPRVLQPKSVQPLDAVSFKQLHYKDGVKAQYHPRTESNPPRTQALDISVFYSD

SEQ ID NO: 165704 - protein, 161 aa, Triticum aestivum
  Clone ID: PAT_TA_60122.pep
MASSSADPEKLMAKADKLTKLSFTRWNADWKSATALYEQAAIAYRFRKDNEKAKDAFEKASKGQEMISSPWDAAKHMENAGALAKELGLWNEVSDFYRRASEFYRECGRSQPASDALAKGASALEDKAPEEATKLYDDACTLLEEDGKDCSIMVYAIIIMK

SEQ ID NO: 165705 - protein, 49 aa, Triticum aestivum
  Clone ID: PAT_TA_60123.pep
HSRSWYLHHENSRNNETSYMLQIRETHHTSPSVCSFIHQLQHTIPRPGR

SEQ ID NO: 165706 - protein, 156 aa, Triticum aestivum
  Clone ID: PAT_TA_60124.pep
MADRGTSRGGGFASRGGDRGRGRGRGRGRGRGKNEEKEWQPVTKLGRLVKAGKINSMEEIYLHSLPIKEYQIVDNFLPKLKDEVMKIKPVQKQTRAGQRTRFKAIVIIGDSEGHVGLGIKTSKEVATAIRAAIIIYELMGAGNWCRGVTNQLCFIA

SEQ ID NO: 165707 - protein, 123 aa, Triticum aestivum
  Clone ID: PAT_TA_60125.pep
RQGRADGPTLLMFSRSRTALARHLSLTLPLLVSHVLLLTATASGITQASFPPLPGSSGRTATTTASGVHFAAVLPRVNLFPNLTSALYCPTVPFSARGSKHKPLLGNPDYPVELGEHELGRLA

SEQ ID NO: 165708 - protein, 136 aa, Triticum aestivum
  Clone ID: PAT_TA_60126.pep
RPGRVDPSGRLCHDKALNTILLFGNISHTKTSELTRLSWLDLAIQQPESHGNFHDPLLYTRLRCGLIFRIATYQWPSLPHHTFAYLDFPLADSHNYYNATMVQGPREGLNQLLFINWRGVVVHPEERPWITLAVDG

SEQ ID NO: 165709 - protein, 92 aa, Triticum aestivum
  Clone ID: PAT_TA_60127.pep
FDLIELCRYYPLAIHNSQAISTPVLIGSHPRASRPLTTTRLKRSVRAASFGWPTKRRQALTLVIRSAPCQITLTGNTQLKLQPLHSALSTAA

SEQ ID NO: 165710 - protein, 127 aa, Triticum aestivum
  Clone ID: PAT_TA_60128.pep
RTLRAIDSGPIRFVIPQRMNCPRNIAPAWKSTRTNPIGPARLSIASTKSSTSVVQAKLSLLARTLSFRQTWKTKHMASRRKIRAKSFQQRWLKEICWWRLERIHVIRSPRGSLRGRRGDVFSCIIPQ

SEQ ID NO: 165711 - protein, 164 aa, Triticum aestivum
  Clone ID: PAT_TA_60129.pep
PAVSESSYLFLPISLSSRELLPRSTLPQHLPLFLRPPADRSISGSRTPPSRLPSSDLHVRSQRPIHPFLDLAHDSPASLASVRRKFISLSLGSAERREAGGRYHSRMSSGHRRLRARRALAPVLPFIVDSQVLAPDSVANWDFSCKHLMIRIVICQKQRKKRSL

SEQ ID NO: 165712 - protein, 218 aa, Triticum aestivum
  Clone ID: PAT_TA_60130.pep
AGPVWEATASHQRPLHSTSKMAFEGEVSRLAARIAASSPARVRMAVGTLARSSAARAAADALVYLFVGTICVLSAATFLCAVAFRACGRNCSVAAAILFYSGMLSLLLMVPAMVLFFLRAAGSEVKYDVVEDRLRPWPLHRTAVAIWRFFVVATSVEFIGLVLQICGFPKVSYLLRAAALLCMLLVIALFCIRAAVALWRMNPRQSAAVAAVVFVYMV

SEQ ID NO: 165713 - protein, 111 aa, Triticum aestivum
  Clone ID: PAT_TA_60131.pep
VRRSRRPGLPIMVYSAGLKLNTACPMCTICLSDFEAGEHVKVLPKCNHGFHVRCIDRWLLARSTCPTCRQSLFAEPHKACGCSEASQVDPARVHSVLVPLRPEGLITTYDF

SEQ ID NO: 165714 - protein, 160 aa, Triticum aestivum
  Clone ID: PAT_TA_60132.pep
LDCQPPPGSTLSLIVLQLADRGGGPDPVPTCASTASRGAVPAPGRLVTVGAALADLALFQAATLCEQALQDTLLRRSEVDLAPYFFLPQPAILHTLRPTPVRLARPPTDAREEISGLKIGARRLVLSSASVVLLLHLNLKCREVVFYICHGLLERPNNSC

SEQ ID NO: 165715 - protein, 145 aa, Triticum aestivum
  Clone ID: PAT_TA_60133.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSQKAAAKSPKKKTAATKE

SEQ ID NO: 165716 - protein, 160 aa, Triticum aestivum
  Clone ID: PAT_TA_60134.pep
SPSPQPERQRASSSSSSKPTSSITRRGNARQGSMCNVITIPSVAWLRRAVRRWRARRSASAPVPAGHVAVCAEGARFMVRLAHLSHPAFLELLRQAEEEYGFRSGSSGPVALPCDEARLRDVLRRVSSSCDSEEPRRPFCRRRGDSRPLLQAVAVEKLFL

SEQ ID NO: 165717 - protein, 238 aa, Triticum aestivum
  unsure (1)..(238): unsure at all Xaa locations
  Clone ID: PAT_TA_60135.pep
MAEKSGVTGLDFEFVKTPAFPKPDFDKLENVGVPTTRYPAIKNAPLPADGSGSDTFNNYVLISILTIVPWWLSWKVGGGFKTTLFFAIIVDLPMLAAWWLTISAISPRKNEKVRLPNRGVEHYLEFKKEADRAKYRGTNKIPMETFYEMYXXGDVDFKGDCLEVMEQRHDWVSFRFTIGLIKFFLFGRMPEVIMHTRSQDEEQVRDHYDRGDDFYGWFLXPRMIYTSGIISDINREET

SEQ ID NO: 165718 - protein, 51 aa, Triticum aestivum
  unsure (1)..(51): unsure at all Xaa locations
  Clone ID: PAT_TA_60136.pep
TQISQAGLVQRNYTQYDDKLRQIALQIYLCLLAHMSAPPWIXSRFCRKRPA

SEQ ID NO: 165719 - protein, 137 aa, Triticum aestivum
  Clone ID: PAT_TA_60137.pep
VRRSRRPVGPSFSSSSIHISFSIGSSSISSPQRSCCLLPCALLLLQAAAHARGPVQRLHVPDHTPPMKVAGPRRVLPLLRVGRPWEVGRPWFFGVTRGCRDHDTTTSEGSCKRCSAGSCKRRRRHHTCCGGAATMDW

SEQ ID NO: 165720 - protein, 138 aa, Triticum aestivum
  Clone ID: PAT_TA_60138.pep
MANASSGAGIHDDCKLRFVELKSKRMHRFITYRLENQKEVIVDQTGEREATYEDFTKTLPENDCRFAVFDFDFTTPEDVPKSRIFYIFWSPDTAKVRSKMTYASTNEKFKRTLDGIQIEMQATDPSEISLDVIKERAH

SEQ ID NO: 165721 - protein, 136 aa, Triticum aestivum
  Clone ID: PAT_TA_60139.pep
MAALVGDAAYWLAEHPDIVGFRWSPSGLWFSTWAFLLGFLATYVSLCLAADALLRRRKQPLPLGPLPAAHALLMAAVSAAIFAGTLLSAVAEIRDTRWSWRGRSRTTPLRWLLCFPPGTRSSDRVFFWSYAYYLSR

SEQ ID NO: 165722 - protein, 61 aa, Triticum aestivum
  Clone ID: PAT_TA_60140.pep
SSKLNIIASRWSSKGPCLVVCPWFDCYLSCRPESIAHSSSPNFKLKVCWTFQGLVVIISHF

SEQ ID NO: 165723 - protein, 88 aa, Triticum aestivum
  Clone ID: PAT_TA_60141.pep
PAGLGFDWASSIFQALHTSSSKLIALAKVVVVWRLWRIPLEKQSPCIPTVTLFNSMSVEALKVIYISDIAARASVCLARQQQEDRHVM

SEQ ID NO: 165724 - protein, 225 aa, Triticum aestivum
  Clone ID: PAT_TA_60142.pep
MPRKLSKNPLPPSSSTLSSMSSASGASSLLPSSLADPSLPLPKLIVFDLDYTLWPFWIDTHVTPPLKPNSSHTSATDRYGEDYGFFSDVPAILYALPRAGIKIGVASRTSAPSLARDLLKMLHITAPEGNTKEKPKKALDMFDGLLEIYPGCKIKHFESLQKRTGIKYEDMLFFDDEARNRDTESLGVTMCLVKDGVTWDELERGVTQWRNKRGYIKRPDAIELE

SEQ ID NO: 165725 - protein, 118 aa, Triticum aestivum
  Clone ID: PAT_TA_60143.pep
RPGRDFSSRLSPPSFLPRRRGSSLGFLAPALPPHRRARTPCRSNEGAPTRSSGPRSARRTMNYNDLEYLHKNNVMKMPSDYLKGESGRERRRCGGSERRMRVNKRVWPPLLNAAHDGN

SEQ ID NO: 165726 - protein, 235 aa, Triticum aestivum
  unsure (1)..(235): unsure at all Xaa locations
  Clone ID: PAT_TA_60144.pep
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPHPSPCQLQGTCGVGSTPILGQCVEFLRHQCSPTATPYCSPQCQSLRQQCCQQLRQVEPQHRYQAIFGLVLQSILQQQPQSGQVAGLLAAQIAQQLTAMCGLQQPTPCPYAXCRAVSPTEETMCCSIAAG

SEQ ID NO: 165727 - protein, 72 aa, Triticum aestivum
  unsure (1)..(72): unsure at all Xaa locations
  Clone ID: PAT_TA_60145.pep
GPFFFFFFXFFFXWXXXXXXXFFFFFFFFFFFFFFFFFXXLATSLSIKSSTPATFPTEPATFISDDCGEAGE

SEQ ID NO: 165728 - protein, 61 aa, Triticum aestivum
  Clone ID: PAT_TA_60146.pep
CNFEELARSTDDFNGAQLKAVCVEAGMLALRRDATEVIHEDFNEGIIQVQAKKKSSLNYYA

SEQ ID NO: 165729 - protein, 99 aa, Triticum aestivum
  Clone ID: PAT_TA_60147.pep
PAGPGRSESCIHLAPRSIVRPWQRSTPSSTSSSSYYVLSIISLIAAASKNIKKRASTPHTLSTAHQFSLRTARAKAHMRCKLDNGPIILQPILIGTKAS

SEQ ID NO: 165730 - protein, 86 aa, Triticum aestivum
  Clone ID: PAT_TA_60148.pep
PFSEREWWEERYSAWPDVAYSTITSERSGACRSIARIYRCEVCEQVFSPVQGRGRWRAYSACVIPSPIGWIGSRGPSRGQTVSTQA

SEQ ID NO: 165731 - protein, 132 aa, Triticum aestivum
  Clone ID: PAT_TA_60149.pep
MAPGKKRGSKAKGAPAPAAAAAAGGAGAGGEFPGCLRLMPPSTVAISVHAKPGSKMATITEIGEEAVGVQIDAPARDGEANAALVDFISSVLGVKKREVSIGSGSKSREKVVLVQDATLKGVFEALNKACGP

SEQ ID NO: 165732 - protein, 42 aa, Triticum aestivum
  Clone ID: PAT_TA_60150.pep
LVKTGHPRSKPVNREGRVESYPILRLGGCNLDGIKVRGCKLN

SEQ ID NO: 165733 - protein, 149 aa, Triticum aestivum
  Clone ID: PAT_TA_60151.pep
RGLFFFFFCFKPSNILLDSDMVTHVRDLGLARALPKHPSGCLEKSSGWATMRGTIGYAALEYGLGNKVSILGDVYSYGVLLLEMFTGKRPTDGEFGEALGLHKHVQMALRVPDRTTNCYQRTKMEEKQTPQTKSISPHRLHRAPDPNRP

SEQ ID NO: 165734 - protein, 103 aa, Triticum aestivum
  Clone ID: PAT_TA_60152.pep
MDRVMKLASERAVVIFSLSSCCMCHTVARLFCDLGVNALVHELDQDPKGKEMERALLKMLGKGPSVPVVFIGGKLVGGTNRVMSMHLSGELVPMLRNAGALWL

SEQ ID NO: 165735 - protein, 61 aa, Triticum aestivum
  Clone ID: PAT_TA_60153.pep
CNFVSRTLLSILSIIYLDEQQGTKFVATLTYDLRSFHFASVLWLSQPHVLLHLKKKKKKAP

SEQ ID NO: 165736 - protein, 68 aa, Triticum aestivum
  Clone ID: PAT_TA_60154.pep
LNMAMRPHGLMCTGKKNHASSTRHTTRISSSNSINILEQQQHQRQHIVNLRQQMQATTIVDRSPDPAG

SEQ ID NO: 165737 - protein, 124 aa, Triticum aestivum
  Clone ID: PAT_TA_60155.pep
HLTSVSYDPGYGEAGRAMTAVSCSDGTNGLITRYGWKTQGQIPKFPYIGGAQAVAGWNSPSCGTCWKLTYKGKSINVLAIDHTAAGFNISPAAMNALTNNQAVQLGRVDATATQVAVSNCGLKK

SEQ ID NO: 165738 - protein, 240 aa, Triticum aestivum
  Clone ID: PAT_TA_60156.pep
MLPSSVRRVVASAVSTPQTGVVSSLASATLKTTPVFVRNHQRRCSSSKPSKSDNGPNDISAGQSVPATTTPKSGGEKRKRKSNKDASDRAASMKKLPSVPSTHHMSQEALGLSSFFSLHRPISVTQTMPRAVTDEHFASIFAARSRNNKLADTESTLSSTIEQLEGPMAQMTIGGQEGQEVMHKVDIKNPDGTESSMYLQIDTMSGEFLPFRPPPLPQVEAAGKSESAVAEAEAVEDVPQ

SEQ ID NO: 165739 - protein, 86 aa, Triticum aestivum
  Clone ID: PAT_TA_60157.pep
WSERAQTMASKVFAMLAIVLVLTHGHLPAVMGQTTPPDRPKYFARQDAAPAAGNGAAAGSGFTEEKGWFFQRPLARPTPLPPSLKL

SEQ ID NO: 165740 - protein, 159 aa, Triticum aestivum
  Clone ID: PAT_TA_60158.pep
MDASATGAGAKAKKGVSGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRTAEKESKEGKSPKKTAKSPKKAEKKA

SEQ ID NO: 165741 - protein, 45 aa, Triticum aestivum
  Clone ID: PAT_TA_60159.pep
GAFFFFFFRWSWWNLRWFFFFFFFFFFFFFFFFFLAKIFGIFYLR

SEQ ID NO: 165742 - protein, 63 aa, Triticum aestivum
  Clone ID: PAT_TA_60160.pep
GPFFFFFLGYARFTIFPGNEVTVVKLSRQAGFCSLRTGMPNKQSNAKFHYFPGKTVKTHTDII

SEQ ID NO: 165743 - protein, 71 aa, Triticum aestivum
  Clone ID: PAT_TA_60161.pep
TERGGEGVKNMSHDWPVYCFVLSLTAAEPPVPPPPHRRGGGGAFFNHCITVMSSNSTKDTLLSSLACAAWM

SEQ ID NO: 165744 - protein, 136 aa, Triticum aestivum
  Clone ID: PAT_TA_60162.pep
MAPKAAEKKPVEKTPAGKKPKAEKKVPASKEGGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 165745 - protein, 242 aa, Triticum aestivum
  unsure (1)..(242): unsure at all Xaa locations
  Clone ID: PAT_TA_60163.pep
MAQDPRALLQKAQKQLQSAGGGFSFFGGREDKYQEAADLFTQAANAFKMQQQNLEAGKAFEQAAXVQTDKLKEPDDAANTLVDAFKAYRKDDPQAAARCLNVAVDRYCAKGNFRRAASHKENLGELYEVDLGDAKSAIESYELAATWYEGDNAAALANKLWLKVADVAALEGDYYKAIEKYEKVAEQSINNNLMKYSVKDYLXQAGICHLASXDLVAAQRALEKYRDMDPSFGAQREHQLYA

SEQ ID NO: 165746 - protein, 99 aa, Triticum aestivum; identical to SEQ ID NO: 123195
  Clone ID: PAT_TA_60164.pep

SEQ ID NO: 165747 - protein, 234 aa, Triticum aestivum
  unsure (1)..(234): unsure at all Xaa locations
  Clone ID: PAT_TA_60165.pep
MASTPPQADYGKEAVLDVSENQDVETGEVKNGGLQRDLKNRHMQMIAIGGAIGAGLFVGSGGALQKGGPAALLIGYLIIGIMLLCTCLALAEMAVLYPVNGAFFTYICRFVDPSWGFAMGWQYALAWLTVLPFELIAASITIKFWREDINMAVWVSVFLVTLIGIQFFGVRGYGEVEFVLSIIKICAWCGFIILGIVINCGXGVGDQGYIGVKYWQDPGAFTSFKGFCAVFVVA

SEQ ID NO: 165748 - protein, 66 aa, Triticum aestivum
  Clone ID: PAT_TA_60166.pep
RPVREGHAAIRADPTMAKSTKAPPKTHKRYNPKKLTYEQRKASLVERLNALNNSAGAADDDEDDDE

SEQ ID NO: 165749 - protein, 51 aa, Triticum aestivum
  unsure (1)..(51): unsure at all Xaa locations
  Clone ID: PAT_TA_60167.pep
MAFWQARDFLGSAAWCGXTLLDFNSHRYASCPLCGFKRKAKEIEGKETRYA

SEQ ID NO: 165750 - protein, 78 aa, Triticum aestivum
  Clone ID: PAT_TA_60168.pep
ILENLWPQGLPLPWPVSCLYTLAHPYTLPENKHVHQDCQRMVNVLQGVVHHKQRQRAYNGARSESLTGWISLTFKGIS

SEQ ID NO: 165751 - protein, 174 aa, Triticum aestivum
  Clone ID: PAT_TA_60169.pep
MAETEYRCFVGGLAWATDDHNLQQAFSQYGEILDAKIINDRETGRSRGFGFVTFGSEESMRQAIEEMNGKELDGRNITVNEAQSRRSGGGGGGGGYGGQRGGSGGYGGGGGGYGGQGGGGYGQGGGGGYGQGGGGYGGQRGGDGYGGGGGGYGGGGGGYGGQRGGGDSGGQWRN

SEQ ID NO: 165752 - protein, 159 aa, Triticum aestivum
  Clone ID: PAT_TA_60170.pep
MDASATGAGAKAKKGAAGRKAGGPRKKSVTRSVKAGLQFPVGRIGRYLKKGRYAKRVGTGAPVYLAAVLEYLAAELLELAGNAAKDNKKSRIVPRHLLLAVRNDQELGRLLAGVTIAHGGVLPNINPVLLPKRTAEKETKESKSPKKTAKSPKKADKKA

SEQ ID NO: 165753 - protein, 173 aa, Triticum aestivum
  Clone ID: PAT_TA_60171.pep
VRRSRRPGPDTACRPSLLHGEATAALAAPPGHAPSSRSSSRLRACRLVLLPSTRVAPSKPPAAAPSYLLPATSGTPGTRPTTPSSCLLLGMHATPGRACFLGHLRRGRQPVLHPSTRRALMLVLKDSMETMKGWHRRRAWSFKVRVLDGAPWKERHLRRRVAGRGERVHVCVH

SEQ ID NO: 165754 - protein, 144 aa, Triticum aestivum
  Clone ID: PAT_TA_60172.pep
NALCARRYNSSPLIIIWIYWSNIQHYALPPCLFHHFQKRWEMRGPWELATPAPWPVQGEPPPSLTYLLPVLSGRRCPAHPPEGRVQVDDGALVPVPLRIWASLHSIWGLPSPSLPFLWRGRKVMVERRRWRERRPPELGSGPGR

SEQ ID NO: 165755 - protein, 107 aa, Triticum aestivum
  Clone ID: PAT_TA_60173.pep
MQALARAARGFWPAAAAAAGRGNRGQVQPSRGIVVHVRDGNLERALQVMERKMRSSGIERLIKRRTEHHVKNSEKRVLARKALMARVRSQELGKNLRDILIKKIRGQ

SEQ ID NO: 165756 - protein, 98 aa, Triticum aestivum
  Clone ID: PAT_TA_60174.pep
GPFFFFFFLYLQHLSFHSSVPDQSILSHPIPSLISLLQPLTSPKVERKKAAISLGRIHKRQRDGAPLTSRKKRRKHMRNSKIKREFQDTRKKIKKTNN

SEQ ID NO: 165757 - protein, 69 aa, Triticum aestivum; identical to SEQ ID NO: 164397
  Clone ID: PAT_TA_60175.pep

SEQ ID NO: 165758 - protein, 43 aa, Triticum aestivum
  Clone ID: PAT_TA_60176.pep
GPFFFFFFFFFFFFFFFFFFFFFFFFFFFFQKALLVVLLHGKM

SEQ ID NO: 165759 - protein, 32 aa, Triticum aestivum
  Clone ID: PAT_TA_60177.pep
AGRVGSLLWVKIDPFISDTQKAVAMGQCGVNC

SEQ ID NO: 165760 - protein, 59 aa, Triticum aestivum
  Clone ID: PAT_TA_60178.pep
VHKNCSQIDSEVYFSSEEMSSPCPSEFLSIPNICTLRCRRQHHNNSPINSIYRRLLTNQ

SEQ ID NO: 165761 - protein, 52 aa, Triticum aestivum
  Clone ID: PAT_TA_60179.pep
MASAPVEKLKSLWNSQVMDEEQWAVNYRVLKAAGIFAGSIFLMRAFGDMMVV

SEQ ID NO: 165762 - protein, 75 aa, Triticum aestivum; identical to SEQ ID NO: 106874
  Clone ID: PAT_TA_60180.pep

SEQ ID NO: 165763 - protein, 114 aa, Triticum aestivum
  unsure (1)..(114): unsure at all Xaa locations
  Clone ID: PAT_TA_60181.pep
MKGIPPDHWLVTSPALLFYDARSMAHYSLQNVYTIHAALRLPXRTFCLCLKKVFTTPQKIKHKRAPTNLAVLKQYEAHSVWEIESLLSKRPTYTCGPGAFMADMEDHHYCVLCT

SEQ ID NO: 165764 - protein, 84 aa, Triticum aestivum; identical to SEQ ID NO: 157489
  Clone ID: PAT_TA_60182.pep

SEQ ID NO: 165765 - protein, 200 aa, Triticum aestivum
  unsure (1)..(200): unsure at all Xaa locations
  Clone ID: PAT_TA_60183.pep
AGRVGSTTRPTSSPIARWAYGAPTPALELDQLSKTEMXGGHNLRFRHQSDDLSCHMTFSLFLPASPDSNLPELYWFSGLACTDENFIIKAGAHGAAAAHRVALVAXPHTSPRETXMYKARQIDEMMAVALHIMRMPQKDNXENVARDDYGGKELPKVLTDNYEQLTTSCASIVAHSMRGHSVLAIYLKNTDKYEYVSAFA

SEQ ID NO: 165766 - protein, 117 aa, Triticum aestivum; identical to SEQ ID NO: 133889
  Clone ID: PAT_TA_60184.pep

SEQ ID NO: 165767 - protein, 67 aa, Triticum aestivum
  unsure (1)..(67): unsure at all Xaa locations
  Clone ID: PAT_TA_60185.pep
SSRPVGKVHGGGDSSSSSSDSDDEKKGSAAGVKAKIYRLFGREKPVHAVLGGGKPADLVXWRNKIIP

SEQ ID NO: 165768 - protein, 131 aa, Triticum aestivum
  unsure (1)..(131): unsure at all Xaa locations
  Clone ID: PAT_TA_60186.pep
MPMQKQETQGAEMASNYVDTTGEEGRFHAHGHHSNSTTPTGEAASPKNTRRRWPGSASAPSGAGHRLASKCVCAPATHAGSFKCRFHRTNSQGHGHGQGQGSRPSSPPSPAAXNTVARHPSPSSSSIVATQ

SEQ ID NO: 165769 - protein, 69 aa, Triticum aestivum
  Clone ID: PAT_TA_60187.pep
MAAKYPLLLGVVLVALLLVSQDVAHAVEETMPAQRPDGYSGYGPGYGGGYDNNGGGGAGQNGDGGSGYP

SEQ ID NO: 165770 - protein, 146 aa, Triticum aestivum
  unsure (1)..(146): unsure at all Xaa locations
  Clone ID: PAT_TA_60188.pep
PAGPGNKSDVYSYGMMLLEMVGGRRNVKSIVAKSSEKYFPDWIYDHFAQDEGLQACEVTREIEEIARKMIIIGLWCIQVLPMYRPTITXLEMFERRLDDLDMPPKQNFCELLESSAQNLDVKSSCSTKPEEISLVNSKILQQSPTL

SEQ ID NO: 165771 - protein, 91 aa, Triticum aestivum
  Clone ID: PAT_TA_60189.pep
KGPLFCTYILFFLELKNIHIHSLFFTQPHCHLVHSGINVAVPNKTPLGKELLIQNDHPFLLPFSLCVSHKQQIKLQMNIDVLFSFLVSVAL

SEQ ID NO: 165772 - protein, 75 aa, Triticum aestivum; identical to SEQ ID NO: 106874
  Clone ID: PAT_TA_60190.pep

SEQ ID NO: 165773 - protein, 92 aa, Triticum aestivum
  Clone ID: PAT_TA_60191.pep
AGRVRYRAVLQRLSSAFVGKEDRLRLLVAAAADSSRASLKKRGLHLAPWRKPEYMRAKWLSPYEREAPPPAPDASASELAAIGEGGEDGAKV

SEQ ID NO: 165774 - protein, 96 aa, Triticum aestivum
  Clone ID: PAT_TA_60192.pep
MKNSTLVAILVVLQAIMVIGILSHAADDNFPKCCDHCNSWSGYQFCDDVGPRCRDGCVNCHVVETSPVKTFRCGDGRPVLGGQGTPTPCPPPCKKH

SEQ ID NO: 165775 - protein, 186 aa, Triticum aestivum
  Clone ID: PAT_TA_60193.pep
RPVRGSCSVLPLSPLPFMSCGAHTAPYSWLFVPSPAVQLPPPSGHPRCRLSVRATCAPTSSSVPAGGGSARQQTRPRLVAAHSIPPPPPPTARTVRRDAATGLAFLLFVLGMVISSALSLVIVSFPAWRALQQMEIAARKLSKLAAQEVPGTISSLKLSFMEMNDLTSQLKKIRHIFTTNRSGKDR

SEQ ID NO: 165776 - protein, 122 aa, Triticum aestivum; identical to SEQ ID NO: 128638
  Clone ID: PAT_TA_60194.pep

SEQ ID NO: 165777 - protein, 142 aa, Triticum aestivum
  Clone ID: PAT_TA_60195.pep
RPGRVAGVLTMRPWERVIDPSFGHLVLDGNNTDHSEMQMYANLYFPQISELLRRLPNVILLMLKTNDCLRAVNHALVGGSTPESFEIIARASSEAVFEAKRMEKRFFLYRFIIWLEELLNELHLFGMKLWLHYQQPRRILAG

SEQ ID NO: 165778 - protein, 56 aa, Triticum aestivum
  Clone ID: PAT_TA_60196.pep
MGKNIPRFQKGKDKGGKNPAVGKPKKKKKKKKKKKKKKKRKKKKKKAPKAPAPPKT

SEQ ID NO: 165779 - protein, 106 aa, Triticum aestivum
  Clone ID: PAT_TA_60197.pep
RGLFFFFFCTPYDPNILTKITVHQDHFKSRTQERERDQTHSYWYIPSAPRVNYPLLIMVAAGMMKMASGDDFPLRQGAGTGSRLNFHGQRFRRGLLPPDRPPRAPH

SEQ ID NO: 165780 - protein, 145 aa, Triticum aestivum
  Clone ID: PAT_TA_60198.pep
MLSLSRTLARRLFSTAAAGSEGAAAASTSVVRKAQNPLEEFFEVERSTADDQPAPHYGRGWKASELRLKSWDDLHKLWYVLLKEKNVLMSQRQMLASENMHFPNPERISKVKRSMCRIKHVLTERAIADPDPRRTAEMKRMINAM

SEQ ID NO: 165781 - protein, 228 aa, Triticum aestivum
  Clone ID: PAT_TA_60199.pep
PAGSEVTSFPPIVGYSTASTIAGFVYGFPLGWPIVASGCTAGALCAFLASRTVLSKYVDRMVGQDHRFVALGQVLRQEGIWYLTGIRFCPLPFSLSNGFLATIPSITPLAFTISTALSSPKLLVHVFIGSRLALLAEKGDKMSAGSKAINYLSMLLGGAVGLIVGLVIYRRTMARAEELAQQEGLDPAGASVEAGEAGYVDSDNSPLMDPEEAAALMSDDDILAMGTG

SEQ ID NO: 165782 - protein, 150 aa, Triticum aestivum
  Clone ID: PAT_TA_60200.pep
AGRAAKQSPSFLLLLILKKHRTLVPKKEMEVKKRAAAIAALCIMFLLVLPSGQRQQVAAMSDFCKCFNDCYPGCRSPGVPRWLCVPFCANKCSPNTNQAGDGVGSAAATCRMACKIHICDFSEAPADAADADVCVQNCNKMKIWSHKAHN

SEQ ID NO: 165783 - protein, 91 aa, Triticum aestivum
  Clone ID: PAT_TA_60201.pep
GAFFFFFFIFFFFFFFFFFFFNNNSAIIIIIKKCMYVWRKICMGKRKFHTNTPSFISRYGLLVGCKVTPRTCCTTHVLDLKLEVVHALSLE

SEQ ID NO: 165784 - protein, 62 aa, Triticum aestivum
  Clone ID: PAT_TA_60202.pep
GPFFFFFFFFFFLFFFFFFFFFFFFFFFFKQQKYGYALVHSSTASHHAMPCHANQSSTLIKY

SEQ ID NO: 165785 - protein, 103 aa, Triticum aestivum; identical to SEQ ID NO: 107316
  Clone ID: PAT_TA_60203.pep

SEQ ID NO: 165786 - protein, 273 aa, Triticum aestivum
  unsure (1)..(273): unsure at all Xaa locations
  Clone ID: PAT_TA_60204.pep
AGRVWVLQFIGRIIGKALYEGRVLDCYFSRALYKRILGKSVSVKDMESFDPDYYKSLCWMLDNDITDIITETFSVEDDEFGVTNVVDLIPNGREIAVTEENKHDYVRLVVEHKLLSSVKEQMAHFLQGFHDIIPAELISIFNEQELELLISGLPDIDIDDWKSNTEYHNYTPSSQQIQWFWRALRSFDKEERAKMLQFVTGTSKVPLNGFKELEGMNGVNRFNIHRDYGNKNRLPSSHTCFNQLDLPEYESYDHLRSQXMKAITAGKRYFGFA

SEQ ID NO: 165787 - protein, 55 aa, Triticum aestivum
  Clone ID: PAT_TA_60205.pep
KKIVGGSSDEPGYASQIAVFRRMARNQGESSLNEDDSHQPYEVLWEWPNASIPSH

SEQ ID NO: 165788 - protein, 86 aa, Triticum aestivum; identical to SEQ ID NO: 119162
  Clone ID: PAT_TA_60206.pep

SEQ ID NO: 165789 - protein, 79 aa, Triticum aestivum
  Clone ID: PAT_TA_60207.pep
RSWKASSREYPCRRASTRSCCSRPTKGWSPVHIIVSPPFIEATVMVLNHCFARGGGDLYSSRLMNYNQNFRAQFSRPGR

SEQ ID NO: 165790 - protein, 201 aa, Triticum aestivum
  unsure (1)..(201): unsure at all Xaa locations
  Clone ID: PAT_TA_60208.pep
MVLRDQPHVAYQEMITHLPLCSIKDPKKVLVIGGGDGGVLREVSRHSSVEQIDICEIDKMVVDVSKQFFPHLALGFEDPRVSLHIGDGVAFLKNAPEGTYDAVIVDSSDPVGPAQELFEKPFFESVSRALRPGGVVCTQAESIWLHMHIIEDIVTNCRQVFXGSVNYAWTTVPTYPSGVIGFMLCSTEGPSGDSSIPSSAS

SEQ ID NO: 165791 - protein, 130 aa, Triticum aestivum
  Clone ID: PAT_TA_60209.pep
MAMISPAAATVVTARPAQALGLPQLRVTRAEKLRCGYSKDGKEAAAASPAVVKGAPLLAAASAAVSATAASPALALVDERMSTEGTGLSLGLSNNLLGWILLGVFGLIWSLYTVYSSTLDDDDESGGPSL

SEQ ID NO: 165792 - protein, 109 aa, Triticum aestivum
  Clone ID: PAT_TA_60210.pep
WAWAVWSLLAPMASIIPNKRLAWSTIHSRTGTCLITKHSLTPMISTRIRFNSYNHDFNLQKTQKRLLLLTQKPHVGKHEGRGGWKITVSCEAILWLGYSCLSGTGLICT

SEQ ID NO: 165793 - protein, 49 aa, Triticum aestivum
  Clone ID: PAT_TA_60211.pep
GAFFFFFFRRKTLLTEIKQKVPARIILSDKVSSTELSPHKFHINQALYR

SEQ ID NO: 165794 - protein, 114 aa, Triticum aestivum
  Clone ID: PAT_TA_60212.pep
PSPAPASTQVDAPAPTSAPISAETIPAEGDAGSSPVQTTEKKDKDKEKEKDKEHKEHITIEDLTLPKSIITRLSKGVLPPNTQIQANAIMDLSQSTTVFINYLASHANENTVNA

SEQ ID NO: 165795 - protein, 124 aa, Triticum aestivum
  unsure (1)..(124): unsure at all Xaa locations
  Clone ID: PAT_TA_60213.pep
MAPSQEVAPPAAATTKEPSTNGNGTAAPAPKTKAPALNERILSSIXRRSVAAHPWHDLEIGPDAPTIFNCVIEIXQGSKVKYELGKKTGLIKVXRVLYSSVVXPHNYGFIPRTLCDGSDPIDGL

SEQ ID NO: 165796 - protein, 75 aa, Triticum aestivum
  Clone ID: PAT_TA_60214.pep
STDIVSTKAFSLQVVWAMKDSSEIIKVHTGSSDASEPFQGPNPCDSNIKLWFTLLRSSKSYSSPTARPGRPERRT

SEQ ID NO: 165797 - protein, 120 aa, Triticum aestivum
  Clone ID: PAT_TA_60215.pep
HRRGKSSGGRPSPSQTGGASAECPRSPDLPLLHKQPATTEQGSRCASSGEGGRFHSILQVNQTRPPSVTCLCEGREGRAASRVGSVGDEGGWLGYFSSKVEKNPLKVLMYLFILFFPIKN

SEQ ID NO: 165798 - protein, 109 aa, Triticum aestivum
  Clone ID: PAT_TA_60216.pep
CGARGGRVGIRLASRSHPLAPPPSTITDEPTTMDRKKPIPPAAQRAIDCALVTACFPFDSLALHIRRSHVTTSTACSARRGSLTRKNRRSLPSASQCCATPGSNLSPSG

SEQ ID NO: 165799 - protein, 108 aa, Triticum aestivum
  Clone ID: PAT_TA_60217.pep
RGLFFFFFYFFFFFFLLVEGDLQRFGIQPDGALTLYGVPFQGTRKAPHQNHPLQITTRARKPDFKFELLPLHSPLLGQSLLVSFPPLIDMLKFSGYSYLIRGQPEPGR

SEQ ID NO: 165800 - protein, 173 aa, Triticum aestivum
  Clone ID: PAT_TA_60218.pep
AGRVWGWSPPMWRARHHGRRRLDAPRVHRWRGMHPLSMAAHSHGRTRLLVRLRQELDVRPLHGRQSQGVPVAMAKLQPATGAASSCWNRGDLLEPAVVHATRSMPRRSKLHPAVKSVASNAIRCRELQACTSGLRPATSGAARGEAIFCGCVLVLPNQLCCCWNRCIFLLEPR

SEQ ID NO: 165801 - protein, 233 aa, Triticum aestivum
  unsure (1)..(233): unsure at all Xaa locations
  Clone ID: PAT_TA_60219.pep
MAGATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGXAVEGYRVAGDPLGEIVDPLYPGGSFDPLGLAEDPEAFAELKVKEXQNGRLAMFSMFGFFVQAI

SEQ ID NO: 165802 - protein, 107 aa, Triticum aestivum
  Clone ID: PAT_TA_60220.pep
LSPSLPRLDSPTQHPSKPSPPPAPWAARCPAPTTRATPPPPPPPPPDSRRRHRRIINSSSSSTGPSGARPLPGRSRRRGSGFPRPVRRLGFGTIRRRRRRATRNNLL

SEQ ID NO: 165803 - protein, 222 aa, Triticum aestivum
  Clone ID: PAT_TA_60221.pep
VRRSRRPGSVGGWVSRKLRTLAQFSIRDMDAESTAGDMMDPSRASMVSVRSGGGAAPGSSSLRNVEPAPQILEEEHDQMTPRHEYEAAPTMISELPDGQETPTGFQHSQYEHPPQSAGSQAPAQLNLSHQPDQGFDMDFSRYSSAEPDHGPVHRRPVPGQAQQPEPMQGYGQAPPQIRLPGVDGREEGGFWSQQEKNEKSEEDWTTDAMMHMNLAGDMKPPR

SEQ ID NO: 165804 - protein, 211 aa, Triticum aestivum
  unsure (1)..(211): unsure at all Xaa locations
  Clone ID: PAT_TA_60222.pep
MASLLFLPHTTPTASPRAAARPRAGAITCGPRDNRGPLQRGRSLSTEAIHAVQSLKRLTAADRSPSAARGAASASLGRLLRADFLAAMAELQRQGHWSLALAALHVARAEPWYRPDPELYATFVSSSPPSEAAAGAVDALVEAFLEEKEEGRGGRLSELEGPWVGVDVYRLTRLVRALVAKGRARAAWPVYEAAVRRXGCDVNEYMYRVMA

SEQ ID NO: 165805 - protein, 105 aa, Triticum aestivum
  Clone ID: PAT_TA_60223.pep
QYSPMPLLSESSLSESTRDSTRAWDMILRTPMVRKRDALVCGVDALTWIALGIFGRSPREQPHGTILSLRPHSAAGIVQDIPRTAAPGDRVHQMGVVRQLPGPAG

SEQ ID NO: 165806 - protein, 102 aa, Triticum aestivum
  Clone ID: PAT_TA_60224.pep
NKMFTSCRVRSAFPISGHRNIFSLQSRCHILFTSLGTSLSSFGVCNTSWRVHSFCIWYVQLRAPLSLHFFLIQQSAVVKRRDAIIVTDLPLVFSSRLRGPCV

SEQ ID NO: 165807 - protein, 236 aa, Triticum aestivum
  unsure (1)..(236): unsure at all Xaa locations
  Clone ID: PAT_TA_60225.pep
RGRGTASVTSPDDLLLDILRRLDTRTALGAAALSRRWASLPREVPVLDLKVSDILPXRYHRCFRLREDARDSKISSTLSDRRLLEAITARYERRAMRSMVCSLKSLLASQARRRVERLSLEVFAYSTSACINRLVVDAVGASGIWRLLPPRQGRSRVWSRRPTASLLASSAGSPASPDCEASSLPTACPRRSGDSTRSPRSSCETCRFPRRRPPTRKRSPRARSCKCYTSFHARSR

SEQ ID NO: 165808 - protein, 141 aa, Triticum aestivum
  Clone ID: PAT_TA_60226.pep
PKYWDTMYYNNLLTIPVLVFFSLVTEDWSSANLAKNFPEDSRNRMMIGIIYSGLAAIFISYCSAWCIRVTSSTTYSMVGALNKLPIAVSGLIFFAAPVTFGSVSAIFIGFVSGIVYAWAKVKENEAKKNALPTAENRDSSK

SEQ ID NO: 165809 - protein, 62 aa, Triticum aestivum
  Clone ID: PAT_TA_60227.pep
ETRHVMESRTAEFTDNDCTCLQVSAGIHEFSDMHKLVDLNHAMLGKVRSAISCPQNFQTRPA

SEQ ID NO: 165810 - protein, 116 aa, Triticum aestivum
  unsure (1)..(116): unsure at all Xaa locations
  Clone ID: PAT_TA_60228.pep
PVRAPSPPPLPDPDPTQAPPSSAGAPTASPLLRPDVDSRNPLSNPNPLPPSDLNTPPPLSLPPRXAQSNPPPSSTQIPPRSXGAARVSPPRAMSPPSTIAPPPPPSRPPSRAPAEK

SEQ ID NO: 165811 - protein, 140 aa, Triticum aestivum
  Clone ID: PAT_TA_60229.pep
PAGFRNAFIISSDFCHWGSGFSYLPYSPTNSPSDLTQLKKRDPKPDGPPIHETIRVIDQAAMDAVETGSHDAFISTLKQTRNTVCGRHPIGVTMAALELLQKEAGFEEKGRFSIIQYNRSNMVEEPNGMSVSYVSAYAVL

SEQ ID NO: 165812 - protein, 58 aa, Triticum aestivum
  Clone ID: PAT_TA_60230.pep
GPFFFFFFLSHMDLILTTISLLRIVSWKDARDTRTLQSNHACDGSNMFRTQPGRLERR

SEQ ID NO: 165813 - protein, 41 aa, Triticum aestivum
  Clone ID: PAT_TA_60231.pep
MTTIRRFCCDDLLRFASVNLDHLTETFNMSFYMTYLARWAD

SEQ ID NO: 165814 - protein, 139 aa, Triticum aestivum
  Clone ID: PAT_TA_60232.pep
MAPKAEKKPALEKTPAGKKPAAEKRPAAGKTASKEGGEKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 165815 - protein, 118 aa, Triticum aestivum
  unsure (1)..(118): unsure at all Xaa locations
  Clone ID: PAT_TA_60233.pep
GHGSQGGESCGAEEGRLRKAREEDGGDLAEGKGSSGRTNAEAELNMPPGFRFHLTNDELVVHYLCREVAAQPQPXPLIAELALYKFNPWVCLVRLLPLSCCSLPWFPSLLVTHWFRLI

SEQ ID NO: 165816 - protein, 135 aa, Triticum aestivum; identical to SEQ ID NO: 140221
  Clone ID: PAT_TA_60234.pep

SEQ ID NO: 165817 - protein, 273 aa, Triticum aestivum
  unsure (1)..(273): unsure at all Xaa locations
  Clone ID: PAT_TA_60235.pep
RPGRALLRQRSRLFGISSWDNKVRIYEIATNGQSQGRHAYEHSQPVLSCDFSKDGTKIVSAGADKNIKVCDLASQQDIVVGTHDQPVRTARFFDSGNGPMVVSGSWDKTVKYWDLRQQGPAATVACQERVYTMDVRDNLCVVGTADRYINVIDLKNPTKFYKTLQSPLKWQTRVVSCFTDSAGFAIGSIEGRCAIQYVEAKDSSANFXSFKCHRDPPANGVTNVHAVNDISFHPVHGTFSTAGSDGTFHFWDKDAKHRLXGYPNVGGSINSTT

SEQ ID NO: 165818 - protein, 121 aa, Triticum aestivum
  Clone ID: PAT_TA_60236.pep
PARVGTKNAPAALGPYSQAIKTPHMIYCSGQIPLTPEGELVQGITEQTRQACKNVQAVVEEAGSSLSKVVKTTVFISDMSYFAEINTEYEKWFSHKPARSCVAVKTLPKNVDVEVEVIALP

SEQ ID NO: 165819 - protein, 106 aa, Triticum aestivum
  unsure (1)..(106): unsure at all Xaa locations
  Clone ID: PAT_TA_60237.pep
MSDTDEHHFESKADSGASKTYPQQAGAIRKGGHIVIKARPCKVVEVSTSKTGKHGHAKCHFVDIEIFNGKKXEDIVPLSXNCEVPHGEXQDYKMIEINDDGYERLI

SEQ ID NO: 165820 - protein, 91 aa, Triticum aestivum; identical to SEQ ID NO: 131606
  Clone ID: PAT_TA_60238.pep

SEQ ID NO: 165821 - protein, 158 aa, Triticum aestivum
  Clone ID: PAT_TA_60239.pep
MTRMMPAPAGGGYDRSPLFYGSTGAPPPHIPLGSASYGAPYPHVGMRYGYGPPVGPHGSYGLISSYGQPGPMGGMGYAHGPELGRYGPELGRYGYGFRGSPMPVSSPWPDGALVENNDSTASRKRRGGPDGLSEGDWECPKCGNCNFGFRINQIKHLS

SEQ ID NO: 165822 - protein, 91 aa, Triticum aestivum
  Clone ID: PAT_TA_60240.pep
VTQSILTPTPSVRAINPPKAEHPSAGEKGAMAKCGKIQSIVRLQQTLRRWRSRAAAAPTAPVPAGHVAVCVGGASQRLVVRASLLFPPAFR

SEQ ID NO: 165823 - protein, 211 aa, Triticum aestivum
  unsure (1)..(211): unsure at all Xaa locations
  Clone ID: PAT_TA_60241.pep
PAGFGYAMIFFXTTTISYALAYTLPILLVGNMGFSVGAAQCLVAPPYAFAGIVMFATAWVGDKYHVRGPCILFNMLLCLIGLPIMGWAESPNVRYFGVFLVTAGANSNIPTAMSFQANNIRGQWKRAFCSATLVGFGGFGGIAGSXVFREQDKLTGYKPGMWACIACCLVTVCLVICCDLDFKRNNAKADRGEKILEAHDDDATADFRYTY

SEQ ID NO: 165824 - protein, 68 aa, Triticum aestivum
  Clone ID: PAT_TA_60242.pep
GPFFFFFFFFFFFFFFFFFFFFFFFFFFFFFFFFFFFLNNNTNCLPLTQFRYNLRRPENTQIFRLLSQ

SEQ ID NO: 165825 - protein, 73 aa, Triticum aestivum
  Clone ID: PAT_TA_60243.pep
VRRSRRPGSAAWEFPSEIYFIRLEPEGVMCLAVLGTPRSGMSIIGNYQQQNFHVLYDLEHNRLGFAPRRCADV

SEQ ID NO: 165826 - protein, 230 aa, Triticum aestivum
  unsure (1)..(230): unsure at all Xaa locations
  Clone ID: PAT_TA_60244.pep
MASEDSAAPVVVDDCRGVLLVYSDRAVVRRDGPGFATPVRDDGTVEWKDAEFDAPRGLGLRLYRPRQRNQLLPVFFYYHGGGFCIGSRTWPNCQNYCLRLAAELGAVVVAPDYRLAPENRLPAAIDDGAAALLWLASQAGPAGDTWLTEAADFTRVFISGDSAGGTIAHNLAVRFGSAAGRSELGNVRVRGYVQLMPFFGGTERTRSEAECPDDAXFLNRPLNDRYWRLS

SEQ ID NO: 165827 - protein, 88 aa, Triticum aestivum
  Clone ID: PAT_TA_60245.pep
SPEMPCVFALSSTSDNARQIKPTQQDETEMGISDKCKEGSCRKIDNKLASALTRACSFRPFLTKSYLSIASISIRTIKFKLLDVYVSM

SEQ ID NO: 165828 - protein, 106 aa, Triticum aestivum
  unsure (1)..(106): unsure at all Xaa locations
  Clone ID: PAT_TA_60246.pep
RPVSDGGGGGGGCYXCGEQGHIARDCPQGGGGGGGYGGGGYGGGGGGGRECYKCGEEGHISRDCPQGGGGGGYGGGGGRGGGGGGGGCFSCGESGHFSRECPNKAH

SEQ ID NO: 165829 - protein, 173 aa, Triticum aestivum
  unsure (1)..(173): unsure at all Xaa locations
  Clone ID: PAT_TA_60247.pep
SPHSAVTSSSSFPLLFSRPDHLFPARERKGLMRPPSILPPSVPKRXSLEQYDELLRFLRGYPVHLRDDTPRQLLLADRRXFHFKDIEPCVLSHSLRYNQTTETRRISIFCWRTLLISDVVDPFQPYGSSSRRLNTALYLICGQNLHICRSTVALMLHSFILCAAMHTETSSEI

SEQ ID NO: 165830 - protein, 137 aa, Triticum aestivum
  Clone ID: PAT_TA_60248.pep
PAGPGGKTRLAKWYAPFSDEQKIKLKGEVHRLVAPRDQKYQSNFVEFRNNKIVYRRYAGLFFCACVDTNDNELAFLEAIHFFVEVLDAFFGNVCELDLVFNFYKVYAILDEVFLAGEIEETSKQVVLTRLEHLDKLE

SEQ ID NO: 165831 - protein, 63 aa, Triticum aestivum
  Clone ID: PAT_TA_60249.pep
PPQEDEHTLGETEALNADDKAFQTILSYIHQIISKKALPAHALRTPGTTINAADSCCNSKKGR

SEQ ID NO: 165832 - protein, 129 aa, Triticum aestivum
  Clone ID: PAT_TA_60250.pep
MALAGGAATAACILVLLALADAAGAANPSPAPAPAPDCTEALIGLADCLDYVVPGSKSARPPKACCTEVKTAVGTPATVKCLCAALDAKTTPIPINMTRVLALPTACGQSASVLSKCHAAAPAEGQEAG

SEQ ID NO: 165833 - protein, 71 aa, Triticum aestivum
  Clone ID: PAT_TA_60251.pep
PAGLRVNLPSGRAGGRACHVPGLLPTSKSSLFRPGKVGSWPCGLIVATCMHGNSVCSSVCPRDHAFYFMIF

SEQ ID NO: 165834 - protein, 126 aa, Triticum aestivum
  unsure (1)..(126): unsure at all Xaa locations
  Clone ID: PAT_TA_60252.pep
RPGSEKKKISHLTHRRSNTHTEKPISPEREASTMSGRGKGGKGFXKGGAKGRRKGLRDNIQGITKPEIRRLALRGGVKRISGVIYEETRGGVKIFLXERVIRDPVPYTEHRRRKERPPMGGGYALQ

SEQ ID NO: 165835 - protein, 240 aa, Triticum aestivum
  Clone ID: PAT_TA_60253.pep
TTHTEYTSSPTTYFIIIRTEIPVDRHGISCTVASTLAVRHEEGRLELDLIVPGVEESGRRAAEIFSLRLPIDRDGGRGRCVLGRRGGKTGAARRRQERAGVVDEVEVLRHLGEDPLVGPVGVDGGEAVGRVGHHVVHHARAVVVHPRRHDHRQLLQLAPAAAAAGVHVLLLLLVRAAAVLLVAVDPDMPYLQVRHGACLVAAAPFRQGEEQDNCHEKLDAPLPPHSHSSVSVLRSVSWYW

SEQ ID NO: 165836 - protein, 181 aa, Triticum aestivum
  unsure (1)..(181): unsure at all Xaa locations
  Clone ID: PAT_TA_60254.pep
MDAAAQAGRRRPSEVRAEGLMRGACAALATASALLMGLDTQTETVLLIRKKATVKDVHALWVLTAAAGAAAGYHLLHLLRCLYLGRFAHNPCRNSKALAWAFLLLDKGCAYVTFAATVAAAQACLIALDGAQALQWNKVCNIFTRFCQQVAGSLVCGXLAAAGTAVLFALLALNLFRLSPC

SEQ ID NO: 165837 - protein, 118 aa, Triticum aestivum
  Clone ID: PAT_TA_60255.pep
DDQYRCGHADLVEHTRMYHDVAVFQDRGSVAVAAAELCAAEESQVELDDDAVVAQIGQDITKAAAELGAFHFPHVRPHQLRRDAWYARTLLGALILVIRGSHSRCGVDLHRVPRICGL

SEQ ID NO: 165838 - protein, 75 aa, Triticum aestivum; identical to SEQ ID NO: 106874
  Clone ID: PAT_TA_60256.pep

SEQ ID NO: 165839 - protein, 80 aa, Triticum aestivum
  Clone ID: PAT_TA_60257.pep
AGRAAIVKRTMIDMVPKAVMLNLVQFTKDEMQRELLENMYRTDTLDDLLKESDFTIRRRKECQQMVESLGKASEIVSQVQ

SEQ ID NO: 165840 - protein, 148 aa, Triticum aestivum
  Clone ID: PAT_TA_60258.pep
PAGFPNVETRPPWLVFVLRSEQQSPAFEAVVFAYHHSLMDGMSGRLFHEKFHAKLNSLPPDPSAPGVLSFPECPELPGPQDDVIDYTTTFAQRFSSLLNWMRPSFLTPTHEIWSAEPIEFNRPHKTRMDTGDIPPRCKAECSPGDSFL

SEQ ID NO: 165841 - protein, 131 aa, Triticum aestivum
  Clone ID: PAT_TA_60259.pep
HTHTHTHTQEEKEEGGPSHGALVQQQRHQQLRRRKGEEASTEEGAAEAADRQDHQQPRAAEERRHGRGEASIGSHQPRHLQLNLSKPHPSSVSQGSRPGTRRMLLATVHVTVLTSPFPSGLPWFPTSLKTA

SEQ ID NO: 165842 - protein, 47 aa, Triticum aestivum
  Clone ID: PAT_TA_60260.pep
RGLFFFFFFFFFFFFFFFFFFFFFFFFFFFFFSANCSRVTNKADSVN

SEQ ID NO: 165843 - protein, 157 aa, Triticum aestivum
  unsure (1)..(157): unsure at all Xaa locations
  Clone ID: PAT_TA_60261.pep
MARKGGERKKAVTRSTKAGLQFPVGRIGRFLKKGRYAQRVGSGAPVYLAAVLEYLAAEVLELAGNAAKDNKKTRIVPRHLLLAIRNDQELGKLLAGVTIAHGGVIPNINPVLFPKKXLXKVEKESQSPKSPKRKAPAPVPSLNNNPNKKEADKKTPP

SEQ ID NO: 165844 - protein, 111 aa, Triticum aestivum
  Clone ID: PAT_TA_60262.pep
PAGSGTRIPASSFLLHPLSPYLPSLEPSPTQGMCIDEKTTRNAAPSATATTGKCASTMSPRSTRAPAIHTPCICPPPPTTADLAKATCTYARPLDAIAPPGDAAPTVDVPR

SEQ ID NO: 165845 - protein, 264 aa, Triticum aestivum
  Clone ID: PAT_TA_60263.pep
MKFFNALLYGALLFSEVSAAKKLTASQVEGDIKKSKLRKTLVDLNNIGKKHGGNRAFGLPGYKASVDYIYKELKKHKKYLDTHIQPFNYTFEQTRDIQVRGPDGEDVYVITLIYNVGTPAGGVTAPLALVPIDDTRGSGCFADQWEGVDAKDKLVLVKRGSCAISDKLKLAKKAGARGVLLVHNAPGEGITSATLSAENLELIVPVGVIPQEVGNAWRKRIEGGESLEVTLLVDSFYETRETWNIIAETKQGDPKNVVMMGAHL

SEQ ID NO: 165846 - protein, 86 aa, Triticum aestivum
  Clone ID: PAT_TA_60264.pep
GVPKWKTLSPFPPFAPLGQIPQLARWFTTSKGPGRSERGKGGEWRNGNWKISPFNYCEKIRVFLTGKVPLGLNPGRTKWAIPPYGL

SEQ ID NO: 165847 - protein, 120 aa, Triticum aestivum
  unsure (1)..(120): unsure at all Xaa locations
  Clone ID: PAT_TA_60265.pep
AGRAAIYGDSRRTLSPLIQQVDFDNVVVYHTSDEHSYPDQGITRRXPCTPMQHWTLAVMNAAPKDAPDVDRAASVMGFLYVSDVDEERHKIKLLAPVSGRLGDQPLVWRKRPKPYINLLG

SEQ ID NO: 165848 - protein, 102 aa, Triticum aestivum
  unsure (1)..(102): unsure at all Xaa locations
  Clone ID: PAT_TA_60266.pep
MSRGGSAGGGQSSLGYLFGDGEPAKTAAAPAAKPAPAEKPAPAAADVAKQIPAGIPGSRANNYYRADGQNTGNFLTDRPSNKVHAAPGXGSSLGYLFXGKRC

SEQ ID NO: 165849 - protein, 184 aa, Triticum aestivum
  unsure (1)..(184): unsure at all Xaa locations
  Clone ID: PAT_TA_60267.pep
AAVLVLFFLVFIRRSGRKPREELANLDQLEGGAASLRGHETEEQRNKFLVLRLYEALNGRDHAAVHSLLAPDLEWWFHGPPTHQHMMRLLTGSSSPSSSSSFRFQPRSVDAFGSTVIAEGVDDKAKAYWVHAWTVGADGVITQLREYFNTDLTVTRLAAAAXVKCVWESRXPERRNSLPLVPRL

SEQ ID NO: 165850 - protein, 59 aa, Triticum aestivum
  Clone ID: PAT_TA_60268.pep
ETIETSRCQQIFDSKRQVNKGITESASAFRSSLCLLHSFCDSLKKFFRDSSWISRTRPA

SEQ ID NO: 165851 - protein, 81 aa, Triticum aestivum
  Clone ID: PAT_TA_60269.pep
GAFFFFFFWEFFCRVIDFFNFFFFFFFFFFFFFFFNTDIKVVSHLCAQTSEANKESSNICLEGGTPLGPRFKQYQKQRTRP

SEQ ID NO: 165852 - protein, 80 aa, Triticum aestivum
  Clone ID: PAT_TA_60270.pep
RPGWDAGNLGDSVTVARDKSKVTVTSDGAFSKRYLKYLTKKYLKKHNVRDWLRVISSNKDRSVYELRYFNIAENEGEEED

SEQ ID NO: 165853 - protein, 184 aa, Triticum aestivum
  Clone ID: PAT_TA_60271.pep
MYPAEVAGVLLPAAYLPPPANAASFGPHYPYQIAEDDHLLFQCGGGSLMQLPYADELFLNHLPAGLPNRSSSDEPAPHAIDRQRAEERRRRRMVSNRESARRSRVRKQKQLGQLWAQVVHLRDANRDLLDQLNRAIVDCDRVVRDNSRLRDEREELQRRLRELPVVDAGDAEGVAVGEDDESTV

SEQ ID NO: 165854 - protein, 97 aa, Triticum aestivum
  unsure (1)..(97): unsure at all Xaa locations
  Clone ID: PAT_TA_60272.pep
GPFFFFFFLFFFFFFFFFFFFFFFFFFFFXXSLNTLWSEILFEACKVKLHCQTRDTRTFSLQSTTNLQSLIELKLKPTIQLHIGRAAVGVGHAVVEV

SEQ ID NO: 165855 - protein, 52 aa, Triticum aestivum
  Clone ID: PAT_TA_60273.pep
TKDDSIFYNEAKLREVLHFSNACGAICTTKKGAIPALPTTATALELISKGSN

SEQ ID NO: 165856 - protein, 107 aa, Triticum aestivum
  Clone ID: PAT_TA_60274.pep
ITHTIHGAKPLLWSSGRSPSYCFAERAVHQSFSPVFSTPYCVNNVGAFLCVYILECHITWGVGTVVYLLCHVPLAEAFGRIRSFLYYYCGPRRVGLVILIFFRIVRH

SEQ ID NO: 165857 - protein, 143 aa, Triticum aestivum
  unsure (1)..(143): unsure at all Xaa locations
  Clone ID: PAT_TA_60275.pep
LYLTSAKDRSSSTSSSSFYNIGFYLKGLMIPNSSNPFAYXYYSYLSSSSFYPALEWLIRSRPLVRMVCEGXNVLCNERQIIGATKPLDSEAACIRVDXSDICRLVIHATNSXDSATTDISLRPPXGCAHITSSPLNWIYEAYD

SEQ ID NO: 165858 - protein, 86 aa, Triticum aestivum
  Clone ID: PAT_TA_60276.pep
MGRERDHLRAALVPSYEHPGGDAECAVCLGDVEKGEPVRRMPVCLHVFHTECIDRWLRSHATCPICRCSVFTPPERPPEVVLNVEL

SEQ ID NO: 165859 - protein, 168 aa, Triticum aestivum
  Clone ID: PAT_TA_60277.pep
PAGSGKTPIHPPHHIHHLSTHKGRQRTKHPRGATKRSIHHPSIARLKHHASARRSTRARLSSGVDGRDGGSIAGAVREERVHERRREHADRLLPRAGCLETWERTRVPRRRDSVTDGHEYYGRVREKQEQPCQLVEHRSYMTVLIWLSFCVTKLVGFNNNMTAPHIWL

SEQ ID NO: 165860 - protein, 96 aa, Triticum aestivum
  Clone ID: PAT_TA_60278.pep
MASSNSGGIPIKAEQDSDGSAQSTADMTAFVQNLLVQMQTRFQTMSENIITKIDEMGARIDELELSINDLKAEMGSDGMTPTKVKDEESKPADSSA

SEQ ID NO: 165861 - protein, 136 aa, Triticum aestivum
  unsure (1)..(136): unsure at all Xaa locations
  Clone ID: PAT_TA_60279.pep
MARTKQTVRKSTGVKAPRKQLATNDDRKSDPFTGGVNKPHCFRPVTVELREIRKYHKRTELLIRKVSFQRMVREIAQDFXTDLRFQISVVSALQEAAEAYLVLLFEDTNLCAIHAERVTIMPKDIQLARRIRRERD

SEQ ID NO: 165862 - protein, 87 aa, Triticum aestivum
  Clone ID: PAT_TA_60280.pep
TNHIGEDWLHSHGIRLPLTMGRFSSSIPGQPVIHTFCISEIAFSPPIETISAQFSIDKFSSDVRLVLQRLPGMDVICRHREIGTRPA

SEQ ID NO: 165863 - protein, 51 aa, Triticum aestivum
  Clone ID: PAT_TA_60281.pep
AGRVSRKSIGFMSHVDQLKLHMDSCCIKSVPIHNSNAYDFISEKKKKKRPL

SEQ ID NO: 165864 - protein, 196 aa, Triticum aestivum
  Clone ID: PAT_TA_60282.pep
GPHLERNHEKNLLSTVVGLSQFYSVAIAQSSTTIAVPTGTPIAGNYNGTYRPQVHFSPPEHFMNDPNGMFRDADGLWHLYYQYNPTAVVAGNQHWGHATSKDLYHWVNQPIALFPPEEDTYVFSGSVVVDENNTSGFFPDQDNGVVAIYTLSSPEVQDQAIAYSRDGGYTFEPYKGNPVINSTSTQFRDPKVHSLQ

SEQ ID NO: 165865 - protein, 89 aa, Triticum aestivum
  Clone ID: PAT_TA_60283.pep
MAGAAKASWMVAMSVGAVEALKDQAGLCRWNYALRSIHRTAKARANVRGGVSQGARQLPASAAVAEKRRAEKAEEGLRTVMYLSCWGPN

SEQ ID NO: 165866 - protein, 72 aa, Triticum aestivum
  Clone ID: PAT_TA_60284.pep
ESVGSDDRQPCVEQGQCNGAEEALRQELQAKNAEIQALRAICNSLERNAVCNSVFYVMTMLVAGLFAGFMLH

SEQ ID NO: 165867 - protein, 193 aa, Triticum aestivum
  unsure (1)..(193): unsure at all Xaa locations
  Clone ID: PAT_TA_60285.pep
MAAAARRALLLLLAAAAVVLLAAPPASAARPCGRAQTLLISFSSFSRPNPDPADPSPLTTTVVTVLRVRRLGPHRFHAHDQNHLQIRRPAESLPAVGTPETDADAASSFQERAKDILVVVSGLLFGFGCGALTAASMYLVWSLVASTXPPAPYEELYSDDDNEDVSDDRAESPKKAXGYVIIHGAEDVVPGKN

SEQ ID NO: 165868 - protein, 75 aa, Triticum aestivum; identical to SEQ ID NO: 106874
  Clone ID: PAT_TA_60286.pep

SEQ ID NO: 165869 - protein, 152 aa, Triticum aestivum; identical to SEQ ID NO: 126262
  Clone ID: PAT_TA_60287.pep

SEQ ID NO: 165870 - protein, 119 aa, Triticum aestivum
  unsure (1)..(119): unsure at all Xaa locations
  Clone ID: PAT_TA_60288.pep
YLMTALQLVMKKXSAHDGLVKALPEPAKAIDKHAAHICVLAEDCDHPDYVNLVXALRAEHNVHLVTVPTANTLGEXAELCKIDSDGNARKEVSCSCDIMKDYGEDSQGLHIPQEYVKSH

SEQ ID NO: 165871 - protein, 78 aa, Triticum aestivum; identical to SEQ ID NO: 106980
  Clone ID: PAT_TA_60289.pep

SEQ ID NO: 165872 - protein, 75 aa, Triticum aestivum; identical to SEQ ID NO: 106874
  Clone ID: PAT_TA_60290.pep

SEQ ID NO: 165873 - protein, 55 aa, Triticum aestivum
  Clone ID: PAT_TA_60291.pep
GRNKQRRHSYNKQYATSTKVMLKAKGHLRKLQTTHRTDTMAALFVIVVVTFQKKL

SEQ ID NO: 165874 - protein, 75 aa, Triticum aestivum
  Clone ID: PAT_TA_60292.pep
MSCNCGSGCSCGSDCKCGKMYPDLTEQGSAAAQVAAVVVLGVAPENKAGQIEVAAGQSGEGCSCGDNCKCNPCNC

SEQ ID NO: 165875 - protein, 50 aa, Triticum aestivum
  Clone ID: PAT_TA_60293.pep
GAFFFFFFRILNKICLVEMTIVYFPLVETGGMKNHMRDILNNQSRAHHHA

SEQ ID NO: 165876 - protein, 75 aa, Triticum aestivum
  unsure (1)..(75): unsure at all Xaa locations
  Clone ID: PAT_TA_60294.pep
MYCNCESGCSCWSYCKXCGKMYPDLKDQVSAACHVVCVPDLVVLPENXAGEFQVDAGQSEEVWICDDNCKCKPCY

SEQ ID NO: 165877 - protein, 173 aa, Triticum aestivum
  Clone ID: PAT_TA_60295.pep
PAGLGFELTSIDDADPFNPSWLFDTEKHCREADASVHGGIGPFGLVILASDNMEEQTVVHFRVYRSQKNYMILMCSDLRRSSLTPGLDTPAYGGFFEFDLEKERKISLRTLIDRSAVESFGGGGRVCIMARVYPVSLVDDDHQPHMYAFNNGSATVRVPHLMAWSMRRAQVSV

SEQ ID NO: 165878 - protein, 78 aa, Triticum aestivum; identical to SEQ ID NO: 106980
  Clone ID: PAT_TA_60296.pep

SEQ ID NO: 165879 - protein, 237 aa, Triticum aestivum
  unsure (1)..(237): unsure at all Xaa locations
  Clone ID: PAT_TA_60297.pep
MADSSISFLPLGAIIQSIVVNGVNIVQGFPTQEDYEKYNYPYFGVTVGRIANRIKDARIDSLNGKEVILAANDGKNHLHGGKVGWSTRVWDGPKPVGIREVPGVEGLEGGESVAFTLTSEDGDEGYPGTVEVTVTYTTGTQKVDGKDVTILAMEYEAKLVGGADETVINMTNHSYFNPSGKETIADTEMTLPTASYLAVGDDLIPTGKIESFPGVTANKTFTLGPQEPXIDHCFVLN

SEQ ID NO: 165880 - protein, 138 aa, Triticum aestivum
  unsure (1)..(138): unsure at all Xaa locations
  Clone ID: PAT_TA_60298.pep
PAGLKLRSSPLPISQEQTTTTAADPQSPMARTKQTARKATGVKAAIKEFGTNAARKWXPVTGDEKKPHRFTPRTVDLRGIRKYQKRTELRIRKLPFQGLVRQIAQDFXIDLRFQPSAASALQXGAEAYLMVMVKDANL

SEQ ID NO: 165881 - protein, 80 aa, Triticum aestivum
  Clone ID: PAT_TA_60299.pep
RPVRGGATRRGGACPRARAARPRPRRGELGTGARGYFWAPVGVATVASRAVYFWASVGDTRSSGALKRYFGVVNFFLARG

SEQ ID NO: 165882 - protein, 220 aa, Triticum aestivum
  unsure (1)..(220): unsure at all Xaa locations
  Clone ID: PAT_TA_60300.pep
PAGLRTGISPTGAAGHSGTRREAAARTRQKPVLRGRPGAGAGAGAGEERGRGRVRRSRXPASGAAEPGAREPEPARGAAVTGCLGAGAGEGRGSGRXAREGGASTRADPAEAELPPRAKAARRGGAGGRAXGGRRLGGDPTSKRRRGVGNSARAGKPTAGRGPAGGREDAREARRGQQQPVGAGANGAMRARRLKPASMEQVSRGGAVAGGCSDMRQGHG

SEQ ID NO: 165883 - protein, 110 aa, Triticum aestivum
  Clone ID: PAT_TA_60301.pep
RPGWAETQAPLPSLPPGLTTSRKSKAREKATSHRIQQPTRRRRERASERADDAAGDVLAPGSGRRGVLAGRHHHRADPKGSIRASFLLGLRRCFLQPIDSTIGLTFFVPG

SEQ ID NO: 165884 - protein, 114 aa, Triticum aestivum
  Clone ID: PAT_TA_60302.pep
EDTVLLFLLRSLLLLLQHDIHLLLELIPPPSSSLHHQPARRKPTMERDAGEGHCRRPARVGSLHCLCRLGSLPIRGAKWTTSCARDGSRPRLRLVPPVPPLSSPPPLPERGGSG

SEQ ID NO: 165885 - protein, 73 aa, Triticum aestivum
  Clone ID: PAT_TA_60303.pep
GHISDSLQRHISTWSRQQGYISAKRLSYREDRVSFCMPTKGDIANIVVEHLHGGSERTFASGLFTGARSKGSH

SEQ ID NO: 165886 - protein, 168 aa, Triticum aestivum
  Clone ID: PAT_TA_60304.pep
MGSSGGSSDYFLRQLSSSDGGSAPAPAPRQPEEWECGGGTGRRGSRRWSRKKARARGHRRGGGGGFCGAPEEAAAAGRKRVMVVVDQSSGAKHAMMWALTHVANRGDFLTLLHILPRGGGARGEDAAALANSLGSLCKACKPEVRARALSCHQTRSSSNKKKMNWSLG

SEQ ID NO: 165887 - protein, 56 aa, Triticum aestivum
  Clone ID: PAT_TA_60305.pep
RGLFFFFFWIHVPRRHSTVKKSPQGLFNTSYDTNSLNSTGGILRSGQHVRPIRVVY

SEQ ID NO: 165888 - protein, 174 aa, Triticum aestivum
  Clone ID: PAT_TA_60306.pep
MAETEYRCFVGGLAWATDDHNLQQAFSLYGEILDAKIINDRETGRSRGFGFVTFGSEESMRQAIEEMNGKELDGRNITVNEAQSRRSGGGGGGGGYGGQRGGSGGYGGGGGGYGGQGGGGYGQGGGGGYGQGGGGYGGQRGGGGYGGGGGGYGGGGGGYGGQRGGGDSGGQWRN

SEQ ID NO: 165889 - protein, 245 aa, Triticum aestivum
  unsure (1)..(245): unsure at all Xaa locations
  Clone ID: PAT_TA_60307.pep
PVRRSGGGLPNLLRVHEVFPLVISSFCRRLRPPTYVGRVERSLRGYIREKPSDDVHVAILCIGGLRQVERLWEIKGYNSRRGAVDTWFNALTKDAPPTESGMSTSKPKRSLFGRKKSTSEARPSGATLNKARSSGSIDGNMDWDAGLVFNTSLSAGAPMSSLSSQQAQALLSDLPVLQQIWLTSAEALVLQRRIVERPQDIKRNQQVMLDLIREDXLDEEDEWWYGRSIPDSVRPPVSVTDDDAD

SEQ ID NO: 165890 - protein, 268 aa, Triticum aestivum
  unsure (1)..(268): unsure at all Xaa locations
  Clone ID: PAT_TA_60308.pep
RPGRDIQVPNYTAPVDVYGTARSMGPTAPINLNYNLTWILPVDAGFSYLLRFHFCEIQYPITKQNQRSFFIYINNQTAQEQMDVIVWSGGIGRTTYTDYVILTAGSGQVDMWIALHPDLSSRPEYFDAILNGLEIFKLQNYGASNNLAGLNPPLPQKPADASPGAASGKVKSVAAIIGGAVGGFVVLLVTCFGICIICKRKNKSKKKKKISKDPGGXSEDGHWTPLTEYSGSRSAMSGKRXTTGSTLPSNLWXHFTFAELQTXTKNFR

SEQ ID NO: 165891 - protein, 70 aa, Triticum aestivum
  unsure (1)..(70): unsure at all Xaa locations
  Clone ID: PAT_TA_60309.pep
CGARXRRXDLLAPIHLLXASTWLWRRGDEDQQLSPLPSKSPPPTRLPASLLHSRPRLGRRRHRTIRGRRG

SEQ ID NO: 165892 - protein, 172 aa, Triticum aestivum
  unsure (1)..(172): unsure at all Xaa locations
  Clone ID: PAT_TA_60310.pep
MVRKGGERKKAVTRSVKGGLQFPVGRIGRFLLEKGRYAQRVGSGAPVYLAAVLEYLAAEVLELAGNAAKDNXKSRIVPRHLLLAIRNDQELGKLLAGVTIAHGGVLPNINPVLLPKRALEKAEKEDQSPKSPSKKIEQEGPAPRRQQDLQEQDRRRAEDHRRRQEGRRRRRE

SEQ ID NO: 165893 - protein, 72 aa, Triticum aestivum
  unsure (1)..(72): unsure at all Xaa locations
  Clone ID: PAT_TA_60311.pep
MAAAGPAKTEVLSLFRAFLRTARQFSDYNIREYTRRRAADAFRENRALADAPAAAAAFADGKQQLEVAKXGK

SEQ ID NO: 165894 - protein, 130 aa, Triticum aestivum
  Clone ID: PAT_TA_60312.pep
RDGGLPPRSPSPSPPSPLRLHLPVLEGPTPCGVWARIIPGKPYPCTVQCREAEPRTSWALGTSGEYFTTTPGPSFFKAVICTFSSDSPVDSCEFSFLTPFPFPFPFSATQPSHVKFSSFFASLMSSDPAG

SEQ ID NO: 165895 - protein, 151 aa, Triticum aestivum
  Clone ID: PAT_TA_60313.pep
MPHRGAVLVFLLALAAAPLAAVAWRPWPPRVASGALAGLGASKKFEGSSNFVKLEYHMGPVLAADITVHPIWYGAWPADQKRTIRAFLRSLSPQASGEKEGAVPSPSVADWWRTVRLYTDQTTANVSAVVALGQEKCDARMSRGASLVRMD

SEQ ID NO: 165896 - protein, 81 aa, Triticum aestivum
  Clone ID: PAT_TA_60314.pep
MSYYNQQPPVGAPPPQGYGDKGGYPPPAQGYPPAGYPQQGYPPQYAQQPPPHQQQQQSSGPSFMEGCLAALCCCCLLDACF

SEQ ID NO: 165897 - protein, 45 aa, Triticum aestivum
  Clone ID: PAT_TA_60315.pep
PAGSGDGNLITSQGPGTSMEFSLAIVEKLFGRERAFELAKAMVFV

SEQ ID NO: 165898 - protein, 169 aa, Triticum aestivum
  Clone ID: PAT_TA_60316.pep
QGRLRHQRSHGRPAELMLRRSLLMFILHTSAQSPYWSWRPVPLGEPLVSATGYWRTTNQGVWILENQTHLMCIGMDPLSIIVHVYNGTAHSPRSHLLCRADFQLWRLLTPWGMTTTCPTTSSGNTNNVSALRTWGRQCRRHPNTQAGSKRGSRRRRIHYGSTICGGGCR

SEQ ID NO: 165899 - protein, 94 aa, Triticum aestivum
  Clone ID: PAT_TA_60317.pep
RPVREPPTRAEAFCSSLFSVLASRQRRRFRIGAAALEAIPDRNGGARGPGERRRQRQVTSRSLFVLDLIHLSLSLKLARRSTEPTNRISKPAPI

SEQ ID NO: 165900 - protein, 107 aa, Triticum aestivum
  Clone ID: PAT_TA_60318.pep
MKPLPVTLALLTLFLVASYQDLTVAADADADAAGAGDVGAVPVPDSVCEGKCKNRCSQKVAGRCMGLCMMCCGKCAGCVPSGPLAPKDECPCYRDMKSPKSGRPKCP

SEQ ID NO: 165901 - protein, 167 aa, Triticum aestivum
  Clone ID: PAT_TA_60319.pep
AGRFRDISPTMAGSRPGGLVAGAWAAMMSLGLNGYLESTGKIMEVSRKIQKGIDDISGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSC

SEQ ID NO: 165902 - protein, 107 aa, Triticum aestivum
  unsure (1)..(107): unsure at all Xaa locations
  Clone ID: PAT_TA_60320.pep
ITFLYFPLKEVYARILSDHCSDKTRGDVGLKPNLPSFSFKKKMKLDFQHQQSERTNMNITVLWGGVLWLPARAHVQVLNGTASHHRRTSELAFHSVTXDSLSTRTGR

SEQ ID NO: 165903 - protein, 224 aa, Triticum aestivum
  Clone ID: PAT_TA_60321.pep
PAGSRKKKTPGESVYGEKRISVDEVVKNDDGTTTTTKIEYRMWNPFRSKLCAAIAGGADEIYIKPGSRVLYLGGASGTSVSHVADIVGPTGYVYAVEFSSRSGRDLITMASKRPNVVPIVEDARQPARYRMIVPMVDVIFADVAQPDQARIVAMNANWFLKVNGGVLISIKANCIDSTAPAAEVFAAEVQKMRAESIKPKFQLTLEPFERDHCLVAGEYLRYKS

SEQ ID NO: 165904 - protein, 72 aa, Triticum aestivum
  unsure (1)..(72): unsure at all Xaa locations
  Clone ID: PAT_TA_60322.pep
NCGFSCSCWSYCKCGKIXPDLTEHDLVAFQDIAVSALGVIPENNAPNFHVNTGQSXKGCGCCNNCYCNPCNC

SEQ ID NO: 165905 - protein, 88 aa, Triticum aestivum
  Clone ID: PAT_TA_60323.pep
MAGPAKASWMVAMSVGAVEALKDQAGLCRWNYALRSIHRAAKANVRGGVSQGSKQLPASASAVAERRRAEKAEEGLRTVMYLSCWGPN

SEQ ID NO: 165906 - protein, 144 aa, Triticum aestivum
  Clone ID: PAT_TA_60324.pep
VRRSRRPVGTVCPQRAEFGDHNIYVTTHRDRELYAGGWYTNQSRGGTGVRTWAERNETLTPESDIVLWVQFGINHIPRIEDFPVMPVEILKVHLKPVNFFTKNPALDVPPSEQRVNKSTLIETTKVEATAGDCGCESSSVPAKL

SEQ ID NO: 165907 - protein, 64 aa, Triticum aestivum
  unsure (1)..(64): unsure at all Xaa locations
  Clone ID: PAT_TA_60325.pep
MDAPSTSNSSAQQSPSVQMVPQPAPTKAXNPSTAPFLQDFTLIAEAAKRAQMAIMIRDFEDCGL

SEQ ID NO: 165908 - protein, 107 aa, Triticum aestivum
  Clone ID: PAT_TA_60326.pep
LISIHRISSSSILHYKHPPNSSMASSLKVAAALAMAVCVVLVLNMGQPMAATECKDCLADCVDVCVNYSDTACSGICTAKPPACQSCKYASFLTCGGTCYSACAHFC

SEQ ID NO: 165909 - protein, 59 aa, Triticum aestivum
  Clone ID: PAT_TA_60327.pep
NSSKSKEAYIFREMITPKLPSRTSPKPYTIMRFLSIFQDNECTEKSLPVEMFQTNLSSS

SEQ ID NO: 165910 - protein, 143 aa, Triticum aestivum
  Clone ID: PAT_TA_60328.pep
MLHWRMLLWEGTIHLTWSSLTNVVAIFKSGEKPSTNEWPRSLEIKKRVSLGVFEKLLGLLRESRKRTIMVTELRWKEGSIESGRHHLLKTIESYTANERVGLVKPTEEVELFLCPYQGKAAQILADNLLKELWCGQDPISHLW

SEQ ID NO: 165911 - protein, 57 aa, Triticum aestivum
  Clone ID: PAT_TA_60329.pep
CWGCRTRGGAGSRYGCGRSGRLLFFFFFFFFFFFFFFFFFFFFFLAKSAIAIIEMSR

SEQ ID NO: 165912 - protein, 101 aa, Triticum aestivum
  Clone ID: PAT_TA_60330.pep
WICILSLTIFCFLYPFAGSYFCHIDFQICNTNIRQSTYTINISNFLLKEHKTTGQTPIKKSRTCANSDQMESFTLSFFIYFLFLSFSILFLFLFFFPKPGR

SEQ ID NO: 165913 - protein, 278 aa, Triticum aestivum
  unsure (1)..(278): unsure at all Xaa locations
  Clone ID: PAT_TA_60331.pep
PAGPGLGTSKEGGLLQTANSFYKSFAVECSKSQVSIDMFLFSSQYQDVASLSNLPRYTGGQTWFYPGWHASRPEDALKFASEFSDYLSSEIGLEAVLRVRATSGLRMNTFYGNFFNRSSDLCAFPAFPRDQCYVVEVAIDENLTKNVVCLQAAVLHTTCNGERRIRVMTLALPTTTNLSDMYASADQCAITTYFSHKAXVERSLSSGLDAARDALQSKVTELLQTFKKELAGGSMGGGLQFPANLRGLPLLFLGLIKNVGLRKSSQIPSDIRSAALCL

SEQ ID NO: 165914 - protein, 193 aa, Triticum aestivum
  Clone ID: PAT_TA_60332.pep
MSSKRHSILPAIDRSGPRPPVHFSSTLTISDNAILQGTHSITMQTETVIHPRSRFESNYGSILIGRRCLVHERTHMGARPADPTAKPGGIVLADYVTIEAGSTIEAGGTEIGEGTIIQAGTIVGSGAKIGKNCTITHMSKIAPGTILPDNTVVFSNGTRRIDRRELSDQRKIALIKQLAILRKMIPSNPDKFK

SEQ ID NO: 165915 - protein, 160 aa, Triticum aestivum
  Clone ID: PAT_TA_60333.pep
MSAMVASSLNPEAPLFIPAAFQQVEDFSPQWWDLVKSTAWFRDHWYHQHQQLDDMADSLIAFEAEDAIDDDLLHGFAVEASQPQPPAALKTDGVLKALSLASPSPKVGNALRVFSEKPRYTEKPTKYAGSPEERWRTAFHPPASLGCQLQESTNPACVMQ

SEQ ID NO: 165916 - protein, 54 aa, Triticum aestivum
  Clone ID: PAT_TA_60334.pep
LYNPLVPSLLISLALIGQSGNVEFLPPFDIWSTTAPMCARMHFFICKKKKKKGP

SEQ ID NO: 165917 - protein, 96 aa, Triticum aestivum
  Clone ID: PAT_TA_60335.pep
MADAGEEPHHVSEPLDLVRLLLNEVVFVKLRGDRELKGKLHAYDSHCNLVLGEVEETIYTVDEDDDDDELKTISRKSEMLFVRGDSVVLISPGVPF

SEQ ID NO: 165918 - protein, 66 aa, Triticum aestivum
  Clone ID: PAT_TA_60336.pep
KVQEETSKSRSDRKPPGVGRGRGRGDIGTKPGGRGIGRGQDDGKGGGRGRGGIGSKGGNKGGRGRG

SEQ ID NO: 165919 - protein, 50 aa, Triticum aestivum
  Clone ID: PAT_TA_60337.pep
GAFFFFFFGFLKATQQNFSKLNAIVFFKPLCPQRLIPKLILYSVIPNQAS

SEQ ID NO: 165920 - protein, 92 aa, Triticum aestivum
  Clone ID: PAT_TA_60338.pep
PLILHGQHRKKGYIEQTRIWQQPSLSSLSPAACTARSNSNPAFTGEERGEVGRENLGGYSKLLFLSGEKQKQEHIVRGGVFWIFWNPPARPA

SEQ ID NO: 165921 - protein, 131 aa, Triticum aestivum
  Clone ID: PAT_TA_60339.pep
MAQLQETYACSPATERGRGILLAGDAKTETIAYCSGRSVIFRRLDAPLDAWAYTEHAYPTTVARFSPNGEWVASADASGCVRVWGRNGDRALKAEFRPITGRVDDLRWSPDGMRIVVSGDGKGKSLVRAFM

SEQ ID NO: 165922 - protein, 55 aa, Triticum aestivum
  Clone ID: PAT_TA_60340.pep
MAEIRRKLVIVGDGACGKTCLLIVFSKGTFPEVYVPTVFENYVADVEVDGKHVEL

SEQ ID NO: 165923 - protein, 147 aa, Triticum aestivum
  unsure (1)..(147): unsure at all Xaa locations
  Clone ID: PAT_TA_60341.pep
AGRFRLLLWKSKASQQXGVILPRERKKQEYLHAVKARYNHLPEIRRIDKHRHLPKPIYKAGKIRRAMIDAQSRKEERRRAHSAPGSRTMQPFRKRRLITEVEYGGSDHGEARQSGILAYYFWSSVSDGKLGSYYYYVEEEYFVTCKP

SEQ ID NO: 165924 - protein, 75 aa, Triticum aestivum; identical to SEQ ID NO: 106874
  Clone ID: PAT_TA_60342.pep

SEQ ID NO: 165925 - protein, 93 aa, Triticum aestivum
  Clone ID: PAT_TA_60343.pep
AGRSGNPSSPPLISIKRSPPNTRSTYNSRQPPSLLLCIFLRRLSTMISSHLLPTLADTIDDAKANTPKTADIPPNHHGLSFARPLCPRWLLTN

SEQ ID NO: 165926 - protein, 156 aa, Triticum aestivum
  Clone ID: PAT_TA_60344.pep
HDDSKPLCPSRRFWADLLRLFRSMRLLECNFTVRHPHRHTDLTPADVRRQGSSSSIDNCVGNSGAGASTGYCRSSIGISLALTSSRNHDGSSLNQLQEKLHIQGSFSSPSDASNGTELSLRSRPTEPGRPACPSHLLGHRRPNRKACFLARGSGRT

SEQ ID NO: 165927 - protein, 99 aa, Triticum aestivum
  Clone ID: PAT_TA_60345.pep
HWRPASSPTKQDGQTQPRAKDQRRCSHSHPHTGTHPERLGKLYMINAPWGFSTVWSIVKGWLDPVTVSKINILGSGYKGELLKQIPAETFPRLRLERRT

SEQ ID NO: 165928 - protein, 197 aa, Triticum aestivum
  unsure (1)..(197): unsure at all Xaa locations
  Clone ID: PAT_TA_60346.pep
MAAPVALTIFLLILLPAHHALATAAGDVHPGYADAETDTCGPALDLGGSSSSSSSAAGAAGRRYGPGLEEYGGGRIVDITHAFRPGMPAYAPGATVGPIVRLKESMENGSDYNLSELSMECHIGTHVDAPGHFNQAHFAAGLDVDTLDLEVLNGPALLVDVPRHTNITAEAMESLXIPKGVRRVLFRTLNTDMGLMW

SEQ ID NO: 165929 - protein, 76 aa, Triticum aestivum
  unsure (1)..(76): unsure at all Xaa locations
  Clone ID: PAT_TA_60347.pep
PAGSGPSYALCRYPDEDAGQLPMAFIVRQPGSNLTRQQVIDYVAKHVAPYKKVRRVAFVNAIPKSPAGKILXRELV

SEQ ID NO: 165930 - protein, 83 aa, Triticum aestivum
  Clone ID: PAT_TA_60348.pep
PSRDIFPREAGVRQVAEGVHHVPGLLEARCTNMDEAWGILQTGSKAKVVGSTNANEHNSRSHWLFTRFLFTRTKLQTIKSRPH

SEQ ID NO: 165931 - protein, 54 aa, Triticum aestivum
  Clone ID: PAT_TA_60349.pep
PPHHMPPPYMFNADYMMNQYRPAPPAYPPPYVPPQHYYVRNMSMEENPNSCVIC

SEQ ID NO: 165932 - protein, 79 aa, Triticum aestivum
  Clone ID: PAT_TA_60350.pep
SPVTRTNCKIYFREKSIYQSIWRGSKTLVCCMRAEQELVQNSDLHYRLHLTVLLNLGKGGPLVVQMLQRRFHFFSRTAA

SEQ ID NO: 165933 - protein, 128 aa, Triticum aestivum
  Clone ID: PAT_TA_60351.pep
RPGSGNSKDGVNVVSGDSLIECAKIANECAKVGAVGINCTPPRFIHSLILSIRKVTDKPILIYPNSGERYDAERKEWVESTGVSDGDFVSYVSEWCKDGAALIGGCCRTTPNTIRAISRSLNQYYPAP

SEQ ID NO: 165934 - protein, 87 aa, Triticum aestivum
  Clone ID: PAT_TA_60352.pep
NLDQASRIMRFSDSLNGVPGTPWRSTMIDKESMYFRHPWGMSSSYRATVRHRGISLSLFWSRLHCIRLLPHKTFICGRYSQYSVYLA

SEQ ID NO: 165935 - protein, 225 aa, Triticum aestivum
  unsure (1)..(225): unsure at all Xaa locations
  Clone ID: PAT_TA_60353.pep
MASSQPTRWAALARDTNETKIQLALNLDGGDFPPDTDSRLLDNDDSHASQASKSQKIAVNTGIGFLDHMLHALAKHAGWSLALNCKGDLHIDDHHTAEDVCIALGYAFAQALGTPAGLARFGYAYAPLDEALSRAVIDLSNRPYAVVDLGLKREWLGQLSTEMVPHCLQSFAQGARVTLHVHCLHGDNDHHRAESAFKALAIAVKAAXHRIPGKEGEVPSTKGTL

SEQ ID NO: 165936 - protein, 76 aa, Triticum aestivum
  unsure (1)..(76): unsure at all Xaa locations
  Clone ID: PAT_TA_60354.pep
PLFAATGLAIGICALRLLRNITAKPEVRVNKMGSAAXLLDNHEEGRRYAEHGLRVYVQDKTPEIMPGINXFFTSPK

SEQ ID NO: 165937 - protein, 62 aa, Triticum aestivum
  unsure (1)..(62): unsure at all Xaa locations
  Clone ID: PAT_TA_60355.pep
MADAEVYSTTAAVVVQHQQCVKAVTYVCQVXVGCIGLLLQVLVQILRGTPSCGXLLSFCGFR

SEQ ID NO: 165938 - protein, 88 aa, Triticum aestivum
  Clone ID: PAT_TA_60356.pep
RLGLDPFIYIPNGCGSFLGLMQLILYAIYRKNKGPAAGAVPAGKGEDAGDEADEVEDAKKAAAAVEMGEAKIKVNDDTAVVDKVAAQV

SEQ ID NO: 165939 - protein, 103 aa, Triticum aestivum
  Clone ID: PAT_TA_60357.pep
MAAAARRALLLLLAAAAVALLAAPPAAAARPCGRAQTLLISFSSFSRPNPDPADPSPLTTTVVTVLRVRRLGPHRFHAHDQNRLQIRRPPSPSLPQAPPSVMP

SEQ ID NO: 165940 - protein, 121 aa, Triticum aestivum
  Clone ID: PAT_TA_60358.pep
GRVTGLKEGLHGFHVHALGDTTNGCMSTGPHFNPAGHVHGAPEDEIRHAGDLGNVTAGVDGVASINITDCHIPLTGPNSIVGRAVVVHGDADDLGKGGHELSKSTGNAGARVACGIIGLQG

SEQ ID NO: 165941 - protein, 87 aa, Triticum aestivum
  Clone ID: PAT_TA_60359.pep
PAGSGFSLPAANSGDMSPAIRRYCKAEQVSGQTSALSPSRETGLSTDPNAAGCAEISSAATPSSQNQDFLDQFDEYPALNLADIWKY

SEQ ID NO: 165942 - protein, 174 aa, Triticum aestivum
  Clone ID: PAT_TA_60360.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGRPSPWKVESSDT

SEQ ID NO: 165943 - protein, 248 aa, Triticum aestivum
  Clone ID: PAT_TA_60361.pep
PAGPGNAVALMVHTNQLEIEERSGTSYWDCFRGSNLRRTEIACMGFLSQITNGGALCYSGSFFFQQTGISPETSYGIALGGTGIAFMGTIISWFYIYKFGRRTIWLTGFSCLVAILWTIGFLALPKQTKPLAWAQSILCVVWLGAYSMTVGPIIYTIVAEIGSTRLRTQTIVLARSTYYVGNIVCGGLIQPEMLSPGSWNLKGKTAFFWAGLGTLTLLWGYFRMFETKDRTFGEMDYMFQKGVSARKS

SEQ ID NO: 165944 - protein, 90 aa, Triticum aestivum
  unsure (1)..(90): unsure at all Xaa locations
  Clone ID: PAT_TA_60362.pep
AQAAVRSFDSLIGKIEKVNMKEEKETXVTWSRASSILPTMVGHTIAIHNGKEHIPIYITNPMVGRKLGEFVPTRHFTSYENARKDTKSRR

SEQ ID NO: 165945 - protein, 189 aa, Triticum aestivum
  unsure (1)..(189): unsure at all Xaa locations
  Clone ID: PAT_TA_60363.pep
AGRFRDDRDWTATGSFYGNLESRGXXDAPAQTVFYTPAENRAIFCDATDYGMIRFCXIANPEQDWRPGTQQDEPVEKCLTSAHRQNQTWLLFLTHRGVENSSCTYYETEGSFEAPMMLETLHECLQDKHXDLACYSLGRNYGGTWPGYHRQSIIDAAHHCSGPVKATTSCWLLAALPLKLQNQSPPDQG

SEQ ID NO: 165946 - protein, 86 aa, Triticum aestivum; identical to SEQ ID NO: 139599
  Clone ID: PAT_TA_60364.pep

SEQ ID NO: 165947 - protein, 100 aa, Triticum aestivum
  Clone ID: PAT_TA_60365.pep
DYVSWTKSLPPSSLNSILLYESHTTRARTAYPIGALPTDRELSSLPKCLGREPDIQTRSYSAARYSTAASPTSTTPSRMTAISYGDMLHNFARGLPDGLN

SEQ ID NO: 165948 - protein, 85 aa, Triticum aestivum
  unsure (1)..(85): unsure at all Xaa locations
  Clone ID: PAT_TA_60366.pep
WQIEVQPPHGVQFSVNRVRGRPHASRLHLIVKQEFGIPAGPGGAVRSRAGPGRHXPFFFFFFFFFYFFFFFFFFXADPAGPSKRP

SEQ ID NO: 165949 - protein, 109 aa, Triticum aestivum
  Clone ID: PAT_TA_60367.pep
MAAMKKIVVKLDLPCDRQKQKAIKTVSTLCGIDEIVVDTKDAKMTVVGTVDPVDVVRKLRKRFCSVRMVSVGPAKEEVSVRAPKEAPTTKLECPPVPPAPPVLIVPPGT

SEQ ID NO: 165950 - protein, 156 aa, Triticum aestivum
  Clone ID: PAT_TA_60368.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLPIPPTYSKNFQGPPPEIQ

SEQ ID NO: 165951 - protein, 102 aa, Triticum aestivum
  Clone ID: PAT_TA_60369.pep
FFPQKKYCIISGNLKIYFFLKKRLQLTQTHYHYSSSSSKLYKCDGFLMPLLVACVCGWVQGWIVCNHCWDTTRVYPGMTGQRKCCHCQSYNTCRVAPSVLPA

SEQ ID NO: 165952 - protein, 206 aa, Triticum aestivum
  Clone ID: PAT_TA_60370.pep
AALRRRARHYISCVTWVGARQPQPGIVEHTTSEDMQMGLYPNKAGDSVLDKSHLSQFESLLSIGKTIFQIVPDIQVQRWEKVVWNAAWNSLTALTLTDTHSWLSSSDLSTPMTRRLMKEVIDVANALDVSLKYDLIDQLLDKILGMPPIGSSMRTDYENGKPMEVEVILGYPVRKGRELGIEVTTIETLYTVLLAINKRLMSSAAK

SEQ ID NO: 165953 - protein, 44 aa, Triticum aestivum
  Clone ID: PAT_TA_60371.pep
YTLILDRVVVILIIVLNILALNTLPATLLIRLPYRKEHCVIDHN

SEQ ID NO: 165954 - protein, 82 aa, Triticum aestivum
  Clone ID: PAT_TA_60372.pep
MAPSRRMAASALLLLVLLVATEIGATRTKVAEARDCLSQSHKFKGACLSSSNCAGVCRTENFPDGECHTHNFARKCFCKRAC

SEQ ID NO: 165955 - protein, 71 aa, Triticum aestivum
  Clone ID: PAT_TA_60373.pep
GPFFFFFFFFFFFFFFFFFFFFFVRKIQESRWKKRGEKRAPEHNQFTNDNPYKNHMMSQQIQPTGLLTTRH

SEQ ID NO: 165956 - protein, 69 aa, Triticum aestivum
  Clone ID: PAT_TA_60374.pep
EARASRATGRQVASEDDSLPASRALSGQAAATVPPVSVLPERPRLVAGAAASLMDLDVHFRDPGRASSG

SEQ ID NO: 165957 - protein, 254 aa, Triticum aestivum
  unsure (1)..(254): unsure at all Xaa locations
  Clone ID: PAT_TA_60375.pep
MSLSKRANDAEKAIEGMDLWEVIPNLFDQETNPDGIVSLGVAENTLMHDVLRKHIHDNLALTNPAFTYGDGTTGTKQVKKSVSRFLTKHLKPFKAIEPAHITMTNGCSAAIEHLSWAVANPGDGILLGQPYYGTFVPDLTARFGAKLLPVAFGEVDPLGEAAVAEYEKVILEAQAQGTRVSGLVISHPHNPLXRCYSRSVLIAFMKLCQKYEMHFISDEIYALSVWTNTVDQHPLSVPFESALSIDTTDIIDTD

SEQ ID NO: 165958 - protein, 58 aa, Triticum aestivum
  Clone ID: PAT_TA_60376.pep
AGRAGRKSQKQQKNKKMALGARLIDKNADHERESCARSVDFFDPSCLFTLLYRKMRDQ

SEQ ID NO: 165959 - protein, 128 aa, Triticum aestivum
  Clone ID: PAT_TA_60377.pep
PLAFNKVITTWFIGGVKHTSAKAYHLESKNMTKQLVETIGEKTIMIHSLLLEQLGLLASSLSPSPFPSFLASRPGGGRSRRGPCPWTPRRGTRRRSSRRRSPPAPSSPSPISGSGGFGGLATAPARPA

SEQ ID NO: 165960 - protein, 127 aa, Triticum aestivum
  Clone ID: PAT_TA_60378.pep
GNSDLMKSMMSTLLQGQYLVWQHQEEWPVSITGIQDMVGDRAYYLIEPADKEKDLQPRCDAAAFRKLHPRPFFVSFPAPVVARCRSSPDFLCIKSSNRNPLPPPFVCNRFSFTLASILYIFSTLLIQ

SEQ ID NO: 165961 - protein, 119 aa, Triticum aestivum
  Clone ID: PAT_TA_60379.pep
EDVHILLDVVQASASVYLPLHHIRHHDRRLLSSDCAPYNMPDLHHTEQPDRIRLHGAQDDLREARNRCRLEGQLLIMVTSRRYCSLRMIKVRRHPERMNQSICDAGYAIIASRHIDRDR

SEQ ID NO: 165962 - protein, 48 aa, Triticum aestivum
  Clone ID: PAT_TA_60380.pep
GPFFFFFFHGTYLVDNPERFFETGRTPAFPLASEKNRYRKIFISQPGR

SEQ ID NO: 165963 - protein, 187 aa, Triticum aestivum
  Clone ID: PAT_TA_60381.pep
PAGQETSSLWRRHHGHGGGGGGYGGGGGGYGGGGGGGYPGGGGGYGGGGGYPGHGGEGGGGYGGGGGYPGGGGGYGGGGGYPGHGGKGGGGYGGGGCHWGCCGHGLFHHHGCRCCARADQVPEPMDRAPAEGHHWAHHPDQMEPWTPAYRKEYWWPVATLGRTLPGWRWSAPLPAYITIKLVRNKHG

SEQ ID NO: 165964 - protein, 104 aa, Triticum aestivum
  Clone ID: PAT_TA_60382.pep
PPSSSSSSSSKPSSGLLVAMALRTVAAKLKAPVASLKQAWAVCRPQAKGPKLSKGLDMDLSDPHIRRVFDENAKLLNRKRTKETAALIVFMTGTTGSALLAMRY

SEQ ID NO: 165965 - protein, 122 aa, Triticum aestivum
  unsure (1)..(122): unsure at all Xaa locations
  Clone ID: PAT_TA_60383.pep
MALRVAPSPLLASGGGATAFATPLTPRKRGAGLLLVSKRSRISAXLGGGGGGGGDGETKPDGKKFITREQEPEQYWQTAGERKGENPMMTPLPYIVIFGFSTPFIILAIAFANGWIKAPLIR

SEQ ID NO: 165966 - protein, 200 aa, Triticum aestivum
  Clone ID: PAT_TA_60384.pep
MAEAARGGPTPPHGGIPDEILIWDILVRLPPKSLLRCRAVCRAWRTATSARDFLIANHARQPTRPLLYVCNLPHYGHYKVGGDIDIIPFDHRAAADKLQPVALLGRASEFKDLVASFDGLVVFDWWRRKSLGICNSATRQYARLMVPMDFTFLGMYRHPPTGEYRVLMYPCLAAGREAGCYVLSLGSIQPPRSIVAGGSA

SEQ ID NO: 165967 - protein, 96 aa, Triticum aestivum
  Clone ID: PAT_TA_60385.pep
LIYHDVTTSHASTIPWPKQGTCRSGASGISRNALSWDLTLGITSGGLNPALERLMWHTMNIMGDGIMTIKWSGTRRGWIDHYQMLTNTKHHNNFQR

SEQ ID NO: 165968 - protein, 136 aa, Triticum aestivum
  Clone ID: PAT_TA_60386.pep
AGRAGDTHFTVTSKANDEDGDFAELYVFKWTSLLIPPTTVLVINLVGMVAGISYAINSGYQSWGPLFGKLFFSIWVILHLYPFLKGLMGKQNRTPTIVIVWSILLASIFSLLWVKIDPFISDTQKAVAMGQCGVNC

SEQ ID NO: 165969 - protein, 58 aa, Triticum aestivum
  unsure (1)..(58): unsure at all Xaa locations
  Clone ID: PAT_TA_60387.pep
MTANSDTWSYGMLLYELITGHRRVDXNRPEDEQKVLDWAKPYRLGVDLNPFFLTSIPE

SEQ ID NO: 165970 - protein, 67 aa, Triticum aestivum
  Clone ID: PAT_TA_60388.pep
PAGSGTFVEAGESIEMPQRTEDGIKVSRTFQTTQIEVVKPNRDRTDYDDLQSESSSTRNLKEEQFNV

SEQ ID NO: 165971 - protein, 229 aa, Triticum aestivum
  Clone ID: PAT_TA_60389.pep
MPQDPAAALSALLQQSSIEDHEEVLKAANAALKANKTDTDSQHTRIIALLKLDRFEDALRAIADGTPTLHSRIALEHTYALYKTGKLDEATLVLKAAGLENKRNLQHVAAQVAYRSERFDEACNIYSRLLDTDPADEENDISINLRATLAQSSWLGYSVTDKVAVQDSDGFELCYNAACAHIANGSLETAADLLQRASRLCDASDDLTEEDKQPRCGHSRQQGYVFANA

SEQ ID NO: 165972 - protein, 277 aa, Triticum aestivum
  unsure (1)..(277): unsure at all Xaa locations
  Clone ID: PAT_TA_60390.pep
AGRVWHGGLTAVMKLTKLFIEKGAAGIHIEDQAPGTKKCGHMAGKVLVPIQEHINRLVAIRAQADIMGSDLLAIARTDAEAATLLSTNIDPRDHAFILGSTNSTLKPLNDLMIAAEATGKSGAELQRIEDEWLAKANLSSFDDAVAAAIDAGSFSDKAGIKQEYTSRAKGKSNFEARAVARQLLGRNIFFDWDAPRTREGYFRLKGGCDCAVNRAIAYAPYCXAIWMESKLPDFAQAEXXAQGVHAVWPEKKLAYXLSXSXNWETAMPRDEQETTSD

SEQ ID NO: 165973 - protein, 244 aa, Triticum aestivum
  unsure (1)..(244): unsure at all Xaa locations
  Clone ID: PAT_TA_60391.pep
MAPSAVETQDVNLTAAAIHKKEVAQPTTTTQAPLDASKLTYTYTQNPRSVPDEANAHSGDETIATDHMVLAAWKQSTGWAAPELKPYGPLSLMPTASVLHYATECFEGLKVYRGYDGKLRIFRPDRNAARLRMSSTRISLPSFEPSEIEKLMISLLSVDGTKWLPADRAGSFLYIRPTVIGTAPQLGVSAPKEALLYIIVTFMPRMDAPPGGMRLHTSPDDMVRAWGRGFGYARXGANYXPSLL

SEQ ID NO: 165974 - protein, 177 aa, Triticum aestivum
  Clone ID: PAT_TA_60392.pep
PARGPARARDKSTGCYNLKCSGFVQTNNQIAIGGTLSPVSTYDGAQYDFDILVWKDPKEGNWWLQMGSDYVGYWPSSIFTYLADSASTIQWGGEIASSDLGQTSTDMGSGHFPEEGFGKASHVKNIQVVDSSNILKPPSDVTTIAGQRSCYNVHNGISDNLGTYIFYGGPGKNSNCP

SEQ ID NO: 165975 - protein, 105 aa, Triticum aestivum
  Clone ID: PAT_TA_60393.pep
GPFFFFFFGRDEFIRREAPFFFFFNSVQPRTKSRNFICLYKKHIQNKSSTSTYLPTRLMSLMVRACPHPHGGRLQLPGSAAASLHVSNARPLVLISMEATEARPA

SEQ ID NO: 165976 - protein, 69 aa, Triticum aestivum
  Clone ID: PAT_TA_60394.pep
LAAYGRRTLDFEMTTQISSVQTLNSLTNASASFSQDLLVRRNNSNDCQRFMPRQTSACTPLCGHVSKLN

SEQ ID NO: 165977 - protein, 83 aa, Triticum aestivum
  Clone ID: PAT_TA_60395.pep
TSRMRFQQYERKTIGRKLYPRNQTDAELPLSCPTARKKGALPTVAQAMKVMELKLVAASCQEFSSSASDRASLSCLASCGEGT

SEQ ID NO: 165978 - protein, 47 aa, Triticum aestivum
  Clone ID: PAT_TA_60396.pep
AGRFGFCSCSMVSVSLVMFLPVGLVFWLLSQGAKPDGDQVQSKAAFT

SEQ ID NO: 165979 - protein, 103 aa, Triticum aestivum
  Clone ID: PAT_TA_60397.pep
PAGVGAYLNAPPLNLSAKLRPPEIEGIENNIDPVADREERNNSIKDLYSRLQAAFPGFDPKKEPVFRANAQGGQKPGNMMGSQASPTAQRTPKMTNMGAPPMP

SEQ ID NO: 165980 - protein, 155 aa, Triticum aestivum
  Clone ID: PAT_TA_60398.pep
WGAGTALAVSGEVAVVRSPPMPASVKHREEEERDALAVPWTAPLPLALAVATHHNGQGLVFVVGSVAGEEDDVDLDTPAPSTSTHRRRRCLCRMEGGDVDLAHQRCLEAGDLTSMPRRHRSSCGRASRLRGLRRRRCRSRRRGGRVRFGGPARPA

SEQ ID NO: 165981 - protein, 89 aa, Triticum aestivum
  Clone ID: PAT_TA_60399.pep
RGLFFFFFSRLRRIFFFFFFFQRNDFSYLVKCKLDSCAPGLLRTRSWYMYNFLSQALCTVTAEIQKCLSLGFLATQIIETPQLGPTRPA

SEQ ID NO: 165982 - protein, 77 aa, Triticum aestivum
  Clone ID: PAT_TA_60400.pep
AGRAGLGDSVTVARDKSKVTVTSDGAFSKRYLKYLTKKYLKKHNVRDWLRVISSNKDRSVYELRYFNIAENEGEEED

SEQ ID NO: 165983 - protein, 230 aa, Triticum aestivum
  unsure (1)..(230): unsure at all Xaa locations
  Clone ID: PAT_TA_60401.pep
MAGGDNLTLVGMWASPHVLRVQLALRLKGLSYEFVEMEGEQGLKNNKSEQLLLNSKLPVLIHGGKPIRGTSLSIIQYIDEAFAGASPSLLPDDHSERVVARYWADFIDDTLVKAMHKAAWGKTDGEKAEGKNQVASAVETLEGAMRECSKPFFGGSNVGYVDVVLGSLLGWVRATDTMQGVKTFDDPAITPLLAMXACRFDALKAVQVVMPDVGTLVDFAMPMMSARHSG

SEQ ID NO: 165984 - protein, 53 aa, Triticum aestivum
  unsure (1)..(53): unsure at all Xaa locations
  Clone ID: PAT_TA_60402.pep
PAGPGYDAVELGYEKVXVLIDATAAARPDIHLANIRDMKTIGVETPTLEEWRR

SEQ ID NO: 165985 - protein, 137 aa, Triticum aestivum
  Clone ID: PAT_TA_60403.pep
ENGGWQSSSPGGPAAPEPGLGDPGGSGGYDPAPTATPLTTSHRKRRPSPPRPPTPTLPPYTPSPPEPTPTPPPYTPSPPEPTPILPPYTPSPPEPTPPPYAPAPMPSPFLEHGVEADSAGVQAAADYEEPPSTPDNA

SEQ ID NO: 165986 - protein, 217 aa, Triticum aestivum
  Clone ID: PAT_TA_60404.pep
RPGRSKSEPLTKATLSAPPPCRHGQLPEQGVYAAAARDAAAARPRRAGGAGGEGGAGGAQEHRPGAAAGGRRGGGGGGGPGVRVAGGRDEGESGPDEGGAGVAHGAAQERRAAPRGRAPPDGQRPGRRRQAAARRRLAPAPRVHPRVPRGRRRHLADNLHAVCSRSLLPGHRDQSLVSSMHGLLAFLLRSVRVHRVIHGEASCFSVSLQRMDPWSGA

SEQ ID NO: 165987 - protein, 72 aa, Triticum aestivum
  Clone ID: PAT_TA_60405.pep
MSREGYQIPTASTGQRGGTRDDQQVRHVMSYLCGDCGGSVTLGKDALVACPHCAGRILYKERTKRMVQFEAR

SEQ ID NO: 165988 - protein, 89 aa, Triticum aestivum
  Clone ID: PAT_TA_60406.pep
PAGPGKRDEAVDVRMVGSDAAAVRVTTAASHAPARLMGALRSLELQVQHACVSRVQGVTLQDVVVDVPPSMQDADGLRSALLQTLQDSA

SEQ ID NO: 165989 - protein, 127 aa, Triticum aestivum
  Clone ID: PAT_TA_60407.pep
MKVLSLNFLTCAAKACKSSKDSYPLHPKDAELVQDDIELNPDMIINVLPRLDWEALRTTASELGFPQLPEQAPTAVELKGDDKTLRDLHHLLLETQMSEGKLVCGSCGHEYAVKEGIANFLLPSHLV

SEQ ID NO: 165990 - protein, 258 aa, Triticum aestivum
  unsure (1)..(258): unsure at all Xaa locations
  Clone ID: PAT_TA_60408.pep
AGRASPXTFDKYNPSLRWAFQPVIDGEIIARPPLETWRQGKWHKVPIMTGFTTNEGSLYVDKTMSKSSEFRHFWAELLPLLTSEDLDTIEELYRDPAKFEDSEYKETRKDMGAQYKRIEAAYAHYAYVAPARQTAELASPSVPVYLYHWAAQSTVNNGAQHADNMRYEVCDPNVLKVSPTQKDLAKTLNHYVTSFITKGDPNAVAGEYPSRPKWEAYDVKDPKVLRFGDGNEELIGGDVGKTAVFDSDEWGRQSKFWE

SEQ ID NO: 165991 - protein, 209 aa, Triticum aestivum
  unsure (1)..(209): unsure at all Xaa locations
  Clone ID: PAT_TA_60409.pep
MATSISRSRALASALRPAKPSVQLRNDQAIRCLSNTARQYVAMPKESPNLRKAPRDHIGTLKAPIVNPADKYQSKSDNMHRYGAWVMGCLPKYVQQFSVWKDELTIYISPSGVYPVFSFLKYNTAAEFTQVSTITAADYPTRENRFEIVYNLLSVRHNSRIRVKTYADEASPVPSITGLFDGANWYEREVYDLYGVFFAGHPXLRRIMT

SEQ ID NO: 165992 - protein, 240 aa, Triticum aestivum
  unsure (1)..(240): unsure at all Xaa locations
  Clone ID: PAT_TA_60410.pep
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTEKPALYQTDPSGTFSAWKANATGRNSNSMREFLEKXYKETSGKETIKLTIRXXLLRXVESGGKNIEIAVMTHKDGLXQLEXEGEIDEYVAEIESREAAA

SEQ ID NO: 165993 - protein, 211 aa, Triticum aestivum
  unsure (1)..(211): unsure at all Xaa locations
  Clone ID: PAT_TA_60411.pep
MRFSGFVSGLGLGLLTAVSASPAAFPAPASIPDPIPAPVAPASPAIEERAAKVTVAVPSGTVVGSSSGKVDSFRGIPFADPPTGSLRLRPPKRLSKSLGTFDASGLSAAACPQMFISSGGQSVITEFLSDFLAVPFLTPITGQEDCLTITVQRPAGTKAGDKLPVLFWIFGGGFELGSSAMYDGTSLLSTAIDQSQPFXYVAVNYRVXGFG

SEQ ID NO: 165994 - protein, 195 aa, Triticum aestivum
  unsure (1)..(195): unsure at all Xaa locations
  Clone ID: PAT_TA_60412.pep
MAEESILDLEYRGRTAILTIHNERKLNAFTGAQYYDLAQKLREIATHDEVFTTVILGKGRFFSAGADVGITRKAPGEDKDSHKQLLQSFVANNLNITHAFATHPKVLVVGLNGPVIGLXAALVAFADFIYCAPSTFLLTPFSSIGLVAEGGASRALALRLGPARANEALLMSRRIGSQELERLWICQCIYDEGDD

SEQ ID NO: 165995 - protein, 213 aa, Triticum aestivum
  unsure (1)..(213): unsure at all Xaa locations
  Clone ID: PAT_TA_60413.pep
MTNSVAFPRSVILQALAISSTVSVFLTKTGAEDALGQAVCPSFSCGHLQDIHHPFRLRGDPPGCGVQEYELVCSDGQAIIQVNTGRYLVTNISYPDSVFWVVDANLDNSSCPIPERNQHPYIHGLRSDYMFLLYMRTVKWAXFVSCSRMMKDDVIYKPVACRSTNTSFVYMLSTMQSYQVQNVEPSCGYLAMTPLKGVWGQMIIIQLMVMKIL

SEQ ID NO: 165996 - protein, 123 aa, Triticum aestivum
  Clone ID: PAT_TA_60414.pep
MATEVLRPHNILQPQTQRIRAAHRRPSNPGTTRRSPPPPATAVSTTGRRHHGRPSSSSSSYGKVTSAAAPARRPAVEVYAGPAFSAASPEPSSLPLPQFPLQKPAAAVNDAATRDLRRMLRLE

SEQ ID NO: 165997 - protein, 244 aa, Triticum aestivum
  unsure (1)..(244): unsure at all Xaa locations
  Clone ID: PAT_TA_60415.pep
MATRTSLRHLGCVPRHLFTFRRYISTRDMTATDLKKLKVDQSRFMEALHDTCKWGTGLKWGDKPTDTGMSRLALSDSDKQVRDWFVKTTEDLGCKVTTDSMGNIFAVRPGRKEGPPTLAGSHLDTQPSGGRYDGILGVHAGIEMLKVLQEHDVEXRVSSXVVVNWTNEEGCSXFQSAWMASGVWAESITQERAHSLKEVAGNATVKSELERKGYLCETPXAINPHPLGAHFELHIGQGADSLTS

SEQ ID NO: 165998 - protein, 129 aa, Triticum aestivum
  Clone ID: PAT_TA_60416.pep
QNWELLASDRATSPLDLSNLDSPSCNRPLRCLIGVSTGSMAMERFLTALVFCEAPLDGYGMSMMTSSRAVKPLVSAGSIKPAAAAPKADDAYAGKKPGFCGETTTQRHAGHELAFDGLNCFETVVMYQA

SEQ ID NO: 165999 - protein, 210 aa, Triticum aestivum
  Clone ID: PAT_TA_60417.pep
MATTTPSMGLTAKGVPKMPMWLTIVRGVTIAMSLGALIAAAYNISLISSWARYYGGSGPAGLIIFSAIFTWIILGCMLAAEFFAPQLYIRSIFFGTLVISSILWLAAWTWAAAWTADFYHLYNSYYISRVSELDAWGGSMAAAVALGAVTWILTVVTTVFFVKACVADPTGSTFVQRPRNDPETAKPKPETTVTALKNPQRNPAWLCCNE

SEQ ID NO: 166000 - protein, 158 aa, Triticum aestivum
  Clone ID: PAT_TA_60418.pep
ERSEHLNTMDLELFHNYMTKTANTLHDGTQPHLWSEGAPRVGFQHNCILKLILSLSSYHLAKLKPIDKPRYLLTAETHLTTALQPATVLISRLGGANSPAAYLTSVLICFVALAKGPSPGNILLTNIEGHVSWLHLLRGVRSVVEVTGWSGIFSGVLA

SEQ ID NO: 166001 - protein, 225 aa, Triticum aestivum
  Clone ID: PAT_TA_60419.pep
MDSNTIMAVQETIAARNWQQTGCFFAGVWLVYIVALVVWRLWFSPLAHIPGPKLAALTQYYEFYYDFVLGGQYNYKIIDMHERYGPIVRINPWEVHVGDPEFFSDLYTSPSPSRRRDKWTFYTQQSGAPRTQVPHPNALAAPKTATEGSLAAIDHGLNKLRRSALIPLYTTQTVRELQPVIEERVEALLTAFMNYAEVSNGKPLDVMYPYSLTNDVINEYAFCSK

SEQ ID NO: 166002 - protein, 197 aa, Triticum aestivum
  Clone ID: PAT_TA_60420.pep
PAGSGSQESVAALVPKVLADGHEIRILINCAGIQRRHPCEVFPDSDFNEVIQVNLNSVFTLCRDVGAHMLNLEPSPVTGRRGSIINFGSLLTFQGGFTVPAYAASKGAVGQMTKSFANEWTAKGIAVNAIAPGYIETDMNEALLNNPERLASITSRIPAGNWGSPDDFKGTSVYLASKASGYVSGHVLVVDGGWMGR

SEQ ID NO: 166003 - protein, 83 aa, Triticum aestivum
  unsure (1)..(83): unsure at all Xaa locations
  Clone ID: PAT_TA_60421.pep
RSAPLPXXAVIFLRIHSRFLPPAIGAGRSSGRRWALGSQLFSFCFCCLVRIFILFSMDQPLVHEPQHPHVIRVPKNLYPRPGR

SEQ ID NO: 166004 - protein, 90 aa, Triticum aestivum
  Clone ID: PAT_TA_60422.pep
PKNVPIQLFPTIIFYIFPIIPLCSQHDNIGCSPHIDIMEDHPVPSSSLASSSSSSAVMLLTASSTSILQITALHYPGLATLYTSSSKIKT

SEQ ID NO: 166005 - protein, 232 aa, Triticum aestivum
  Clone ID: PAT_TA_60423.pep
MSKTTLATMACLGAGGGAAITAAVYSIRGGKRVEETNTLATPPPTTNSFAALPAPTASPSIPPTQVFGPPAGAPPSSTPVDINAIVNPAGLFEYGFPGPVADVANRSGLVSSYDRRLRNPHWVVEHITPQSLAIREGDRKHSNFVEDESVPQKFRAGLKDYYRSGFDRGHQVPAADCKWSQKAMDDTFYLSNMCPQVGEGFNRDYWAHFEDFCRRLTVKYPSGRIVTGPLYL

SEQ ID NO: 166006 - protein, 156 aa, Triticum aestivum
  Clone ID: PAT_TA_60424.pep
MLTYNSTSTMPIKAPTKPVSIALSPTTSSPMTAATPSLNSAAINGHKTQGQQHIWLVTGPAGCGKTTVAEYLAKSLGMPYVEGDAFHPTANIEKMANGIPLTDEDRWDWLTALREESINRLNAGSCGVVLTCSALKRKYRDVIRVAGYYDRRIQIH

SEQ ID NO: 166007 - protein, 152 aa, Triticum aestivum
  Clone ID: PAT_TA_60425.pep
LCGARGGRTESFRIYSPPLILFLSPEKFLPQTLILSASLLSPELLPTQPSPAADLLLRSRGDGGAAARLFLPLLVVADAGQVPRGESGDAVRVRWRRRHRMSPEITSCGSAEIPCPWVDSATRGWWCCDQRVTVLGPASAGAGTIDVRSYIR

SEQ ID NO: 166008 - protein, 66 aa, Triticum aestivum
  Clone ID: PAT_TA_60426.pep
ASTPITGMYYMQQANELISTCAHTPLALSLAATGTATGTASAAAAGAASRGGRSKHGARHVRTRPA

SEQ ID NO: 166009 - protein, 118 aa, Triticum aestivum
  unsure (1)..(118): unsure at all Xaa locations
  Clone ID: PAT_TA_60427.pep
CGAQAAVTXTNSQSLSSESPSPPSPEEEKDEAMVLLYACARDCYEDEEKFARFQAWVRSEYASMGFVEVDYDYFGERAEATRLSKEAREEVFRDTDLSSDSEDDDELKHLKRTVRSWV

SEQ ID NO: 166010 - protein, 242 aa, Triticum aestivum
  Clone ID: PAT_TA_60428.pep
MADVPLVVISEFAQSERRITPSWSISQLKTKLETVTGVPPGCQRLSLKPTAGAEAIAIEAPNEDDTHLSNFPLAPYAELHVIDTRPPASRINLNDTAGVDKYVMPEEEYEKKSDSVLAWKKAQKLGRFDPDAPSHEQAKLSALDREVATRGIAVGRRCRVGGEDTRRGVIQYVGEVKEIPGGLGSWVAVKLDEPVGKNDGSIAGTRYWGEPSELKHGVFVRPERVEVGDFPALDDLEDMEEI

SEQ ID NO: 166011 - protein, 59 aa, Triticum aestivum
  Clone ID: PAT_TA_60429.pep
RNETWIQGKRYRFTIKKCCPSEKAKAQCSTEKRRVRGLLQSSISNRRWTHGGVKGTTHI

SEQ ID NO: 166012 - protein, 246 aa, Triticum aestivum
  Clone ID: PAT_TA_60430.pep
MKGLITQLALAVCCSQTFASPVRSTSSKNLVVFGDSYSTVGFWPGGQLPSASNPIGNPGLPGQTTSAGLNWVGHVTSTLNTSLILTYDFAYSGATIDKKIVNSWAQYSMSDQVGLYKQYVAPAVSDADTLVAIWIGINDVGEAFWSKTNALVTECVNRYFELLQTLVDDGFDKFVLLNIPAYADQFPKMIGQPAVDLARLRADIISYNKAVQSKAAAFTSSHPTVKLQIFDTKPSFDQVVNNYAKY

SEQ ID NO: 166013 - protein, 248 aa, Triticum aestivum
  Clone ID: PAT_TA_60431.pep
LCAARGGRSGNDISPRTYRVDSFSNIGTMANDSKVDVLIVGAGPAGLMAAAWMARCGVNARIIDKRNTKIFCGQADGLQCRSLEIFDSLGFADRVWKEANHMIEICMWNPGPDGIIRRSDRIPDTIVGLSRFQQVVVQQGRIERFFLDNIKKYPKDQIKVERAVLPEAIEIDKSNLESTKDHPVTIKIRHLSEEEATPAQQATASKTQASDGLFRSNLVFDDQVDNDSALRKAPDRDAVTETIPAKLC

SEQ ID NO: 166014 - protein, 261 aa, Triticum aestivum
  unsure (1)..(261): unsure at all Xaa locations
  Clone ID: PAT_TA_60432.pep
MDLNSLSNYKTPGGAVVALLAFVTFWWLTTTLIAWNRLKHIPGPWVAGFTYAWAGWTEYSGKQHFSFLDLETKYGSLVRIGPELLATSDVEVVRRMSARKSTYRKSSWVDGVRLNPYHETMFGVRDPIEHDRIKTRLAPTYSGRDTPHLESVVDQQVNNLVSLIRRKYVSDPTSGDFRVMSLIKVASYLTLDVISKVGLGTEFXCCASDSDPYGFTXAVAELLESLWTSGRRGQAETLFLVIAGSDTTAAAIRVTMFYIIS

SEQ ID NO: 166015 - protein, 190 aa, Triticum aestivum
  unsure (1)..(190): unsure at all Xaa locations
  Clone ID: PAT_TA_60433.pep
MASSDTPALKNNPKFIFFTDFDGTVTTADSNDYMTDNLGFGVERRRQLNKDVLFGKMHFRDSFVEMLDSIKTPFDECVDILLKNIKLDPGFKEFYDWAQQNNVPIVILSGGMEPVIRALLDTLLGPGWDIQIVSNYVTAREGKTLKDEGGWRIEFHDDSIHXHDKSIEIRKYSSLPDRPTMFYAGRGSFR

SEQ ID NO: 166016 - protein, 198 aa, Triticum aestivum
  unsure (1)..(198): unsure at all Xaa locations
  Clone ID: PAT_TA_60434.pep
MLGATTATATTSTTAMTSLSTAPTVLGDTTLLNQDTTETSKQPEEVPSFTPGQCLFCSTSSPTLEESMVHMQKSHGXLFVPQQDHLTVDLETFVRYLHLVIFNYRECLYCETSRSTVQAVQQHMTSKGHCKIDLAEHSEFADFYDCYQTEHELSEGSVNEYGSRKDIDRKPLQVHQDSMRLPSGRLVSKKSSAQAEAS

SEQ ID NO: 166017 - protein, 226 aa, Triticum aestivum
  unsure (1)..(226): unsure at all Xaa locations
  Clone ID: PAT_TA_60435.pep
MAPKVLVVLTSQSKMNNGNPTGWYLPELAHPYYDLVNAGVEITVASPAGGEAPLDQGSVQMFKEDEESVKFLNEKKQVWEQTTPLKEFLGKSSEFDAIFYPGGHGPMFDLVNDETSIKLIEEFYKAGKPVASVCHGPIVFTQVKIDGKPLLEGREATGFSNSEEDAVGLTSAMPVLLEDEIKRVGGKYVKADDWAEKLAVDGQIITGQNPASAHAVGKAILKXIGA

SEQ ID NO: 166018 - protein, 256 aa, Triticum aestivum
  unsure (1)..(256): unsure at all Xaa locations
  Clone ID: PAT_TA_60436.pep
GGHKIPTQLELSNGSQTPGLTGTSHIRLKCRADTRWSGHTSHLSPAHRWPIPTSKNPRPTETLAHSAPFPSHSFPDAPISSICQIPSAGEHVQHRQPLRRQLQRRGGAGAPYRARALAGRYGQQLRVQCDAPCRPSRQRRYRHRPFPPRAWICEACQICSSRQTASFTSAHCFARAALGSSACSSDIVDADSGVGGTRCLSREAEGYXRWWAILRSPPAAXGCPXGSAQSSCRPRVPEXVCVVRPSPMXARQGGRL

SEQ ID NO: 166019 - protein, 165 aa, Triticum aestivum
  Clone ID: PAT_TA_60437.pep
MFSRLASFANPAAKSASASGRTMLQVRYLSEKAVAGSKGRAMPFSAVRATAPAASLPATLTIRDGPVFQGKAFGANANISGEAVFTTSLVGYPESMTDPSYRGQILVFTQPLIGNYGVPSAARDEFNLLKYFESPHVQCAGIVVSDVAVNYSHWTAVESLGEWCA

SEQ ID NO: 166020 - protein, 246 aa, Triticum aestivum
  Clone ID: PAT_TA_60438.pep
MTGGKKEGSTNPSAVRIRDNQRRSRARHKEYVEGLQKKLQDYERRGVEATLEMQQAARSVAVENSRLKILLGYHGVTNDDVEKFLQSFPDQSVSDAAKATISQSTAGQPPIALAPKMPLQPLSRAPSDSPRTLPLPHIQQETSTSTRDVVDAVVGIKRDSRKAGLDGRPKLPLPIEQRQPLLQPRPQLPILPALPSLVLGQGRPEPPPLDKLSVLATASVHQEPDSNKHRRSHSNADSLRVPSPSI

SEQ ID NO: 166021 - protein, 271 aa, Triticum aestivum
  Clone ID: PAT_TA_60439.pep
MPFATELTKRLGIRVPVVQGGMMHVGTADLASAVSNAGGLGLITALIFPTPEELRKEIQRCRTLTKNPFGVNITLLPSMVPPNYAAFAQTIIDEGIKVVETAGNSPGPVITQLKKAGIIVLHKCTTIRHAQSAVKLGVDFLSIDGFECAGHVGESDITNFILLSKARQTLGVPFIASGGFADGYGLAAALCLGACGINMGTRFMCTVEAPVHIKVKEEIVRAQETDTTLLLRRWTNTTRLYKNKVAMDALEIEKKSESGEFAEVAPYMSGS

SEQ ID NO: 166022 - protein, 233 aa, Triticum aestivum
  unsure (1)..(233): unsure at all Xaa locations
  Clone ID: PAT_TA_60440.pep
MASAVESPPAHSPPTNPPQRPRGILKNSYRKSPPASPEQEQAASEKELTIANTHINAGHRRSSSGARPTGSRRQSGVNSSSDGLEQSQRLKWDEANLYLTEQERSSTMKITEPKTPYAKHYDPAEDPSDDEDPLADAGARLKDSRPRREDDIPGLSLGEPEEEIPEAGAPSPRSEKSVHVDDESSIGHDAEEDLAGMSPEEREKHRKFEQLRKRHYENEEMWAXLLGHPDDLP

SEQ ID NO: 166023 - protein, 131 aa, Triticum aestivum
  Clone ID: PAT_TA_60441.pep
MGSFLSSLWTPPPLPGDDPDSAVVAVHSKPAWDRHWEAHRNASKLMVIDFSASWCGPCRFIEPAFKEMASRFADALFVKIDVDELAEVAKTFRVEAMPTFVLVKGGQEVSRVVGAKKDELDRKIKTFISSS

SEQ ID NO: 166024 - protein, 222 aa, Triticum aestivum
  unsure (1)..(222): unsure at all Xaa locations
  Clone ID: PAT_TA_60442.pep
MGKAKGKQRQDKYYHLAKEQGYRSRAAFKLLQLDARFRFLPTARAVLDLCAAPGGWVQVAVNHAPVGAFVVGVDLVPIRPIRGAHSLTEDITTSKCRSAVRKLMDSKGVAAFDVVLHDGSPNVGGAWAQEATTQSALVIDAVRLATMFLAPKGAFITKVFRSQDYNAIMFCLKQLFEKVEVTKPSASRGTSAEITLSXSQYKAPAKIAPELLGIKHLFNAQP

SEQ ID NO: 166025 - protein, 165 aa, Triticum aestivum
  Clone ID: PAT_TA_60443.pep
METPETITRGDTAKTAEVCKAHGISPEEFSELRTRATAAKATAYCPYSQFRVGATVLSSEGKLTSGANVENASYPVGTCAERVALGTAVTSGHRGFRAIAVATDIAPPASPCGMCRQFIREFCKLDTPIIMFDKNEDFVVVKLEQILPMSFGPDQLPRPGAAVTE

SEQ ID NO: 166026 - protein, 68 aa, Triticum aestivum
  unsure (1)..(68): unsure at all Xaa locations
  Clone ID: PAT_TA_60444.pep
MSRIQXPLDVITSRLNFGDRFQSLRSGPLSGRFSXLRPVNEFLDFKRLSXXNNFVEMQSRVNYNLSTT

SEQ ID NO: 166027 - protein, 116 aa, Triticum aestivum
  Clone ID: PAT_TA_60445.pep
RKHIMTGYHGETPHDSVQLSSASEITGETDFLVGWCLCDEERVCGSGIRPLSRSSRRSSDCIVHRIVISSSRDGKAMLVRYPVNSSWPRDPSVPRLKTSTLSSHLSDTNRNPSPAG

SEQ ID NO: 166028 - protein, 176 aa, Triticum aestivum
  Clone ID: PAT_TA_60446.pep
LQHPRRIPGNPHDGTIERATSRPRAASPHDICHAHARHQEFNTAASCRRTRCMSRLHASSARSRSIVRPIPATAAFIVARGAEVVAVIDRMADRTTNRMATRRNERTSDRWPPTASSLINARRPRAAALLRPLHARLMTAPRIPGSGWLPGRGKSLRLQAEAGRTIMMNRPPRAPH

SEQ ID NO: 166029 - protein, 176 aa, Triticum aestivum
  Clone ID: PAT_TA_60447.pep
MADAQNDAPATAPFKAVQVEALVIMKIAKHCSSAFPSVATGAIVGMESEGLLEVTNTFPFPTVDPATTDGHQSDASQLAAAAPRQQKNITYQNEMIRHLKEVNVDANNVGWYTSATMGNFVNMNFVENQFHYQSANENAVALVYDASKSSQGNLTFRAFRLSPAFLSAHQEGKFTT

SEQ ID NO: 166030 - protein, 128 aa, Triticum aestivum
  Clone ID: PAT_TA_60448.pep
MAEETPQDVSMESPPPAPMQTDQEPKYGGYSRFEIELEFVQSLANPAYLNHLASQKLLSQPAFVAYLAYLRYWSKPPYLKYLTYPGPTLRHLELLQQETFRQQIINPDVVRPLTQEGMRASADCDRGE

SEQ ID NO: 166031 - protein, 169 aa, Triticum aestivum
  unsure (1)..(169): unsure at all Xaa locations
  Clone ID: PAT_TA_60449.pep
MIFHTLAATVVAVALAGNVRASPCKPASRSTAIHLETSSIETTTIENLPTTIQILSSATTVLSIETFTSEAAISSATLTSETSITFDEPTTIVPSAIEQTTLAATTTVNDLSSETAAATDTLTTVXVSVTTTAYTTTEQSAIETVTSSSAPHCTFTGEYTNYVQNPSFD

SEQ ID NO: 166032 - protein, 71 aa, Triticum aestivum
  Clone ID: PAT_TA_60450.pep
PAGLGALLSFSSGPRSCIGQNFAMIEAKAVIAVILQRFSFSLSPKYVHAPMDVITLRPKFGLPMILKTLEM

SEQ ID NO: 166033 - protein, 236 aa, Triticum aestivum
  Clone ID: PAT_TA_60451.pep
MDQQLILPSTPADGVRVLALNRPSKRNALSQELITIFLEQLKTASQDDGVRVIVITGSSTFFCAGADIGEISRLDAEGARDCRYLSDLCTGMQAVRKPLIAAVEGMALGGGFELALMCDLIFAAHDSRFGLPEVSIGLIPGAGGTQRLTNAVGKFKAMQMILLGRPIQAEEAQSAGLVAQLYESGSVLDNVVKDTASTLAALSPTALGLARGAICKSDDLGVDHEFERELYYFAFG

SEQ ID NO: 166034 - protein, 220 aa, Triticum aestivum
  Clone ID: PAT_TA_60452.pep
MGPAVGIDLGTTYSCVGIFREDRCDIIANDQGNRTTPSFVGFTDTERLIGDAAKNQVAMNPQNTVFDAKRLIGRKFADAEVQADMKHFPFTIIDKAGKPAIEVEFKGEKKTFTPEEISAMILTKMRETAESYLGETVNNAVVTVPAYFNDSQRQATKDAGLIAGLNVLRIINEPTAAAIAYGLDKKVEGERNVLIFDLGGGTFDVSLLYIEEVSSRQVYC

SEQ ID NO: 166035 - protein, 74 aa, Triticum aestivum
  Clone ID: PAT_TA_60453.pep
QLRLLPAHPSSSPGTDACCSRSFSYKEKSLKKKKRGGRGSTSLELTYPPTLTEFNIKLINTHYLKNTTSTQNPP

SEQ ID NO: 166036 - protein, 189 aa, Triticum aestivum
  Clone ID: PAT_TA_60454.pep
MAPSRPETKKSNPDIAKLLVDAQTQLEVGRLEEAATLAQQALDTTGQGGDFELSAANLLGTIFVESGDLDEARAAFERAVHLDQDGTVDEKIGGGPEKFLLLAQLSEEGGLDTVQWYERGATALRKQIAVLSELRSPTPEQKTSIQEKQHKLGGVLCAVAEVYMTDLSWEPDAESRCETLNHEAMLLAP

SEQ ID NO: 166037 - protein, 196 aa, Triticum aestivum
  unsure (1)..(196): unsure at all Xaa locations
  Clone ID: PAT_TA_60455.pep
MESGSGTGTGTPNALVRKRTDTSLMPPPPPAKKIKRPKKVLDEDTYTETLSQIIARDFFPGLLQTETQQEYLDALESKDAAWISSAGRRLQHVMTPGRQNTPLPPKSTNSFAPGDRTPSTYGGDTPASVISNVSDFQPRLKTNMSLSKFQETYTSEDNESFYKLVDXHNQKKAEKYAXLWRGNKLPSKQMINQRKL

SEQ ID NO: 166038 - protein, 105 aa, Triticum aestivum
  Clone ID: PAT_TA_60456.pep
RPGLVLVEAQGKNGRYFRSFTANSLDGNWTPNAASESSPFAGKANSGATWTNDISHGELVRTSNDETFPIDACNLKLLYQGRNPSASAPGYNSWPYRPGLLTLKK

SEQ ID NO: 166039 - protein, 109 aa, Triticum aestivum
  Clone ID: PAT_TA_60457.pep
MSVLRLLYALSISLKVDPVITHDTRNQILRLIDFLMQAFHINFLSLSLSTMLPKMLIISYPATSMLSVSVSYLTVSPQNTLAGQAPFDSGPQVPRLSKDTGTTTSVGIH

SEQ ID NO: 166040 - protein, 272 aa, Triticum aestivum
  Clone ID: PAT_TA_60458.pep
AGRSGNLRPPFSCHCTIATSVHSFSLTMAAPSFDTTPENQAGILHFFRQQLRYKPQAVTGVSLEGKTGIVTGASSGIGLETSRQLLDLGISKLILAVRNLEKGNAAAEDLAKGRNPPLKEGTIEVWKLDLDFYDSITAFAEKAKSLTRLDMVLMNAGLCPAKRVVNEQTKHDEIIQVNYLSTALLTLLLLPVIKATRLNQPGPTRVTFTSSEVAAWSKFKYDNGMNIIKTLDSSEKGSDTLSQMFNSKLLGQFFIAELAKRVPSSLAIINGA

SEQ ID NO: 166041 - protein, 251 aa, Triticum aestivum
  unsure (1)..(251): unsure at all Xaa locations
  Clone ID: PAT_TA_60459.pep
RPGCGLPLSGKDPEGAFPIVLGHEGAGIVESIGEGVTNVKVGDHVVALYTPECKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTXRVWRGCAFGGVKGRSQLNDL

SEQ ID NO: 166042 - protein, 194 aa, Triticum aestivum
  unsure (1)..(194): unsure at all Xaa locations
  Clone ID: PAT_TA_60460.pep
RPVWELNLILLLSHQCLLPLLPELGNHLASLHITIVRATLEPCTFELFSHGIPMMXHNFSQICTWESTTPATTAPGYYXTTLHRVVPMFMGDGHDFLDGYEAGSPCAWGFEAFEDDNFTVIHDQPGLLSMDNAVPNSNESHVFITTVPTSFLYNHDVVFGYVFEGMYVYLKMEATXTGYREKDMPNLDVDISQC

SEQ ID NO: 166043 - protein, 130 aa, Triticum aestivum
  Clone ID: PAT_TA_60461.pep
MPRSDEAEAFFHAVYSAVQEIPHGKVTTYGHIAALVGTPQRPRQVGVCLKHLPADPSQHFNHDNVPWQRVINSKGQISPRSQPGESRSQAQALEAEGVEVETNALGEHSVDFSRYGWFPEVLPSEEDEND

SEQ ID NO: 166044 - protein, 188 aa, Triticum aestivum
  Clone ID: PAT_TA_60462.pep
MSFAGMLNRLHGQPESYDKKAKYKFGRTLGAGTYGVVREADGPTGKVAVKIILKRNVKGNEQMVYDELEMLQKLKHPHIVKFVDWFESRDKFYIVTQLATGGELFDRICEQGKFTEKDAAETIKQVLLAVDFLHKNNIVHRDLKPENLLYLNRDPESDLVLGDFGIAKMLDGKGESLKTMAGSFGYAA

SEQ ID NO: 166045 - protein, 251 aa, Triticum aestivum
  unsure (1)..(251): unsure at all Xaa locations
  Clone ID: PAT_TA_60463.pep
MKLSNPGTVPVYTISGASSARPLPDWLARRRKRSLKDDAEYQNRVELLQDFEFEEASNCIRVSEDGGWIMSTGTYKPQIHVHNLSQLSLSFARHTNALNHSFELLSSDYSKSIHLQTDRRLEFHTPMGCHYEVRLPRYGRALVYDRQSTEALIPSVGLDGDGKGEVFRMNLXXGRFMKSYQXRCXVATTKLTGGGLQGGIGVGSVNTAAIATNTHNLLAFGTSIXNXEFXDPRSKSRVAMLXGIDGEAQHL

SEQ ID NO: 166046 - protein, 126 aa, Triticum aestivum
  Clone ID: PAT_TA_60464.pep
RPGPVSDTMALRVVVPRNSRATAYCAFDGKGRLELRQGDCVTITASQYPFPTVTRTDTEWFDSVSRTLRWNVRAAAQKPFDADVAEDGKDDEEIGWDIDTDSACYASEDGSVSASPVRRQMSLLGL

SEQ ID NO: 166047 - protein, 249 aa, Triticum aestivum
  Clone ID: PAT_TA_60465.pep
RPGRALSPGSYPPLPHSPISRASSRSARTPVQTQERQPWLRRRPSARSTSSWWARASLAAVRRTRRRPGARACSCSSASTCCTSAARRTASPAPPAPPTRGRSTLPWSGFYGTPSMEYPGLIKVCRNGGPPCDPDGRDWATGTGAGGIAEIVARWIDEFMPGVVDTAGGPVLRQPCMCCMTPDEDFVIDFLGGEEFGKDVVIGAGFSGHGFKMGPAVGKILAELALDGESGTAAEAGLELEHYLIGRFE

SEQ ID NO: 166048 - protein, 282 aa, Triticum aestivum
  unsure (1)..(282): unsure at all Xaa locations
  Clone ID: PAT_TA_60466.pep
PAGLGIKEIYNAIPKHCFQRSALKGYGYILRDIVLLATTFSIWYNYVTPEYIPSTPARAGLWAVYTVLQGLFGTGLWVIAHECGHGAFSDSRLINDITGWVLHSSLLVPYFSWQISHRKHHKATGNMERDMVFVPRTREQQATRLGKMTHELAHLTEETPVFTLIMLVLQQLVGWPNYLMTNVTGHNYHERQKEGRGKGKHNGLGGGVNHFDPRSPLYEHSDAKLIVLSDIGIGLMGTALYFLVQKFGFXHMXIWYFVPYLXVXHWLVAITFXQXHDPTFPT

SEQ ID NO: 166049 - protein, 250 aa, Triticum aestivum
  Clone ID: PAT_TA_60467.pep
MANIIKSALPTHLKPNTGDEQGNERRHGKTRSHMAFENTSTNVAAAQMRNALTNLAETVKDPEQKKLFETEMDNFFALFRRYLNDKAKGNAVDWDRIAPPAQGQVVDYDDLANTESVQFLNKLAVLKLNGGLGTSMGCVGPKSVIEVRDGMSFLDLSVRQIEYLNRTYDVNVPFILMNSFNTNDDTAAIIKKYEGHNVDILTFNQSRYPRVYKDSLLPVPKDNDSPINEWYPLGHGDVFESLYNSGILDK

SEQ ID NO: 166050 - protein, 109 aa, Triticum aestivum
  Clone ID: PAT_TA_60468.pep
SNNLAYLILPNKCQSPSILHPPSSSSSPTDSMKKHSRNRGPNMKARRPSGCLSCRFYYEPSICSRACMLPGAMDHACYTVVPVEGTHRSVPALAHYLAPLRVPIGPQCR

SEQ ID NO: 166051 - protein, 241 aa, Triticum aestivum
  unsure (1)..(241): unsure at all Xaa locations
  Clone ID: PAT_TA_60469.pep
PAGLVRWKFGDILLADVLTSYAKVFGDLFITLCMFFTAQGSSTQRPDRNCGGTVLVPFIMGVPSLIRFRQCLIEYFRVRRAPYKESTGWGGQHLANALKYSTAFPVLITSAWQRSVEDPESKAALHKAWLVAVVINSAYSFYWDVAKDWDMTLFSSRQDRESPTHFFGLRDRLVFRTPNLYYLVIAMDLMLRSTWSMKLSSRLDKFSDLEGGIFPIEFLEVFXRRWVWIFXRVEXEWLRNN

SEQ ID NO: 166052 - protein, 279 aa, Triticum aestivum
  Clone ID: PAT_TA_60470.pep
MSQPDPKRVKTDDEAPYELIYWPTIPGRGEFVRLVFEEAGVPYKDIAQNQEEGFKAVKELTATDNIGDDHNPPALAPPALRHGDLLICQTTNILLYVAPKVGLAPKEGNGLYHLNQIALTIMDGLVNELHDTHHPIDISAYYDDQKEEAKKRSSFFTKERIPKYFKYMQRLLDAKTSGEGPWLYGDSLTYADLVLFQAVDGTKFAFPKSVEKLEKSGEYDGVFKIYEAVKERPNISKYLQSDRRYAYSDGIYRYYPELQEERRDFLKQHYSSYMRDPQG

SEQ ID NO: 166053 - protein, 139 aa, Triticum aestivum
  Clone ID: PAT_TA_60471.pep
MARRSGGGRSSRPAPRAAPVRNPPAPARPAPPPATTQSSGGGIMSGIGSTIAQGMAFGTGSAMAHRAVDAVMGPRTIQHETVVGEAAASMTPMDNAADDKCGNPSKAFQDCINHYGSDISKCQFYLDMLNECRRGGATL

SEQ ID NO: 166054 - protein, 93 aa, Triticum aestivum
  Clone ID: PAT_TA_60472.pep
GPFRALGLSGCFLQCARRELVCFRNIALATTRMMQARVVALNRRTVVVYLGPLEHPVLLGNGTFHNQVLLFELILDHVVLLRVIERELALSWW

SEQ ID NO: 166055 - protein, 81 aa, Triticum aestivum
  Clone ID: PAT_TA_60473.pep
FRRQYAIEILGVHVVAVQSLIGVDREVDTVRVDVLDDNVAHIVGVSLEVDVNVGDSRRGAHRGRSRRRRRSCGPHLLHISQ

SEQ ID NO: 166056 - protein, 60 aa, Triticum aestivum
  Clone ID: PAT_TA_60474.pep
PGGYPKVIVKLTVSFAALAAAAFHPCGWPNRLLCRRLYYAQKWRRPQRYRRLPKLPCDIP

SEQ ID NO: 166057 - protein, 136 aa, Triticum aestivum
  Clone ID: PAT_TA_60475.pep
AQHSRQCNACIISGSVVGRRVSIQEIILGEVAEFIIVELVGEVAAPVGVLDVPHVVTVPLEARQPLIRAQVSPLACVLSLAEPVHHQQSKQSADAAEKAANRPRTSKIAVMSGHATREKAIPAKRCHYCDLLENGR

SEQ ID NO: 166058 - protein, 36 aa, Triticum aestivum
  Clone ID: PAT_TA_60476.pep
MLRRFPPPCSGTCSPSSSRAAPCSPTTASRPAASAT

SEQ ID NO: 166059 - protein, 239 aa, Triticum aestivum
  unsure (1)..(239): unsure at all Xaa locations
  Clone ID: PAT_TA_60477.pep
MEKLSMAATMFCAMVLAALAAAAGGEAAVVEHTFVVHEMNQKHLCNTTKIYVVNGQLPGPTIDITDGDTVVVHVVNRLPHGLTIHWHGVRQMRSCWSDGAGFVTECPIPPGGEHMYRFNVTGQVGTLWWHAHVTCLRATVAGAFIVRPKGGRYPFPTPAKDVPIIIGEWWELDLVELDRRMHDGNFDDNPLSATINGKLGDLSNCSGKPEESFVLDVVRXDTYLLRIVNTRSSRILLQV

SEQ ID NO: 166060 - protein, 214 aa, Triticum aestivum
  unsure (1)..(214): unsure at all Xaa locations
  Clone ID: PAT_TA_60478.pep
MMGYFEYLHLLVTPITGTLGRCIDSIHERDDANATSALKARQATATMERNHMVYFYSXXSDEAAYAPYRXGEARHYHSDWYFTVNICAGKTRQPLCTARIIDYGGSFFHLGXGYLVHNLWTRXPLLEYYCVKQSTFRYXPERQCQQLSTDYSCVDCYDLYMSTRXPLPSIDVDNNFNHHCAIRRYKRNRDSVHLQNHFNACRSAVMNLRNHYYQ

SEQ ID NO: 166061 - protein, 81 aa, Triticum aestivum
  Clone ID: PAT_TA_60479.pep
PAGSVEEKDAEDRRWGLIPSIKGASRGGVCHSKHVKFEGNACRQRYDRHKYTTFAYLVRRCQRYHAPRVLGIGVIVRSASA

SEQ ID NO: 166062 - protein, 100 aa, Triticum aestivum
  unsure (1)..(100): unsure at all Xaa locations
  Clone ID: PAT_TA_60480.pep
MYAALSTAQWVVGKALAPVADGVLGAWAAARNFGPTVEALSTELLLVKATLEQAALKELSGPAMEMLLQKLXDLAHSAEDLLDELDYFRIHDELHSTYDA

SEQ ID NO: 166063 - protein, 60 aa, Triticum aestivum
  Clone ID: PAT_TA_60481.pep
MNQQRTRPIQKLAKAVSQCSVEATSYGKCIVADYNAVHKDKCVKEFMRLKDCYLAASKKS

SEQ ID NO: 166064 - protein, 89 aa, Triticum aestivum
  Clone ID: PAT_TA_60482.pep
PAGFRSYYFREYSWNRIISLTESRNRNYRGGCPTTMYTRAQQRMPVSSRKGLLSIDLVISVCHKLFQKRVYVIRIASFTDSKKKKKKAP

SEQ ID NO: 166065 - protein, 140 aa, Triticum aestivum
  Clone ID: PAT_TA_60483.pep
MLRTDLQVVNVKFVANFACYASTRAQAVGWPPVRSYRRNAMTVQSVKIKKEEETEKQQPAAAAAAGANGSNFVKVSMDGAPYLRKVDLKMYNTYKDLSIALQKMFSTFTATGKIRHRRHQNIKLELEQMYKSRRSHSSRQ

SEQ ID NO: 166066 - protein, 279 aa, Triticum aestivum
  unsure (1)..(279): unsure at all Xaa locations
  Clone ID: PAT_TA_60484.pep
MGSRMTPEAIKPVMLIDGQLVGASDGNSFPLFNPATGEKVADVPEATEDDTNRAVAAAQRAFPEWSAMDPAKRGSYLKKLASLIKEHNEELALLEAKSMGRPLAEFFEGHIAASSYEHYAEAWPHIQGQASLNTPGYVTMTLRQPFGVVAAIIPWNASLLFFASKSAPALITGNTVVVKSSEKAPLGAAKFAELIHKAGFPPGVFNVLSGHGNPSGRDACFPHMDVRAISFTGXXSPTGRAIQEAAAKSNLKKVILELGGXSPVIIFDDADLEQAAQDT

SEQ ID NO: 166067 - protein, 260 aa, Triticum aestivum
  unsure (1)..(260): unsure at all Xaa locations
  Clone ID: PAT_TA_60485.pep
MKSISILSVAFAALVSNVSAAGVTGTPEGFAAEATGGGNAEGAYPKSTDELVSMLGDSTTRVIFLDQEFDFTGTEGTASEQGCAPWGTGAGCQQAINKDGWCNNYQADAPKVDVTYDKAGLNPIVVNSDKSIVGIGANGVIKGKGLYIKGAKNIIIQNIHITELNPQYVWGGDAIQVDGSDLVWIDHVTTSNIGRQHIVLGTSATNRVSITNNYINGESKWSATCDGHQYWXWYFTGSSDMVTLKNNYIFKTSXXSPQVA

SEQ ID NO: 166068 - protein, 206 aa, Triticum aestivum
  unsure (1)..(206): unsure at all Xaa locations
  Clone ID: PAT_TA_60486.pep
MSSNKPSRKFSTGATSHRKRQMSLMVEKDGHINAPLQTLYLGISAVLADDHTAVIALAIHDTVYLNDFSIKHVSLDEEMRQGQDLIADHIINEVETYEHVNFVKFIGAGLPVTLKYMSPSLCSRLWLDLDIVPVVLRPDHEAKEKNFXDVKRVDEQADSMARKCILNFGPSLVPHLQVGHRGIVQTDAXXFRVHXHNXQNPQDTCS

SEQ ID NO: 166069 - protein, 107 aa, Triticum aestivum
  unsure (1)..(107): unsure at all Xaa locations
  Clone ID: PAT_TA_60487.pep
ASTYIPDEGSIGYSRLNTSESDPAAVYSLTAAVWPDCSEAAGARPLDLIKVNGPAXPSATCRSQDNTSAITNNMVWDNTTARREQCXQRDRAGPIVDSSETGTSIVT

SEQ ID NO: 166070 - protein, 281 aa, Triticum aestivum
  unsure (1)..(281): unsure at all Xaa locations
  Clone ID: PAT_TA_60488.pep
PAGFGNSQAQFIKMDKMEYVKLGNTGLKISKVILGCMSFGSSKWQGSPWVLDEEDGLKLLKAAYDNGINTWDTADTYSNGESEVIIGKALKKFNIPRQKVVILSKIYNPVMDDGTRPPSVNDGPLVNQMGLSRKHVFHAVDKCLERLGTDYIDVLQIHRLDRETPPEEIMRALHEVVQSGKVRYIGASSMYTWEFARMQYIAESKGWTKFISMQPFYNLLYREEEREMLPFCEXPGVGVIPWSPIARGLLAKPLSSKDDNQSIRSQNDRRLIRGLRIQSRH

SEQ ID NO: 166071 - protein, 232 aa, Triticum aestivum
  unsure (1)..(232): unsure at all Xaa locations
  Clone ID: PAT_TA_60489.pep
MTTPNPFLLAADNNPTLLPLLRERPELASSQDEHGYSLVHAAASYNHLDLLRTLIREFNVDVNLKDEDNETALFVVETQDAAQVLVEELGADIGHRGLEGLTAREKIEAEGDFPVIAEYLLKIEAKQADDPASTAAAVMPEVIPPPPEGMKVTVGTMDEAADIPEEIDQEFRRRIEELAQRDDFDSPQGQAELRRLIEDAVXXRRVVSATNATYDRSRIKRRILCLDLHMRY

SEQ ID NO: 166072 - protein, 242 aa, Triticum aestivum
  Clone ID: PAT_TA_60490.pep
MYSWIPLLATFAPQALASCAYGTHLHRRADAIQAPKFGYSAANGPANWYNLDPEANKLCATGTHQSPINLSNGTHKVLSGSDLQIEIPDFHDGAEFENLGSTVEVVTEGMGGKLTLDNTVYHLKQFHFHLPSEHLDNGTSMAMEMHMVHQSEDKKLAVIGVYIDLDDGLPNATYKAKAAAREATGKDCKTTQAQRSTVATTVLNSVDKIATLQTTHTKPLKMSEIVSLLEAGEFQSYSGSLT

SEQ ID NO: 166073 - protein, 218 aa, Triticum aestivum
  Clone ID: PAT_TA_60491.pep
MASSDPVVIPGEVRLILAEVSTDASTFVLQPTPSSDPNEPLNWSSWRKCLNFGFTIAVTVAAFTNLSIQTVFWQQMTVDMGVTITQLTYSSSAQLAGLALGCLFFIPFTIKYGRRPTYVVSCVVLAGVTWWSARMESYAELIITQIITGLAGAINETAVQMTIADLFFVHRRGSANAIYFTAVMVGAFLCPMAAGTQAAHEGWRWSYYSLAICLSILS

SEQ ID NO: 166074 - protein, 216 aa, Triticum aestivum
  Clone ID: PAT_TA_60492.pep
AGRFWFVGEISSSISKTVDQGFGTTFDAHVIAGYRFLMRYYEPGAKIYVFGFSRGAFTAKFLARMLNKVGLLCKGNEELVPFAFRLYQRHLQGEIKDSETAHDETREASNEIDAFSQTFCRKETNSDGEEENIKVFFLGIWDCVASVAVLERKARMPVPVTGTAHHVRHAVAVDERRVKFKPALLAQDIRAAVHNHKPAAEETSKKSGSLVTTAMS

SEQ ID NO: 166075 - protein, 224 aa, Triticum aestivum
  Clone ID: PAT_TA_60493.pep
METVHGICSPQFQGVRDLLENYIKSNEELGASLTINVNDEVVVDIWGGHKDQERKEPWEENTIVNVFSSTKTVTSLAVLILVDRGMIDVNERVSKYWPEFGQNGKEDVLVRHLLSYASGVSGWEEPLSTEDMYDLDKSTPMLARQAPWWTPGTASGYHALTYGHLLGELIRRVSGKSLREFVATEIAGPLDADFQIGASENTWDRVTPIVPPEASGITADFDVK

SEQ ID NO: 166076 - protein, 173 aa, Triticum aestivum
  unsure (1)..(173): unsure at all Xaa locations
  Clone ID: PAT_TA_60494.pep
YHGALLASSISCWLDRGGEVCCAQLDDGQFAYQGFTRAKLTLRSARRPTCXGAVLAVTNFTNETKANAFHPCPVRFITGARNSAAPRSFSTSFVVAIVSGXQGLRDHRICFVGSPTTDFTXAAPGMTMPLLKSTNGTGTATIMAXQLHTILSPEFRDIDMKRDGIYDNNLRLA

SEQ ID NO: 166077 - protein, 240 aa, Triticum aestivum
  unsure (1)..(240): unsure at all Xaa locations
  Clone ID: PAT_TA_60495.pep
MTKTLTPPEVPNVVLSYPESHILLVRLNRPEHLNAMQRQMSFDLDHLWKWYDNEPSLRCAVITGTGRAFCAGADLKEWNVKNSESSTTNLDKWADNGFGGLSNRRGKKPVIAAVNGLCLGGGMEMILNLDMVIASETAKFGLPEVKRGVVAIAGALPRLIRTVGRQRASEIALLGRMYTAEQFLSWGVVNKVVKXEEVVSEALRWAVEMSNNSPDSVIVSREXLLGWVGSRRAQGQHQQD

SEQ ID NO: 166078 - protein, 72 aa, Triticum aestivum
  Clone ID: PAT_TA_60496.pep
VKVVNRSLRLSLSGGFHDINSLEGVNASRRSSGSFGVAAGSGNRNGLVHDPFTNAEISSIQPVFRNRRLSAA

SEQ ID NO: 166079 - protein, 210 aa, Triticum aestivum
  Clone ID: PAT_TA_60497.pep
YIVTMAAAEQPQVENRPPPSRMRVALVVLFHSSCAIWSTILSKSALNGVEAPVTLLALQTTIQVLLLTVIGLATGWIKLYRPLNAWIALLPLTVARLIGILAKTYCLASVNASVYQIARGLLLPFTLFLSLLVLRPRPYYPPISLVGCAMVMAGFGTGMMADYSQMLTSGKGVLLGVGSSFTTAVESVVVKRFLGKSRRVCGRWFGCLTA

SEQ ID NO: 166080 - protein, 245 aa, Triticum aestivum
  unsure (1)..(245): unsure at all Xaa locations
  Clone ID: PAT_TA_60498.pep
MQSADRDHFFETDAVQAQRQRRAAKADNKNGEPIVMKSKVLAVVPDPAYPLTSVFIAESAGAVRRINLETSELKTTYRGPKAPVTCVSIGGKDNQTVFAGSWDKDIWSWDVETGKSGRKFSGHLDFIKTVVCATISGKHILISGGADKKIFVWDVESGKRLHTLQDPTTTMLAVQHIAIDPVLSDSTKLVFASASSDPHIXRRWKITLDSYEQLPESFSVRPDAERLTIEEHETSIYRLGYDQSS

SEQ ID NO: 166081 - protein, 150 aa, Triticum aestivum
  Clone ID: PAT_TA_60499.pep
RARSDSKHEAKDDVSMSRARTGGWCALMAGVTYIGYSRVCASIGRSCRLEPYMSEDAECEKVRYSLVQVERRKSGPCPASASMIDERSGDMVTESFLRTISKATVIPAGHSTYNSISDKFMFHAHEYVIYVTLDVFRHHYIVAINRSVST

SEQ ID NO: 166082 - protein, 100 aa, Triticum aestivum
  Clone ID: PAT_TA_60500.pep
CLRTAQLVFIALVFANYRGWCSRCCHSSGSYRREGGGPSEGRTPYGCCSGCRVMSIIGVALATRDKARLVWGDSFPVLFLELAVVNGSGRLHRKVYRLLA

SEQ ID NO: 166083 - protein, 284 aa, Triticum aestivum
  Clone ID: PAT_TA_60501.pep
AGRVGLLGWSDSPKGLLLVYQLVPEGSLDRHIHTSCLTWAQRYKIIIGLGSALRYLHMEWDQCVLHGDIKPSNILLDSSCNKKLGDFGLARLVDHGAGPRTTQVVMGTAGYIDPEFIRTRRPTTESDIYSFGMVLLEVVSSRRPDMDIDTEQPAAAVDKVAIPLLKWVWDLYEKSAIVEAVDRRLKGDEQLSDGHDGKWQVHRALVVGLWCTHPDPSVWPSVVQFMNVLQLKEVTLPILSRPGPSFYIFHGSHGYNASSSSSATFAAMYLAAVADEQTYFTGPV

SEQ ID NO: 166084 - protein, 245 aa, Triticum aestivum
  Clone ID: PAT_TA_60502.pep
MASPPHIGSLSRLPANLRGSIESVKRGGHNVSWPLLNLDLLRNVLLFLFFWRWSRRAFWQLRGRGIIGSVVELYTNIRRILYGYFLRAPGVRGKVQQQVNESLVKLSDKLVPKDQIRYLTLPKEGFSHDVVRSELENLANMDHTRWEDGYVSGAVYHGEDELLALQTEAYGKFTVANPIHPDVFPGVRKMEAEVVSMVLSMFHAPPGAAGTSTSGRTDSILMACLAARQKAYAERGVTEPEMILP

SEQ ID NO: 166085 - protein, 252 aa, Triticum aestivum
  Clone ID: PAT_TA_60503.pep
MGAQSSKPTLHEKAVLDRLHSLQLQDDDEYVEISSDSEKAPLGPLVRDAQGLSVHVLESWQASILKDPKNKLALTALSSTNPRQVLTSLPTQIADQQVFNVKIPFEGDPITNQRSSGRCWLFASTNVFRVALMKRYNLESFELSQQYLFYWDKLEKSNWFLEQVIDTAGEDLEGQLVQNLLGDIVSDGGQWDMVYNLVEKYGLVPQTLYPDTWNAQSSGILNNVIKTKLREFALKLRGLINSPNGVSATALS

SEQ ID NO: 166086 - protein, 151 aa, Triticum aestivum
  Clone ID: PAT_TA_60504.pep
YGALALLCLMSHARMEELRSYKPTRRGLDFKQLNQDFPDERYELFLNNLTVEVFVLAQMAFLPGGKTGPIRMSPWLIEYPEEFLKHVELVAHPDARSGKWERLLRNGDERVNLIAAIIFKIFDQKIFSPLLFGAESKHMETLKNLIPSSSM

SEQ ID NO: 166087 - protein, 282 aa, Triticum aestivum
  unsure (1)..(282): unsure at all Xaa locations
  Clone ID: PAT_TA_60505.pep
PAGSGKKFILISQNHFHFKIMTVDVKKIANLKSVSLAGLLAGQADAIDDLVSSCKTYGFFYLDFQDPSTSGILKLVEQLSVIGKTVFKLPLEEKEEYSTEKYLPSRLLGYKRAGCSVGPFSGKKDGYESFSIHNNGIFGEDAMIVPEEIDQNLALFKIFMGEVHGYTDCILSILSEALQLPYDLKDCHRKDKPSSANMAMLNYLPWGSSDERIGNMAHTDMGTLTVVFSKSDGLQAMLPGCDDWSFIPPKEGHAVVNVGDSLRFLSSGMLASSXHRVVHQIS

SEQ ID NO: 166088 - protein, 257 aa, Triticum aestivum
  unsure (1)..(257): unsure at all Xaa locations
  Clone ID: PAT_TA_60506.pep
AGRVGKLPSFGGGTGSGFGALLLERLSTEYGKKSKLEFAVYPAPRTSTAVVEPYIAVLSTHSTIENSDCTFLVDNEAVYDICRRNLDIPRPSYEHLNRLIAQVVSSITSSLRFDGALNVDLNEFQTNLVPYPRIHYPLISYAPVISANKSEHESFKVQELTFQCFEPNNQMVVCDPRNGKYMAVALLYRGDCVPRDCNAAIASLKAKASFNLVEWCPTGFKLGNHYQKXMAXPAPAXAXGLAPRQRSVSMLSNTTAI

SEQ ID NO: 166089 - protein, 206 aa, Triticum aestivum
  unsure (1)..(206): unsure at all Xaa locations
  Clone ID: PAT_TA_60507.pep
MPSLRTIVLATAASAVTLVNADYVIDPDSVPLSLRKVWCQNEVETCPMICGQTSKGDTKVNECDPKSLTYGCICGDGKQPNMSEYSLTLPFYVCQEWGNQCVGDCAGSASCASDCRQNNPCGAQDPKKYNTTSTATGTGAGSVKATASATDDANTVYTDTPGSDSDDNDSDSPASTKSNGASVIEVGRTWGLTIVLGTMXAGFAML

SEQ ID NO: 166090 - protein, 124 aa, Triticum aestivum
  unsure (1)..(124): unsure at all Xaa locations
  Clone ID: PAT_TA_60508.pep
TFSGKNITLQVWSADNYRNVDVPMQENEGIPHQQHRHIFGRNQLEDVRTLLDYXIHKEPTLHLELHLHGPLQILDSTLICHSICLYGEPSYPIEHXTETSQTREGISPHCQRLMLSCEAAMMMD

SEQ ID NO: 166091 - protein, 89 aa, Triticum aestivum
  Clone ID: PAT_TA_60509.pep
SSCYWTPGEAACDTANLNLVCAHSILPQLLEAGYPSTTPPICFSDPYHINCLSLSVAICLMFCYHLISSSLSDTYRVLDVILYRKDMIC

SEQ ID NO: 166092 - protein, 119 aa, Triticum aestivum
  unsure (1)..(119): unsure at all Xaa locations
  Clone ID: PAT_TA_60510.pep
SRGSSRRCFGFGVHLLLDEAKEAPPAARTTTNSSLILSSGAGGLHVLPALRAVERRRRRFGLVHAPQLLLVGVLEHVGLHKVSSHHGRHISFSNKFFLRCLLLPXLLWDLRGRVPEPGR

SEQ ID NO: 166093 - protein, 166 aa, Triticum aestivum
  unsure (1)..(166): unsure at all Xaa locations
  Clone ID: PAT_TA_60511.pep
MFKRSFRSQDPGRVDKSARHKRSGSHRDQTKMSKLQRSLNEQDSIPQKSAPIPPPAPAPAPSPIVTLTVGRDGRLFAAHEEVLRQSPFFEAACRGNNFEKQSKRISLPDEEPEVFSAVLEYLYKGDYYPRLLXNKQRNSWGLXGQARTPHTSPNPEKRRWPRRQPV

SEQ ID NO: 166094 - protein, 238 aa, Triticum aestivum
  Clone ID: PAT_TA_60512.pep
MTAQIEQAHEPLAADTFDDVDSDSTFSGSDLESLESLRSSVLQYQVENGRTYHAMSSGKYNFPNDESESDRLDLQHNLWLLTLHGELGLSPKIKGSAKRVLDAGTGTGLWAIEYADAHPETKVIGVDLSPIQPNMVPPNCIFEIDDLEKEWTWTEPFDLIFARTMTGSFADTEKFIKNSFENLEPGGYLEMQDLTYPIACDDDTLLPDSALVRSGKLSIEASAAGRIDLAPQYKDFFE

SEQ ID NO: 166095 - protein, 158 aa, Triticum aestivum
  unsure (1)..(158): unsure at all Xaa locations
  Clone ID: PAT_TA_60513.pep
GTPQAVSSPCGKSEDNDWLPVTKLLRLXEDLQIHRMQXIYLHSLHIREDHIRNDFRPKFNDDCLKXMPVQKQIRAELRTLFTDIVTHRRLLTSHPPLNTNSSAXVAAAIRVTIIIFNVIHLPGLRAYSGTCLVVYRSLTTYLTGPCLTNAVRIHPLPT

SEQ ID NO: 166096 - protein, 213 aa, Triticum aestivum
  unsure (1)..(213): unsure at all Xaa locations
  Clone ID: PAT_TA_60514.pep
MAPKKAANNSSKSNEDDGFTAGKIYSISGPVVIAEDMIGVAMYELVRVGHDNLVGEVIRINGDQASIQVYEETSGVMVGDPVYRTGKPLSVELGPGLLNGIYDGIQRPLEAISKMAKSIYIPRGIAVPALDRDKKWEFTPSVKVGDHLSGGEVXGSVFENSFLANHKILFPPRARGTVTKIASKGEYTVVEXILEVXVDGKKDEYPMMQSWPV

SEQ ID NO: 166097 - protein, 213 aa, Triticum aestivum
  unsure (1)..(213): unsure at all Xaa locations
  Clone ID: PAT_TA_60515.pep
MSPSAVEGNGVVDVKTTLKPNVGVYTNPNHDLWVAPAEPSAEAVKSGSDLKQGEVSVAIRSTGICGSDVHFWHAGCIGPMIVEGDHILGHESAGEVIAVHPSVSHLKVGDRVAVEPNIPCGTCEPCLTGRYNGCETVQFLSTPPVPGMLRRYINHPAVWCHKIGNMSYENGALLEPLSVALAGMQRAEVRLGDPVLICGAGPIGLITLQXCAA

SEQ ID NO: 166098 - protein, 101 aa, Triticum aestivum; identical to SEQ ID NO: 141162
  Clone ID: PAT_TA_60516.pep

SEQ ID NO: 166099 - protein, 129 aa, Triticum aestivum
  unsure (1)..(129): unsure at all Xaa locations
  Clone ID: PAT_TA_60517.pep
LKDLQRHPPISXTSALLAEDMVHCPATLLGPSAKQYADGVYVTTIHFPPDYPSNPPQAAFKTRVFLPHINXNGTICLDIFQDESHPVLTDPYMLLSIXSLLKDPNPDHPLYPYIAAHEKKIYLQTMSPT

SEQ ID NO: 166100 - protein, 196 aa, Triticum aestivum
  Clone ID: PAT_TA_60518.pep
MAAVQLQAAPRKVGVFQNLIASQTETLVLKEKVMSLTGDSFDIKLANGQPILKVEGKVMSISGRKKVFDMQGNHLFSIVKEHLHIHATYAVEDAQGAKIMEVKNSFKLMGSKATATFTSSDGTAEILEMKGNWFDYAADIFGKSANTVVARIDRKILSGRDMIFGQQTYALMVAPGVDMALMAALCICMDEKNNEK

SEQ ID NO: 166101 - protein, 242 aa, Triticum aestivum
  Clone ID: PAT_TA_60519.pep
MFSTYSYRCRSFTFKLHPVTPKPIFKMSSMGKMIRRKKNVKKGIQFCLMVCGASGTGRTTFVNTLCGKSVLEHKESDDASGAHVEDGVKIKPITVELELDEEGTRISLTIVDTPGFGDQIDNEASFSEIVGYLERQYDDILAEESRIKRNPRFRDNRVHAMLYFITPTGHGLRELDIELMKRLAPRVNVIPVIGRADSLTPAELAESKKLVMEDIEHYRIPVYNFPYDIEEDDEDTVEETLS

SEQ ID NO: 166102 - protein, 257 aa, Triticum aestivum
  unsure (1)..(257): unsure at all Xaa locations
  Clone ID: PAT_TA_60520.pep
MKSLLSLALLPLALIARTSAAPNCRCMPSDACWPSNNAWASLNKTVDGTLIKTVPIGSPCHDPTYDADACAALRSAWMLPQTHIESSSSVMQQFFANQSCDPFLAQSRPCLIGNYPSYAVKVSNARQVAAAVRFANDNNIRLVIRNTAHDYFGRSTGAASLAIWTHHLKTKEVIEWADNLYCGPAFKLGAGIQGAEAVEFANANGLTGVPGECPTVGLAGFTLGGGHSPLSTSFGLGAXNTLEFEVVTAAGRIVRAS

SEQ ID NO: 166103 - protein, 194 aa, Triticum aestivum
  Clone ID: PAT_TA_60521.pep
MGAHPSEYAGEDPCRRRRKLRGCDPIPPTPHAPKPVTGPVVEVEVEAPSSYATAGKLLFVAAGAFAGVLLALVALHLYNSGRRQRARGRRSLPISGEAPSPRGLDPLDPAVLRALPVVAAAAGAGDCAVCLAEFERGEEARALPRCGHRFHVECIDAWFRGNSTCPLCRAAVEAPDDAEARPEVRVDVAAADAA

SEQ ID NO: 166104 - protein, 205 aa, Triticum aestivum
  Clone ID: PAT_TA_60522.pep
MSRQIASQASRVASQAIRSSTPVCRSSFRVATMAYASRLAICPNLSQRNFSTTVSRRKGIMPDTDDPAKPLTETEQVEPTAAVADITEQEYHEIADEYLDNVVNRFEELQDQREDVDVEFSAGVLTIDWPGKGTYVINKQPPNKQIWLASPISGPKRYDWCLLGEGQDQKEGTAMGDWIYSRDGSSLNQVFLEELGVDIAIPSEE

SEQ ID NO: 166105 - protein, 131 aa, Triticum aestivum
  Clone ID: PAT_TA_60523.pep
TWQPSKHLLNLEQLGIFYPPHVYIGHHTAFTPHWPFTSLPFASPHSRTLAHETPYGPQYLGLQLLVTTFDMQTTPYDCLPESWHPPRGSMIMTAESYRSSMIIMPGSIIVTSMRFSGRPSRNDDRLVQPGR

SEQ ID NO: 166106 - protein, 248 aa, Triticum aestivum
  Clone ID: PAT_TA_60524.pep
MRSLMSSFPRRLGRPRSTPSTSYLCKVAVTGLAILTTFPSPSVSHPSLFPRNNFAMASSDLAQLIPPDSWDSHMHIVDVENYALDPSAIYRPSSHTLEQALNFETSVGLRNIVLVQPSIYGLNNSCLLDGLRDLGSERGRGVVAIDPKAFDADELRKWHELGVRGVRLNLQSVGAELDAAELEQQLTLYADAVRPLGWVVQVYVPMKMIELLEPIIPKLNIKFCIDHLGQPPLKANRVLRCMTCSSHL

SEQ ID NO: 166107 - protein, 158 aa, Triticum aestivum
  Clone ID: PAT_TA_60525.pep
PAGSGEALITSAEKEGAKILLDGRGWKPEGFPDGNWVGPTVIAGVTPEMECYREEIFGPVLLCMEADTLQSGINNGAKASLFQQEIDAGQVGINVPIPVPLPMFSFTGNKRSVAGTGLANFYGKDGLRFYTQWKTVTSLWKADDASTGEKLTSMPTSS

SEQ ID NO: 166108 - protein, 177 aa, Triticum aestivum
  Clone ID: PAT_TA_60526.pep
MVTTGPLFPPDLIGADVVSSFPQGYTIRPLERGDYAKGFLDCLSVLSDVGNVSQDQFEERFDWMKIQGQGVHFHVVIEHENRVVGTGAIIVERKFIHNLGLIGHIEEIAIGKDFQGKGLGLKLLASPSSIAKNVGCYKTTLGTSPDNEPFYVKCGYNKSGNIMNQYFEEPKEPYYRG

SEQ ID NO: 166109 - protein, 60 aa, Triticum aestivum
  Clone ID: PAT_TA_60527.pep
CACAAQLRWLSILEAAMSVLRLPMCLAGITSVRVNLGSGSSVGESNERGHRNSEVLVVIH

SEQ ID NO: 166110 - protein, 253 aa, Triticum aestivum
  Clone ID: PAT_TA_60528.pep
MAPTGDAMGETVAAAGLHAEMVDEKRASVAAERRSSVVTDPQAPAAAVSSGGVTADGQFPTPEEMQSLRRIANKIPMKLFSIAFIELCERFSYYGCTVVFTNFIQQPLPPGSTTGADDEQPGALGMGQRASTGITTFNQFWQYLMPLLGAYLADQYWGRYKTISYALVVDIIGHLILIVSAVPGVIQSDGALGAMIVGIIVIGFGTGGFKPNVNPLIVEQLGEQYMHVKTLKSGERVIIDPAVTIERGYMWFY

SEQ ID NO: 166111 - protein, 171 aa, Triticum aestivum
  Clone ID: PAT_TA_60529.pep
MADNTKFVLFFLLLSGSSPCFGTEQDIGCLKSVQGSLADPGGVLRSWDFENDTDGYICRFTGVECWHPDQNRVLGLRLGNLGLEGPFPPGLQLCSFMTALDMSGNNFSGPLPEHIFEQMAYITYLDLSNNSFSGVLPAGIGNMMYLSTPRLQHNQFAGGNSAQLSTLRSSF

SEQ ID NO: 166112 - protein, 65 aa, Triticum aestivum
  Clone ID: PAT_TA_60530.pep
MGDGKKSSPGFWSVVASWFACFRRPPKVKAASTGGRTTTYEEYDPAGGMVAAARHFSSAHKINFG

SEQ ID NO: 166113 - protein, 248 aa, Triticum aestivum
  Clone ID: PAT_TA_60531.pep
MFNWAKQQLANVAGTQEPIYGPSAIKSVAIEAEKTPYTEVTRDGLKWKAMDSTSVETESFYITADNGYIALAQVIYSNVAGIRTTCQFNCKVFDKDPTKPHLWASTPLNNQDFNEDKTSFYADDCAVELSEDGTYYTIKSMNSQDAIVNLKITRSTPGFQAGTTGTTLYGTDHNNPWGSIRHAFWPRCVSEGTITTKEGPIDLKGKALFVYALQGMKPHHAAGRWNFVNFPGPTYSAIMMELPAPIIR

SEQ ID NO: 166114 - protein, 192 aa, Triticum aestivum
  unsure (1)..(192): unsure at all Xaa locations
  Clone ID: PAT_TA_60532.pep
MASIVVIGLVLLLDILAFVLAIGAERRRSTAQLGEAEPGGRRYCVYDTDASTWYGVSALALLLVGQAVAMAASRCFCCGRALSPGRWRFFSGLFFVLCWLTFVIAEVCLLAGPVRNAYHTKYVSGYYNEGALPCAMLRRGVFAAXAXFAFLTXLFVMLHYVFYSRXAPHHQRRRHRHDPHLIPCAMIVERCL

SEQ ID NO: 166115 - protein, 105 aa, Triticum aestivum
  Clone ID: PAT_TA_60533.pep
KHLVSIEVLPLGSRSIMDCQERGTVSGAGGAAQASAVVDDWFFTSLTASIATFAVRLWIRVSEILRHYHKQRSHRSRYSGFLIVILHGEREHDVGSLQCNGVNHG

SEQ ID NO: 166116 - protein, 204 aa, Triticum aestivum
  Clone ID: PAT_TA_60534.pep
AALRRRVGVYTSSRFSTLSSRNNFFTMRSAIIIAIGATLASASSPVEKRDAKECASLAQDFLPKLTDIPTPEGSLVSFIASKTELATFTNSCEFPHVTGTMAKEYSSYVDKLSSWYKDQVSDVSKLMAACSDVPEVKTELDKLKTNGALCSELSWAKETGSASSSDGDKDDDSKKKDEGNAAGLNTIAAGFVVAVAGIAGVMML

SEQ ID NO: 166117 - protein, 48 aa, Triticum aestivum
  Clone ID: PAT_TA_60535.pep
MAPAAKKQKINGSLARQCLADLEEKGIIKPVVTHSKMKIYTRAVGGTD

SEQ ID NO: 166118 - protein, 267 aa, Triticum aestivum
  Clone ID: PAT_TA_60536.pep
RPGRACRPSCHPDDVNCPPCTYLTTRLCICGKTTFHNKPCHLQQVHCSKVCGQKLSCGLHTCKKLCHRSGECGDALAGCEQLCGKAKPLCGHSCQSVCHGQTACNESTACQVKMTVKCPCGNHKKEFKCLASTSNPTPNRPEVRCDEECERLDRNRRLAAALNIDPATHTNDHVPFSDDTMKLHKQFSKWGDEQESQYRVFAANKDEVRLRYEPMKNVSRQFLHLLAEDFGFESKSEGHDIHRSVLVWKTDKFVSAPPKTLSQWCKD

SEQ ID NO: 166119 - protein, 252 aa, Triticum aestivum
  unsure (1)..(252): unsure at all Xaa locations
  Clone ID: PAT_TA_60537.pep
MEDYLFRHYVDQCRVVKEETSYVEIFNYSDPFYNVCEEHPLPDDEFHNFVNQTGAFAPPGNLRPDTKLLSGVRLIVQKNAKHPDTFLTKVISLPAEKYGTMVRAMKLPHRGIETNSVVGPFFWCAHDQDDDDPHLQIIHRKSDVLKKGKTRGWEMLLSHSFKTGITTGFIKGTPSSEIEKSLNHLKACTDQIGHPILLPLIILTYDLSPXNDXEQRXARHWLXXRLEXAVSLRNGVEEQEQYFQNGFIDIDG

SEQ ID NO: 166120 - protein, 135 aa, Triticum aestivum
  Clone ID: PAT_TA_60538.pep
MTGPVKLIGAFGSPFVHRAEVALRLKGVAYELITEDLSNKSELLLRHNPVQHRVPVLLHGDKAICESLVILEYIDEAFDGPPLLPTDPSERAKARFWAKFFADKCLMSVWLALWTEGETQKVLMKDVGQTKVCKP

SEQ ID NO: 166121 - protein, 202 aa, Triticum aestivum
  Clone ID: PAT_TA_60539.pep
MAFLILVIGDLHIPDRALDIPAKFKKLLSPGKISQTLCLGNLTDKHTYEYLRSVSPDLKIVKGRYDVEATSLPLTQVVTHGSLRIGFLEGFTLVSNEPDLLLAEANKLDVDVLCWGGTHRFDAFEYMDKFFVNPGSATGAFMEGFSQEADEPTPSFCLMDVQGISLTLYVYQLRKDDKGNENVAVEKVTYTKPVEPSGGASS

SEQ ID NO: 166122 - protein, 162 aa, Triticum aestivum
  Clone ID: PAT_TA_60540.pep
MAAFVKHALTRRDENEDSYQWDSTNSDDNDVYWWYSREGYIVKWTILAVLVLLFTLWIVGGYWHAKKRIQKGLRPLAYHRCFVSRSMMAQVDPRYAYPPNTYYYAPPNGYQGQPGGYPMHNMPPPPVYDPSRPPMYDEAPSGAKIDPSQGQQRREDGPADYY

SEQ ID NO: 166123 - protein, 209 aa, Triticum aestivum
  unsure (1)..(209): unsure at all Xaa locations
  Clone ID: PAT_TA_60541.pep
MDEQWMIGQTSLSLGLNVGGPRRAPPVTRDLVEEDFMSSKKNHEAEALVAELRRVGEENRRLSDMLRALVAKYADLQGKVSGMMAAANNHHQSSTTSEGGSSASATRKRPRSGSLDTTSRNPSPPLAAAGSSGRFDVSVTVGPEQAECTPVHEPCNSKRVRDDEVKASRVSKLYVHADPSDLXLVVKDGYXWRKYGAEVTKDNPCPRAY

SEQ ID NO: 166124 - protein, 65 aa, Triticum aestivum
  Clone ID: PAT_TA_60542.pep
MEIRPMVALRAALVGGVAAFAKIAGAMKAAGGVKVGAAAAAMTAAATAAVSGKDAGNDNQKPGAK

SEQ ID NO: 166125 - protein, 144 aa, Triticum aestivum
  unsure (1)..(144): unsure at all Xaa locations
  Clone ID: PAT_TA_60543.pep
EGAEHNGQDALTGSPRIPRSPTRTACKVEEAYIADLWVYDDINEYLQASNYDPPAXERIKEVMKEPDIDMDGLLHREELEXFIRKLTVESLCWIKLKMIITLITGPAMSLETNREAEVVPGVNKVEHKAPNAIYVDDISMAAVV

SEQ ID NO: 166126 - protein, 241 aa, Triticum aestivum
  unsure (1)..(241): unsure at all Xaa locations
  Clone ID: PAT_TA_60544.pep
MSNDRKQTQDDTDSTKTIIRYLFIFGLPLVVLVIWNKLFSSTKTERTTEANMSSGRIAPLVFPAASQHTATVIFVHGLGDTGHGWASAVENWRRRQKMDEVKFILPHAPQIPISVNMGMRMPGWFDIKQLGGDVDSLIRNEDTEGIKLSQKYFHNLIQQEIDSGIVPERIVLGGFSQGGAMSLLAGLTCTSKLGGILGLSSWLLLSKTFADMVKPTDANRQTPVMXVHGEEDPIAPCERGK

SEQ ID NO: 166127 - protein, 247 aa, Triticum aestivum
  unsure (1)..(247): unsure at all Xaa locations
  Clone ID: PAT_TA_60545.pep
MKLSSGALALGLANLPATLAWGSLGHMTTAYLASHFVANTTEAHFKYILYNDEEDYLAKIASWADSIRYTNWGRFSKNFHFIDAHDRPPHNCDVDYERDCKDDGCVITALHNYTQQSVEPELPFWRRNQAAKFVVHFVGDLHQPLHNEDVEKGGNGLSVIFDGKHFNLHHVWDSSIAEKLLGGLHGDPSKLANKWANQLAVEITDGKYAEAKESWLKDLDFXEAIDTALAWSRETNALVCTHVLPEG

SEQ ID NO: 166128 - protein, 111 aa, Triticum aestivum
  Clone ID: PAT_TA_60546.pep
YHIHIDAACHAPRAHKSLLDVIRPTLGASRSTQGCETCMSVSAYGSTSARTPQLRSTPSIPRTARPCTTLFYTDMSIYDTCSCADTLSDSVPLTIAYTCWQLREMITEDAV

SEQ ID NO: 166129 - protein, 255 aa, Triticum aestivum
  Clone ID: PAT_TA_60547.pep
MPLDAQATSKVKSIIDNACADQTRDIPGTTIVVVDRNGEIFAHSAGTRGVGTKEPMTLDNIFWIASCTKMLAGIACMQLVEQEKLKLDDGEHTENILPELKSLKVLKPDGTFEDKKNLITLRMLLTHTAGFGYTFFNERLRDWTHPAGVDEFSGRIEDIISLPLLFQPGEGWEYGTGIDWAGIAVERVSGLSLNDYLQKHVFQPLGITNMSMLPDKEMRSKLAYMHQRDQDGKLRIREHLQRLPLVIDPDNKEAA

SEQ ID NO: 166130 - protein, 241 aa, Triticum aestivum
  Clone ID: PAT_TA_60548.pep
MSRKIRTAQSVSFDIPAAEQPYLHNRWHPEVPSIATVEPGETVKIECLDWTGGQIGNNDSADDVRDVDLTKIHYLTGPFEIKGSEPGDLLVVNITDIQPFDHSPWGFTGVFSKDNGGGFLSEHYPDAAKAIWDFDGVYCSSRHIPGVRFPGLIHPGILGCAPSAEILAEWNRREGELATSMAGPHPDKVFAQPPCEINAHGGLAKGDVMARIAKGGARTIPGRPEHGGNCDINIFSRGSKT

SEQ ID NO: 166131 - protein, 175 aa, Triticum aestivum
  Clone ID: PAT_TA_60549.pep
VDALRAQSGDFDSAKLEFMGLRLSNDASDAMMRRAVANAFAHRAVELMTPEYGSLEPSKAADRALNSRPGATKFINEVGIGLEDDNEAAQVEFIIALQKALTRSQGPEQSRVGILLAAMLQQLYSLDILEEEGILGWWENDRAVEGESMTLLKEKCRMLVDWLENAEEEDDSDDE

SEQ ID NO: 166132 - protein, 68 aa, Triticum aestivum; identical to SEQ ID NO: 137813
  Clone ID: PAT_TA_60550.pep

SEQ ID NO: 166133 - protein, 166 aa, Triticum aestivum
  Clone ID: PAT_TA_60551.pep
THPTNSILSERGQEVPLADYKGKVVLIVNTASKCGFTPQYAGLEKLWTDLKGKYPDDFVILGFPCNQFGGQEPGTDDDIQEFCQLNYGVTFPIMQKTEVNGDGTNPLWVWLKDQQSGLLGLKRIKWNFEKFLVGRDGKVKGRWASTTKPESLEKPILEALAEKPAA

SEQ ID NO: 166134 - protein, 131 aa, Triticum aestivum
  Clone ID: PAT_TA_60552.pep
MAAAASESFIHLARPLAPNTVGLQTNLAPLTVNIQPQAVLSILDHAVRRDIRDTQSTRVIGALVGTRSEDGTEVEVRSCFAIPHTEEEDQVEVDVEYQKNMLALTLKGNRGESLLGWYTTSHELNSFSALL

SEQ ID NO: 166135 - protein, 243 aa, Triticum aestivum
  unsure (1)..(243): unsure at all Xaa locations
  Clone ID: PAT_TA_60553.pep
MGDAISEKPHNAWLGAKGPASLDLRSDVVTTPTPAMLEAVSSCSLLDDVFQEDPATNGLEAYVAERTGKEAGLFVLSGTMGNQLALRSLLTQPPYSVLCDYRAHIFTSEAGGTSNLTGAQIQTVVPKNGRYMTLEEIQENVTLDDDVHGCPTRVISLENTLHGMVMPLSEVKRISEFAKEHDIKLHLDGARLWEAVVSGAGSLTEYCSHFDTITLCLSKGLGAPAGSVLVGPKXTLKHARWVR

SEQ ID NO: 166136 - protein, 162 aa, Triticum aestivum
  Clone ID: PAT_TA_60554.pep
MGSLGTNPMSFSAIPDDKAAFEPLNPEDVRAYLHKAVDFISDYYTNIESMPVLPNVKPGYLQDELSASPPTYSAPFDVTMKELRTSVVPGMTHWASPNFFAFFPSTNSAAAIAGDLIASAMNTVGFTWQASPAATEMEVLALDWLAQLLGLPTTFMNRTSTG

SEQ ID NO: 166137 - protein, 238 aa, Triticum aestivum
  Clone ID: PAT_TA_60555.pep
MASEVAQGLNERPEDVPDVLEAENDAADSDSTLESEDGSSSYLTSLKSSIFSYRYENGRRYHAFHEGTYLVPNDDEEQNRMDLVHHIYSLVMQGKLHTAPISDNPQRVLDLGTGTGIWAIDFADDHPSSEVIGTDLSPIQPDWTPTNCVFEVDDFEDPWVYKRPFDYIHTRELEGCIANEDQFFERAFQNLSSGGYLEMQGQRAYFMSDDESIKKAVNAEVWAVALRESSIKFGKPID

SEQ ID NO: 166138 - protein, 180 aa, Triticum aestivum
  Clone ID: PAT_TA_60556.pep
MAERKQPNGTGAGSGQVTMSEYKKAQARVRDLVEKRRALERRLTQVEDGIAQKETIYLDSTPSGNIITGFDNYMKGMSGAAAQRRKVGPMEQNRVFSRSSISYRPNNLEGITPGSGGSTPAGATPSSAAFRDGPSNHPTPTSTTAAKNVNKSKKKTVEHEDSENDTSTSKKRTNFGAQRK

SEQ ID NO: 166139 - protein, 123 aa, Triticum aestivum; identical to SEQ ID NO: 122909
  Clone ID: PAT_TA_60557.pep

SEQ ID NO: 166140 - protein, 183 aa, Triticum aestivum
  Clone ID: PAT_TA_60558.pep
MSSHYTSVGYSMPLPVPSKGSQYPTYSQYSVSPPECDDSVSSASGIPSYSNGGYSATSSGYTGAYGEYESTRSASGVDFQEYMQDRFANSFDPIPLDRSMAMQAQTSGKMNAKHRELLELQKKAQARLAKTRERFQEGMRDAHEVRSDLEWTQKKVSSLKTKASRKHGKEYSKARARYPSPEN

SEQ ID NO: 166141 - protein, 245 aa, Triticum aestivum
  Clone ID: PAT_TA_60559.pep
MKAGLTSLLLAALAGSSVAQTNKINAAKFNEDYLRASSAPNAVGMAELRQRKMALHESEAAAGVFDKDRYKVLGSSTPCSGGKAGEYSCNNIDLMGFLRHQDMGSRTRVGNDIWGWTHSSGREFALVGQSDGTAFVEVKKDGSLTYVGRLPTQTVASSWRDIKVIGNYAYIGSEAAGHGLQIFDLTKLLNTDPKNPPTFSIRSDLAAHFSGFGNSHNIVCHEQTAFIAAVGTAYDLKCRAGLWMI

SEQ ID NO: 166142 - protein, 237 aa, Triticum aestivum
  unsure (1)..(237): unsure at all Xaa locations
  Clone ID: PAT_TA_60560.pep
MKFSQASLLAACLPAVSARFIEIAEVDNVVLQPDELFLIETAPGKTQWITEEEKWEMRRNGQNFMDITETTTLGSKGINAESTVTFPKKCVKQDEVAKLSKKLEKKNMQANLEKLTSFHTRYFKSDYGLQSSDWVLEKVNQIIKDAGAEDTVFAESFPHTWKQHSVIATIPGQSNSTVVIGAHQDSINLFLPSILAAPGADDDGSGSVTIXEVFRALLNSXDXVKGKAPNXIEFHWY

SEQ ID NO: 166143 - protein, 180 aa, Triticum aestivum
  Clone ID: PAT_TA_60561.pep
PAVPSRRTNSQSTHTRSRSVISASVLIRSPNPSPRRARRRPRSLRHQILPPVRPTHKQGVTAPSRRISRRPSSPPAVVPGRRNPTSWISRRHRSVAAPTARTGCLRRQPRTPPASAPSRPGTPRPPSSPARTASSSPPRIVLVVVVLVIVVIASDVCLPLVAHDLRFDLLLVLVLRIVWL

SEQ ID NO: 166144 - protein, 105 aa, Triticum aestivum
  unsure (1)..(105): unsure at all Xaa locations
  Clone ID: PAT_TA_60562.pep
RRRRARGRRWRQRTAAWSAPPARRAPRRRRRRPSHTRTRRPSTSRAAPAPARRRRPARPRGPXPPSSSSSPPAPLXAAGRRPRPAARPRRRWPTPGIRRRRSPGR

SEQ ID NO: 166145 - protein, 231 aa, Triticum aestivum
  unsure (1)..(231): unsure at all Xaa locations
  Clone ID: PAT_TA_60563.pep
MEVNVLSSRLVKPAYTAGEVPMPATEYIPLSTFDRVTFEMQMAIIYAFAPPAPTTASIKKGLATVLAQYRAFAGQLGESPDGTPSVILNDRGARLIEASVDADLVDMAPSKPTPELLKLHPDLEAEHQEVVLLQLTRFRCGSLAVGFTSNHVVADGHATSNFLVXWGRTTRGLPMGLPPVHXHKNLFKPRSSPRVEHDHRNREYYLPSXSDVVGHHXDAADNIVIHKRTSP

SEQ ID NO: 166146 - protein, 109 aa, Triticum aestivum
  Clone ID: PAT_TA_60564.pep
PAGPGQRDEDFFHEHLEIARNKGVPIYWINLHCDPAILEKRLSTPERQEGSKSKLTDVFVLRNIIKSNELIEFTNKENDDICLIYRELDVSGSVESSVDRLKDILGQVS

SEQ ID NO: 166147 - protein, 41 aa, Triticum aestivum
  Clone ID: PAT_TA_60565.pep
GPFFFFFFLFFFFFFFFFFFFFFFFFFFFYSAEITVRQDLC

SEQ ID NO: 166148 - protein, 187 aa, Triticum aestivum
  unsure (1)..(187): unsure at all Xaa locations
  Clone ID: PAT_TA_60566.pep
MNTPINNSYAMYANKVAVVTGGTSGMGLSVVKYLLENNWRVFVISRRNQPAVSGSRFLQADISSQEELASAFRTAFEDTGRLDVVFANAGHAGNDNYFEHVKRIPWTXSSIDINLGGTIRTASLAREYFTKSPHHGKGAVLVMNASIAGLYPIDLFPVYSVSKAGIVAFTQTLLPRCSIMVQRMQSV

SEQ ID NO: 166149 - protein, 219 aa, Triticum aestivum
  unsure (1)..(219): unsure at all Xaa locations
  Clone ID: PAT_TA_60567.pep
MLVERKVKVVTEQNVIDKPPVDQFPMREWSLKVFMVDEDGNERPADVFTKVVYNLHPTFENPVQSYTKHPFTCKNEGWGEFEISIDCYTTEKTKLAPIIHDLNFHQTKYEQTHTVVFKNPSQSLQERLRETGPLPTDDDHRPKKKGIATKKSAQKYDYEKIAESLEKLEEEDLLRVIQIINENKGPDTYIRSDXEVDDLVKAGEXSIDLYTMPDSLTSK

SEQ ID NO: 166150 - protein, 177 aa, Triticum aestivum
  unsure (1)..(177): unsure at all Xaa locations
  Clone ID: PAT_TA_60568.pep
MSSLARPMLRSPALRVAARRFESTTAQKAAENAKQAATRAQEGLSRVTPTAGPAIAGYAKGVASTLGKVGGRTGKIIGFVERQVPFVVYYSKVGLELGKFVFHNQKMSPPNMATFQTTYQNLIKSIQNRTIIQSSQNLVQQVRNIGPAQLAXXGVVAAEVLGFFTVGEMIGRFKLVG

SEQ ID NO: 166151 - protein, 252 aa, Triticum aestivum
  unsure (1)..(252): unsure at all Xaa locations
  Clone ID: PAT_TA_60569.pep
RGPRGLFFFFFCVCIGLDTSNIGSYRRVAYFLVMLVYNLXFFHPLRNYSGPWLNTMTQXPXHTLLMLCGLPHXRHLALHMKYGPVVRIGPNMLSFNHPDAMKDVRGHRTSGEAEHGKDPIIVLSNGDNIVGSDRENHTRFRRALAYGFSAQAMLEQEPTFTTFDMIGDLAFGESFGCLDNSTYHPWVALAFESLKSLAFMAEMGRDPRIAPYIGFLLPRGLLTKFAENKELASMKVRKRLDTETDRPDFVPE

SEQ ID NO: 166152 - protein, 208 aa, Triticum aestivum
  Clone ID: PAT_TA_60570.pep
MVQTSALVTASVATAAAAILGYVAYFDYQRRNQAEFRRDLRRNERKQARAAKEEAEASTQQQRQSIRSRVQEANEEGFPSGVEEREAFFNEQVMAGEMLSQDPSKALESALAFYKGLKVYPAPSDLIRIYDSTVPKPILDILAEMIAFDSSLDVRGPASPAGINLSDIPNVGLDRGIRPIPISSPLLALYTRTEMVENIPSPKLYMES

SEQ ID NO: 166153 - protein, 172 aa, Triticum aestivum
  Clone ID: PAT_TA_60571.pep
MGAKSGTALKFLQWFIRGIQFACAALILAIYSYFLATLHNHNLSISNKIRAVEGISGIAVLYTAAALLLLCCLAGRTLSSLLAIMLDIAFIGAFIYVAVANKGGASSCTGYLDTPFGRGKAGNTAEGSDGFTALPSYRTACKLQSACLAVSIVAIIFFILPFLSELHLPRHI

SEQ ID NO: 166154 - protein, 262 aa, Triticum aestivum
  unsure (1)..(262): unsure at all Xaa locations
  Clone ID: PAT_TA_60572.pep
RPCRERLSYKSHSFNPIIRPLFTHRTMASAAAKRLAGKTILVTGASSGIGRSTALEFARTAPKDDLRLILTARRVDSLKELAEKIKSEVGDGVQVLPFKLDVSNPAEVKGIVNNLPEEWRNIDVLVNNAGLVKGVARAPEIAEEDINIMFQTNVTGLINMTQAILPIFLARPDGGHGDIINVGSIAGREXYPGGGIYCATKAAVRSFTESLRKELIASRVRVIEIDPGQVETEFSVVRFYGDKSKADAVYAGCEPLTPEDIA

SEQ ID NO: 166155 - protein, 89 aa, Triticum aestivum
  Clone ID: PAT_TA_60573.pep
RCGPGPVVHLLARPFQVGSGPAGACAKARRHGLIMWQALREAGLTEQRKLPASNGGRITGCCTTGPLGPHSLLQRTTIFSIKKKKKKAP

SEQ ID NO: 166156 - protein, 229 aa, Triticum aestivum
  unsure (1)..(229): unsure at all Xaa locations
  Clone ID: PAT_TA_60574.pep
MTAFPPPPVNTIDWSNVGFKVREVNGHVESTYSKITGKWTPLRFVADPFMRIHGMAPALNYGQQAYEGLKAFRTPNDEAITVFRPDRNAKRLQHSAEVVSMPPVPEDLFLSAVRAAVALNAEYVPPHDTGAALYIRPQLYGSSAQLGLSPPDEYIXXVFVIPTGVYHGAHPVKALILEDFDRAAPHGTGNAKVGGNYAPVLRWSDKARDEGYGITLHLDSVRHEEIDEF

SEQ ID NO: 166157 - protein, 98 aa, Triticum aestivum
  Clone ID: PAT_TA_60575.pep
GPFFFFFFQLTWRFPLLNHHGVAASPSSLFNAAPKQTQKIKTTRTKTQPSPSPSAALAYRDYQFDGEKQKRACPRLNRPKQGTKVTQHESTRCYRSDG

SEQ ID NO: 166158 - protein, 163 aa, Triticum aestivum
  Clone ID: PAT_TA_60576.pep
MCSADFFLAFLAILFPPLPVWVKCGLCSADSLINILLCCLGYIPGLIHAWYLIAKYPEPPYEYESLPQDREGNRVTYVYVQCPPGPHQHGQNNKQPKPQPKPHSGNTGNMNYGTQNAASSSHPAPQQQQGVTNNGEGSSSNDQSVPPSYADVVAGDHKIQSKD

SEQ ID NO: 166159 - protein, 132 aa, Triticum aestivum
  Clone ID: PAT_TA_60577.pep
GAFFFFFFENKYIISLFKRKEKLYLHSTLSTSNLAENQKNIKKRSISILRTHTLGWAQAAPGKLVASCRSRSFLRRQPLMHHPDILRRGRVDAAPLRHGAGGPVHARGGHLLPLRSDLLHPLDADFSNTRHV

SEQ ID NO: 166160 - protein, 128 aa, Triticum aestivum
  Clone ID: PAT_TA_60578.pep
DFLTGDEMMSDSYPIKEVDDVIFEVDCDAIYPESVAGDDEPVEFNNVIYSFRLQPTTYDKKTYVSSLRSYLKIVKNRLKKIGKNPEYIANFEKNAQDFLKTKLLPNFDDLEFYTGESMDLDGMYVLRV

SEQ ID NO: 166161 - protein, 249 aa, Triticum aestivum
  unsure (1)..(249): unsure at all Xaa locations
  Clone ID: PAT_TA_60579.pep
MEQTNVRLPQLAKIAALLLLFLLVPMVPPSLRAPYLYLLFNALVVGLGVQAGITSVSSRSNLTAQPPAPAPAAAVTPNHHHHLVTSQPPIMAAPLPGRLREVNLLADRGAVNNVVAVAKKLKETIKKVPSRASIFFIGSLDPHDAXARSWTRRQRRSTTRKGGKGKVDASSGDLMSKQELYAKADAFIGNFYKQLKMQRGESWNKLQDLCSYHPTTTRAGASRDSRSMYVYLESRCMASIYIYVRACIC

SEQ ID NO: 166162 - protein, 57 aa, Triticum aestivum; identical to SEQ ID NO: 141066
  Clone ID: PAT_TA_60580.pep

SEQ ID NO: 166163 - protein, 75 aa, Triticum aestivum
  unsure (1)..(75): unsure at all Xaa locations
  Clone ID: PAT_TA_60581.pep
MSCNCGSGCSCGSDCKCGKMYPDPTEQGSAAAQVAAVVVLGVAPENKAGQFEVAAGXSGEGCSCGDNCKCNPCNC

SEQ ID NO: 166164 - protein, 242 aa, Triticum aestivum
  unsure (1)..(242): unsure at all Xaa locations
  Clone ID: PAT_TA_60582.pep
MTPCPEGASAISKAESAPGEKGPVYEQFIPTIKNLSSLPTADDLNAIVDSFFXPALGVVATRTILSSFIAALREIENQDLWIEVGNRTLDTIAAQSSSSSFVDVVVTLRELIATAHEKNEDFLDAAKTLADIPLDSSQRKITDEEKARTWARIVRNYLEADDSTAAEMYINKLKNIMHSVADQELNLHFKLSXARILDAQRDFLSASQRYHEISFFPAIDEDDRAHTLSMAIXGAVLAPAGP

SEQ ID NO: 166165 - protein, 199 aa, Triticum aestivum
  unsure (1)..(199): unsure at all Xaa locations
  Clone ID: PAT_TA_60583.pep
MTAILERRESTSLWGRFCNWITSTENRLYIGWFGVLMIPTLLTATSVFIIAFIAAPPVDIDGIREPVSGSLLYGNNIISGAIIPTSAAIGLHFYPIWEAASVDEWLYNGGPYELIVLHFLLGVACYMGREWELSFRLGMRPXWIAVAYSAPVAAATAVFLIYPIGQGSFSDGMPLGISGTFNFMIVFPAEHNILMHPFH

SEQ ID NO: 166166 - protein, 217 aa, Triticum aestivum
  Clone ID: PAT_TA_60584.pep
MKISYLSVGLLALFSPLAAAWSKEDREIFRIRDEISKYETDPAANFYDILGVPNSASLDDITKAYRKQTRNLHPDKVRQSMRSKAEKDKKSGANVKPPTNAEIRTAVKKAGEAQARLSLIANILRGPERDRYDHFLSNGFPLWKGTDYYYNRYRPGLGTVIVGLFLVVGGGIHYLTLYMSWKRQTEFVDRYIKFARETAWGVVVSTSPGVQAAEPAP

SEQ ID NO: 166167 - protein, 122 aa, Triticum aestivum
  Clone ID: PAT_TA_60585.pep
VVFDYSLHAAAQLMCNEWDETKKKKPTGLASSRRVPSRDNESRCRTKTSAGISARLLSLVTGPGQTPSLCRFFAFFWTFFLPRLGRITAPIFLTSDLRAFSRCRLRNLVVEKKAALETLRLN

SEQ ID NO: 166168 - protein, 102 aa, Triticum aestivum
  Clone ID: PAT_TA_60586.pep
MASAGNVFDHGRHGTSLAKVEQATRCCATSPVDAQSPPKPLLVAAPCDAGEYPVVLFLHGYLCNNYFYSQLLHHVASHGFIVIAPQLYTVSGPDTTGEINSA

SEQ ID NO: 166169 - protein, 204 aa, Triticum aestivum
  unsure (1)..(204): unsure at all Xaa locations
  Clone ID: PAT_TA_60587.pep
MAGQRLFGLIVAQVLFAGLALFLANSPYLNMSVAPTKQPWADGPMKLVITPQYETKKTDLFTTGATHMALLHNAIIRGFNSIYLQAPHVKDADKADFIGYSQTWFKFVKSHHDDEEDNLFPKVQELLGEDPVWEETHHEHESFLAPLAEFNNYLSXLASPTDLDGAQVIKLMEXLQTDFEHHXHSEISTIAALSTIQGSQGDSP

SEQ ID NO: 166170 - protein, 234 aa, Triticum aestivum
  unsure (1)..(234): unsure at all Xaa locations
  Clone ID: PAT_TA_60588.pep
MASATRQFARAATRATRNGLAIAPRQVIRQQGRRYYSSEPAQKSSSAWIWLTGAAVAGGAGYYFYGNSASSATAKVFNPSKEDYQKVYNEIAARLEEKDDYDDGSYGPVLVRLAWHASGTYDKETGTGGSNGATMRFAPESDHGANAGLAAARDFLQPVKEKFPWITYSDLWILAGVCAIQEMLXPAIPYRPGRSDRDVSGCTPDGRLPDASSARSSPRYLRPYGFNDQESLPS

SEQ ID NO: 166171 - protein, 162 aa, Triticum aestivum
  Clone ID: PAT_TA_60589.pep
RPVRDYSWNTEANLMFLESPVGVGFSYTNTSSDLLQLGDKITADDAYKFLLNWFKRFPQYRSHDFYIAGESYAGHYVPQLSEKIFDGNRVGPKESYVNLKGLMVGNALMDDETDQTGMVDYAWDHAVISDRVYADVKARCDFTMANVTDACNAALQEYFAVY

SEQ ID NO: 166172 - protein, 241 aa, Triticum aestivum
  unsure (1)..(241): unsure at all Xaa locations
  Clone ID: PAT_TA_60590.pep
MSFARAVQRIKSIQNFLTRPTVPHISAAAAGQSRLINMASTTETNNYKFNHSMIRVKDPKASTKFYEFLGMSLVKKLEFPDNKFDLYFFGYDSPNALSHNKSTFDRQGLIELTHNYGTENDPEYKVNNGNQDPHRGFGHTXCIAVDNIQAACQRIEDAGYKFQKKLTDGRMRNIAFVLDPDGXWXVEVVARNDYKETENVKETDVSTYTMNHTMLRVKDAEKSPEYYPRSLGMSRLRTLRN

SEQ ID NO: 166173 - protein, 269 aa, Triticum aestivum
  Clone ID: PAT_TA_60591.pep
PTQPLANTQGHIPEETAKVVHGIYKGVIGTDQSEFSPLLKTDGTNDDKQPYLAVSEWYTDFVRSGLITLSNGKVETLEGSTAILSDGTKVADVAAVVAATGFDASPCISYLPSDVLQALQFSPKHIDQPVALAFHGTHHPQVPDLGFVGFYRSPYWGVMQMQARFVAALWSDNVSPGRNSEVFKCKLRDDVSIQRTLDLRDDPRVSQFPMGDYPYLMNEIAEALEIQISEPLTPPVLELPHNNLPLDMLTPARYSPSDDQESKDAATHR

SEQ ID NO: 166174 - protein, 245 aa, Triticum aestivum
  unsure (1)..(245): unsure at all Xaa locations
  Clone ID: PAT_TA_60592.pep
MADKIQDSHTTPVGPAYRTHQQKPSATVSVDVNLDNVHVLPQTPQLIALLSMIRSKETERADFIFYSNRIIRLLVEEGLNHLPVIEHTVTTPIGRTYNGLMFQGKICGVSIMRAGEAMEQGLRDCCRSVRIGKILIQRDEETAQPKLFYDKLPEDIXADRWVLLLDPMFATGGSETMAVQVPRGRGVPEEHILFLNLIASPEGVKNFSAXFPRLXVVTAFIDXGLDEKNYIVPGLGDFGDRFYTI

SEQ ID NO: 166175 - protein, 218 aa, Triticum aestivum
  unsure (1)..(218): unsure at all Xaa locations
  Clone ID: PAT_TA_60593.pep
MLGHLVFTLCLASSAIAAPDGAGLVSAPVVGKSLKVRALPNSPSGGYAPKVVDCPSTRPKVRLADGLSDQEEAWVRRRRNNTIDPMTDLLSRVKISGFDAKTWIEKXNNATALPNIAIAASGGGYRALMNGAGFISAADSRNNKTGPISGLLQSATYLAGLSGGGWLVGSIFANNYSTIPDLQKGNRDSDIWAFDPFIFXXPEKSXXRVFDTAEYXDD

SEQ ID NO: 166176 - protein, 271 aa, Triticum aestivum
  unsure (1)..(271): unsure at all Xaa locations
  Clone ID: PAT_TA_60594.pep
AGRSREQDLDEVRTAHAGKRSHGIGRLRPRFVLYNEYNPDEEAIGNVSSADLKARPDAVVVVGTTLKVPGTRRLVREMCQVTRGRKNGVAIWINLDDEPKGVDLKNCWDIVVRSKCDNVAHLADLTHWDFNIGEGYELTKEEEQERENRLAKGKKQLRSIFLRARXSLDPDADEKAAVKPKQVEQAQGIPTPNASPKISAAKKPGKKQSTLSFNGQQQPPNTATSAPKPRKRGRKPAQPKPDTPAVEFQKKFTIIRERNLNQLSPQTKSDG

SEQ ID NO: 166177 - protein, 230 aa, Triticum aestivum
  unsure (1)..(230): unsure at all Xaa locations
  Clone ID: PAT_TA_60595.pep
MRLSSLISRHGSVLRRCSGARARPICSHPQRRLMSSSLAGVKELLKVSDEIADGVSTNKPIVALESTIYTHGALGNELARQHSDLVRSNGGIPAIIAIVDGVPTVGATASDILRMIESGSAVKASRRDIAYIAGMGLTGQKIHGGTTISGTMLLARLAGIRVFGTGGXLGGVHRGGHDSMDVSADLTELGRTRVAVVSSGCKGFLDIPXTLEFLRQGCSRLNVADGDPED

SEQ ID NO: 166178 - protein, 237 aa, Triticum aestivum
  unsure (1)..(237): unsure at all Xaa locations
  Clone ID: PAT_TA_60596.pep
XQQLVSTPVLALPDFSKQFAIETDDCDRGFGAVLQQEGHPIAFMSKGLSPRYHELSTYEKEYLAIVVAVDQWRPYQQHNEFVIYTDQKSLIHLEEQRLTTPWQQRAFTKLLGLXYVIRYKKGLENTVADALSSAQSPISCLTXITCRPSWLEDVAASYHNNPQSQKLXLEQLAIKEDPKQRFTLEQGILRFCRRIWLGGTAVMQXKIISALHDSLMGGHSGFPXTFQQIRRLFAWPR

SEQ ID NO: 166179 - protein, 187 aa, Triticum aestivum
  Clone ID: PAT_TA_60597.pep
MECSGDEVVELNCARAGGDPGEYAAVLKRKLQLYCAAVAKTMEGKPQESSLNCLSSQASDTSPLVSQASFDCDGTVVQGKPANSCTSKEQSDDDDGDLEENTDPASAKRVKRMLSNRESARRSRKRKQAHQNDIESQVTQLRAENASLLKRLTDMTQKYKEASLGNRNLTVDIETMRRKVYPFLDNS

SEQ ID NO: 166180 - protein, 96 aa, Triticum aestivum
  Clone ID: PAT_TA_60598.pep
PAGPGYRRLLTLLDSSSHVMHVPCQCSISYAYAAALTPCSTATQVHLDVSRPRSSFLSSTLCMRIRTDALQDAITRMQKPLRLHPLDPAALYSKLM

SEQ ID NO: 166181 - protein, 134 aa, Triticum aestivum
  Clone ID: PAT_TA_60599.pep
MDMDQLCLMALATILLTFILRQVLGGKGTGARLPPGPWNLPVIGSLHHLVATKLPPHRALFRLSRRHSPLMLLRLGEVPNVIVSTPEAAMLVLKTNDLTFATRTSGPTLDVVGSASEGIIFAPYGEHCVRINLV

SEQ ID NO: 166182 - protein, 247 aa, Triticum aestivum
  Clone ID: PAT_TA_60600.pep
AAGLGHLHSSLSEFGALGFEYGYSLSSPHALVMWEAQFGDFANNAQCIIDQFIASGEVKWMQRTGLVMSLPHGYDGQGPEHSSGRLERYLQLSNEDPREFPTGEKLVRQHQDCNMQIAYFTSPANLFHALRRQMHRQYRKPLIIFFSKSLLRHPLARSDIEAFTGENAGFQWIIPDPEHETGAIKSPDQIERVVLCTGQVWAALHKYRADNNIDNVAFTRIEQLNPFPWQQLKENLDQYPNAKTIVW

SEQ ID NO: 166183 - protein, 180 aa, Triticum aestivum
  Clone ID: PAT_TA_60601.pep
QHHPKHQPYTSAMYFSAILLTLAATASAVDVRAYSNSGCNGGWVGCAGINPGVCCVFSNSASSGRLSVSVNAIPSSWRIRGEANTGGGCTYLANQQDSNGNTDICMTYSSRGDRTGGSYSFVGRKRAADNSCPAEQPDGGKCEAGVKPDLLGLSDGTVYNIANTGAGADAVPAEFEPLRR

SEQ ID NO: 166184 - protein, 138 aa, Triticum aestivum
  Clone ID: PAT_TA_60602.pep
PRGLRGAHPGERETGVDGRLRRAVVPPPCCSAWTVVMLLGDVLLMGSLFDLSTLKSLEVAHGIIALIWIGAMSWYTGYELLQYYRIHPQVLNIVDMTRFVCGRTLESIAGVMMMIQVIFVAASAMVTLSIALNTISEH

SEQ ID NO: 166185 - protein, 212 aa, Triticum aestivum
  Clone ID: PAT_TA_60603.pep
MLSTQGSHADRAGTLDPRDYRIAWIAPLEIEAKAALYFLDGRHRGRFPVDRGDDYVFQAGVMGGHNIIIATLPAGQEYGTGSAAALAGQVKKFFPNLWFGLLVGVAAGLPDLSRVPARDIRLGDVLVGLPVGDNAGLVPYDLGKETEDGFQPLRLGHSLAMTEPIVRSAIGSIKLQAPNDTEIFLPYYEKIRDCEHETGTFADPGQTMTYCT

SEQ ID NO: 166186 - protein, 213 aa, Triticum aestivum
  Clone ID: PAT_TA_60604.pep
MSAPAHKFKVADLSLAAFGRKEIELAENEMPGLMQTRAKYAADQPLAGARIAGCLHMTIQTAVLIETLTALGAEVTWTSCNIFSTQDHAAAAIAAAGVPVFAWKGETDEEYNWCLEQQLTAFKDNKKLNLILDDGGDLTTLVHQKYPEMLKDCFGVSEETTTGVHHLYRMLRDNKLLVPAINVNDSVTKSKFDNLYGCRESLVDGIKRATDVM

SEQ ID NO: 166187 - protein, 224 aa, Triticum aestivum
  unsure (1)..(224): unsure at all Xaa locations
  Clone ID: PAT_TA_60605.pep
MALHSADTSKLIFAPAGHQATGQAEQFTKGTLVRSQLNSESPIPQFHSWFSRAQENDSGVEHPETCTLSTASLPSGRISSRTVYLKELDNRGFVIYTNLGTSRKSADIASNPRAAMLFFWEALQRQVHVEGRVERISKEESQKYYDTRARGSRIGAWASKQSQVLEPQGEDDDGRKQLERXVKDVEQRFEGQEKIPVPDFXGAXLRVIPDRIEFWQGRESRLHD

SEQ ID NO: 166188 - protein, 148 aa, Triticum aestivum
  unsure (1)..(148): unsure at all Xaa locations
  Clone ID: PAT_TA_60606.pep
AGRFGNHHILSSFLSLSLTLSLRCRLNVLPAIPTTNMRGTPVKYPVSSRNATGHTNWWLXNILSIFDHSKNKPDPKPKPAPVLTXNEDINDYLDNGHRPDGKNYMPNILLXKQQIRSPYLNEELHADYDYESLAVVNKPKDISKNQDC

SEQ ID NO: 166189 - protein, 222 aa, Triticum aestivum
  Clone ID: PAT_TA_60607.pep
MQAVKWKCDAVTFGNLRTKLHNGSHADVTIASVTWYPWGDRAVAVDTILVPPTDQWPDWHIRMHRIRCNKSIPPLHTIEGGFAIHGRKAADGMILPTIDTLDDATPGKSEGIYSDNVSTLISSEDGCSGISIEALLDRFKTPVESYALKPDSNTNIVRQRTLIPAAAVSISGGLEPQQELLIQTSVFSISSKANGGISDDESCLRDRWLNRPSVDVAGFEHM

SEQ ID NO: 166190 - protein, 90 aa, Triticum aestivum
  Clone ID: PAT_TA_60608.pep
LNSRIIFLGYQLTIQNKVCDKSITDNITSSYLCHSPMFRPYDRSFLLSLPFYWRHALQVRESGCISFGRSTQLLQLGILPCDPYMVRGMA

SEQ ID NO: 166191 - protein, 266 aa, Triticum aestivum
  Clone ID: PAT_TA_60609.pep
MTGFKKSAIFGLLSSLAAVTAQKFTNPVIWEDLPDNEVTRAGDAYYMTSSTFHYSPGAPVQRSYDLVNWEHIGHSVPVLDWSPDYSLENGRRAYVKGIWASSLKYRESDKKFYFVACISGTGKTFVYSASSPMGPWTKGATINKCYYDAGLHFDETDTPYVAYGRDDIHLAQLSKDMNSEVKEQVVLRPPLTLEGARLYQRSGNWYIFLTRPPDGQYIAKSSSGPWGPYDNRIIADRLKLSAVPRAGSPSQGSLVTQKGDWYYMGF

SEQ ID NO: 166192 - protein, 209 aa, Triticum aestivum
  unsure (1)..(209): unsure at all Xaa locations
  Clone ID: PAT_TA_60610.pep
KAHHGIHATWQPASSTNRQGSSRAKRASRRRKSSPSYHVTSSPLRIGRATAHQHEQRGARALDLCDXYGDTHLETHKKDINAALPSVEIHTRCFDALDEDKVKEVIDHAMNRYGRLHVFFANVGXIVARTTLFSDLSKDXFMWILNTSTSSDFLPAQYLSPDMMXTSPHKPHSGGSIIGTVSSRVIRSNAGSTSYSHSEAESVCLAHTI

SEQ ID NO: 166193 - protein, 227 aa, Triticum aestivum
  unsure (1)..(227): unsure at all Xaa locations
  Clone ID: PAT_TA_60611.pep
MDSSYSGLVAQVASLPPPPQILLFGDSITQGAFSLQTELTKRYMRRLDVLNRGFGGYNTNSALTLLPSFFSAVVPSKTVPRVAVMTVHFGANDSCSPGEPQHCDLETFKSNIRRILDWEGVRLHETKVILVTPSPVEEYRLPHDEKGRAERVAMYAQMIRDIGESENVPIVDLWTAMMRTTGWKEGDILRGSLXTVPSVELXRLFYDGLHLNQDGYEIYIELLRVLE

SEQ ID NO: 166194 - protein, 196 aa, Triticum aestivum
  Clone ID: PAT_TA_60612.pep
MNAPEPEQTPFEAVSVHTSRIQRKYQALLDQSTPFVLYRWVGTVVCLVLFFLRILVAQGWYIVAYALGIYLLNLFLAFPQPKFDPSNEEADNDMEDGSVGTLPTKSDEEFKPFIRRLPEFKFWYWATRAIVIGFTCSWFEVFNVPVFWPVLVMYWFILFFLTMRKQIQHMIKYRYVPFTGGKEDYAKNSSTPELSR

SEQ ID NO: 166195 - protein, 118 aa, Triticum aestivum
  Clone ID: PAT_TA_60613.pep
MASSTALSCLAALLLLAAAAAPASAAEKETRLRVYWHDVVSGGPNARVVQVAQAPSSNTSATGFGTVLVIDDPLTEGPSLTGSRLLPVADPLVRRQDRRRHRGVQDPSPPRLMHYQLN

SEQ ID NO: 166196 - protein, 182 aa, Triticum aestivum
  Clone ID: PAT_TA_60614.pep
RPVRARGRTWLEAFDGLGISLLLTCNPSIQYTVFDQLKQKLILRQTRKNAESAGDSSPVALSAFSAFLLGAISKSVATILTYPLIRCKVMIQAADPDEDDEDESEKPGNSRPPKTMLGAMHAMWNKEGIPGFFKGLHAQILKTVLSSALLLMIKEKISKFTWISLLALRRYLFVSRKRIKSA

SEQ ID NO: 166197 - protein, 145 aa, Triticum aestivum
  Clone ID: PAT_TA_60615.pep
MAGRMALAVVLLTAAAAAAAAQSASNVRATYNYYSPEKINWDLNAASAYCATWDAGMSYAWRSKYGWTAFCGPAGPTGQASCGKCLLVTNTATGAQITARIVDQCSNGGLDLDFDTVFSKIDTDGQGVAQGHLTVSYQFVDCGDN

SEQ ID NO: 166198 - protein, 210 aa, Triticum aestivum
  Clone ID: PAT_TA_60616.pep
MKFFTALSFVAGMASARPAGDVEARQFGNGLGSGLGSGLGSDLGSDLGSGFGGLSGGGLGGGLGGLGGSTRNDLEQGAAGSCPKAIFIFARATTEQGNMGMSTGPAVASKLEAKYGKGGVWVQGVGGPYTADVPGNLMPDGSSPAGINEAVRLYNMAHEKCPDTPVVTGGYSQGTALVAAAISKLDPKLWTRSGVRSLSIHKNAQNMRPS

SEQ ID NO: 166199 - protein, 264 aa, Triticum aestivum
  unsure (1)..(264): unsure at all Xaa locations
  Clone ID: PAT_TA_60617.pep
MAAVTANGDAAASVLDDIKPPAGVVLPPREIRNVLEKTAGYVARNGAVFEDRIRDKERSNPKFSFLNPSDAYHPFYQWRLDEVKNGRGTAIAAGRANEPAAEPPKPQGPPKPVDFQFSARTPRIARKDLDVIQLAALFVAKNGRQFMTQLAQREAGNPQFSFLIPNHTLHNFFQHIVDQYTTLLRASGLSGEGGKLQEERVRELEANIKDKFLVLNRARQRAEYAKFXESERXKKEEEEESRRRICSIDWSDFXVVEPSLFTRP

SEQ ID NO: 166200 - protein, 156 aa, Triticum aestivum
  unsure (1)..(156): unsure at all Xaa locations
  Clone ID: PAT_TA_60618.pep
MGIKDLAISYVVFTVIHFFLFALALATCGLYGTDVHHANQQGKYSDSKWVYAVVVGSISAVTCVLYFVPFVLRIAGVFVPVWDFILFVLWIALFGVFGKMYINEDAEGDGDVRRMKNAVWVDLASALLWFIAALXAFGYWWKHRDHRSRFTXRAHV

SEQ ID NO: 166201 - protein, 124 aa, Triticum aestivum
  Clone ID: PAT_TA_60619.pep
RSRQNQQQGYSYSQAVRVGNTIKCSGQGGWDDQGNIDKEDLKGQIDLAFKNVEKNLKDAGARGWADVHSVRSYHISLSGSFDLMVEEFRKWMPDHQPTWTCVGVTELGIPGMIVEIEVEANIAQ

SEQ ID NO: 166202 - protein, 162 aa, Triticum aestivum
  Clone ID: PAT_TA_60620.pep
MGVVSAVADAVVVLFSLTIAVGVPLIDAQAVLSHDAYPAQLRDLKRWYAAEFDDYLMAHPPPFFRGLLCLELAFLWPLSVATVYGVLARRRWAATTSLMVGVTTLTSLSAIFGEMLGSGKATTKLLQMYVPYAVFAVIAILRGLCSCSAPASPASSARKKRV

SEQ ID NO: 166203 - protein, 161 aa, Triticum aestivum
  Clone ID: PAT_TA_60621.pep
RPVRDARHLCQTGVVEAMHAVSTGVPLGASHAIGHQLGPLGVGHGETSCIMLPAVCKFNAKKGVNQDQQKCTLDILVKQQPVKSLMDEVKMMDKEYDLADVLDLIIRELGMPRSLRDVGITSDHLPGLAANSLNDIWIKTNAYKITKKEEVMEILEAVIGN

SEQ ID NO: 166204 - protein, 182 aa, Triticum aestivum
  Clone ID: PAT_TA_60622.pep
TPTKPNPWSNCSHPPPSRKFSWDWLPSSLMGSKCPPSPPLVSQTADPSANYTLNGADTLEGCLELQPERIRPAHDNPRWPPIQDNQTAADCLCFAFMVRGHLEGTNAHNVDTSVSGQARHGPHPQRCIDYESSENRLLALRVPQDVNDPRLQAHSHSDRCIRDHTSPMKDNISRQKLSNKMY

SEQ ID NO: 166205 - protein, 205 aa, Triticum aestivum
  Clone ID: PAT_TA_60623.pep
PAGLGTQAAQHQEIPRRSSEPPQTQAPSVEAILLHHGVNPATLTPSQLQLFKVAEPPQQERLIELWNICPPGSGGDIPALAWSSTTVENEEQLARIRYDRLSQQHQVMSLDGTQVQTNDGRWVSQQEPEMEPYMASGYEELMRREQEREARDSQPRSTYGLYSHATDPVYMGPDYAREQQLLAMASQYGACHGFRAPEMDTMDVM

SEQ ID NO: 166206 - protein, 179 aa, Triticum aestivum
  unsure (1)..(179): unsure at all Xaa locations
  Clone ID: PAT_TA_60624.pep
MPLVDPVTMSTTLIKSGPAQQQPAPKAAVPAIPLVNSPLALPASIAHSVLLAGLFYWRFDALVADPVTSLQTGLPVVAAIQAVYLMLSLPPAGSSLSSKKPRPGEKKKSSDGREAKSFPTAVISLLLALILTPALHILLVLFGAPFLTHVPHTFLCCAHIALLAIYPVFLRRXSDPVPC

SEQ ID NO: 166207 - protein, 255 aa, Triticum aestivum
  unsure (1)..(255): unsure at all Xaa locations
  Clone ID: PAT_TA_60625.pep
MKFLLISLAAIAAALPTDKGIIPGKFVVALKPTDDLNLHARWVSDVNRESLSRRGVESVGIDKTFSFPGFKGYSGSFDEETIKIIKANSTVLRVEPEQEYTVAAQVTQQSPPWGLSAISNAKPPSSKASYTYDSTAGEGVFAYVLDSGIYLEHEEFQGRAVFGADTSGVTSQKQHGTLVAAIVNGATYGVAKKATVVDVQVLGDSTGTTSGVIDGVAWTVNDIVGKKRAGKAVINMXFVGASSEIMKRCVQKRSM

SEQ ID NO: 166208 - protein, 155 aa, Triticum aestivum
  Clone ID: PAT_TA_60626.pep
RGIEKWARKGRGIMDLEQRRGAGVYTIRVYRLRCIGSYSYPPSQVFYDIGSFGMGIGGVLDRPTDTLPHGVYGVDYVCGPIILHVQARAALRSTSKRSLMSIFQDNVDITSARVLFELDERGCQALRMDLRRIVLLVSHLWSRYTRFEKKKKKGP

SEQ ID NO: 166209 - protein, 187 aa, Triticum aestivum
  Clone ID: PAT_TA_60627.pep
MGSHDSLNQAEGAPRFWYRDNFFLTNDKSYLCPQTFNKSLDDNWWSSPLPNGQLQRVLDNCLTLAVYYTPQTAEEMKRNGIASPKDGSPHKMVGFARVVTDYVTLAYLTDVFVVDEFQRRGLASWLMQALKEIVNEWKHMRGLLLMTHDQAAARLYQRELGAQEFEKGPSAGLVMLEMAPEKPAPKH

SEQ ID NO: 166210 - protein, 208 aa, Triticum aestivum
  unsure (1)..(208): unsure at all Xaa locations
  Clone ID: PAT_TA_60628.pep
MMPPSCDWVLIVSWLCLIMEVAPAFEIRSTMTHIXRFLLIIIFGNEVKIADNDQAPILPIGRVVYGIDCSAMYFEIRNMVLIMKIAXRSFDNNMNTKGTLGQINLLRHVHHEIIIGLRDEITPTISQSINKNYVPTELMDTXDLHHIIALPTENSRKXHCQYFLYQMLRELNYIHSVDVIXRDLQTNNLLLNDNCDLQIYDFYLPRXS

SEQ ID NO: 166211 - protein, 267 aa, Triticum aestivum
  unsure (1)..(267): unsure at all Xaa locations
  Clone ID: PAT_TA_60629.pep
MVRFSSLLAAAACFVAAESVSITVGSKGGNATSGHQYGFLHEDINNSGDGGIYAELIRNRAFQYSKKYPVSLSGWRSINGADLSLNRLDEPLSDVLPVSMKVEPGKKGKSNEIGFLNEGYWGMDVKKHKYTGSFWVKGSYKGHFTASLRSNLTDDVFGSVKVKSKAKKDKWVEHEFSLKPKMDAPNSNNTFAITFDPKGADGALDFNLISLFPPTYKGRKNGLRVDLAEALEGLHPSLLXFPGGNMLEGNTXXTWWDWKDTIGPLRY

SEQ ID NO: 166212 - protein, 266 aa, Triticum aestivum
  unsure (1)..(266): unsure at all Xaa locations
  Clone ID: PAT_TA_60630.pep
MSEHLAVISSKSQFDSLLKSSRIVVADFYADWCGPCKQIAPLYESLAITLSRPNLVTFAKINSDEQAELSQEYSVSTLPTFLVFRDGKEIDKVQGADPNKLKAIIQKLVTEVDSLGESSGSGSGDGVNWKGAEAPRGYSDITDQIELRDLEVLNADEAAGGVRVLFEGSKPSGLGNGKGTSKDYVQSGADDQLLLYVPFQSIVKLHTLQLTSLPPKDDEDVMRPGNVHLYINRTHNLDFSEADDTDPTQXIEIGPEDWNADGTVNL

SEQ ID NO: 166213 - protein, 245 aa, Triticum aestivum
  Clone ID: PAT_TA_60631.pep
RPVRAAEEMNFHGYLNGSREDQGGNYGYPHCYTLWSTEDFPNRRDLKVGDQFPADRQSRQSKSDTNPTDKECNTDYVPPVLAFQAHTAPLDMKFDNDGKNAYVSFHGSWNREPPVGYQISEIPFEDGRPANSSRSRDAATPIIYNEKLSSCPDDCFRPVGLAWDTQGRLWFSSDKTGEIFVLNHNKDDSSQDGSSKGDSDDDDDNDNSAFSLRPSAALIVTMAAVIMRFPRITSKVTALYSCTGR

SEQ ID NO: 166214 - protein, 70 aa, Triticum aestivum
  Clone ID: PAT_TA_60632.pep
LLRKSTLYRTSSTTTSRDTTKLIPNPQKPRRPMKFAAAPRFRCRSSCPRRERYLHHRGAHCSHHLLPRTN

SEQ ID NO: 166215 - protein, 169 aa, Triticum aestivum
  Clone ID: PAT_TA_60633.pep
MNQVSEEPRDDPSKRVSGAAPAAARAGCFDCNICLDFAVGPVVTLCGHLYCWPCIYEWLRRDAAGGTISTAGRPCPVCKAALTLDSLVPLYGRGGSRSGKSRLRPALPRRPTVHRGAVEQQSARTSGGSRHRRVIVEPDSPTRSSRHTRVGAAQFDILYPPPALRGMNA

SEQ ID NO: 166216 - protein, 182 aa, Triticum aestivum
  unsure (1)..(182): unsure at all Xaa locations
  Clone ID: PAT_TA_60634.pep
MRQSFLTGLLAAPLSAYAVALTGYEYIVVGSGAGGGPLAARLAMAGHKTLLIEAGDDYATTNYTVPAYSANASEDPEISWNFFVKHYADDERQARDFKTTYDTPDGEYTGLNPPADAKLKGTLYPRTQALGGCTAHNALIAVYPHQSDFEYIATLTGDDSWSAKNMRKYFVKXRDNNHLLPL

SEQ ID NO: 166217 - protein, 116 aa, Triticum aestivum
  Clone ID: PAT_TA_60635.pep
KKKKGRVSRLRHSCLAGVGALGCLVHAGADRRDGSWCTSLGLMPLHALFVAAMAACWSATWPCLGRRMAPSSASTEGRSAPRRAASSESISRMLGRMHRFIPMKLLAELALSGNGR

SEQ ID NO: 166218 - protein, 251 aa, Triticum aestivum
  unsure (1)..(251): unsure at all Xaa locations
  Clone ID: PAT_TA_60636.pep
MPTTELISYDEAQNSAFDNVLHGKSKESRGGMRAMMNKDNKAHAAAVDEYFQFFDNKKAEDEVEAVRQERTDNYASLTRQYYNLATDLYEYGWSQSFHFCRFAYGESFDRAIARHEHYLAHNIGIKPGMXVLDVGXGVGGPAREIVKFTGAHVTGLNINEYQVGRAGIYAEKEGLSDKLKFVQGDFXMKMPFPDNSFDAVYAIEATVHAPSLRGVYSXDPTCPETSGIFGVYEWLMTDIYDNDDLGQRRIR

SEQ ID NO: 166219 - protein, 255 aa, Triticum aestivum
  unsure (1)..(255): unsure at all Xaa locations
  Clone ID: PAT_TA_60637.pep
MATVQHITPRSVLLKNPSHENLPQSRPNSMIIRSVVNDEGLPEVVNSSYAMMNYHDAPIPVDSESDKRFNEAPIPVGTLDDSPPPLPARKSTNQYPYGPESYVSQHQPPYSTGGYDPQVPLQHPDNNGSTPRPPSYHGNEVVTHVTPLTELGDHPKFVDCPFCRHRAETRVKKTSSRVTHISATVLGFTTIAGAAVPYAGKXAAHTTHYCTNCDRKVAIRKWGTKEMKGLTPEHMREIHDILLRVYVHEQQFRMS

SEQ ID NO: 166220 - protein, 103 aa, Triticum aestivum
  Clone ID: PAT_TA_60638.pep
PSQERRAAEPCLINRELRSASSHQGRPMAFLGGSLQVDSRKMMEEKRQSHGGSWRQAPASVRQLFWRMRRAVLRPKRRAVSFGYNLKSYSQNFDDSLVPAHRL

SEQ ID NO: 166221 - protein, 257 aa, Triticum aestivum
  unsure (1)..(257): unsure at all Xaa locations
  Clone ID: PAT_TA_60639.pep
MSWLSIPSESHFSIANIPFGIISTSSNPTPRPAVAIGDHVLDLQAFAKGDGFSGSPDAQKHADVFSQSSLNAFAALGRPVHRVVRSYLQGIFAKDTKYAQILKDNQKLQETALLKSSDVKNHVPLNIGDYTDFYVGKHHAFNVGCLFRGPDNALQPNYTHLPVAYHGRASSVVISGTPIRRPWGQILRPGNKVPDLAPSEKLDIELEMGMFICRENALXEPIPISEAEXDYIFGYVLLNDWSARDVXXWEYVPLGLL

SEQ ID NO: 166222 - protein, 118 aa, Triticum aestivum
  Clone ID: PAT_TA_60640.pep
HEYVFVTPLLTLDHYYSIQASSPGEEVSAKIFERVCCKLTTQVIQDRCWYEHTAKANHTSYSVTFGVICRYIQKTRSLPNTRSRQRASTVWFPPLLIILSTYSFLAGRWSWGRSEPAG

SEQ ID NO: 166223 - protein, 250 aa, Triticum aestivum
  unsure (1)..(250): unsure at all Xaa locations
  Clone ID: PAT_TA_60641.pep
MAKSPMAILALGLAALVLSGAGLVAAQNCGCQPNECCSKYGYCGTDDRYCGQDCRSGPCTASGGGSGDPVESVVTDAFFDGIKSQAADEGCPGKSFYTRQFFLDGAQANPDFGKGSTSDDGKREIAAFFAHFIHETGRKFTSKLQLTTTTNTGGIYLSMIKLAVCNLCADMCSIEENGGASKDYCDETNTQWPCTPGKAYYGRGPLQLSWNYNYXAAXESTGFDGLXSPDTVAQDPAXTFRGAXWFWMTT

SEQ ID NO: 166224 - protein, 218 aa, Triticum aestivum
  unsure (1)..(218): unsure at all Xaa locations
  Clone ID: PAT_TA_60642.pep
ARYIHNNSIDAVPSHRLPTLQSQDNGRVDGPLFSLQKNAADQDRWEDIFNLAVKXVQRHRYAQREKIRLXRLEKSDDSGYMHGEGNLIYQPRIKVMKKXAPPSARKILQLLRLLHINNSVFVKESMVITDMIWGVKPCISXGHANLKTXRSSPTSERTIKAXKQRNVLTDDSIVDENLSKDGNPCVDDLIHKIITDVHIFKQGXCFLWPFKLSNPTGG

SEQ ID NO: 166225 - protein, 133 aa, Triticum aestivum
  Clone ID: PAT_TA_60643.pep
RSSWAVEHGEELFQFVSVDRDITPDSVTHHLNSADPKNVALYRCPVSKNTVLIWTRCPATSSSKRIRAQNRVRRDLTWYAGEEGIQNIVTVGNTLLCQSSLSKFIQLSMRSKEDVTVSKLRDACGISGEIQYQ

SEQ ID NO: 166226 - protein, 60 aa, Triticum aestivum
  Clone ID: PAT_TA_60644.pep
PAGPGVGIAHVEDFDSIEDASKRASCECRALDCGKAILKGRRQFESIEQVIALVQSVTQD

SEQ ID NO: 166227 - protein, 265 aa, Triticum aestivum
  unsure (1)..(265): unsure at all Xaa locations
  Clone ID: PAT_TA_60645.pep
MGGAPTTVGTYDAALQRRQALMGASGARALVKNWKVFRIAAFACIGGILYGYNQGMFSGILVMKSFERHMGDYVQNKTKKGWLTSILELGAWLGTLMSGAIAELCSRKYGILIATSVFIIGVVIQCTAMQAGHNAILAGRFITGMGXGSLSTIVPLYNSECAPPEVRGALVALQQLAITFGIMVSFWIDYGTHFIGGTGEGQSDAAWLIPVCLQLGPAIVLFIGIMWMPFFSRWLTHXNREERARQVWXTYVTFPXHELIELEFS

SEQ ID NO: 166228 - protein, 206 aa, Triticum aestivum
  Clone ID: PAT_TA_60646.pep
AGRSGAARKDADTRNNEIRSLRHQNSKSSEIIAQLKDLESQNRVLLGNLEKQLTDLKQSNASLMTENKKMEVTSLDAVRRTESLNKQVSDLSNLVKSKDAASAVVRERNVMQETEVEKMKVRLEHAQKDRDNWKNKALSNSSEEEEMLRTFALCTICRNNFKNTALKTCGHLFCNQCVDDRISNRMRKCPTCSRAFDKMDVMPVHH

SEQ ID NO: 166229 - protein, 93 aa, Triticum aestivum
  Clone ID: PAT_TA_60647.pep
KKKKKKKKKKKKKKKEGEQFAKENGLIFMEASAKTAQNVEEGFVKTAGAIYKKIQDGVFDVSNESYGIKVGYAVPGQAGGAGASSSQGGSCCG

SEQ ID NO: 166230 - protein, 209 aa, Triticum aestivum
  Clone ID: PAT_TA_60648.pep
MANFLASIFGTELDKVNCSFYFKIGACRHGDRCSRKHVKPSYSQTILMPNLYQNPAYDPKNRMNPSQLQNHFDAFYEDIWCELCKYGELEELVVCDNNNDHLIGNVYARFKYEESAQKACDELNSRWYAARPIYCELSPVTDFREACCRLNLGEGCVRGGFCNFIHRKNPSEELDRDLTLSTKKWLKQRGRDERSASRSPTPEPTRRRY

SEQ ID NO: 166231 - protein, 226 aa, Triticum aestivum
  unsure (1)..(226): unsure at all Xaa locations
  Clone ID: PAT_TA_60649.pep
MLSTLRVASRRAARPAQYNLAAIRAASNWANVPQGPPDAILGITEAFKADKFDKKXNLGVGAYRDDAGKPYVLPSVREAEMKVVESKLNKEYAGITGVPEFPPAAAKLAYGANSPALDRITITQTISGTGALRVGAAFLAKFFPGEKKIYIPQPSWANHKAVFNHXGLEVEQYRYYDKKTIGXLDFEGLIADVKSAPNGSVFLFHACAHNPTGVDPTQXQWKQISD

SEQ ID NO: 166232 - protein, 271 aa, Triticum aestivum
  unsure (1)..(271): unsure at all Xaa locations
  Clone ID: PAT_TA_60650.pep
RPVREHAVDRHKSALSRGASSSLGSPRSPPPSYGSIVTVLSIEGGGVRGIIPGTILAFLEEKLQELDGPEARISDYFDVIAGTSTGGLVTAMLSAPDDAGRPLFAAKDINKFYLDHCPSIFPQASKGPFGLMRSMMGPRYNGEYLHTVVKKLLGDTRVGDTLNNVVIQTFDIKLLQPTIFSTYNTMMDKSKNALLSDVCISTSAAPTYLPGHHFQTEGEDGTPRQFNLIDGGVAANNPTLLAMMDVSKQILMGNPDFFPIXPADYGKFMIL

SEQ ID NO: 166233 - protein, 179 aa, Triticum aestivum
  Clone ID: PAT_TA_60651.pep
IWPTVLPRDILQPPHQAPPAFAGRQSEFNAIVFQSQIWQTSLKQFIKNTTRDALSEAFAAAAHMGRRRCGGVSSRRKWPASGGLDPASSLTSSSWPTTQARWGGRNGALASGSSRIPTNSKENDCWEVSSGDAMGGRPPLRRAVVGGSGGGTSHGRRRPMAASCGLIGRGCSVIRKRPA

SEQ ID NO: 166234 - protein, 178 aa, Triticum aestivum
  unsure (1)..(178): unsure at all Xaa locations
  Clone ID: PAT_TA_60652.pep
RGRPVRVRRRGICIITKKDKKERQGKGGGCCRRPCGEAPWWCGPAEVLRLGFGAVLHLGARAAMAGGLGLGSGRCPALSNRGKGRPWRWSPSIVMAWLQKIQKKKKRGGGWRAYLWRLGAAARRRRRGPPHPIHPWVGVGLGFCPHPSIXSMGRVGPSWPTSRTSMGVGHPAGAALDC

SEQ ID NO: 166235 - protein, 84 aa, Triticum aestivum
  Clone ID: PAT_TA_60653.pep
HRFEISHLGMCAEFDYRNLIGKLVMRGNFSRKFYPARKNLLRFAGRSPASRFMCLSYMSNATRLFAIAATSCWMPCLCTAVCTL

SEQ ID NO: 166236 - protein, 177 aa, Triticum aestivum
  Clone ID: PAT_TA_60654.pep
MGVGMKRAREEEPVVSLALSLSTDSPATSTTTSESDSSTGAPAMVPRKRARRGRAVATSGEGEFVCKTCGRAFETFQALGGHRTSHLRGRHGLELGVGVARAIKQRKRQEEKQHDCHICGLGFETGQALGGHMRRHREEMALSGAMDWWVALSDQEAGHQHAADRPPVFARAVCLVS

SEQ ID NO: 166237 - protein, 248 aa, Triticum aestivum
  unsure (1)..(248): unsure at all Xaa locations
  Clone ID: PAT_TA_60655.pep
MASAPPPCAAPAVPRMKLGSEGMEVSAQGLGCMGMSVAYGPPKPDADMVALIHHAVAAGVTFLDTSDVYGPHTNETLLGKALQGGGVRDRVDLATKFGAFLSEDGWNVRGDPAYVREACEGSLKRLGVDCIDLYCQHRVDTRVPIEVTIGELKKLVQEGKIKYIGLSEASASTIRRAHAVHPITSVQIEXSLWSRDVEEDIIPTCRELGIGIVCYSPLGXEGVFSVXSKLADSLSDDDFXRKXLPRFQ

SEQ ID NO: 166238 - protein, 258 aa, Triticum aestivum
  unsure (1)..(258): unsure at all Xaa locations
  Clone ID: PAT_TA_60656.pep
MLASARSPAFRNSFRQFTKIRAAQTLSMAPTKRANSSSSSSSYVENHSKGPMLRWQDSLPRLPVPTLEETASRYLKTLHPLLSTSEYEASKKAVDEFVRPGGVGSKLQEKLVAKREDPKTKNWIYEWWNDAAYLSYRDPVVPYVSYFYSHRDDRRRRDPAKRAAAITTSVLEFKKQVDAGTLEPEYMKKLPICMDSYQWMFNASRVAAKPADHPVKFSAEENKHIVVIRKNPVXQIQHEIDGKQLNTSELEHXXSTSM

SEQ ID NO: 166239 - protein, 151 aa, Triticum aestivum
  Clone ID: PAT_TA_60657.pep
PAGSPLLTALLTLPDEGREWGRFSIITLISGYPYFHPLVSSWISENSFDVKKRAVASSTYNVIVQMGSVTSSQIYRKWDGPYYKTGNKVLISILCLSVVVFIAQRQWLVYLNKKKTELWEQMTPEQKVEYQTDKEQREIDGNKRLDFRFAY

SEQ ID NO: 166240 - protein, 248 aa, Triticum aestivum
  unsure (1)..(248): unsure at all Xaa locations
  Clone ID: PAT_TA_60658.pep
MGLFRPPKRTQTVLPDKPTKGHFFFAGKEFQRLQWWKRRNMRTLYFYIVILILTNTANGFDGSMMNGLQTLSYWQEYFNHPRGSVLGLFNASMSLGSLIGLFCVPYMIDRLGRKMGVIIGCLVMLLAVGLQSGARNFGMFVAARLLLGFGDCIVLGSAPLLIAEIAHPQDRAILVTLSGASYHSGAFISSXVTYGTLRIKSDWSWRLPSLXQSICSVVILGGIFWMXEXPRWLLSKIXHDEHSSAYSL

SEQ ID NO: 166241 - protein, 224 aa, Triticum aestivum
  unsure (1)..(224): unsure at all Xaa locations
  Clone ID: PAT_TA_60659.pep
MSSLPSNVHVSQHPCLVAKLSQLRSKSISPREVKSLIHEVSLIVSCEAFASSLKATEGSQDETPLGFQFKSTTVSPSTMCLVPILRSGLGMVDAVQTMLPVAVPVHHLGMYREPSTLDPVEYYNNLPQQSSSEKASSLAILVDPVIATGGTCAAAIQTLREWGAERILVLSVIGAXEGVQRVAAEWPEGCEVWIAGVDNELTSDGMLKPXXXXXXDXLXLTIGK

SEQ ID NO: 166242 - protein, 224 aa, Triticum aestivum
  unsure (1)..(224): unsure at all Xaa locations
  Clone ID: PAT_TA_60660.pep
MLPSFLLSSLLCLSTVSALPNPILAERAACDCTGTRDGGSNSKEYICRDARLGPLKLPRKLPLSTFVESYNRFGGLTPAQFLLTWTDEKGSYRYPPQNGFQLDAQGNAINGSMILPVGTMVDRFGSEYGSFISAAAAPYSQRALPPSNLATNPDTPDFPYNYHVYRVIKPLPVVGGPIAPWFGQPGLGAQFFTGELGNIKFLLEQSYXXXEDPKTLVHKSDGCA

SEQ ID NO: 166243 - protein, 292 aa, Triticum aestivum
  unsure (1)..(292): unsure at all Xaa locations
  Clone ID: PAT_TA_60661.pep
RPVRDGVRGGRERNRMKEFITNKRLMLSLADAGGRMMYSIKDLSELAGYTSRVYTLISTLHRVNADAYQVRAGQSELYSLSDVSGTIQKGFDGVRFEHVPVAAPGLWPQGGEELLESLSIIVRRGEHLLISGPNGVGKTAISRIIAGLWPVYRGLVSRPKDIGQDGIMFLPQRPYLSPGTLRDQVIYPDGHVDMKEKRKSEDDLIKVLEAARLGYLPDREGGWDXSKEWKDILSGGEKQRMGFARLLYHEPXYAXFVDEGVQRRVXVGREGLLYETCKEKGITLITXLTRAS

SEQ ID NO: 166244 - protein, 242 aa, Triticum aestivum
  unsure (1)..(242): unsure at all Xaa locations
  Clone ID: PAT_TA_60662.pep
MISRSTLARTAQQAARQSCRVQRRTYAAAASTGSYETSDASGLKIASRDAHGPTTKLAVVAKAGTRYQPLPGLTAGLAEFAFKNTQRRSALRITRESELLGGQLASSHSREAVVVEANFLREDLPYFTELLAEVISMTKYTTHEFHEDVERVLHHKQAALNADVAATALDNAHAIAFHSGLGSSILPSSSTPYQKYMNEXTLPAYADVAYAKSNIALVXDGASGDXLSQWVGHFFTMCPPPK

SEQ ID NO: 166245 - protein, 137 aa, Triticum aestivum
  Clone ID: PAT_TA_60663.pep
MSRLLTRRYTPSSLRVPITPRLSSTFQSRPGPPKLPAEEQAEFERLQRAASVSSAFQPTEKTAEVTGATPATSQIKHTTTPEKKTDDDMNVGYFRGAPPEFEGDVNPKTGEVGGPKNDPLRWGGESDWSYNGRATDF

SEQ ID NO: 166246 - protein, 133 aa, Triticum aestivum
  Clone ID: PAT_TA_60664.pep
PAAQARLPQPSPEAIASSADPCRLLNARAPVPLLLASSSTGLAVDRDHQAKPRHPLPPPRHPSSPIINLFLPLPVFFMQKLQRRLIVSSPASPWIQAPIAGGRHPAPGSAHLHSLRRHVHRSCRVGLLFQEPR

SEQ ID NO: 166247 - protein, 67 aa, Triticum aestivum
  Clone ID: PAT_TA_60665.pep
GHLPQNDMYDAERDFCKVHSAYREETMHLIEDECQELGLLTREEPRDHARRSLTVSIRSATRAIDSR

SEQ ID NO: 166248 - protein, 81 aa, Triticum aestivum
  unsure (1)..(81): unsure at all Xaa locations
  Clone ID: PAT_TA_60666.pep
MFAFVTSDSTAEIRELVSLDLGASGVWISLSRMVLDCGLTKVLVKVFWIEGHSLAANKDSSLEGIGLLSKRLIXPRKNSQG

SEQ ID NO: 166249 - protein, 118 aa, Triticum aestivum
  Clone ID: PAT_TA_60667.pep
RRAPPLSPAWPRSCSSRPPRRPRRLRRTPGCGRTGTTPGAAGLTRGCCRGGTCRSPTPPPWDLVLCSLSRTPLSEVSNLNPRLLGRAQRMHIIARQRQAVAAHGHELLLLRRSLQRTA

SEQ ID NO: 166250 - protein, 250 aa, Triticum aestivum
  unsure (1)..(250): unsure at all Xaa locations
  Clone ID: PAT_TA_60668.pep
RPGSGNPTKSILGEPNKLHLEGTAKGPFNSHNPYIAPIAESYELFSAKDRNCLHMEVDISGSNLKYETGDHIAIWPTNPGEEVNRFLDILDLSGKQHSVITVKALEPTAKVPFPNPTTYDAILRYHLEICAPVSRQFVSTLAAFAPNDSIKAEMNRLGSDKDYFHEKTGPHYYNIARFLSSVSKGEKWTTIPFSAFIEGLTKLQPRYYSISSSSLVQPKKISITAVVESQXIPXRDDPFRGVATNYLFAL

SEQ ID NO: 166251 - protein, 226 aa, Triticum aestivum
  unsure (1)..(226): unsure at all Xaa locations
  Clone ID: PAT_TA_60669.pep
MSDNVDKETTPEIDSPITKVEITPTKIEIEKAPEVPAIPQNDNVAHALAGAGGGLLSMILTYPLITLSTRAQVESKKAESKFSEAVGNIIAREGISGLYSGINSALFGISITNFVYYYWYEWTRGFFEKAAAKAGRAGSKLTTVESMIAGAIAGSATVIITNPIWVVNTRVTTRQQEKKKDVEXGESSQPAKAPSTIGTLLLLPQNEGPQALFXGVIPALVLVINP

SEQ ID NO: 166252 - protein, 210 aa, Triticum aestivum
  Clone ID: PAT_TA_60670.pep
AGSRPGRCPGKKKKKKKKKKNLPYLARGAVEPAYAQSRRACLDSARMVIQAETQMEEEDTMFKATRLRLCLALHSVFIASIVLLLDFCLGVDADEKEQRRQDLAEAWNILETAKEHSRPTARIQDLLRQVMKKHKVSLPVVKAKERHHPRPVGKTLPPTPNSSTAIMSTGTTPSDVGVSSSQELNDLGFNMDLDGMDWESLLWGLEAPMF

SEQ ID NO: 166253 - protein, 248 aa, Triticum aestivum
  unsure (1)..(248): unsure at all Xaa locations
  Clone ID: PAT_TA_60671.pep
MLGSSSTFVLLLITWLCLVIQLGSAAEEAKHGLGQKLHQLTNPDSSEHCVDIVAVHGLDGHWKRSWTATNNAFWLQDLLPVEIPCARIFSYSHDSRTRGSETPLDWDISDHATALLTTLSTERRLTQTERNPILFIGHSLGGIILKAALLKAELARVGHLEHFKAIKLSTYAVVFLGTPHQGGEGIPLVEVLCRISSIVSHTNTKILSKMERNSEWLXGLQSDYNAISQDIETIFFYTQMDRNENLLR

SEQ ID NO: 166254 - protein, 38 aa, Triticum aestivum
  Clone ID: PAT_TA_60672.pep
PCRERGALGGRMMAVNRTARLATVANYDPTIFDKIIKK

SEQ ID NO: 166255 - protein, 131 aa, Triticum aestivum
  Clone ID: PAT_TA_60673.pep
MIQLKTMLNCIDNSGAALVECVLVVGQKRHARIGDRVVVVVQEQRGSSSGGMAGMSAANKVKRGDIRHAVVVRTRYPTQRPDGSIVKFDDNACVLLNKAGDPVGSRINGAVGAELKRKKWSKILSMAPMQA

SEQ ID NO: 166256 - protein, 60 aa, Triticum aestivum
  Clone ID: PAT_TA_60674.pep
RPVRDAVMGTKAVLLRSRDITVEQGLEHVATWNSGMLRSNDLMEAIKAFMEKRKPVFSKL

SEQ ID NO: 166257 - protein, 159 aa, Triticum aestivum
  Clone ID: PAT_TA_60675.pep
MESGPTELAATIQAASIEHNPDAKLDTNPRTAADKRQPMTLEQDDGIDEDDDEEEDIPYSVLRPAPRHSNLPPLPDLRFEQSYLRSISKADTWWKVALITTRDQILMPLTQGLAYNLFLCGWQHWNRNAQLHGNTVGARVRRWWWGVNNWHIPTHRKRA

SEQ ID NO: 166258 - protein, 211 aa, Triticum aestivum
  unsure (1)..(211): unsure at all Xaa locations
  Clone ID: PAT_TA_60676.pep
MAAGAQKLQVLVASALLLLLAVGCQASPLQIGFYHDRCPEAEAIVKGVMMEAISQNPGNGAAMIRMLFHDCFVEGCDASVLLDPTPFSPTPEKLSPPNNPSLRGFELIDTIKDALEAACPDVVSCADIIAFSARDASCILSASKVDFEVPSGRRDGTFSNASEPLKFLAPPASNLSDLVDSFVVKGLDVEDLVILSGAHTIGRSHCSXFVP

SEQ ID NO: 166259 - protein, 265 aa, Triticum aestivum
  unsure (1)..(265): unsure at all Xaa locations
  Clone ID: PAT_TA_60677.pep
MTLSQAVLQLLSASLALGQMVYNEVEGPTERPQCKTRETKEPTYTHTPFSYTLTETVRYATSVPAPTTTTTYADPPESLISLVPSLSFTTWGKWDPNATTKASDTDDPYGQAAWTALWEHANPPNFTEKAVYSTTVSPTPIPSSELILPPRDYFGPEDCYNFPKNFSFGVASSASQIEGATAEEGKSPSLMDILVRDDGGKDYVTNEHYYYYKQDIERVAAMGAKHFSFSIAWTRILPFALPGTPVNXEGIDHYNDVINFILEKE

SEQ ID NO: 166260 - protein, 212 aa, Triticum aestivum
  Clone ID: PAT_TA_60678.pep
MSFFKAAAAAGLLIGAANATPHYAAYGNGTEYTTEVVTAITTYCPAPTTLTYGDKTYTVTKETTLTITDCPCTISHPLKPTKPVIPVPPVVYTTEVLTAITTYCPEPTTLTHGNKTYTVTKPTTLTITDCPCTVTKPQTEHYPQPTPGKPGHPGKPEIPAPHPTAPAPGKPEYPQPGHPEAPHTTGPVPVNPTGSSPPEGTTLSSLLLASPL

SEQ ID NO: 166261 - protein, 95 aa, Triticum aestivum
  Clone ID: PAT_TA_60679.pep
HLLHLSQRYPPLGRQFAESNIVALSPISTATNCTSSYHRLRPDQSHLSAGSIPRSTRSTDVYRENLNSLAIPCSSHNSAAIDISFSFFKTGCRFL

SEQ ID NO: 166262 - protein, 188 aa, Triticum aestivum
  Clone ID: PAT_TA_60680.pep
MTPALEHEDAIAQDPQAPAHSSNHKHRRTMTSTDEIDSTIIRPGSVKINVKGAFIVDPDTATPASTSGASAGAVNSINGRMSPTHPETSDIRLPYHTAIVSHIAIDIGGSLIKVVYFSREVDSTDPGGRLNFQSFETDRIDDCVEFMRHLRDNQLVNGSQPGELCVMATGGGAYKYYDKIRAALEVDV

SEQ ID NO: 166263 - protein, 130 aa, Triticum aestivum
  Clone ID: PAT_TA_60681.pep
MFARGIRAVSRRAAIAAPLARPTILPATRQIAPAVAVNSSRSYHEKVLDHYSRPRNVGSMNKKDADVGTGLVGAPACGDVMKLHCSMLAEDAIKSAISDYYTKNPNAKVSNLSGTGMKLPEADAPAAATA

SEQ ID NO: 166264 - protein, 203 aa, Triticum aestivum
  unsure (1)..(203): unsure at all Xaa locations
  Clone ID: PAT_TA_60682.pep
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAENRVVSYEAGKALADDIGIPFLETSAKDATNVEKAFMTMAGEIKNRMASQPAASGASRPATVQMRXQPVSQQSSCCS

SEQ ID NO: 166265 - protein, 155 aa, Triticum aestivum; identical to SEQ ID NO: 105868
  Clone ID: PAT_TA_60683.pep

SEQ ID NO: 166266 - protein, 264 aa, Triticum aestivum
  Clone ID: PAT_TA_60684.pep
MSQPYGAISNGESRAENGISTQNDETQPLLAPKPGSRSWLRTRLGADVRRDWADVMLLSCYIITGILDSASISTWGAFVSMQTGNTVYLGLGPTAGTNRWKKSGTSILSFCIGSFLFSRLHRAFTSSPRRKWVFCLSFGIQTAFIVAAASILTWGPKGAGPDDVPWYVIVPIALVAFQSCGQAVASRALKFNALTSVVLTSIYCDLFSDAGLFTASNVERNRRVAAPVLLLIGAIIGGIIAKSELGNSGALWIAALLSYSSCLD

SEQ ID NO: 166267 - protein, 208 aa, Triticum aestivum
  Clone ID: PAT_TA_60685.pep
MATSAALSTAANPTQLCRSRAALGKPVKGLGLGMGRERASQRSITCQAASSIPADRVPDMEKRKLMNLLLLGAISLPTVGMVVPYGAFFVPAGSGNGGGGTYAKDKLGNDITVEEWLNTHGPNDRTLAQGLKGDPTYLVVEQDKTLATYGINAVCTHLGCVVPWNGAENKFICPCHGSQYNNQGKVVRGPAPLSLALVHADVDDGKVL

SEQ ID NO: 166268 - protein, 253 aa, Triticum aestivum
  unsure (1)..(253): unsure at all Xaa locations
  Clone ID: PAT_TA_60686.pep
MSSENKEVDYSLANPDTLTKYKTAAQISEKVLAEVSKLVVPGAKIVDICQQGDKLIEEEISKVYRGKKINKGFSHPTTVSPSSYVTPYTPLTSDEAEAGAEIKDGEAIKIQLGAQIDGFGSIVCDTIIATPEDKAGDKITGRTADLILANYYINEVLLRLMIPPGTLAQGSDEEKAKAAAQKAPTQAKITSLLEKVAKTYEVNIVESTTSWLFDHNEIEGSKKIVLSPAEGTKGEGVPXIGEVWGVEVGVSLG

SEQ ID NO: 166269 - protein, 216 aa, Triticum aestivum
  unsure (1)..(216): unsure at all Xaa locations
  Clone ID: PAT_TA_60687.pep
MVLIKSFVLGALAATVAAKSAVIELLPSNFDDIVLKSGKPTLVEFFAPWCGHCKKLAPVWEDLANTYESAKGKVQIAKVDADAHRELGKRFGIQGFPTLKFFDGKSAKPEEYKSGRDLESLTTFIAEKTGVKSKKKLEMPSEVTYLNDATFSKTVGSDKHILVAFTAPWCGHCKTLAPTXEDLAATFANDKNVVIAKVDAEAPTARAPPSSRVSSP

SEQ ID NO: 166270 - protein, 109 aa, Triticum aestivum
  unsure (1)..(109): unsure at all Xaa locations
  Clone ID: PAT_TA_60688.pep
RICGYAVQRIHPVLSMFDRSTYNMQNDIIYVFAPPAPTTCSIDKGLDMNLLQYRAFFGKFGKTPDGTTYVILNDRGARLVEGTVDADLXDMSPRNPLRDLLNLHPDLQE

SEQ ID NO: 166271 - protein, 179 aa, Triticum aestivum
  unsure (1)..(179): unsure at all Xaa locations
  Clone ID: PAT_TA_60689.pep
MAPSLETPESIDDVFANPIKQKPQLVAPEPQNCVGPDSQQAGKADSCAGCPNQAICASAPKGPDPDIPVISARLENVKHKILVLSGKGGVGKSTFTSLLAHAFATNPDSNVGIMDTDICGPSIPKMMGVEGETVHVSGTGWSPIWVMDNLAVMSIQFLLPNRGXDPVIWRGPKKNGLIK

SEQ ID NO: 166272 - protein, 152 aa, Triticum aestivum
  Clone ID: PAT_TA_60690.pep
MDHGRDPCPYVILNDFGGAFCMGAIGGTIWHGIKGFRNSPYGERRIGAITAIKMRAPVLGGNFGVWGGLFSTFDCAVKGVRQKEDPYNAIIAGFFTGGSLAIRGGYKAARNGAIGCAVLLAVIEGVGIGFSKMLAGSTKLEAPQPPPQEATL

SEQ ID NO: 166273 - protein, 107 aa, Triticum aestivum
  Clone ID: PAT_TA_60691.pep
RPGRDCVFPSHTSRSLEYRAQLTVTDPNAPKRGLSAYMFFANEQRENVREENPGISFGQVGKLLGERWKALNEKQRAPYEAKAAADKKRYEDEKQAYNADQEEEESS

SEQ ID NO: 166274 - protein, 131 aa, Triticum aestivum
  Clone ID: PAT_TA_60692.pep
GSWLGSTRRGTISALPLGCGASHSSPESDSHPTSTPGGGRTVNTSWRYHAARHAPPRRGCGGGSHANHLSLTAYHMGVTLHSCSRATGFTLMRTATEAYDSCTCMISGGSAPAYTKTGKTPSHAANSRMSY

SEQ ID NO: 166275 - protein, 241 aa, Triticum aestivum
  Clone ID: PAT_TA_60693.pep
MAAANTLFPYLRKDPSQLPEGEDPFTITTRTGYLPFSLPLTKLPSQFDPVSDLLNDIPIQKLDGTPGLLATFELGPLIDNGGLPDLTSEIDNLVVPGTDKKDMAAITAAFRDYSFIASSYLLEPCWEHYSKSDDGGYGLGRQTLPKCIAGPLVKCAEILDIPAFMSYAASYALYNYWLVHPEQGHDDYDNIRLVRAFEKGLDAKSSEAGFILTHIHMVAQTGGLIEGAVDLLTAAEKTTAL

SEQ ID NO: 166276 - protein, 152 aa, Triticum aestivum
  Clone ID: PAT_TA_60694.pep
MSASSARGHYANPPLEDEDDLIDPDDADLNDFDDPLATNNPRQPLTGNIGSSSSSRPLNEGYLTSRIPGEDRAAPLNTIDESVWDTLRRDLLAVWAKLREVLYPRYLLGGTMFDSEGGIRGAYSSIRGAGLSGTREELTGLASRMVDAETLL

SEQ ID NO: 166277 - protein, 140 aa, Triticum aestivum
  Clone ID: PAT_TA_60695.pep
MTATPDSEFPCSITLNVPFPTARLAATALKAIQVDPELSPLVRRQLTVVPAPASKSTQGSPNGQDADVDADARFLEVQYRATTNRMLRVAVNGFMESLKLVVEVMEQLDTDVLAQHINNMILPSIITINVIMEKKKKKGP

SEQ ID NO: 166278 - protein, 132 aa, Triticum aestivum
  Clone ID: PAT_TA_60696.pep
PAGLRLDSQSTTKTVGFAPKSNGNDHSLLNKTAFTFPTVPFQERPTSAYNSASSLHRPVPTAVKIKQHDRSCTPHKTLEPQLLRLEILRPHPATSPHCNKTSPKLPHPHPLTLRHLELDDGSATPVFASLPR

SEQ ID NO: 166279 - protein, 100 aa, Triticum aestivum
  Clone ID: PAT_TA_60697.pep
RPVRGPPRFVVHTTPIPSPPPPSPRRRRPLFIPRSIPSPLAAAPLPTLAARRPPLPPPSQTPRLRARRSRQSRRPPRFKLDTSVLYCDRRCPCLPTFVFY

SEQ ID NO: 166280 - protein, 196 aa, Triticum aestivum
  Clone ID: PAT_TA_60698.pep
MAENVMAAYWDLPAISRNLITALVLTSVTCKLNIVSVYSVLYHPTYLWMFPPQIWRLVTCFFVELNPINLLMNSFFLYRYCTQLEMGNARFPRKVDLVFYILFVCSVILMIDYVTGLNSMLYLNGIILAMAYTVTQDQRGQKTQFLVLTIPAQTLPLCMIVVTALMAGPSAALVEIEGLFAAHLYDFLARIWPEIG

SEQ ID NO: 166281 - protein, 236 aa, Triticum aestivum
  Clone ID: PAT_TA_60699.pep
MASPTTTNLPSRATTGFSTQSEDAIPEVDPSSTAGLLAERLQAWKHAVGYIEEYMKAMERIHGHHAKEYEKALKAISNPLKEGHHFDQSLGGMAGFFENMRSNTQSLINTNIETEKSIKGSVLPVLERLHKEIKHKAKELAHGAEKGAKEVEKARNTTQKQIELLGQHSASFDSAGGHLNSNDDPYVVYRGVLHRLNSQVIAENNHRNDLIAVQNNFHAFETHIIEVIQQAMEAFT

SEQ ID NO: 166282 - protein, 104 aa, Triticum aestivum
  Clone ID: PAT_TA_60700.pep
AGRAGHDQVPLKTSGGQVRITDSKNFPISKTIAAAHAIIDPGAIREMHWHPSADEWSFFIKGRARVTIFAAEGTARTFDYVPGDVGIAPRNMGHFVENIGDEPI

SEQ ID NO: 166283 - protein, 146 aa, Triticum aestivum
  Clone ID: PAT_TA_60701.pep
MNTLRPLRGGCQCGRNRYIIAVPQDGINEAQVLFNTDSAHQTSLATPLAAYIRVPLSWYHSTTYSFFPDETHALIRRVYTHPSQEHSKRHFCGYCGTPLSYWSENPQTEADFINLTLGSLLREDLRDLEDMGLIPEEGDSNLTTQA

SEQ ID NO: 166284 - protein, 72 aa, Triticum aestivum
  Clone ID: PAT_TA_60702.pep
EYSIPQIIPSEGFKRDPGATLCEAVDGDKATENSIAGYEINQSRMILFYEVLGLAKNIWELPAKFKICHTDC

SEQ ID NO: 166285 - protein, 84 aa, Triticum aestivum
  Clone ID: PAT_TA_60703.pep
FISVASANRVCSLTHAKGKKKTLAHFIPTHSPRTPPQLCISSTSIAAATLSSTAVVGRRRSRSKRHGISSLPLSAAYLHRHFRL

SEQ ID NO: 166286 - protein, 74 aa, Triticum aestivum
  Clone ID: PAT_TA_60704.pep
CEKTTEGENDDELVPGDSKPKLDLQSDNKKGIQVQLNLKSNGNGSSAKKAPAARSKAPGSAGKAVGGSGGKRKR

SEQ ID NO: 166287 - protein, 62 aa, Triticum aestivum
  Clone ID: PAT_TA_60705.pep
LGFFDGGAELQSAPTERSLGRRLVYWTISFVTLGNYGYGNGMALEDTSIAHDHLSEHSSSTF

SEQ ID NO: 166288 - protein, 135 aa, Triticum aestivum
  Clone ID: PAT_TA_60706.pep
MNITPICSSNSKLQAGRKEEESYKQTADCRAKLAALTRKLSSLFILPLLSSSRSRVDAAARRRQKGTAARRRQKGTAARRRQKGTAARRRQKGHHLLPITHDLISRWCSPAPLPTPLLPWCLAKPYGIATLLLHH

SEQ ID NO: 166289 - protein, 65 aa, Triticum aestivum
  Clone ID: PAT_TA_60707.pep
QLVNLAEVRSPGKPTLYSLLSTMEFSKKGGRLHHDDLKQRNEDINVMNRPLRGEQLRPRTLTRIS

SEQ ID NO: 166290 - protein, 81 aa, Triticum aestivum
  Clone ID: PAT_TA_60708.pep
LFWLFALRIFIIFQTVFSTRQQYLVRQVLQFGPYKGRRFRAIRYAALSRAHQSFRILFDALCRHWPHATQCHGSRCHHPAY

SEQ ID NO: 166291 - protein, 91 aa, Triticum aestivum
  Clone ID: PAT_TA_60709.pep
LTGGSMRGPQSSLSVRKLAGSRFCGVSSPSPTASSPPAARGDDSWRFCGGVSKVLFVIFPFMGSFLQSVRTSGASGAFWLGLSVCGCNYVS

SEQ ID NO: 166292 - protein, 35 aa, Triticum aestivum
  Clone ID: PAT_TA_60710.pep
SNLLKTLVFIMERSIGQTTSSESQRDRPDGCLCQG

SEQ ID NO: 166293 - protein, 111 aa, Triticum aestivum
  Clone ID: PAT_TA_60711.pep
CDDGCKRRQRSSCRPCRRCCLGQCRGHPAKIEDAHAKIFQATSKSSMQPTSKKAPVAMEHLLPHEIIERELEMQEAAEIEERREEELRVAEVEVEKSLSVEESVMEYQREL

SEQ ID NO: 166294 - protein, 89 aa, Triticum aestivum
  Clone ID: PAT_TA_60712.pep
MKGMAQRPHTRNHHRHQAPPSPPPPKPPPPPSPPPPKPPPPPSPPPPSPPPPKPPPPPSPPSPKPPPRSPPPPKPPPRPPSLCQIGVTG

SEQ ID NO: 166295 - protein, 144 aa, Triticum aestivum
  Clone ID: PAT_TA_60713.pep
GRPARRHRRGYTLDNLKGISPTLCQHKINMEHDAKPVVDHQRRLNPKMKEVLRTEILKLLKEGIIYPIVDSRWVSHVHCVPKKGGITVVPNDKNEFIPQRIVTGYRMVIDFRKLNKATRKDQYALPFIDQMLERLSKHTHFCCL

SEQ ID NO: 166296 - protein, 81 aa, Triticum aestivum
  unsure (1)..(81): unsure at all Xaa locations
  Clone ID: PAT_TA_60714.pep
TDSSHLSESTKIAWRGTKCSWNQTKFAPLDTDVHLGXWKIASTGGGRDKAGLFRPDEIKRNRGWIVICASRVAILLIREPL

SEQ ID NO: 166297 - protein, 92 aa, Triticum aestivum
  Clone ID: PAT_TA_60715.pep
ISNLAYPIMAIAHEGIASLAVDLHEVGDLLALTNSLVQPHNLVGGSQVTPSQSRRHHSPRSSKWCVDDELLALVLQMIVSPTLKSLSSVVFS

SEQ ID NO: 166298 - protein, 59 aa, Triticum aestivum
  Clone ID: PAT_TA_60716.pep
SHPLLTALFVSFCFHCSTFLNKQYIALAYYCFNCFIYIHMFISRHVATVHFGTANAPGA

SEQ ID NO: 166299 - protein, 69 aa, Triticum aestivum
  Clone ID: PAT_TA_60717.pep
VAKSYLICTSHPPGAYIFLQSIHCTECMPPDLPNSLNASKSIAHYMELIIHFLIQRRKHRVQLNYIQEA

SEQ ID NO: 166300 - protein, 115 aa, Triticum aestivum
  Clone ID: PAT_TA_60718.pep
RRKLQQIVLLTLRCFEITHSVFLSVLFVIRCSCCSFLLIVILFFQNRIEDNKIKLSPVTQSTGNSSKIWQRSTSNSTDSNLLTSRQDDVLSSGPRIVVSLADEDGVSSDEESSYA

SEQ ID NO: 166301 - protein, 64 aa, Triticum aestivum
  Clone ID: PAT_TA_60719.pep
RREQERSFRRRFPHFEATMMIYKKMDEIYNMSFTNFVHRLLLVLCHLSFGLAHVFSKYLSFGYF

SEQ ID NO: 166302 - protein, 71 aa, Triticum aestivum
  Clone ID: PAT_TA_60720.pep
DTMMLNYKGKNLTKTERLHAYLTTTKKQQPAEHERNEDQATGDHAQPEPQNRSTPMTTIDVDRKNQVLEGN

SEQ ID NO: 166303 - protein, 83 aa, Triticum aestivum
  Clone ID: PAT_TA_60721.pep
LLWSIKSNPPSLLLYFKRLVHVAWNMDGPHLCKHLCSFLMRVCVCTCMGRAIFNIFIFILQMPSRTLHKNIKLCSIFVADNKI

SEQ ID NO: 166304 - protein, 138 aa, Triticum aestivum
  unsure (1)..(138): unsure at all Xaa locations
  Clone ID: PAT_TA_60722.pep
LREDDRRELTTAGCTDAEKVCFAAHQLDGPAASWWENFTTTYPIDTVTWDQFQQAFRTAHVPAGAMAMKNREFHNLHQXGRTVGQYVDVFSKLARYAPDDVATDAAKQEKFLEGLNDELSMQLMVATFNNYQELVRIS

SEQ ID NO: 166305 - protein, 59 aa, Triticum aestivum
  Clone ID: PAT_TA_60723.pep
KTTEGIPQVATLLGRAAEACGRLGTTLTSSPNPTCVLWSKKNHRESFIPFGLRLVFLFC

SEQ ID NO: 166306 - protein, 67 aa, Triticum aestivum
  Clone ID: PAT_TA_60724.pep
VHQPGIIGKVGSILGTMNLNVNFMSVGRIAPGKQAIMAIGIDEEPDKEALKLIGETPSVQEFVFLKL

SEQ ID NO: 166307 - protein, 69 aa, Triticum aestivum
  Clone ID: PAT_TA_60725.pep
VLTEKNTSLSQELEECKAQLRAAAVGMEESKKASSGNTCLDKKERIYVYQLVFSMFANLTIDSADNPGV

SEQ ID NO: 166308 - protein, 37 aa, Triticum aestivum
  Clone ID: PAT_TA_60726.pep
KSGPVPMHWSFFSAANSQALFNKSQYLTSHNVSMILL

SEQ ID NO: 166309 - protein, 134 aa, Triticum aestivum
  Clone ID: PAT_TA_60727.pep
QVDCGRGRSHCHPAASRVTGWQTRLSMSLPAPSWFSHGRRGFDHAHVQHFACCPGGDEPGRPASRRLLPMLGWFDCNMRVVLRSIWFDCIFSKCRLKTLVSPKNMLWGTFLATKYMPSSSLNNIVDNYHDTCVY

SEQ ID NO: 166310 - protein, 98 aa, Triticum aestivum
  Clone ID: PAT_TA_60728.pep
ILVTRRKILNFCYVPQQSSPDQLGRKEDPHDGSRMGHFRQPMTYTRKIPQDLARKTTTLLNPRPLMHYINRDYASQYDILYSLQQYRGRYRYYTIPNI

SEQ ID NO: 166311 - protein, 91 aa, Triticum aestivum
  Clone ID: PAT_TA_60729.pep
GGRGKGRELPLGWVYSPISVRGVVFFFFFLCFHFPCLHARSSSSILFFHLLLSFFLSFLCRHNKEIMREHPYLSSASASIHPQKKKKEKEK

SEQ ID NO: 166312 - protein, 120 aa, Triticum aestivum
  Clone ID: PAT_TA_60730.pep
TLSRYKLATGSFYLQNLQHQLPCRVHQPSPQSTASPCQTLACSDRKTRVIILSRDNQQAEPSLTSDQHTRSYTLGSCQNAVHRLLFKFEEHSCCMGMPGLQSRVLFGSDILTCVIAAVSA

SEQ ID NO: 166313 - protein, 86 aa, Triticum aestivum
  Clone ID: PAT_TA_60731.pep
LSLINLVCSVFLFGVILWPCHLGNHPHSPSPSGSSFSKHCQDRVTSLLDQTLISFFRNIYFSIKGITLSTVGCKATHISVHPKIPK

SEQ ID NO: 166314 - protein, 100 aa, Triticum aestivum
  Clone ID: PAT_TA_60732.pep
TMQASLGISVHTRNSPTMHGLASLLMVHTRNSPTMAWLGLATRNSTTNSQKKLVLRRHILLEIPEIMNGPTLLCRKQIYTYKGIHDFPHTYSLRKKNIRA

SEQ ID NO: 166315 - protein, 76 aa, Triticum aestivum
  Clone ID: PAT_TA_60733.pep
MGVKSLKIQGLTMRVRWEWIRRTDPTCPWPGLHLMVDKDAKVVIDSMVLIKVGEGSKVMFWTDRWIHDFAARISPP

SEQ ID NO: 166316 - protein, 76 aa, Triticum aestivum
  Clone ID: PAT_TA_60734.pep
HFFQIWSRSRLDHSTTTICSTACSMLQQRLPIISYIILSIQECDTWLLLLHIFCTKLKYSHSGSSNKSSYHVLLLL

SEQ ID NO: 166317 - protein, 126 aa, Triticum aestivum
  Clone ID: PAT_TA_60735.pep
FTGRPAARRRHKGERKTVVADDTMPSGHEVYAGDAIYISLYSMGRMESLWGKDCLDFNPDRWLLGDSNKLKYVPSNKFLAFNSGPRMCPGKEIAVVQMKTIIAAVVWNFDLELVEGQSIQPKLSCL

SEQ ID NO: 166318 - protein, 44 aa, Triticum aestivum
  Clone ID: PAT_TA_60736.pep
LIKGPYASTRCRGRGSSSFSKKKTPQIKTKQGPGGGSGISVHRL

SEQ ID NO: 166319 - protein, 63 aa, Triticum aestivum
  Clone ID: PAT_TA_60737.pep
IIQIVLHNLARQPYIVLHVGTFFHSATAHSRHTSGHQQMCHDQTNRLQKLSKTVMGRPGYSRP

SEQ ID NO: 166320 - protein, 89 aa, Triticum aestivum
  unsure (1)..(89): unsure at all Xaa locations
  Clone ID: PAT_TA_60738.pep
MLWRTIRSMEVMAHSSSFLLPKLHQPAKTPANNYTLVVLNQQLPRFMPRLWAQXAAKMRICADGGANRIFDEMSQMTNDLDRNRYIPEI

SEQ ID NO: 166321 - protein, 103 aa, Triticum aestivum
  Clone ID: PAT_TA_60739.pep
HLEKSPTQSQGKQRIRPRTGTGMDLAHIGMTTATAATKLRNAALDGKHLTPPPTGTPEHRESAGISTKLDQKLTKKGGGGRKIAGRKCEHGREPYLQPAALRT

SEQ ID NO: 166322 - protein, 99 aa, Triticum aestivum
  Clone ID: PAT_TA_60740.pep
MSPQTETKAGVGFKAGVKDYKLTYYTPEYETKDTDIVAAFRVSPQPGVPPEEAGAGVAAESSTGTWTTVWTDGLTSLDRYKGRCCHIEPVGGENSQWVC

SEQ ID NO: 166323 - protein, 68 aa, Triticum aestivum
  Clone ID: PAT_TA_60741.pep
VILRTFIFCTINNTMAVLLKTTSVQVSFIQIMQVRVQNKGKKCLEKSIRWRRINSPKLKPLLVLKQFS

SEQ ID NO: 166324 - protein, 78 aa, Triticum aestivum
  Clone ID: PAT_TA_60742.pep
DIDGNFLSCNLMLYLYHHFIMPRELKYYPRGCLLSIGCFLQERPQKMHRQYNFFVSDMDSLNLTECFSKSVRKLHADR

SEQ ID NO: 166325 - protein, 94 aa, Triticum aestivum
  Clone ID: PAT_TA_60743.pep
YNIIWYLRIDPFAIMVPAMFSFKYHFPDKLKYLSSADLCTCPTFTLIYHRVLHSGISKISWNCITSYGFFINCYFSPIPIFLGSGLSSTESTDM

SEQ ID NO: 166326 - protein, 76 aa, Triticum aestivum
  Clone ID: PAT_TA_60744.pep
NTPTTKVLLLAEQLLLASSARFLSQKRDSQKIDKENHPMANQDVVRWLGGQCYFQPTRVQVVLVFAFIFEFISVFR

SEQ ID NO: 166327 - protein, 60 aa, Triticum aestivum
  unsure (1)..(60): unsure at all Xaa locations
  Clone ID: PAT_TA_60745.pep
DARRRQKGDSSKSWRQAGSDGSSQLKLKEPSTNVVLADHVTTKKWXQVVDFDDHLDDISK

SEQ ID NO: 166328 - protein, 84 aa, Triticum aestivum
  Clone ID: PAT_TA_60746.pep
VTITVYDWDNVCKRKVIGSVTIAILAEDETGAVWYDLDSRSGQVGYAFMNNKSAFLISVPHHSRHRMYNPAYNTKYLVADLLAY

SEQ ID NO: 166329 - protein, 70 aa, Triticum aestivum
  Clone ID: PAT_TA_60747.pep
FFLDLCFVYPSLPWGPLPASRSASPLSGHPYLRPASALCYLPWSVEMDEDELALQSALVTTVEGNRSGVS

SEQ ID NO: 166330 - protein, 137 aa, Triticum aestivum
  unsure (1)..(137): unsure at all Xaa locations
  Clone ID: PAT_TA_60748.pep
TLRKSFKQFLGVQVEAFSERYLGLPIAVGKINSGTFEYLADRARGSTQGWAERLFACTSRETLLKSIVQAILTFNMSSFLLTXKVCKSFTSSMAKFWWGSSIDRNSLHWIAWDKLATPKCKGGMGFRNFRLFNLALL

SEQ ID NO: 166331 - protein, 48 aa, Triticum aestivum
  Clone ID: PAT_TA_60749.pep
KYTRDRGLEYKARYYVFKLSLSLSLLISTFILLTFPLSRSGSETDDYD

SEQ ID NO: 166332 - protein, 91 aa, Triticum aestivum
  Clone ID: PAT_TA_60750.pep
MGHHFGLLRPVGYLAQSGPNLTFGLLKSHVFYGLEIFTPVNGLFLLRAQIMFRPVKGQLRAHAYQKNMKAYADLGPYIFSGYMPILARSRF

SEQ ID NO: 166333 - protein, 69 aa, Triticum aestivum
  Clone ID: PAT_TA_60751.pep
IDSQLRVCVFVKGPQLHVNHQLATRGCVCCRCPQLQVEHRLATKGAFVCLSRVPSCMSIIDSRLGVCVC

SEQ ID NO: 166334 - protein, 100 aa, Triticum aestivum
  Clone ID: PAT_TA_60752.pep
GVFRQTIAGNILVGSYCAFSNTGGLVHPHTSIEDLDDLSTLLQVPLVAGTVNRGTEVIAAGMTVNDWTAFCGSYTTATDLSVIESVFKLRERQPATIVDD

SEQ ID NO: 166335 - protein, 42 aa, Triticum aestivum
  Clone ID: PAT_TA_60753.pep
GYRSIIGGTDTVTHTVTRLQLSRRRRRPARVALRRSLLTDTG

SEQ ID NO: 166336 - protein, 83 aa, Triticum aestivum
  Clone ID: PAT_TA_60754.pep
WRAAAGTAMIDHDDGWFGEQRPHQLLSKSWSAHAGCTSQGKVTLPLAISHGYTSKPAQRARSLFRIDGSTIDLLTANRVTVTS

SEQ ID NO: 166337 - protein, 104 aa, Triticum aestivum
  Clone ID: PAT_TA_60755.pep
DLGGNTIKLRWYRRKSNLHKVRPTTVSGSQLHDPFIYSLSTIVVVYEGVVFPNYHVWDSDVITEAMKDFFNIEEYAMIESIQRNITVCYLTSHLCTAFCAITSA

SEQ ID NO: 166338 - protein, 83 aa, Triticum aestivum
  Clone ID: PAT_TA_60756.pep
CISVNTSLHPALFFPCSYSTLSHPPLWMNSETPRDLTRGRNKHPPSIHPSIHHKKGKISLATVHSICTRHSMFCYIRASTSPR

SEQ ID NO: 166339 - protein, 92 aa, Triticum aestivum
  Clone ID: PAT_TA_60757.pep
EGLHSSGPTNSLWFNKREASVQAPEDRFLDQDRPSKSGMIYNTSYNICHSTINNIQIVFIFVIVVTPLDFRCLLLNLSPSVVVSCPPALICA

SEQ ID NO: 166340 - protein, 72 aa, Triticum aestivum
  Clone ID: PAT_TA_60758.pep
RNGDQSIVDAKLLEHPIDQLHLYVRILFGGRIEGPFRILGLWSRAVYIFYGPAQFLRQYHKMRYLTMGMWIR

SEQ ID NO: 166341 - protein, 124 aa, Triticum aestivum
  Clone ID: PAT_TA_60759.pep
SRKKMDTPEMTVVASVHAGNGEALGGALCSLSLKEEGETEEGKGWRRREGNPRGAGCWIYRRARKHRGVAVKPRWPCVGTPRGFTVREKRSGGGRKNRGRRGCRWGLDGCPMWIHHGRERGGLR

SEQ ID NO: 166342 - protein, 83 aa, Triticum aestivum
  Clone ID: PAT_TA_60760.pep
REISNSNRGDVASLTRDYCSLIIRVSQISSTTRNLVPRFMRGSEGEGIWLRNSNERSESWLLFSKRSIHNVDVFISLLQVIMM

SEQ ID NO: 166343 - protein, 98 aa, Triticum aestivum
  Clone ID: PAT_TA_60761.pep
LHTLEGSLVHRLERKAQRPREASQAAVSSRPGLRTPPDSFHGNKLRSDCRFRRSLYLERTSCQRGEASWGTCACAFLCPPPLARSSIQIRKVYCWVLS

SEQ ID NO: 166344 - protein, 63 aa, Triticum aestivum
  Clone ID: PAT_TA_60762.pep
EKGSLDLNVWISRYSKMKIELKSDQKVCRGSVSDVVATTAIGEPRGVALLNYTNSEFKHIWVV

SEQ ID NO: 166345 - protein, 86 aa, Triticum aestivum
  Clone ID: PAT_TA_60763.pep
YLVSADSNLFVGSTAMPAAPGRRSLRTRARRLSGCHRQGQAGFGRRVATQTRRQTIPAAVMVVWLFRDLDIFLIVFEVLCTFNKLL

SEQ ID NO: 166346 - protein, 87 aa, Triticum aestivum
  Clone ID: PAT_TA_60764.pep
TTSQTDLQLHLHLHHHLTTCTPCHRPVRLARLPTNILHRAQLREAASTCTFHTPGRCRMRCTLHSILPHDTVSTCRPREARLQLSHY

SEQ ID NO: 166347 - protein, 139 aa, Triticum aestivum
  Clone ID: PAT_TA_60765.pep
TMIPCTWDYHHAQAIEMHEGVLHIRDIQGPKGKGTVEARLEAMEQEVSKCKGMVERGLNANHLMITYFTRDHKVDGQSMKDVVFTLNEQINFLQRQIYDLQNQVFEYEARFKGMGLTTSCGTRETHASSYDGEPFCRLL

SEQ ID NO: 166348 - protein, 114 aa, Triticum aestivum
  Clone ID: PAT_TA_60766.pep
PPHYTFFPILLVLHWIEHIVDPPAVAPSRTTVASTLESPQRALVVAFASSSTFPRLLTAGDEASSINSSRNPSYRFQQITLPPLAPPSQIGHYQGCSMPNSFSIFQVPKMSFCE

SEQ ID NO: 166349 - protein, 92 aa, Triticum aestivum
  Clone ID: PAT_TA_60767.pep
PRAWVEEPWSRYPCEECHGRCRVGVAGVEEVAVEPRAQRGAELVMGAVVVHRGEDVVDDALRRGCQERGHIVDEGMHQWCQHRACVDGRRRS

SEQ ID NO: 166350 - protein, 46 aa, Triticum aestivum
  Clone ID: PAT_TA_60768.pep
MRSYLRVTRNGGINVVPNDKNGLIPQRIVTGYRMVIDFRKTKNQKK

SEQ ID NO: 166351 - protein, 89 aa, Triticum aestivum
  Clone ID: PAT_TA_60769.pep
DLPTTFASAAALRPSSTTSFCPHRRGGHQRPLWPNHGPPALHVRSSFSNNVRHRDNHHDQVWPDPCRRTPLIFERAQQGVLIRSTTHFC

SEQ ID NO: 166352 - protein, 40 aa, Triticum aestivum
  Clone ID: PAT_TA_60770.pep
IYNETHLTAHHNGKQTRHIKSSSLESIVCFAPALLTLGLR

SEQ ID NO: 166353 - protein, 57 aa, Triticum aestivum
  Clone ID: PAT_TA_60771.pep
PGRRTGSLPVCRLIGVVVCCNSCHFELVFRSVASYPSCHVRSMCFLMSTIEFSFCFL

SEQ ID NO: 166354 - protein, 59 aa, Triticum aestivum
  Clone ID: PAT_TA_60772.pep
GCIISAPLWIVLPPKPHDTIMIEIPMTPAHTKKNTMLVTRMQECIKGYFPLVEYNGRVV

SEQ ID NO: 166355 - protein, 66 aa, Triticum aestivum
  Clone ID: PAT_TA_60773.pep
ASKRNCGLLGDQVCEGLEVTCEDLPVLLGEICVILAQGEYGEDCVSSSLNTQPLQPDVQLSQQLDL

SEQ ID NO: 166356 - protein, 70 aa, Triticum aestivum
  Clone ID: PAT_TA_60774.pep
GVANATLTVESARDNLERLIGKEKNQDDEKVFIQSFLAFCFGKTHILNKVLNFFSFFLVVGSASTFECCV

SEQ ID NO: 166357 - protein, 105 aa, Triticum aestivum
  Clone ID: PAT_TA_60775.pep
AQPTPAFSTLAAVSRSPLHLPFTASAVREEPDPIPCARTLLLLSISLSFLSCAASLRSPPERPNSLLLLAASSACAGAREQQYPDMLPACTVSWPSRGHHRANIS

SEQ ID NO: 166358 - protein, 67 aa, Triticum aestivum
  Clone ID: PAT_TA_60776.pep
KSLLLSRRSVGGRPELRRWTSSMDAYFFLPPVTNTASPRGLNVLLVYGTFIPVVTFFQNKMRSTRLD

SEQ ID NO: 166359 - protein, 55 aa, Triticum aestivum
  Clone ID: PAT_TA_60777.pep
WCPGGVPPRGGAMFEGYYIPIRTCVLSCPIIWNKDVMYYNVYDFKFHLLCGRLLI

SEQ ID NO: 166360 - protein, 60 aa, Triticum aestivum
  Clone ID: PAT_TA_60778.pep
ACKRIHTSSTVYTTFSSSDVALQFHSWDVPVDTHHSHHAADPPFTSCGTNHPVRTYRPSQ

SEQ ID NO: 166361 - protein, 87 aa, Triticum aestivum
  Clone ID: PAT_TA_60779.pep
IFFFARRIFGAALRDLGYECHEHIGTGVCCFWYDRFSSVWRDIKASSTFYCGARRRLDAPRHTRVWGQRKRSNKNLHEFKCEPIVIG

SEQ ID NO: 166362 - protein, 62 aa, Triticum aestivum
  Clone ID: PAT_TA_60780.pep
TRQAASVIIPILSSNRILNFRTIARNSVAEQTLGCILHGISCDSCLTVASNGHHLSHMGLSP

SEQ ID NO: 166363 - protein, 70 aa, Triticum aestivum
  Clone ID: PAT_TA_60781.pep
TDRTCPALESDRPMWARIWRQLANRQSVTTSVQLSLCMGILPMSAVSLTGIVRVLMEVPPGPYTRQPDAW

SEQ ID NO: 166364 - protein, 74 aa, Triticum aestivum
  Clone ID: PAT_TA_60782.pep
ISLNHHNLPQDPRCMLCLQQPETATHLCKDCPFTVAVWNQVNSWTNEGVPISGFLPEPGNVSDWWDKTLNSQSK

SEQ ID NO: 166365 - protein, 79 aa, Triticum aestivum
  Clone ID: PAT_TA_60783.pep
SCRSMHITIASVLTTPVGNVLDIVLDILTSKVYQMVSIPSDKLPILHGGKEATRIPSDPSDHVGITGSCSALIDTQQER

SEQ ID NO: 166366 - protein, 124 aa, Triticum aestivum
  unsure (1)..(124): unsure at all Xaa locations
  Clone ID: PAT_TA_60784.pep
DDCVLARVPSGRDITALDQQIKNLLSPSTPFFFNTVYDPXRERADIVRGYHFRLKEGAPTAVSHGLWLNIPDXDAPTEMDIPRNTNSMYIDDVLNIPMGTLFRMCGRNLAVDRQLIGPAMYIGR

SEQ ID NO: 166367 - protein, 59 aa, Triticum aestivum
  Clone ID: PAT_TA_60785.pep
IEFVLHTYSPRKRQKKLGLVHLIRTNLSLCIIFLAFALLNLPVHHRVKLLVLESSPLEF

SEQ ID NO: 166368 - protein, 58 aa, Triticum aestivum
  Clone ID: PAT_TA_60786.pep
HASGGIRSQPIPQLEKVSQCPYSCAGFRLLLLAGKAVFSREPRLDFHVMILHSIADNM

SEQ ID NO: 166369 - protein, 87 aa, Triticum aestivum
  Clone ID: PAT_TA_60787.pep
ITDDIQTTDWFGLTIPKCTVYIAKTTYALVPMTSHMHNAKTSQNAEGSHRLDPTYPTCYDFHHIRDDHHLDIRSLSGGNLDIPVVHA

SEQ ID NO: 166370 - protein, 68 aa, Triticum aestivum
  Clone ID: PAT_TA_60788.pep
CHEISLPLPKGFLYIISCHGYPALLVLGKDIPLKYVFKHIFPFIVLFNLIITFSFPLTCLTFLMGYMI

SEQ ID NO: 166371 - protein, 80 aa, Triticum aestivum
  Clone ID: PAT_TA_60789.pep
KIRGKIQRKGEEEKHMKVSKTGPKQSMTFPKELCNLLSSLEAACPRSGKVIACILSEKVNKRQDQEGDEVSQKKNKKKQK

SEQ ID NO: 166372 - protein, 59 aa, Triticum aestivum
  Clone ID: PAT_TA_60790.pep
FIVHMWHQSGYPRVPSVDRTFSLLGNLTLLQRSLSYIMPVETRPAYIICPLVRYQNCSV

SEQ ID NO: 166373 - protein, 145 aa, Triticum aestivum
  Clone ID: PAT_TA_60791.pep
FVRAELKKLGCVQNIHDFLNSLFCGGVSYMSIIKFPGPLLSCAFNISTQLMSDLVACPLLTRNSCSTRYMHIVVCPTLTHNPFDLGVCPSLTYAPNRIHLEHRHPICSAQLHVQPQHTTHARPRCSRAGMAMTLFSFCRLVAAWS

SEQ ID NO: 166374 - protein, 86 aa, Triticum aestivum
  Clone ID: PAT_TA_60792.pep
IHVVRFTRASRRCLPGTLHVVQSLRLPHTRPIFLKLHDTWAAGALGTALCGAFHRPYMHRLTRGTCRMISGHPSAPFVLDQASSAK

SEQ ID NO: 166375 - protein, 70 aa, Triticum aestivum
  Clone ID: PAT_TA_60793.pep
LLEEGQFLALSRSAIYQQGLRHYHNRKVKPRSFQEGDLVLRLIQRTAGQHKLSAHWEGPFVISKALGNDS

SEQ ID NO: 166376 - protein, 63 aa, Triticum aestivum
  Clone ID: PAT_TA_60794.pep
TPFAAGFAQTGRPFTRRQANIIENVTKNCSDGWIQTRDHTLDRIVASRCSLAGSDYVCLQLQR

SEQ ID NO: 166377 - protein, 80 aa, Triticum aestivum
  Clone ID: PAT_TA_60795.pep
GFFEMSFRWRRGLYDFLNENMRTASFQAVPQGDAPTTSKLEVDSLPVTWIWLYTTRVVSAPSFALSRPLSEPSRACSLTD

SEQ ID NO: 166378 - protein, 59 aa, Triticum aestivum
  Clone ID: PAT_TA_60796.pep
FFVSPLFFFGLNIHLNLKQQTPLQIKSRSKPIGESGVEGRCIHFQVAPINIPFAVSRRL

SEQ ID NO: 166379 - protein, 34 aa, Triticum aestivum
  Clone ID: PAT_TA_60797.pep
VFSSCECNSAIWCQVLNSDLKTQCRRLRLPNAGP

SEQ ID NO: 166380 - protein, 50 aa, Triticum aestivum
  Clone ID: PAT_TA_60798.pep
SFRLLKHWHHQGHTLRPPSMRQIWTHLRRLHIHDSRRRAFALHFNLPTRF

SEQ ID NO: 166381 - protein, 61 aa, Triticum aestivum
  Clone ID: PAT_TA_60799.pep
RQRRQWHFMEQLARAGKVGRRNRPGIRLHEYIPNINEKISQIYSHHSHPTNTQHIVISLSL

SEQ ID NO: 166382 - protein, 65 aa, Triticum aestivum
  Clone ID: PAT_TA_60800.pep
TRVQSNNKKPTMCARHQERQIMGRKLECHPNLHCEHLNRYRTYYVRHHQAQSTTPTVFKRKRLPT

SEQ ID NO: 166383 - protein, 117 aa, Triticum aestivum
  unsure (1)..(117): unsure at all Xaa locations
  Clone ID: PAT_TA_60801.pep
XPKVLRSSIFAAYGLPRHIRGRMCSPSSTPTPRAPPSGSSSARPPSFACAFHLVLLLACCCCVTMCLYRCSLLLLWCLVVVFYWCASCFCDVCVLAAVCSDLLTTVVLRGGETAPSS

SEQ ID NO: 166384 - protein, 139 aa, Triticum aestivum
  unsure (1)..(139): unsure at all Xaa locations
  Clone ID: PAT_TA_60802.pep
QMFQDELVDSSYSDEEVDMVMLMSMKEEMERQVGHILNFKGSIKGRRVVNRDRVSGAKLPHRDSFAPNPTFPDDPWFRHRFHMWKPLFVRIVEGVDAXDDYFKLTRDCCGQLSFSAKQKCMAAMRMLALGTDAVPIDEM

SEQ ID NO: 166385 - protein, 53 aa, Triticum aestivum
  Clone ID: PAT_TA_60803.pep
IHNSCDLHEILHDSVTVVAGERLIPAEFTASETEVETPIILVTTFSKSEHLAA

SEQ ID NO: 166386 - protein, 55 aa, Triticum aestivum
  Clone ID: PAT_TA_60804.pep
SISLQRLTVSLGFRRFRLFPLLFRSAPKPGPPSPYTQTHNATHLTRPTQVTLARC

SEQ ID NO: 166387 - protein, 135 aa, Triticum aestivum
  Clone ID: PAT_TA_60805.pep
RPLIVFLFFFFFSTQFNSDTSTYHQHIYNSTYQQHIASNSNCRSIITQKSLKDHHHNQHRHKHKHIEKHHTQVSNWPSPHTSHLKHHHHTQGLSATTSSTAEVVTAKTAEAQVVTASGNATAKTASTSAFASASV

SEQ ID NO: 166388 - protein, 86 aa, Triticum aestivum
  Clone ID: PAT_TA_60806.pep
MCSISDRSHALTPVYEAATRSGTEDQPSPSPKTDSEESDTKDVVLPGVNLIFDGAQLHPFDIGACLHARQPLSLITDASDASLAMT

SEQ ID NO: 166389 - protein, 92 aa, Triticum aestivum
  Clone ID: PAT_TA_60807.pep
AARRRHKGEKGWTPSLFIRKMDKAGAGIEEPEAAKEGVVVTSIFRITLMKGIFLIILDRDEFMIIRCCVQRMTSRQFNKIYRRRHHGGLREI

SEQ ID NO: 166390 - protein, 86 aa, Triticum aestivum
  Clone ID: PAT_TA_60808.pep
QYLTPEHPVDIIDQRRQLVKVHMVADLGIMDLRLRLWHGEVIPSSYIGLVNRMINTHLILIVMACIKITSRCTSAMITQPRLDPDK

SEQ ID NO: 166391 - protein, 139 aa, Triticum aestivum
  Clone ID: PAT_TA_60809.pep
RPGNVRCLPCSSRACRPWRTAADRSGSGRSSPSPISLLSSLIWRATICCCLLFQAIVGVDEEQRRCRNLKPADRVQAYQQRIPWWSYGALGWLAVFTGALLLLAEGRPTLFLPACVSYGRQFQLQLGGHAEQVMLLWRF

SEQ ID NO: 166392 - protein, 76 aa, Triticum aestivum
  Clone ID: PAT_TA_60810.pep
QVALRRGAEAMQLGCDEHATSTGHRFVKTSGAIGMQINSLPSRAHTALHHKILSVVEVNCSHRFDTFVHPNRYVCQ

SEQ ID NO: 166393 - protein, 46 aa, Triticum aestivum
  Clone ID: PAT_TA_60811.pep
TPQKTSFQKQGMSGYASPSSESPSVHKNNYLKQIENNESANIIHLY

SEQ ID NO: 166394 - protein, 48 aa, Triticum aestivum
  Clone ID: PAT_TA_60812.pep
PSRTARPPRLSACSHIESLRPKLHIADIYVFRHILILYTSIFIHFCNN

SEQ ID NO: 166395 - protein, 66 aa, Triticum aestivum
  Clone ID: PAT_TA_60813.pep
QDGVYIILLESIPLHHVTLLNALLCSYELNTLDVGRSRSMCGVIVVDAGRSRSTCCGRDAYIHDHA

SEQ ID NO: 166396 - protein, 39 aa, Triticum aestivum
  Clone ID: PAT_TA_60814.pep
AARRRQKGTAARRRQKGTAARRRQKGTAARRRQKGESAS

SEQ ID NO: 166397 - protein, 48 aa, Triticum aestivum
  Clone ID: PAT_TA_60815.pep
KYWFHFYLCPIFSESNMSIFLDLFGTIFIWVIFRDDPEGFTNPHFRIK

SEQ ID NO: 166398 - protein, 61 aa, Triticum aestivum
  Clone ID: PAT_TA_60816.pep
ARPRIDVVKRLACIEGAQMAFARVKMQLEKMKATEVATTGPPEGKDHRKPERYFDDVLEGA

SEQ ID NO: 166399 - protein, 107 aa, Triticum aestivum
  unsure (1)..(107): unsure at all Xaa locations
  Clone ID: PAT_TA_60817.pep
VVERFVDWMVSWLLMYGEAKLLLVIYLWHPSTRGAGHVYDGFLHLLVALHEADIDRGLLELMAXARDVTTSQLKAVAAIGQVWLVEAARCVSLQLQAARSGREGATH

SEQ ID NO: 166400 - protein, 68 aa, Triticum aestivum
  Clone ID: PAT_TA_60818.pep
KETPFRYMEWSIAIPIVAYDMYHAVHQTFETVALSQWSRAGYVLMDPLLVVVSLNGVTLPRKKIVGHP

SEQ ID NO: 166401 - protein, 63 aa, Triticum aestivum
  Clone ID: PAT_TA_60819.pep
ALFMVLFVEYLANGTLKCRKLLGVWVSIQYVLMSMDPGNVHALLVLVNKILGVHAFILNICNS

SEQ ID NO: 166402 - protein, 107 aa, Triticum aestivum
  Clone ID: PAT_TA_60820.pep
AARRRQKGDCEECLRHVHSFTGVSFTGGTTMGEAASLYTRYLSREGRERFGSRMWTSFTAMMLTAMSTDLFSVLVYYMIYIYLCCVDTLTTLGLETCVIMCYLCALS

SEQ ID NO: 166403 - protein, 85 aa, Triticum aestivum
  Clone ID: PAT_TA_60821.pep
CKSNLAVDFPLAPSCCATMMSFLDKHQRRCIPSPFLAAIRRTRMGKKSSSFMFTKSTCLYRPQLSSQTLNSTECNAPCHVVGLEL

SEQ ID NO: 166404 - protein, 109 aa, Triticum aestivum
  Clone ID: PAT_TA_60822.pep
HGAFVFRRLPVGTNRCLNFFNALRVYERSLFSRVSLGSRRSLSPPCLAPIKGRSLLSERRTRTTSSSRHRFLSTALLLRSFASRLAACTTGRDSRPPDPHLFPSGTGEG

SEQ ID NO: 166405 - protein, 57 aa, Triticum aestivum
  Clone ID: PAT_TA_60823.pep
LPFAASHVFQIHRNPLNPSVSHAAAELGCLLWGASTDPSQVSFPLRSSSRNRVHADA

SEQ ID NO: 166406 - protein, 69 aa, Triticum aestivum
  Clone ID: PAT_TA_60824.pep
LKIGQHILQKCPLSIQGSYQGTTLIIWICCYLALRTGASNKSSLFPPLAHKLNWNEMVTYVPEGHASFM

SEQ ID NO: 166407 - protein, 65 aa, Triticum aestivum
  Clone ID: PAT_TA_60825.pep
GDLFRKTVSRSSISQTSGSARNSTGEIESCGEKSANLCRVYKLIMISRVPGYGHVEYLVFDLLVE

SEQ ID NO: 166408 - protein, 129 aa, Triticum aestivum
  Clone ID: PAT_TA_60826.pep
AARRRQKGLQRLLKKNVNYSNMSTKVPSKTYIRSYIHAYYQEGLVELLQQASFDSWLGQPTRLQLEMVLRTRVHYSPLQYTTEDPPPSSYGRAILGTHTYLEAFSSFHLLVYELYRQPSSPLPRTRLFE

SEQ ID NO: 166409 - protein, 76 aa, Triticum aestivum
  Clone ID: PAT_TA_60827.pep
CRVYGQCSWHYEADKHSRVPRSLRLVDVIYATGRNMRAQMRHQRISETVLSRMQTCGFLTGRRILEIPCRVIVNCA

SEQ ID NO: 166410 - protein, 55 aa, Triticum aestivum
  Clone ID: PAT_TA_60828.pep
SVIRYGNTPTCFCSNPIRTYILLVYHLIHKTRSPTLSSTGQRLFVDSSQDQRKDD

SEQ ID NO: 166411 - protein, 70 aa, Triticum aestivum
  Clone ID: PAT_TA_60829.pep
GDIAMLVFLRVHVAVVWLSMLESTIYHLLGSPACSRPDVLLLILIRARSLMLVCAPGGCNFADVWMVSNE

SEQ ID NO: 166412 - protein, 56 aa, Triticum aestivum
  Clone ID: PAT_TA_60830.pep
HVHTDRGHKTRHSSHTIIQAQAEATSLSTDTRKKEGFSKPVYLHRALHGQDHHLGG

SEQ ID NO: 166413 - protein, 53 aa, Triticum aestivum
  Clone ID: PAT_TA_60831.pep
LCFCILISVSWALLEVRRMVVGMAEGAQRHGPGGVALGVANGGQRRGRGGSWH

SEQ ID NO: 166414 - protein, 50 aa, Triticum aestivum
  Clone ID: PAT_TA_60832.pep
ISGSWWIAKQPLRFKLFNQALLVKQVWRIITVPNSLCARALKARHFPGKD

SEQ ID NO: 166415 - protein, 67 aa, Triticum aestivum
  Clone ID: PAT_TA_60833.pep
GEGILLRNSNRSSQSWLPFLKRSIHYVDVFISLFQVIMMKSASFLRELHRTYERVKGGYFGRTDLCM

SEQ ID NO: 166416 - protein, 76 aa, Triticum aestivum
  Clone ID: PAT_TA_60834.pep
QKVYNFAPRPWPMTISPGLCHKPGLKGWSLLRAEFSPTSPTEGGSHQFISPSLSASLSSSQSENRCPNREKFNLNS

SEQ ID NO: 166417 - protein, 71 aa, Triticum aestivum
  Clone ID: PAT_TA_60835.pep
HGIFFIFMLDHYNFNCHIICVNLGASFACSFHLYLIHHADMRYSLVELYHAHCTSIKSFEYGFRECVMCFT

SEQ ID NO: 166418 - protein, 120 aa, Triticum aestivum
  Clone ID: PAT_TA_60836.pep
LELCVHAHGPEVELIMEASYSNNNPRVITSPLIYAWSFSTVVPTMIVFLWSHFSDKLNHLSYADQCACPTSILLNPRVFPYGISRISRNYITSYEFSIKYYIITDFNFFTGSGSLNTQGH

SEQ ID NO: 166419 - protein, 60 aa, Triticum aestivum
  Clone ID: PAT_TA_60837.pep
INYICKWGRKMPSLTWYTLLCCLTTLKLCLGQNSTKSKICTRGFSGIVVCCFRPHLNLPK

SEQ ID NO: 166420 - protein, 62 aa, Triticum aestivum
  Clone ID: PAT_TA_60838.pep
RWEEFYGVYTFLVIHLSLCVETSTYSCDHSTPPMLRIDVVASIISMACVDNSKIQLVWRVSV

SEQ ID NO: 166421 - protein, 101 aa, Triticum aestivum
  Clone ID: PAT_TA_60839.pep
HLSGRKQPHVFINFLVVTKLFVLTWIVANLLACRWLLPIIVYLCRENWPTLGVHKTLIQILATQNFGGATLGSNQTHLEFLTQPRWDLWDRLDLITGCKTR

SEQ ID NO: 166422 - protein, 96 aa, Triticum aestivum
  Clone ID: PAT_TA_60840.pep
PVRRFRGDIGEGKNQQSVRPNRGSPRYGPMPRPNRPSSYSPTSVSKILVDVNKNYTSIVVPFQKKHISGYFLPKGSLYPTDTKYPFDCSKLLSLLI

SEQ ID NO: 166423 - protein, 38 aa, Triticum aestivum
  Clone ID: PAT_TA_60841.pep
LPAWSPPPPAQNITTPISRLPLQSKSHNDQKVLKTLNI

SEQ ID NO: 166424 - protein, 131 aa, Triticum aestivum
  Clone ID: PAT_TA_60842.pep
APLGAMDVSGSRLCQIIQDAGLRPHTMQRFQKVLATAGVVALANAGFASRMDDMMVHSIRKFTDVKKRADDLAILLQPARPGSSLPATLIGLHGDELFQALVALQVPEVTTKNVHLQAALVAHRLANQETV

SEQ ID NO: 166425 - protein, 50 aa, Triticum aestivum
  Clone ID: PAT_TA_60843.pep
LLNEMVILPCGISDKVTIPSKSLISLLARCSLHCYAAMPTTCYNMPPMLP

SEQ ID NO: 166426 - protein, 107 aa, Triticum aestivum
  unsure (1)..(107): unsure at all Xaa locations
  Clone ID: PAT_TA_60844.pep
LIPLTNCIFEQHFHLSVARDGPLHLRRWHGQFAVLCTVSGSILNSTEDIHSFCXSLTPAITTHRTSDLCKQYXVSLLNFNARSNRSYLHRVEISRVQFVPLRVTVSV

SEQ ID NO: 166427 - protein, 59 aa, Triticum aestivum
  Clone ID: PAT_TA_60845.pep
THLIQPFDQFELRTRLWGYGRGAAPQPAIMPNTYLALHAPFYAIPVTWHAAPSVLGTTQ

SEQ ID NO: 166428 - protein, 68 aa, Triticum aestivum
  Clone ID: PAT_TA_60846.pep
LRDVLQEKEWELFFYKMVYQTHNMVRCKMILTLTGIGTVNTLCAAMLVLVLKILGYERGIWFQLSCRG

SEQ ID NO: 166429 - protein, 145 aa, Triticum aestivum
  Clone ID: PAT_TA_60847.pep
RHHSDVRQLCRFPRHSSVVIPSLGRPGFFNRPLPDSSGALISSRTSSICRSSGKIHDPYKTGKGIDRAVTLNFPLVPIPFLCPLPHRCRGASLSVESGATGQMLCRSSFTLIWLGVANQTTSTFKHAAHKSIDGSSAHASHCGGS

SEQ ID NO: 166430 - protein, 115 aa, Triticum aestivum
  unsure (1)..(115): unsure at all Xaa locations
  Clone ID: PAT_TA_60848.pep
MRNLCLKHLTPHSQVGYCDIKVLHHYDSIRVLYTIFHSNPDSSYKVRXILPILTSAXPLTHIRLLHSLYVSLDTVNSQIKGSYLQLVENSRAQFVTLPVSLPLQSALPATDFIAH

SEQ ID NO: 166431 - protein, 125 aa, Triticum aestivum
  Clone ID: PAT_TA_60849.pep
PRDVDKRATLPSNDYVQWPPHGAPVRSVLRLRCSAALWVHHRRPYPAMVLGRIAPSNPAEVWERCCAGIKVKPINKEKIFIFLVFGCASIMWRLLPFFKLVGACYQRAMLCIALSEQDTNAVTTK

SEQ ID NO: 166432 - protein, 99 aa, Triticum aestivum
  Clone ID: PAT_TA_60850.pep
TAARKRQKGYARAHHHPSWTTSCPELGLRLEKPPSSWAADWGDPSAREAALYAPLRRSSGAARLNTPPHRLDLTPARPSIRPRRSSPKTRHMYRLPLDP

SEQ ID NO: 166433 - protein, 82 aa, Triticum aestivum
  Clone ID: PAT_TA_60851.pep
PDLVWWRSRGLVSVRRESAQPEVVRRRVREEDEHVHRYMVALEGGRFSNTRQFLQGSHFNYDPVRVPSLWVSTAAPQEPRVS

SEQ ID NO: 166434 - protein, 102 aa, Triticum aestivum
  Clone ID: PAT_TA_60852.pep
GTALVSTYKPTDPLHRFIKNSAHLPIQSRFLPHNDYDEVLAAMCGRVILADLKTPMVPGRVIQTTLWPKKRNPDWGGTSRGSTDLGSGSGWRMIMWMSRSSK

SEQ ID NO: 166435 - protein, 138 aa, Triticum aestivum
  Clone ID: PAT_TA_60853.pep
NSLSSPPSSSLYLHICSICSMAAHLSVNLHHPAAPRSSAPASSIWSSRGRAAHDKSERGLESLGLNPWGKIRDLDQGGERERKIRQRRSSIFPSLAAGSIWTRSRGTRGGHQRLVCCNLCARSPFCRLLAAVPFFRLF

SEQ ID NO: 166436 - protein, 89 aa, Triticum aestivum
  Clone ID: PAT_TA_60854.pep
LQRHVLGQCGDISAWVPSCLQNLASLVSLEMSECPGITSIPGDIWRTNLASLEELYITDCPDLVSIGGLEAVAQLGTLHISGCPKMIEM

SEQ ID NO: 166437 - protein, 67 aa, Triticum aestivum
  Clone ID: PAT_TA_60855.pep
IICFFLIHLSLCVETVHTSVTTVWHTGIMPRIDPVASIISMACVVNSKLQLVWRVSIISCIRMYASF

SEQ ID NO: 166438 - protein, 71 aa, Triticum aestivum
  Clone ID: PAT_TA_60856.pep
TKSANCGKLHAKSCKYLMFFKKGRRQLLKALVLAPGKSQANVSFPLKSKGYEANTPESCFPIPEGTKGTFL

SEQ ID NO: 166439 - protein, 74 aa, Triticum aestivum
  Clone ID: PAT_TA_60857.pep
MCRNFLASGFAAALKPDKCTGTYFKRWQTKATLWLTAMNVFWIAGVPMGMIAPEQEKAFREVTVVFLGAVLSVI

SEQ ID NO: 166440 - protein, 114 aa, Triticum aestivum
  Clone ID: PAT_TA_60858.pep
FKCDQALFSNMISLITGSYCSMIIRASQFSSTTRNLVPRFKRGVRGEGLVTNLAGLLILACTSGRGWSNTLMSSFLCFGHHDEVGVLSSGTPSYLRKNKGWALWENGPRQVCLS

SEQ ID NO: 166441 - protein, 143 aa, Triticum aestivum
  Clone ID: PAT_TA_60859.pep
SGAGAGVVFVTPSEGIIPYSFTLTSAVSNISAEYEALIIGLELALNMGLDSLIVYGDSQLVIDQLLGIYMVKKEELMPYFQRAKVLMSLFTDLKIQHIIRSQNEKADALAGLAASLSLTSHQMMDVRVEECKILPILTAREET

SEQ ID NO: 166442 - protein, 98 aa, Triticum aestivum
  Clone ID: PAT_TA_60860.pep
GETKKIDFQAIQFHSGTNLAFHNKQQQQHMDAVHIATTCQFLRLQPSPHLLTSLHYCFSSNQKKMTLLDILLDVHVLPLFSAGPVKCHRNHGAHVTMS

SEQ ID NO: 166443 - protein, 55 aa, Triticum aestivum
  Clone ID: PAT_TA_60861.pep
YIQSKYKKDRSNNDGSAPIYSPIPYFREPFTCSKTLVRMYYKDKNEASIICNRGS

SEQ ID NO: 166444 - protein, 132 aa, Triticum aestivum
  Clone ID: PAT_TA_60862.pep
HRVQVSFKIGAYEDTLECDVLPMTVCHLLLGRPWQFDRGVIHNGRTNHYSFKMKGKEFVLRPMSPSQVIADKQATHRGENRERANHQKESECHKPKLSASMMSDTTNLVLSATKREMREMCENPSSVLHYVL

SEQ ID NO: 166445 - protein, 42 aa, Triticum aestivum
  Clone ID: PAT_TA_60863.pep
RGRKMPLIHVPTKKKKFSVADAVPTSAGDVRWPARAWARSAP

SEQ ID NO: 166446 - protein, 139 aa, Triticum aestivum
  Clone ID: PAT_TA_60864.pep
LISAIIASSRYLPHSIQSLNQGRAKDAGQVSGLVPHLVDGGISILQYADDTIIFMEHDLAKVIFTATALIRMWSLLTPTEARGRLATASTRWEMVARVIFNRFGWRSCNRIRIYCSYFICQPVVALCLGSLEQPFFLSN

SEQ ID NO: 166447 - protein, 96 aa, Triticum aestivum
  Clone ID: PAT_TA_60865.pep
VDQLWPERSKPNSYFNLVQQFLDVVSRINAMKRLACIEGARMTFAPVKAYWAEMDATNVAAQDLAIGRRAAEHYFEEVLEGARLIETQCSKNIMFE

SEQ ID NO: 166448 - protein, 90 aa, Triticum aestivum
  Clone ID: PAT_TA_60866.pep
TDLPETRPHTPTGDGSTTETGPRGENLIPFLGSRHRLVFLSRTETLTKLEERSKNGALPPAGTMIHSVPMTLRPQETRQTTDGRHRNPSF

SEQ ID NO: 166449 - protein, 48 aa, Triticum aestivum
  Clone ID: PAT_TA_60867.pep
FFPSPFFFLTTPKTELISHHSTSKTKQEYTVFSSGRWFPPLYRILAPR

SEQ ID NO: 166450 - protein, 141 aa, Triticum aestivum
  unsure (1)..(141): unsure at all Xaa locations
  Clone ID: PAT_TA_60868.pep
FVENFSKIAKPLTNLLHKGVKFHWTEKCQESFQALKDKMTSAPVLXPDSRKDFVIYCDASRQGLGCVLMQDRRVIAYASRQVRPHEENYPVHDLELAAVIFALKLWRQYLLGNRCEVLTNHQSLKYLFTQPDLNLRQQRWM

SEQ ID NO: 166451 - protein, 142 aa, Triticum aestivum
  Clone ID: PAT_TA_60869.pep
GSFQPTDGTAGAGMILRDHLGAVMLAAIRGLGNCADALEAELAAIHEGITLSLNWTELDILVETDSADAVQLISAAGKDRSTHTHKVMEIRSILSQEKRIQIMKIKRNVNVPSQTLAHMGRTQQHTACWLRSPPDEIASIVV

SEQ ID NO: 166452 - protein, 109 aa, Triticum aestivum
  unsure (1)..(109): unsure at all Xaa locations
  Clone ID: PAT_TA_60870.pep
MIEVVLSDRLXGTKVLVKWSDDNTSSDITKLVAAHTGTTADMIRIQKWYTIYKDHITLSDYQITKGRGPNSTTTSVITPAIAGPSPIVPVMSVGCIPVPMSSQLDVWAE

SEQ ID NO: 166453 - protein, 34 aa, Triticum aestivum
  Clone ID: PAT_TA_60871.pep
LHYVVRAGNLFRLAALTPRQADVVVPRASTLEFR

SEQ ID NO: 166454 - protein, 95 aa, Triticum aestivum
  Clone ID: PAT_TA_60872.pep
MSTSAASLCCSSTQVNGFGLRPERLLLYQPTSFSFSRRRTHGIVKASSRVDRFSKSDIIVSPSILSANFAKLGEQVKAVELASCDWIHIDVMDGR

SEQ ID NO: 166455 - protein, 125 aa, Triticum aestivum
  Clone ID: PAT_TA_60873.pep
PTRPYGCEKTTEGYDESLQSDAAARLPVTLALASLWLRRNYADTVLVRVVDSLPEVYPKVETWIENVVFEEGNATILTLFVCLITILYLRERQRRQVVVVADPVAADVAQPLDADVAQHLAAFPR

SEQ ID NO: 166456 - protein, 72 aa, Triticum aestivum
  Clone ID: PAT_TA_60874.pep
CCSWRFIIMDESVGVCFIHYIIGFGTELDEPADTSFGLTPSKSLGSDTETSGVPGTNPLVLNQWAFASSITW

SEQ ID NO: 166457 - protein, 71 aa, Triticum aestivum
  Clone ID: PAT_TA_60875.pep
APNSYVLPQDPSLIYTMSFLVAGLIWALVTLPRSGMRPNKTLGVGLIVLYSVFLFIRVSSAMGILPLPGLN

SEQ ID NO: 166458 - protein, 113 aa, Triticum aestivum
  Clone ID: PAT_TA_60876.pep
MKVFNLDRGNTLSVFLFSGVTNSKELLNSMLDGSLKLEVSFLNASLIPDIFPLLAAAQKALISKSRDSLSTRTLHSELVYNYSGSKHITESLKRCGISENTTYILAARFNASP

SEQ ID NO: 166459 - protein, 71 aa, Triticum aestivum
  Clone ID: PAT_TA_60877.pep
ERHINTYMHEEKFLGEIECLMKAKHKNIVRFLGYCSDMKGNMRTYGNVLWQMGNKDCTALNIFLKEVRMVI

SEQ ID NO: 166460 - protein, 141 aa, Triticum aestivum
  unsure (1)..(141): unsure at all Xaa locations
  Clone ID: PAT_TA_60878.pep
THASAHASVRCRRRQKGEVAENLARPMATLVSSQTYIYHCHISKQALYQAKESYSHRRISRHNHRERLDFSHRNHRLTITRKQQPLSFNTVCFAADEPSEISADARIRSEVLSPFRLVRMFFYLAFIASGSLXGLIATSRL

SEQ ID NO: 166461 - protein, 157 aa, Triticum aestivum
  Clone ID: PAT_TA_60879.pep
LPVPARDSRGHPRVRTAARRRQKDTAARRRQKGDESDKTRELCRREKIEKVPHFSFYKSMEKIHEEEGIEPDQLMGDVLYYGDNHSAVVQLHGRPDVEKLIDENRTGGKLIVLDVGLKHCGPCVKVYPTVLKLSRSMSETVVFARMNGDENDSCMEF

SEQ ID NO: 166462 - protein, 59 aa, Triticum aestivum
  Clone ID: PAT_TA_60880.pep
FLDYTSKRARALQRENATGKARESGYEDVVDILNRNISCLVFMCSRNIRLPRASRRCNC

SEQ ID NO: 166463 - protein, 134 aa, Triticum aestivum
  Clone ID: PAT_TA_60881.pep
HASDSGKFYGDQEKDKGLQTSQDARFYALSARFEPFSNKGQTLVVQFTVKHEQNIDCGGGYVKLFPAGLDQTDMHGDSEYNIMFGPDICGPGTKKGHVIFNYKGKNVLINKDIRCKDDEFTHLYTLIVRPNNTY

SEQ ID NO: 166464 - protein, 129 aa, Triticum aestivum
  Clone ID: PAT_TA_60882.pep
MKWVTFISLLLLFSSAYSRGVFRRDTHKSEIAHRFKDLGEEHFKGLVLIAFSQYLQQCPFDEHVKLVNELTEFAKTCVADESHAGCEKSLHTLFGDELCKVASLRETYGDMADCCEKQEPERNECFLSH

SEQ ID NO: 166465 - protein, 72 aa, Triticum aestivum
  Clone ID: PAT_TA_60883.pep
FHPRNVRDRAFEEGDLVLRVHQNRPHKLAPACKGPIIITKVLHNGAYHLYNVATMKDEPRSWNVELLCRFYT

SEQ ID NO: 166466 - protein, 58 aa, Triticum aestivum
  Clone ID: PAT_TA_60884.pep
QCLDILLFRINVDKSAYKNSTNPTGLAWAAVHDSRMGPVELRSRSSQLELPTNFSRPV

SEQ ID NO: 166467 - protein, 62 aa, Triticum aestivum
  Clone ID: PAT_TA_60885.pep
KVAGKIMRRTDVYIYAYSLLMRLSRRFLFFAELFGHISLRLSHINVIRWDYYNNYVCHFLLL

SEQ ID NO: 166468 - protein, 65 aa, Triticum aestivum
  Clone ID: PAT_TA_60886.pep
AARRRQNGTTLMPSHQHKLVRVWSYSVSSLLSNNCYSLHWYIKITYVLNVVINSPSLRILDTSET

SEQ ID NO: 166469 - protein, 93 aa, Triticum aestivum
  Clone ID: PAT_TA_60887.pep
YMHVYIKHTKFSASHLAQIFEVQQQNTLPRRSERCTTCFCLIFIAGRSNLFDLHLAPTKTTSTTFPSSSLLSSASCVLGAWQTYATSSWRAAL

SEQ ID NO: 166470 - protein, 97 aa, Triticum aestivum
  Clone ID: PAT_TA_60888.pep
RLAKGGWCDLDLNPRLFNRQLIHTARGVNVKTPWLFTFARHVVSGHYWAWKPMSATFTRGRTLFRQVHGIWRRTRPAMPKTILRAGLIVIEAWFGGY

SEQ ID NO: 166471 - protein, 91 aa, Triticum aestivum
  Clone ID: PAT_TA_60889.pep
DLHVHAAASLPPLSSSSGNKNKNKKKITACLSRERKGKEARKEVEIHYALRSHQISRSAHRIIFCSSAPGPARSRFALSGSDIYLFYLFTN

SEQ ID NO: 166472 - protein, 58 aa, Triticum aestivum
  unsure (1)..(58): unsure at all Xaa locations
  Clone ID: PAT_TA_60890.pep
GVEETVHDSVMTRLLCNVGSGGELAASPVESRQSLTIELRSSFLWGLLCNVXSGGDCS

SEQ ID NO: 166473 - protein, 87 aa, Triticum aestivum
  Clone ID: PAT_TA_60891.pep
FIILQRLASNRRKMSSFIVLLHCIPYIAGGTSRMKMALQVGEQRGSTEGNTIRSKTGIQQPASVRQLTNSEIPARASPDCRHLAAST

SEQ ID NO: 166474 - protein, 82 aa, Triticum aestivum
  Clone ID: PAT_TA_60892.pep
LDCLLTMCRTKTETLAVARDFTFFPGKSNGSETFCTLLLYKFFKLSNLFHNVWSYRSLLNLQITTDCPVLDRFYFLCVVCLF

SEQ ID NO: 166475 - protein, 108 aa, Triticum aestivum
  Clone ID: PAT_TA_60893.pep
YADHRSCRAPNRCHYRPARFRHLQARTPPPPRRPRFTASVQPLHRRPRPPESPPCSTLTAAPSPPYVANVSVSHLPLHPLDRYPTLQIRSSQELGFLVDRFSYGLFSV

SEQ ID NO: 166476 - protein, 102 aa, Triticum aestivum
  Clone ID: PAT_TA_60894.pep
MTTIRRFCCDDLLRFASVNLDHLTETVSHPQKIHLSLPLLLLFLHDAVRPSSSRSDTSIRSPQFNMSFYMTYLARWPDYFHTAVNPGDRVMGYSMPPALIPL

SEQ ID NO: 166477 - protein, 60 aa, Triticum aestivum
  Clone ID: PAT_TA_60895.pep
TTSDTTLSCNPSSVNLGGGSSYIHLVDYIEWNSPGVIPRVFPFMFGHTDTWTLQLLLGKA

SEQ ID NO: 166478 - protein, 40 aa, Triticum aestivum
  Clone ID: PAT_TA_60896.pep
NFAHSSKFLPNPIIYVSTGSNLSFCQYFQVVKQVYFILLP

SEQ ID NO: 166479 - protein, 80 aa, Triticum aestivum
  Clone ID: PAT_TA_60897.pep
LYRAALQFFLLYILGKKEPNDVDDCRPNLYSESRPAQCQQRRSPFRSLPCLILGCSHLLALIKSQLTLLSFKHEKISVDK

SEQ ID NO: 166480 - protein, 81 aa, Triticum aestivum
  Clone ID: PAT_TA_60898.pep
LYGFMEQKVSSNPREAFVNYRDLDIGQNVVGDNGVPTYESGRIWGEKYFMGNFHRLATVKGQVDPDDYFRNEQSIPPFLPV

SEQ ID NO: 166481 - protein, 75 aa, Triticum aestivum
  Clone ID: PAT_TA_60899.pep
TVLSPGWKQCRRSAWGVTSVFSHHDGILAAPYGVHGIGELTVANCSLEHMEHLEELHQSRYGSLGIARVMSCARW

SEQ ID NO: 166482 - protein, 118 aa, Triticum aestivum
  Clone ID: PAT_TA_60900.pep
YLLVACGTKNILLVNISNHDPRTDHSSSAGNPRYYYVDSCSAGEAAALLVYSHAINVPLHCQPTPVYLKKNPPRPRSRSPPPRPPPTSSPLHTPWPASRRPAAMTPWPNPATMRTRRP

SEQ ID NO: 166483 - protein, 56 aa, Triticum aestivum
  Clone ID: PAT_TA_60901.pep
KSVNHFFNSTNYLKFMNFCIKIGEPFSNLWFFFKIRGTFFKFVNFFINIDELFPNP

SEQ ID NO: 166484 - protein, 80 aa, Triticum aestivum
  Clone ID: PAT_TA_60902.pep
HFIIFIHSFETRGGTFHREMQGREVLVGREDTDELTCLQTSLLKQQISELIIRLQLFRSNIWFLVFLVPSKWFDQSPRRK

SEQ ID NO: 166485 - protein, 116 aa, Triticum aestivum
  unsure (1)..(116): unsure at all Xaa locations
  Clone ID: PAT_TA_60903.pep
LEDDTLACTRVLTCLDVRSNHQGDHVISNGGQSDVRDHTGNNQVXNLGNPVELTXNYYIDGADEVSFLNITGFRAFPLGDMPMLHVLRYASQKVFVPLTVGGRNIHFTYHTGRYHS

SEQ ID NO: 166486 - protein, 144 aa, Triticum aestivum
  Clone ID: PAT_TA_60904.pep
AIVTESLQVMCRLMAAPGETGAQLRRQISSSKEVIHGMEEILKCCGCGEQVRILTIEILTQLPVGLGEEFPCGNKESRENFIKMLPSIFTDEAKEHPIRKLAGEALLKLSQSETNAAIILKANDHLVRDLRKILLDAAAKGTNR

SEQ ID NO: 166487 - protein, 137 aa, Triticum aestivum
  Clone ID: PAT_TA_60905.pep
SLDTVGTVKTKIHCMEGFPTNLQCLIFKGKQLEDDERTLAEHNIHKDSTILLVLHPRPRGGMIIFVKMLIGKTLTFEVESSDTVESVKVKMYQKEGIPPIQTRLIFAGKELDDKRTLAEYKIQKEDTLHHLLCLCGC

SEQ ID NO: 166488 - protein, 65 aa, Triticum aestivum
  Clone ID: PAT_TA_60906.pep
LCFSFPSNQFMYLLEMHLSIYTFPYSFSFSTIHQLKPQFGVDFCLFGGFTRSWEVHACACPTKLQ

SEQ ID NO: 166489 - protein, 63 aa, Triticum aestivum
  Clone ID: PAT_TA_60907.pep
AIQSLITKIPTCPVWRQSISSRSGINASCGTGLRNLFRARGSQFRKKIYIHRTYIDKCLHMNT

SEQ ID NO: 166490 - protein, 70 aa, Triticum aestivum
  Clone ID: PAT_TA_60908.pep
QGSTEHDRRVRLREDDRRGRLRLSNACLYHLLDSKQSNVLPVWLDIISILSRSCPFSFSCFPSVARAPCY

SEQ ID NO: 166491 - protein, 80 aa, Triticum aestivum
  unsure (1)..(80): unsure at all Xaa locations
  Clone ID: PAT_TA_60909.pep
IYQQDLRRFHARNVRGRAFQEGDLVLRVDQQKPHKLAPAWEGPFIITRVLHNGAYHLLQRRAQEXEPRAWNAELLRPFYT

SEQ ID NO: 166492 - protein, 87 aa, Triticum aestivum
  Clone ID: PAT_TA_60910.pep
WGPRMTLRSSRRSGSWSWAKGASSAASYLGPDRVRWRNMACGGLICLQEQYCLPDIKLVSCTVHDVVNCTSEMKFYLLLGKKKRRAE

SEQ ID NO: 166493 - protein, 135 aa, Triticum aestivum
  Clone ID: PAT_TA_60911.pep
ASQMDAAPLTYGALADVWIQTHASVVQCQVPVRQGIRLLHKWCWRVGNQPPHKLQNRPKHDEMNYSIGSNKLDTHTHDESNDERPCRWKHNFPNYAWMRMFHVMVKLFPSGPFCRLLAAVPFCRLLAAVPFFRGP

SEQ ID NO: 166494 - protein, 85 aa, Triticum aestivum
  Clone ID: PAT_TA_60912.pep
LWQRRNGPCRDDDRRSSLKLWDGTCHLLTCSMKQSRTDRTRFCMSGSNCHHKEKQICDRRRTLIRTIGGLQIREGTCSNWLASKE

SEQ ID NO: 166495 - protein, 121 aa, Triticum aestivum
  Clone ID: PAT_TA_60913.pep
WLDRHTTASYDPRKMCHPIRRIDHSQNAHTCVYRHHLYLTDKLVSVMSSSSLLHSVKEDGCMLCPLQYHRVIALRDGCNDCASVELLWLHLSKPVPLWNRYSTGSTPSYTSRRCQRSTRMT

SEQ ID NO: 166496 - protein, 58 aa, Triticum aestivum
  Clone ID: PAT_TA_60914.pep
SPLAWEAVKVRRCLKLYQIRYGLGACRASNPQTSALLCTWHHRHMSHLVTITYLTTVN

SEQ ID NO: 166497 - protein, 54 aa, Triticum aestivum
  Clone ID: PAT_TA_60915.pep
LWANTWMMILNVNWLEAVSILARLDITPMSWKPAERNVRTLVTDDSVNEVVKCS

SEQ ID NO: 166498 - protein, 123 aa, Triticum aestivum
  unsure (1)..(123): unsure at all Xaa locations
  Clone ID: PAT_TA_60916.pep
PTIHRDPNSGAMETVMGVLPHMFCQTAAAMASAVTDYDIIMPHNDSLKFLAYAHDLIMLRXLTQHQSSINTTHYIMIHGSVSSSSLIHLAYHFQKDPDTRVAILRIQGSGHRLTFTAPHHVVI

SEQ ID NO: 166499 - protein, 98 aa, Triticum aestivum
  Clone ID: PAT_TA_60917.pep
IFAKGIVFYWHRHWIHRHRAPPKPTSLTYRLNILIFLSPHFLSSDPRSFAPSSHPRARRCRPPLRHGHNEQSSRPSTLTCSWQCQEAIEPCSVCCRAL

SEQ ID NO: 166500 - protein, 89 aa, Triticum aestivum
  Clone ID: PAT_TA_60918.pep
SNQSTPECVIRLNLSVLITLSFEHLAWDSVWSFSVLDLLAWRLTVTGLIRYLKKQLHTLGISPACLQKVPMHPVLQHFVHSRMYPRDIT

SEQ ID NO: 166501 - protein, 62 aa, Triticum aestivum
  Clone ID: PAT_TA_60919.pep
FCVDSYFKFGFFCSFFFFFFFFFFFFFFFFFFFFAADNKRYYQPVKQTHLQGTPFCRLLALC

SEQ ID NO: 166502 - protein, 94 aa, Triticum aestivum
  Clone ID: PAT_TA_60920.pep
CTGWQHLAFYVLYSPHAVHLALPREIPCNVTTFLLGQCDPMLNGIFFPIVSLHKLYAIVISWSDVMTVLPWNVIEATGTHLPDYFHMIMSEYRL

SEQ ID NO: 166503 - protein, 132 aa, Triticum aestivum
  Clone ID: PAT_TA_60921.pep
GPHKHRRVRLREDDRRVSSVCGLVAVFSGTLYAMTKGAINQLTKNLACEWAKDGIRTNSVAPWYITTSLTEGLLANKEFEASVVSRTPLGRVGEPGEVSSLVAFLCMPGSTYITGQTISVDGGMSVNGFYPA

SEQ ID NO: 166504 - protein, 59 aa, Triticum aestivum
  Clone ID: PAT_TA_60922.pep
FLYFFLWLYNKYNHEKILMYFLVKCEHISWIAMFCKQNIQNGTPCLIGLTFGCSVGPRV

SEQ ID NO: 166505 - protein, 70 aa, Triticum aestivum
  Clone ID: PAT_TA_60923.pep
FSLFFIFFSVVSIFQPRSSALITGYKRMRTKAVAARGKRPDDIISNENSNESQATYAVIRIIVGTDVVPR

SEQ ID NO: 166506 - protein, 140 aa, Triticum aestivum
  Clone ID: PAT_TA_60924.pep
PKIKTVKEHLRRSAVQKREAIGEEVARLLTAEFIREIYHSEWLANVVMVPKKDNSLRMCIYFKHINRACPKDHFPLPRIDQIVDSTVGCERLSFLDAYSGYHQIRLYGPDEIKTAFLAPFGCFCYVTMPFGLKNARATFM

SEQ ID NO: 166507 - protein, 52 aa, Triticum aestivum
  Clone ID: PAT_TA_60925.pep
QQYPCVVFWRPYPSVVLSQPYPSVVFSQPYHSVVLSTAVPFCRLLAVVRPGN

SEQ ID NO: 166508 - protein, 60 aa, Triticum aestivum
  Clone ID: PAT_TA_60926.pep
VVLHLKMLCRPSLQGAHKGYDVHACVHRDDCMYVCISVCICTVLRDVDNQTSILNFSGEH

SEQ ID NO: 166509 - protein, 100 aa, Triticum aestivum
  Clone ID: PAT_TA_60927.pep
HSLFSSGMHNTARSSSFRYIGSQAPQTLMTTDYCHDILSGTSMTFDDRYTSCSPLPLHNTLHAYSTDYQTLLLHSVDYTYHSMIQLRVRKDPFLDFLTVS

SEQ ID NO: 166510 - protein, 108 aa, Triticum aestivum
  Clone ID: PAT_TA_60928.pep
CEDDLVELSRDSAGIQDIWWYIRLPTMAAAIRTFSIIVQSTCAPEKPDLAGLIVLERLDRRCYSWFWYSPELYVHVSSPMRNVIPHSEIPRVSKCPFIESEGRTAGSG

SEQ ID NO: 166511 - protein, 78 aa, Triticum aestivum
  Clone ID: PAT_TA_60929.pep
FRLTLGFRLRIRAVFVPFSFLVVFISVLGSRVFVFISGTAGEKKTMTATSSICFRYVLILVYCLVNGKCREAAYECCW

SEQ ID NO: 166512 - protein, 132 aa, Triticum aestivum
  Clone ID: PAT_TA_60930.pep
RLLTNLAQCSSRIIGNAGVVHDDMMAHTHLGDDKLLIIPMMTTGVLEVEDGHFVHVNLSKQIHHGVDGVLRRCRVVGVHHQDVVRPHVGVHMIHTMLHWSATRYLLCITSMHLSTVMFIRTPIISVSFPCMI

SEQ ID NO: 166513 - protein, 88 aa, Triticum aestivum
  Clone ID: PAT_TA_60931.pep
FHRCIVVRLVPQNASRHVMRTSAHTCSTRPFYSTSADLKLHYLLVSHCSDTLATDRSALDASFDSLDPWLGCPPMSIGGTQKMWSSRS

SEQ ID NO: 166514 - protein, 54 aa, Triticum aestivum
  Clone ID: PAT_TA_60932.pep
SCTTGGPVNGDPDRWHHIGKIPSIIPFLYYLPFKNEAALLASPSTVRALFTYAY

SEQ ID NO: 166515 - protein, 62 aa, Triticum aestivum
  unsure (1)..(62): unsure at all Xaa locations
  Clone ID: PAT_TA_60933.pep
LRDRKXEVLDSRRTLANKSLDDCARRMVSSVRILWATHYPKSHIGMDGFKLINIDVPKQNNE

SEQ ID NO: 166516 - protein, 56 aa, Triticum aestivum
  Clone ID: PAT_TA_60934.pep
SNLPRARALTHLSISIINHILPGSCVKDPANTSYEHDAYRWKMQLQGKISPSRISP

SEQ ID NO: 166517 - protein, 101 aa, Triticum aestivum
  Clone ID: PAT_TA_60935.pep
PMYAWACDVSKTRRRGRGIWNQMNNGETTEMEGASAMLTGGDVLCRGCMDGMGNTSDLLDVIDATMMTLGAMVEMFLGKSTMDRWDSDGDTTNVLDGESEG

SEQ ID NO: 166518 - protein, 82 aa, Triticum aestivum
  unsure (1)..(82): unsure at all Xaa locations
  Clone ID: PAT_TA_60936.pep
MDKTEDDCSMEFLEEKGFFISFEEDGTLDWFFYSAYCECASLSDYQRLVXKNYGGTEYSMWSVYPSYRHSYDIEREYLKYCQ

SEQ ID NO: 166519 - protein, 125 aa, Triticum aestivum
  Clone ID: PAT_TA_60937.pep
KTTEGYGCEKTTEGYGCGRRQKGHFVAIDIFNGKKLEDIVPSSHNCDVPHVDRQDYQLIDITDDGYVSLLTESGNTKDDLKLPTDDVLLGQIKTGFADGKDLILSVMSAMGEEQICAVNEIGGGK

SEQ ID NO: 166520 - protein, 140 aa, Triticum aestivum
  Clone ID: PAT_TA_60938.pep
VFAIVTDLVTLGGNGLAFFVAPTKNLSMASPSQFLGLFNPQNNGNASNHVFAVELDTILNPEFRDISSNHVGVDVNGLASVVAEPAGYYDDDTGDFKNLTLIAGDAMQVWVDYDGRSTVLNVTLAPVEAPRPIKPLISVT

SEQ ID NO: 166521 - protein, 47 aa, Triticum aestivum
  Clone ID: PAT_TA_60939.pep
RCPYINLYRSPVHHSSKTYSAKLQEETERVSSLLVVVPYYTGQCGVG

SEQ ID NO: 166522 - protein, 82 aa, Triticum aestivum
  Clone ID: PAT_TA_60940.pep
RSEDGTANVRWVSSSFKGEGSNVKCSAMMETEREWGDPTGKGKATSWGGFFCWTYVTWQIVRKTIFLLHVWSGFEEPNYPNS

SEQ ID NO: 166523 - protein, 52 aa, Triticum aestivum
  Clone ID: PAT_TA_60941.pep
NYCSMVFGPKKKKDLLLQQNSLILRYKKSSMNRQNCRPPFYMDVMVAFSIGM

SEQ ID NO: 166524 - protein, 72 aa, Triticum aestivum
  Clone ID: PAT_TA_60942.pep
NKSETLRRSIKDQSITRARHRDLLTRFTDMATSPGPDYGRSSRDTVTIPHPVALDTGTCRRLPPRSGAIMLA

SEQ ID NO: 166525 - protein, 78 aa, Triticum aestivum
  Clone ID: PAT_TA_60943.pep
LGRMVAWEQDFVSPLERLVERPLATSNSIHLDRSMHVPPTILLPSYSNSFSSCSTTYVLLASCRWCLFSSIFVVLNQS

SEQ ID NO: 166526 - protein, 42 aa, Triticum aestivum
  Clone ID: PAT_TA_60944.pep
LIKLAFQLVILLHAMDNTNSDRGKGVPSFDEMMNISLMEVDP

SEQ ID NO: 166527 - protein, 67 aa, Triticum aestivum
  Clone ID: PAT_TA_60945.pep
LCLHRPGTACHPIGDTFVRTAHRPTRSTVDCTVHGPTRSALVVPKPLSSATESIDHTLFTSFLAECL

SEQ ID NO: 166528 - protein, 45 aa, Triticum aestivum
  Clone ID: PAT_TA_60946.pep
LFRSHITPEEVVFGATHLVSANLSSLGAIFLFFLRTSTTCPMSVQ

SEQ ID NO: 166529 - protein, 114 aa, Triticum aestivum
  Clone ID: PAT_TA_60947.pep
FLHKEHTMAILLKTTSIRVSSIQIMQTRVQNKRKSVWKSRYDGDISTPPSLTHCLSSNNSVDKLKVTKKNFYKLYLILLLQICRTNVHVFSKDYELTIFTITLRSHIYSYQWHN

SEQ ID NO: 166530 - protein, 54 aa, Triticum aestivum
  Clone ID: PAT_TA_60948.pep
NSRPFFFILIAFLDLVLRHCSMNDDHHTSTHLQLNDHNSVLEQGTVFRWALTQE

SEQ ID NO: 166531 - protein, 105 aa, Triticum aestivum
  Clone ID: PAT_TA_60949.pep
PQNGTAARRRQKGTAARRRQKGTAARRRQKGTAARRRQKGTAARRRQKGTAARRRHKGTAARRRHNGTAARRRQNGTAARRRQNGTAARTRQNGNAARRRPKGYS

SEQ ID NO: 166532 - protein, 70 aa, Triticum aestivum
  Clone ID: PAT_TA_60950.pep
KGLAFAEYETEEIAQYAVRLFSGLVRLHNRTLKFAISGQDKASSNVNVPVTPKMKPIPLSNPPQPMRFGD

SEQ ID NO: 166533 - protein, 96 aa, Triticum aestivum
  Clone ID: PAT_TA_60951.pep
PNTGVCVLPLSRCSSAGTMLNCATCELHCDFLEEERMAQYSRDKYFPQLRIKVIDLLREPSNTSLAVPTHKITETSTQHKQWVVNPLRVNCKDQLS

SEQ ID NO: 166534 - protein, 141 aa, Triticum aestivum
  Clone ID: PAT_TA_60952.pep
TLNDLFSLDPVSYEHLLQLKRYEGKLLDLELRFVTTNNENADQSEELLPGGRGMRVTDHNVTTYIHLIANHRLNYQIRSQSTHFLRGFQQLIPKEWIDMFNEHEVQFLISGSPKSLDIDDLRSNTNYAGGYHEGHQVIDMF

SEQ ID NO: 166535 - protein, 136 aa, Triticum aestivum
  Clone ID: PAT_TA_60953.pep
GQHADCGGAMISKLSNTTWPKGAFMETMKVWQQEWFYITEPRRTKWAAIPEFRFGPPMRLTSWNAKGHDWGSQMEVHELQMCITNMLGKNVGLSNVVQIKLFRCILPYQRRASPMWEFKPEGPRALPHFLCTMNES

SEQ ID NO: 166536 - protein, 51 aa, Triticum aestivum
  Clone ID: PAT_TA_60954.pep
AGQETNSYEPGSNIALVQKPHGYTNEIRNAAPPIQHVKDPLNTTSHPSSIE

SEQ ID NO: 166537 - protein, 74 aa, Triticum aestivum
  Clone ID: PAT_TA_60955.pep
NMTRRLNLDIPQNNTFLLPRDVLAATDHLIGMKFGTGILDDDDMNHLKNKRIRSVADLLQDQFGLALGRLQHAV

SEQ ID NO: 166538 - protein, 76 aa, Triticum aestivum
  Clone ID: PAT_TA_60956.pep
HCEKTTEGYGCEKTTEGYGCEKTTEGTHHVATASLTRETPVSCFHALGHGISVAFATPACVRAMFSPAPPLFKVEW

SEQ ID NO: 166539 - protein, 93 aa, Triticum aestivum
  Clone ID: PAT_TA_60957.pep
PHSMDPSNDLWRVPFRISSHMQVAGCPIGVLTLCSGVMLACSARLMLSNLVQALESFFDHRGFAIQSHVNFPMLVGQKPRSGKSVVLSFISWI

SEQ ID NO: 166540 - protein, 79 aa, Triticum aestivum
  Clone ID: PAT_TA_60958.pep
RSCLQRLRASCIWTPTQMGLSNICLLCYSNLLRSSGCQSTTQGRPNHTDRSPKPHVSETLDRHLPTSALLRLPLPPHHD

SEQ ID NO: 166541 - protein, 93 aa, Triticum aestivum
  Clone ID: PAT_TA_60959.pep
STEVRTLDRKRRRTYSSDACYLVGRHYLSHAYRASLDRVLDIVPGGKCCLEPGVVDLFCLARQTWACMYGSIPGWRFCQLVTKELLHDGPYCT

SEQ ID NO: 166542 - protein, 96 aa, Triticum aestivum
  Clone ID: PAT_TA_60960.pep
LRRQKGTAARRRQKGTAARRRQKGTAARRRQKGTAARRRQKGEEPEEWRRLEQEPQGAQGQALHHPALRRHAPPLARLIDSLAPWMDPSFHSMDGV

SEQ ID NO: 166543 - protein, 62 aa, Triticum aestivum
  Clone ID: PAT_TA_60961.pep
HIPVCRLLRLESQSWGNPVDVTIYKTRCTRSVLRVHPLLLDTRQWNTIIFRSHCPRKSPATV

SEQ ID NO: 166544 - protein, 78 aa, Triticum aestivum
  Clone ID: PAT_TA_60962.pep
RRPRPAAGRAHHSTLRMSKFLPLMSFNSVVLLMNDPAHEPPETPLILQELATLKQTLHRFHSSGVQVPRLLTMKTRSC

SEQ ID NO: 166545 - protein, 130 aa, Triticum aestivum
  Clone ID: PAT_TA_60963.pep
RRVRLREDDRRVRLREDDRRVRLREDYRRVRLREDDRRGNRFGMNHSAISNITWKFIESLEDHAISHLKWPDPEEMATIKAKFEKLQGLPNCCGAIDTTHIVMCSSAQPNSNVWLDCENRNCMVLQAVVD

SEQ ID NO: 166546 - protein, 61 aa, Triticum aestivum
  Clone ID: PAT_TA_60964.pep
ILSALLPFVTNRSAPYHEQNYPKSQAESEVRHGFQAPQTTKTTHTEVASGSITRNITSNQH

SEQ ID NO: 166547 - protein, 91 aa, Triticum aestivum
  Clone ID: PAT_TA_60965.pep
AVVYINAARITPLAELANPGQRRAREPHGRVVMAVKALGVAMQARGGTFFAALTQLVVTCHLYGVSGQLATSGDFMRISLLSPPIVSKEGS

SEQ ID NO: 166548 - protein, 72 aa, Triticum aestivum
  Clone ID: PAT_TA_60966.pep
TTGGTAASHLKLHPSGSMHVAPTIPSYSNSFSSCSTTYVLLPPFQNKCLNFLLALVQIYTKVNTLILGRREY

SEQ ID NO: 166549 - protein, 69 aa, Triticum aestivum
  Clone ID: PAT_TA_60967.pep
TIRNPDFFYLNIIFLLFPFIFIFSFLFLFICFKFMSFFSLCHMFTQCQANLDRRLFCHADLVSCCVFGF

SEQ ID NO: 166550 - protein, 97 aa, Triticum aestivum
  Clone ID: PAT_TA_60968.pep
HNFRIGLPTIHFRHPNLTQFCLCCELRLLRCFGYLGTVLPIPTPCIVHHLTLHFCIASQNQSLHFRNPIELPQNHHRLHYHRLTFVLEILSCGFSVS

SEQ ID NO: 166551 - protein, 111 aa, Triticum aestivum
  Clone ID: PAT_TA_60969.pep
DATNARIGRLQNEVAQLDMENMSEEDKNQLSILHMKNIQEENPGMVANLIFTKEQDLGLEDLNKLFSELSRVEKDIRFRLPPLHGREDNIGGTCVAQDLQLPSVLPADHLG

SEQ ID NO: 166552 - protein, 90 aa, Triticum aestivum
  Clone ID: PAT_TA_60970.pep
STWQAFLGCWNIFVLIRYRKRLSPRFINKASTKHKVHKVPLETRTHQTPPHEGPTQTHKTQHTRNNGSAVGTAPQAQHNTQGRTYNKRRW

SEQ ID NO: 166553 - protein, 102 aa, Triticum aestivum
  Clone ID: PAT_TA_60971.pep
SPPEDRLKISKNQATVPPLLKQRDMILVPCIYFGAGAATKTCRFIRVNHGEREGGSTTLQRVARWYQPTMVQVPDRTLVLAFLRFVSAFPGRMFVQWEKTFS

SEQ ID NO: 166554 - protein, 68 aa, Triticum aestivum
  Clone ID: PAT_TA_60972.pep
TYNTLTLAQQHLTVLALRTNYNPVSSRHTSTALTNPGIQHPCVSNASTADCIMLITSYRRVWTLYSPR

SEQ ID NO: 166555 - protein, 68 aa, Triticum aestivum
  Clone ID: PAT_TA_60973.pep
AVSGTTPSGCTQRAPTGMVSTRNGPPNPSDGQTTKKTRSRREEIPSNQLLDVGPSLHTMVYGWLHRLQ

SEQ ID NO: 166556 - protein, 53 aa, Triticum aestivum
  Clone ID: PAT_TA_60974.pep
NYAILGDKKEKVKPKLIKVKTIQKRFISQNRSTLNCCYEVYVNQWINVDLHIV

SEQ ID NO: 166557 - protein, 65 aa, Triticum aestivum
  Clone ID: PAT_TA_60975.pep
NVERPMMHPPSISIMRMHKGSNGRTGKREAARCECNTVCTHIKAPLHSNASTTSYAPKHLPKHLH

SEQ ID NO: 166558 - protein, 82 aa, Triticum aestivum
  Clone ID: PAT_TA_60976.pep
FFFCCNRRGFLLHPVNYSATAIHGDDDDSAAIVVNFCYDWQFPFMMSCDSDSVCVATAIAFCYDQHVILSHPCHGVTAARCS

SEQ ID NO: 166559 - protein, 75 aa, Triticum aestivum
  Clone ID: PAT_TA_60977.pep
VYDFELSITWKFFLSISSTPFNSTLSPMTQKEKMKLRKQKSSRFMFLELIPSLQGHTNFFTFKVFRKSSVEELHF

SEQ ID NO: 166560 - protein, 139 aa, Triticum aestivum
  Clone ID: PAT_TA_60978.pep
GDVLNSLRSLSLSGDSWPNYVRLEWEADDEEIRSLPTTLLIATVDDLTDTLDFDSEDIDGMDDNAGDEQEPPPTGRWTATSSYDIYIWWIHQKKTTARNGRMQQRIIPSSSNKSDEGGAALNPATVKIAITAQERITPR

SEQ ID NO: 166561 - protein, 59 aa, Triticum aestivum
  Clone ID: PAT_TA_60979.pep
YHDCMVGASWVHMCVRYSNYHGMCVCRNSAVNLHRFMFFTLCIWSCIIAEKMKEGRNRT

SEQ ID NO: 166562 - protein, 54 aa, Triticum aestivum
  Clone ID: PAT_TA_60980.pep
RLDRGNDLKRISNFNLPSKCDQGGNMVRTITARDPIYDTGRIIQKIKYPCKKLP

SEQ ID NO: 166563 - protein, 79 aa, Triticum aestivum
  Clone ID: PAT_TA_60981.pep
RYRGQWFAPDECSQSLPVRIYYGRELSQLLTVYGMCREGWSHFGGNMYLHELNHDSFLIISFRPYQCRVYMLQRSCYRM

SEQ ID NO: 166564 - protein, 58 aa, Triticum aestivum
  Clone ID: PAT_TA_60982.pep
FVSLCFLFWNMHECAYYILVLIKEERQKNASTKIIQDSYIYSSLLIYLCNLWKKVWTR

SEQ ID NO: 166565 - protein, 63 aa, Triticum aestivum
  Clone ID: PAT_TA_60983.pep
RPSTRPNITALHYESTQWTTSCNGSVCAWRYEHHGRRLRQLNSTLACATHYTGFKVSESIESV

SEQ ID NO: 166566 - protein, 85 aa, Triticum aestivum
  Clone ID: PAT_TA_60984.pep
PQVCYLFSNHTLVLLPPSATSLHVDLFPLHHLPNLLSSALLVTQTKTLICTIKGNPTSCRLIHVWDNKESKEESIVEETRYRTRI

SEQ ID NO: 166567 - protein, 65 aa, Triticum aestivum
  Clone ID: PAT_TA_60985.pep
SGTLRLPGMCPSSLMYVSFQGNDSRYSFKSLQHPTSCVHMFMINTVRCWVMYACSYKFVPPWVYD

SEQ ID NO: 166568 - protein, 86 aa, Triticum aestivum
  Clone ID: PAT_TA_60986.pep
YRSIWHFYSSSNVFTVRWGAVEQTDHRQIPTPPTGRRLSLELEERNEGEELAVAQTLLSDGTRVDRIGVQSTRTSFLGDKAVICLI

SEQ ID NO: 166569 - protein, 54 aa, Triticum aestivum
  Clone ID: PAT_TA_60987.pep
QAERDSGLVLDHEEHGPLRGRKSGCIVNGPTVLWAFSRPKEKPGRYWTMKGMGH

SEQ ID NO: 166570 - protein, 64 aa, Triticum aestivum
  unsure (1)..(64): unsure at all Xaa locations
  Clone ID: PAT_TA_60988.pep
ILQDFQRIXTTLIYSGGIQMVHCRATHVSYICFMCFSMISSSVQTSSWEKNDGIIHHVENNTEA

SEQ ID NO: 166571 - protein, 109 aa, Triticum aestivum
  Clone ID: PAT_TA_60989.pep
QQIYMISLLIQRTGCNKHILSSTNCSRKCLVSFILLNDKGKKKLLMLIYMSCVTLFLTVRFNSENTNHDMIRDRGSSFAAASKKRRNASLNVLQEGNVLRLTIGCDVDP

SEQ ID NO: 166572 - protein, 131 aa, Triticum aestivum
  unsure (1)..(131): unsure at all Xaa locations
  Clone ID: PAT_TA_60990.pep
TCQKSTRFEDITRYDGERAPYTRTQMKKPSASRSGMASIDYDLDADFSHRKSGHSXSRQHASMAXAAPLDFVIRRXSKIDPEXILARAKQQVQDQRRLTMSXKLQXLKTPNKKNLQASKLIVERRGMVKYL

SEQ ID NO: 166573 - protein, 94 aa, Triticum aestivum
  Clone ID: PAT_TA_60991.pep
YKYMGRHSMQTQVRFKGAVSWVCYGYVPSHQSPVTLIQTVAVILQCRASTNMLLQQHSRVCMLCCWLFRDTHLQLAALTQHQSDHAGFLSNQGQ

SEQ ID NO: 166574 - protein, 89 aa, Triticum aestivum
  Clone ID: PAT_TA_60992.pep
MDSGESLMLRYTNGDTAILHHVFLLIFIMFWVNISLYDAILMSFLSYYARFIWRGKLPSAGILDLKRVTLEIAILRKAPNDLKIYGDLF

SEQ ID NO: 166575 - protein, 47 aa, Triticum aestivum
  Clone ID: PAT_TA_60993.pep
DMTGYPCATCPLLQVSLTYCTRNISHTWVRSIQQHYSYKGFSPKGCH

SEQ ID NO: 166576 - protein, 42 aa, Triticum aestivum
  Clone ID: PAT_TA_60994.pep
YQWTFDFYVSYVVFYSISTDTSVHIHAHTLTPMNAHTHTVPL

SEQ ID NO: 166577 - protein, 48 aa, Triticum aestivum
  Clone ID: PAT_TA_60995.pep
MAPIRRQKGTAARRRQKGTAARRRQKGTAARRRQKGTAAKDDRRGALD

SEQ ID NO: 166578 - protein, 66 aa, Triticum aestivum
  Clone ID: PAT_TA_60996.pep
NTSCASLISFKYDLIELLFVLHFNLLSMVLQNASCASFIYFELGYWLVYINCRMLHELHLYLLEYE

SEQ ID NO: 166579 - protein, 78 aa, Triticum aestivum
  Clone ID: PAT_TA_60997.pep
APRRRQKGCRQAVIVGICFSLVLLVLSLCFICCSPQQYGDDCFVIQSGRKPYFERMACLVTVRRGERLAWPESSKSKA

SEQ ID NO: 166580 - protein, 79 aa, Triticum aestivum
  Clone ID: PAT_TA_60998.pep
VDLGLHIGPTDLNTSVTPSCSNHLRFCNLGATELFHSVTLTGSGYKYPRVRFWKLLQIPSARGYPALPPRVSESSSRHQ

SEQ ID NO: 166581 - protein, 144 aa, Triticum aestivum
  unsure (1)..(144): unsure at all Xaa locations
  Clone ID: PAT_TA_60999.pep
RLREDDRRGLSLTQKKYSLDLLRRAGMLKCKSVGVLLTPDDATEYRSIVGGLQYLTITRPDLSFAVNRFXNYLKALLDTHWSAFKHILHCVRLTVFFGLHLRPASSMVLSAFSDADWARSPDDRRSTGGYAVFFGPNLIAWNAR

SEQ ID NO: 166582 - protein, 96 aa, Triticum aestivum
  Clone ID: PAT_TA_61000.pep
KENRSCRTMVHGTLTMKFFIICSERLNVTILPKYTACMYVHSTQFLICISLYTCSNLYQLFVSFPFFRQHVVPTSLVIHPPSICKPPRNRVWCRPG

SEQ ID NO: 166583 - protein, 105 aa, Triticum aestivum
  Clone ID: PAT_TA_61001.pep
RRIILEVVSYFYYRSSIFVSFLATSVAFVLYILYDLNILYVVMILASVIMLIFQIWSGVVFFWPLCALIDVVWLCDSDDAHAMVAWVEREEGWESATCIRTEEAT

SEQ ID NO: 166584 - protein, 88 aa, Triticum aestivum
  unsure (1)..(88): unsure at all Xaa locations
  Clone ID: PAT_TA_61002.pep
AIKRQKGIMVRLKKLSYGHFDKSTXPVLVAQKVCVRVYMGVTTSQLDELAAETAAALTASQPDYASLAARIVVSNLPPSGNSLCGAHK

SEQ ID NO: 166585 - protein, 55 aa, Triticum aestivum
  Clone ID: PAT_TA_61003.pep
TLAVVHDLHFLLESQKLLKLFAQYWYKNCLFCPNFQNFWSTGSMVDVQITTDCHV

SEQ ID NO: 166586 - protein, 96 aa, Triticum aestivum
  Clone ID: PAT_TA_61004.pep
CCNLHIYFVRQKKPCIAYFSKGPNRIIQDASLVNHHHTIPDQPQVAKHLALQIIIIISSLRFCRSRQLTRQRQGCSATFETYYHHHHRAGPCAVRK

SEQ ID NO: 166587 - protein, 108 aa, Triticum aestivum
  Clone ID: PAT_TA_61005.pep
LFDHHSFILGRRFTTEVATLTILEGPNTSLLSFNNMQFDLACHSPVPTCCVQLSAYETRWISCVLQRCKKIGELGIRTVGAYATHQIKTRCLKICFETNDSSLYPRRP

SEQ ID NO: 166588 - protein, 113 aa, Triticum aestivum
  Clone ID: PAT_TA_61006.pep
FIFLFSFILALVKNTRLGLMRSIKSYRMLLRNASPLSVILRIERPNSPRLAQSAHDARMEAQGAFQKIQELRKFPPGRPFIRQSNYLRRSFFLLTRIWSFPGEFGIFRAIVLA

SEQ ID NO: 166589 - protein, 39 aa, Triticum aestivum
  Clone ID: PAT_TA_61007.pep
LEPMDLLLIYRVTSQNNLYRYPASIIIALLDECTPISCC

SEQ ID NO: 166590 - protein, 89 aa, Triticum aestivum
  Clone ID: PAT_TA_61008.pep
LFLLCLQCTITRIAMILKRNRQKGSSFHYEAARFRRFSVLIDHGELVLNYIGMFIPNPMCSTKSSERKLTKVENKKIMDLFGGTGRTSV

SEQ ID NO: 166591 - protein, 110 aa, Triticum aestivum
  Clone ID: PAT_TA_61009.pep
RISQTCLGFKKKSSIFSNFFKKEKNIVSNLTLGYDLKGLSWPLVGRILFIKWLATRSQVFEGIILILQLIIFFRIFLGFTNTCRLVVYQCVGPYTNCCASHALFYATSVI

SEQ ID NO: 166592 - protein, 39 aa, Triticum aestivum
  Clone ID: PAT_TA_61010.pep
IRHPPPCHEQQQHQIGVGNRERSSVMGFLLHFTYELKQG

SEQ ID NO: 166593 - protein, 73 aa, Triticum aestivum
  Clone ID: PAT_TA_61011.pep
VTTGLVSHKYGEKAAAATNEGLDAAGHAIGTAWAVFKLRQALNPKSVLKPTSLAKSSIKAGAAELRSKSSKSE

SEQ ID NO: 166594 - protein, 64 aa, Triticum aestivum
  Clone ID: PAT_TA_61012.pep
ICGHVQRRLRHKRGGRASGSWYRERSEEETRQIFVEWKATNDKIYSSIDHEEHRYAIFKDALRG

SEQ ID NO: 166595 - protein, 101 aa, Triticum aestivum
  Clone ID: PAT_TA_61013.pep
AKIKPAVNQIGTHPYFQRDPLVKFCQKHGICVTAHTPLGGSTANTELFGSVSCLDDPVIKSLAEKYGKSPAQLVLRWGLQRNTVVIPKTSKEERLEENLAV

SEQ ID NO: 166596 - protein, 96 aa, Triticum aestivum
  unsure (1)..(96): unsure at all Xaa locations
  Clone ID: PAT_TA_61014.pep
AAKRRQKGRAWLHERELPERRYEYKYVLDGNWVCTEHDMITKPNADCHVNNYIQVAKDGTSDEXTAMQERLTGPYPDPAQDDTLITKDYLEQYTEQ

SEQ ID NO: 166597 - protein, 79 aa, Triticum aestivum
  Clone ID: PAT_TA_61015.pep
YVTRHLMSCPLPHAAFESAWLCGPHNVHSYSPIAHALLPHSLCFIETLPLLSNLTCTPPASSPWCRNKQTRGRSRCLRQ

SEQ ID NO: 166598 - protein, 84 aa, Triticum aestivum
  Clone ID: PAT_TA_61016.pep
DAHNPHTHGVYFSFTCPIVYVYISVHSVICHCGIVAEGFASGIDELTSDCHAIHHWGIVAEGFASSIDELTSDCYYYCYLLLYH

SEQ ID NO: 166599 - protein, 71 aa, Triticum aestivum
  unsure (1)..(71): unsure at all Xaa locations
  Clone ID: PAT_TA_61017.pep
RIRNIELAQEVDDDEMNTDHTRGPVRDEFINRKWLYTSKRLPTTHTAYSITNRLDGSTVCHVFTHCXEVMW

SEQ ID NO: 166600 - protein, 126 aa, Triticum aestivum
  unsure (1)..(126): unsure at all Xaa locations
  Clone ID: PAT_TA_61018.pep
RPHQSHNVPLRGCSQETLSVIGVLDVVARSIQALHLAYSVGLNCVIRPVQLPHADPEDGTKVSHAINGTMSPGAQHDTDERELSALQAVMKCLXDHRLEEDYPVDPPQTRVIQLENANAYKTKAVE

SEQ ID NO: 166601 - protein, 99 aa, Triticum aestivum
  Clone ID: PAT_TA_61019.pep
RLTVRPRACDASRVALARQGIFHLSFSLLRVRVLAIYPCLFMFLAFNPKHTQRSCVRQPTITPRHIKWVVIEEKIHLMLYCLGSRPRHCIVQFALSNLA

SEQ ID NO: 166602 - protein, 100 aa, Triticum aestivum
  Clone ID: PAT_TA_61020.pep
SRARRRQKGTAARRRQKGTAARRRQKGTAARRRQKGTAARRRQKGTAARRRQKGTAARRRQKGGRGIGRGARGGYGSVGGGRGGCGGGADANVHGPKAHQ

SEQ ID NO: 166603 - protein, 51 aa, Triticum aestivum
  Clone ID: PAT_TA_61021.pep
LPIHHQINISWNHFLPTGYYNGIMNELHHHISTNALVQTCKRVVRGGVFGY

SEQ ID NO: 166604 - protein, 70 aa, Triticum aestivum
  Clone ID: PAT_TA_61022.pep
AYTRDMRTGKISGASVLGNWGAAPIPWGPPIQHCRRPINGSAQRGARSRLTGQWLTFVGKSTGRGKPRAK

SEQ ID NO: 166605 - protein, 67 aa, Triticum aestivum
  Clone ID: PAT_TA_61023.pep
YVTTTCMVPVMLKQCGRWRHQRLDIHTPTYSEGRNHFVICNLLTVHEWKIIYFHELEHLYRIGTSTI

SEQ ID NO: 166606 - protein, 112 aa, Triticum aestivum
  Clone ID: PAT_TA_61024.pep
RIGNRLSLVGLPSAAARLAPPPSPNRSKVPRRERERERERERVCTCGTSQWRIAGRRGSPSSSPSGQSVRRRRAVGDFEGGCPLFACSAADGANTDFRAHIFFFLRNFRAHI

SEQ ID NO: 166607 - protein, 61 aa, Triticum aestivum
  Clone ID: PAT_TA_61025.pep
TYVTFLICFVNTHTHTHTQRQREREREREREMRKSSFFVTWSIFFYTYLTFFKYLVTFQYI

SEQ ID NO: 166608 - protein, 49 aa, Triticum aestivum
  Clone ID: PAT_TA_61026.pep
LSSLLILMLLVLWAGKAQVTYQRARCQGKATSIYILSLLNTTQKVNLTY

SEQ ID NO: 166609 - protein, 111 aa, Triticum aestivum
  Clone ID: PAT_TA_61027.pep
ACRYRSYIPRSTARRRQKGKILSKRRRDYFKKLLKGAVLTTSLSSLFASWTERRRLLEMDRARRLPRTKVRRSPRTNLHSSCSSTALYPLLYLMLKVDVMWRRPPVLRNRN

SEQ ID NO: 166610 - protein, 107 aa, Triticum aestivum
  Clone ID: PAT_TA_61028.pep
QSPEFRIVVSRTFWPLDHALRFMCFFLFYGCERGSVGLGLVDWPQFRVSRFAPGLDVVPVKLLDLLSGEPSPHRAVLSTRWSRAVNQFMSLSVTLPRFLSPPLPFSS

SEQ ID NO: 166611 - protein, 87 aa, Triticum aestivum
  Clone ID: PAT_TA_61029.pep
RVPVRCMPNCAMRRGEAPGPCSWVGGAPLPGEEGASEFRSRALANLGHCGRDERILAASWWMAFSVRGSGKMEPSSGWLAGISFHFS

SEQ ID NO: 166612 - protein, 112 aa, Triticum aestivum
  Clone ID: PAT_TA_61030.pep
ARRRQKGFTRVVNAKRQVVAGTLHDLMVEVVDSGKKSMYKAKVWVKPWQNFKAVVEFRHAGDFQSESSVASDASTGQAILKLSLQTDMAPKMHSNENTGLSVDSSSSQAHTV

SEQ ID NO: 166613 - protein, 59 aa, Triticum aestivum
  Clone ID: PAT_TA_61031.pep
RRQKGEDEEEEVITEEGLQTILDKLRVQHHYCLYCGCKKCRERLRALANECPGPNEDDH

SEQ ID NO: 166614 - protein, 64 aa, Triticum aestivum
  Clone ID: PAT_TA_61032.pep
MLVPSNDVSTQSTFGKRSARLLKKAHELAVLCEADLGVLLFDSAAGRWNTAAPTPGPLGLRRPR

SEQ ID NO: 166615 - protein, 51 aa, Triticum aestivum
  Clone ID: PAT_TA_61033.pep
IHTAARRRQKGWSEFQQAVQAGHKGTYGHIRLMKPKQSIYTYPAPDCMCQG

SEQ ID NO: 166616 - protein, 67 aa, Triticum aestivum
  Clone ID: PAT_TA_61034.pep
PQKGTAARRRQKGTAAIRPHNGTAPRRRQTGTAPTRRQKGTAATRRHKGTAATILHTGHSFLKHSQT

SEQ ID NO: 166617 - protein, 56 aa, Triticum aestivum
  Clone ID: PAT_TA_61035.pep
IAERGCKSLLCKSPFKFYNAIWRYTEVLNCLLRTLSSNSMQGDEKVTALFLRAHRF

SEQ ID NO: 166618 - protein, 137 aa, Triticum aestivum
  Clone ID: PAT_TA_61036.pep
MLFDIDLKIQASYHGEHVPLVSLMSRLDGKAIVGHPIQIEILVDGSTDHLVSGGDISMEESTGAPTAWRTGRRTAMQRIPRSNPLGASMDCGNEGRLAYPDWEMKPVFSKYSTSANHQVKKSMSNSKQRSSASKSQK

SEQ ID NO: 166619 - protein, 153 aa, Triticum aestivum
  unsure (1)..(153): unsure at all Xaa locations
  Clone ID: PAT_TA_61037.pep
PKEPGFDARSIIVQGLVDRNRAHQEGHDRDVPTSSRVHVSGPECFSRAIQAAVIPPNFRLATGVSKFTGESKPDTWLEDYRVAVHIGSGNDEVSMNXLPLMLEGSARARLNQLAPSSIYTWEDLARVFVRTFEGTFKRPNRLTDLQVCMQKSN

SEQ ID NO: 166620 - protein, 76 aa, Triticum aestivum
  Clone ID: PAT_TA_61038.pep
WQRWRFGALACLEKVNVLHVALLASVRRAAPSFMCNIVGWQETGEGMAGNGGVFIERHQLMETYNIKEHRASTRSR

SEQ ID NO: 166621 - protein, 95 aa, Triticum aestivum
  Clone ID: PAT_TA_61039.pep
TAIFILCLGILSGESSLGNPAPPGRLTQIVISPTVGVVLHHRATRSQMGGGPRIPIWLSHTAHLLERDRPNMGGFRRADRTSNLRPKAGEQEPQA

SEQ ID NO: 166622 - protein, 64 aa, Triticum aestivum
  Clone ID: PAT_TA_61040.pep
SSESVMEKSVVARSPPQKPYHPPPVQQQLRDWNRWREEEEVLVHLSERRGLPFIGARAATEIKI

SEQ ID NO: 166623 - protein, 80 aa, Triticum aestivum
  Clone ID: PAT_TA_61041.pep
RCQMDDYVRMYRRRYARSVDSLILLSMSLFAKSATGIYHRTEVDTLLLIHLDHTSISNCFVVDRRSCPSIEDGDCSNYGR

SEQ ID NO: 166624 - protein, 60 aa, Triticum aestivum
  Clone ID: PAT_TA_61042.pep
PLVVVAARAAQPSGIRQDGNTVCSHPCIIFLFHPRFHPKLNFSSFFDSLVRIQLFIPDPS

SEQ ID NO: 166625 - protein, 54 aa, Triticum aestivum
  Clone ID: PAT_TA_61043.pep
HDIDIVLGFRVPRHLVSLCLTLYIKRGKNHVLREHRRNYLAVAHIYGQFCWCLC

SEQ ID NO: 166626 - protein, 82 aa, Triticum aestivum
  Clone ID: PAT_TA_61044.pep
QACVCTMVKRSNKNANQWRIRRQIGFEAAAFVTCDTNHLFYSASYALDKMQTCTANFLQHVLWAGPCAGPSGPVFLLFVFEL

SEQ ID NO: 166627 - protein, 44 aa, Triticum aestivum
  Clone ID: PAT_TA_61045.pep
GINGQKFRILSVSCTIGSHHVNSSSKLQNAGLFVVSAQNLNSQN

SEQ ID NO: 166628 - protein, 77 aa, Triticum aestivum
  Clone ID: PAT_TA_61046.pep
RKRARTEEQTSPTYTAKNIITGQNILWPMSSVAAACQLAQENCRNHMALLLARLKGVVQKGTTQLQNQRTRTARAKS

SEQ ID NO: 166629 - protein, 70 aa, Triticum aestivum
  Clone ID: PAT_TA_61047.pep
CTRLPGRWMSPRSTISLVAMLLQRRQSRCCHQRRLPCMADLLSAPTTSPVDSSQVSTWKWMVERDVLLTG

SEQ ID NO: 166630 - protein, 143 aa, Triticum aestivum
  unsure (1)..(143): unsure at all Xaa locations
  Clone ID: PAT_TA_61048.pep
KDQGGLGIENLEVKNRCLLNKWLXKLSVETDATWAQILRSKYLHSKTLSQVRARSSDSPFWKGLMKVKVTLFNRTRFLIGNGASTRFWEDTWLGETPLAIQYPSLYRIVQRREVFVATVLQSTPLNMQFRTALIGNRWEAWLH

SEQ ID NO: 166631 - protein, 49 aa, Triticum aestivum
  Clone ID: PAT_TA_61049.pep
GINRLKTPNHVNMHVHVGVPSQDGTREPQNTRNPSYMHHRAPNPPFCRL

SEQ ID NO: 166632 - protein, 146 aa, Triticum aestivum
  Clone ID: PAT_TA_61050.pep
HRNGVSGLGVIKVRIQNTALLLKYLFKFYNREDVPWVQLIWETHYPNKVPHTAEPVGSFWWKDVMQLSGIFCGITRVVPGDGCTSLFWKDVWFGDPASTLMDTHPRAFSYALNEDDSVAKILKSTDPASIFSLPLSIQAREDISEI

SEQ ID NO: 166633 - protein, 59 aa, Triticum aestivum
  Clone ID: PAT_TA_61051.pep
STPCWDLLESLTCGPLTSWPACQLHLVTSANLTVILGQSFPVIKFDRQLYRKKNKTIKQ

SEQ ID NO: 166634 - protein, 62 aa, Triticum aestivum
  Clone ID: PAT_TA_61052.pep
LHVSRLRNSHAELKNVPKQIMDIIIHERYKRELVPFGANAHHARLATLFFNISLTEFPIVYA

SEQ ID NO: 166635 - protein, 101 aa, Triticum aestivum
  Clone ID: PAT_TA_61053.pep
FFVQVATLTSTCNGGRFSFVIVATPTSTRNWTLTFFVSVASPCNWGSKLFCPNFKFMPNIFLFRLQVHPRLATDLFLVSIASPPSTRKCNPIIFVLITSPP

SEQ ID NO: 166636 - protein, 95 aa, Triticum aestivum
  Clone ID: PAT_TA_61054.pep
NFPERKRIDISGKTYATRKNMTCPKCDMFKICMTCTLQICVLTGKISLTKKITTIALTKKTPRILLTTPKTTKTPKILLTTPKTQQWTHEKKRAL

SEQ ID NO: 166637 - protein, 73 aa, Triticum aestivum
  Clone ID: PAT_TA_61055.pep
RGGGGGAKSYFVCEIGGHHEASAPCDADTRDEASPGSPALQLAHASARGTAIGELHLTDAGAATGTIPAASRV

SEQ ID NO: 166638 - protein, 58 aa, Triticum aestivum
  Clone ID: PAT_TA_61056.pep
LDLERELVFLSDQKAKKLLSYNISTGKLNEIQDVLMWHQYYVYVPCYSELPAQEPSVD

SEQ ID NO: 166639 - protein, 65 aa, Triticum aestivum
  Clone ID: PAT_TA_61057.pep
WGKMVTIDTRPCAGTTHSGMPTPNGRYATTLHRVCYAAYGKSIYLHVYCICSPRKALQVDRHTQV

SEQ ID NO: 166640 - protein, 60 aa, Triticum aestivum
  Clone ID: PAT_TA_61058.pep
PILPMDVAVDRPLGRRTYVGFADKLNGSACLTLTPQVSCTISNVTGLDQQLYSMMEIVPV

SEQ ID NO: 166641 - protein, 121 aa, Triticum aestivum
  Clone ID: PAT_TA_61059.pep
STGCEKTTEGVLISGRRPLQVTASPMSEFEKASLISWARHLAHVGRLLDLVDSALLDVNRDQALLCITVALLCIQRSPTRRPSSEEALEMLSGEGEPPHLPVEFSPSPPGGFPLRSPRKGR

SEQ ID NO: 166642 - protein, 112 aa, Triticum aestivum
  Clone ID: PAT_TA_61060.pep
PPRSLSTPLSSVPTPWSCTPTHATRGGPSRRKKCFHPREGRCGRDVLPCHRRLHLLSVPTEYGLYLWLNSSTTPSHADAGRSTSAHRTSMQCTVQVKQRTLSPTKKQRAGRK

SEQ ID NO: 166643 - protein, 93 aa, Triticum aestivum
  Clone ID: PAT_TA_61061.pep
KLRNKRRLAKGEMTMCVGSVSKVDVIKHRMLPLPSRFVFALSMIGLCLSQYGYSFKENNGYSVYLNNTFNGLAPKMNLDRSDTHVRTKKKGKR

SEQ ID NO: 166644 - protein, 68 aa, Triticum aestivum
  Clone ID: PAT_TA_61062.pep
CGKPRRHANRTPSRKDKHSIIKGSETPTYGLHQDPKRAVVERATPPAPPRPASKFRAPSVVILTIPMS

SEQ ID NO: 166645 - protein, 54 aa, Triticum aestivum
  Clone ID: PAT_TA_61063.pep
ADTQYRALCHAPDMDMCHKNFKRHSQVDIEIDIKRIPNTVTLIQDMDEPHVNPK

SEQ ID NO: 166646 - protein, 50 aa, Triticum aestivum
  Clone ID: PAT_TA_61064.pep
RPSHSGGTYMDDKVYTQTLPFLCCKFSTVTVFISSVHHFVRKLVCFSINP

SEQ ID NO: 166647 - protein, 55 aa, Triticum aestivum
  Clone ID: PAT_TA_61065.pep
PYRIIYILFRGNNLYILIRSNHNLSTYMLYICCELCSKYVRVDVMAYTYQLLLVF

SEQ ID NO: 166648 - protein, 42 aa, Triticum aestivum
  Clone ID: PAT_TA_61066.pep
ETSSFLAELPGKQTPLEHSDIAHFFPSHACIRTATALCMILL

SEQ ID NO: 166649 - protein, 55 aa, Triticum aestivum
  Clone ID: PAT_TA_61067.pep
RRRTPLARRWMFMCGKSQGACMRVFYLWVCVPIFKSHVQIEIVCIRSDRNSYLNF

SEQ ID NO: 166650 - protein, 99 aa, Triticum aestivum
  Clone ID: PAT_TA_61068.pep
RTYEMIDVSCTTTSQLRYSTHGDLRPAGQRTADIDIDDRLERAYPRRYSPHADDHVPLVEQVCLHVCTCGTVMVYGVCLCVAVYSICTCLIRRNDHPYQ

SEQ ID NO: 166651 - protein, 54 aa, Triticum aestivum
  Clone ID: PAT_TA_61069.pep
EPVHEVMHVIHVALLCTVEHSMQRSTMREVVQILSELPGPAGNQRDEDELHLAG

SEQ ID NO: 166652 - protein, 51 aa, Triticum aestivum
  unsure (1)..(51): unsure at all Xaa locations
  Clone ID: PAT_TA_61070.pep
LCCFCLSTYSWMVRLHDLYTSARXNLFSAMFGTILPAGLLMIDVISAIINH

SEQ ID NO: 166653 - protein, 65 aa, Triticum aestivum
  Clone ID: PAT_TA_61071.pep
LLITRLLPCPQEQTELLKAHNIDHVSRYKYAINNLSIKIFHQINQLASTTTCNQHYCTPRYQSDI

SEQ ID NO: 166654 - protein, 131 aa, Triticum aestivum
  Clone ID: PAT_TA_61072.pep
GPLRQDDRMVRLRQDDRMDRYVWWLFLEGYVAGLWYRRKLPRTTEANNGEKVRVRVIHGLNISHKALIYLLHQSINHQDIVLHACSYGDTLLRQYHRSSPTATHNEYKHHTSHAPTSLHKASPYVHATALT

SEQ ID NO: 166655 - protein, 40 aa, Triticum aestivum
  Clone ID: PAT_TA_61073.pep
YIIIIMMMMAMSQHPIQFSLIIIMVPYPNQLSASQTAATA

SEQ ID NO: 166656 - protein, 126 aa, Triticum aestivum
  unsure (1)..(126): unsure at all Xaa locations
  Clone ID: PAT_TA_61074.pep
APPACCGTGRPRAPCSATCAGTSSRPPRALAWGTARAARTTPPTPASPASSPATTPSTSPRXGTSLPAPPPATSPRTPPPPWPRSSSSSCTSRSSRWPPWRGYSARQAPAPRTPSPPAGATTACSG

SEQ ID NO: 166657 - protein, 117 aa, Triticum aestivum
  Clone ID: PAT_TA_61075.pep
IDIDNPVVGARWDRIAEAHGQLVRRQELEWSSCMELGPPQESSARVVGLDSALSAWRCTLCGSLWRCLVSGSRQTHHIRVSAGRSVPWWTRSTPVTLPPPHCALAPPSSSVHTSPPR

SEQ ID NO: 166658 - protein, 232 aa, Triticum aestivum
  unsure (1)..(232): unsure at all Xaa locations
  Clone ID: PAT_TA_61076.pep
MAGSRRGGDEEACRVGLLDGHGGAKKDDWQVVAGGEESSKLGRRVLEESKKLWVIVAPAMFSRIVTFSMNVITQAFAGHLGDLELAAISIANTVVVGFSFGLMLGMASALETLCGQAFGAKKFHMMGVYMQRSWIVLLGCAVLLLPMYFFAEDVLLLTGQSPELSAMAGRVSVWFIPLHFSFALLFPLQRFLQCQMKNFVSAAAXGVALCVHLLVSWLFITRFQFGLVGIAL

SEQ ID NO: 166659 - protein, 44 aa, Triticum aestivum
  Clone ID: PAT_TA_61077.pep
SVDAAVAKAHIRRQAHSDVCSQDKNTFCSSTFWYHKHGDQVPFP

SEQ ID NO: 166660 - protein, 211 aa, Triticum aestivum
  unsure (1)..(211): unsure at all Xaa locations
  Clone ID: PAT_TA_61078.pep
DVAADVPAPEVEVTADPVVETTAEAAAGDAKPAKETKAKAAKAKKPSAPRKPRATPAHPTYAEMVSEAITALKERTGSSQYAIAKFVEDKHKAHLPGNFRKILSVQLKKLVASGKLTKVKASYKLSAAAAKPKPAAKKKPAAKKKAPAKKTATKTKAKAPAKKAAAKPKAKAPAKTKAAAKPKAAAKPKAKAPAKTKAXAKPKAAAKPKAR

SEQ ID NO: 166661 - protein, 229 aa, Triticum aestivum
  Clone ID: PAT_TA_61079.pep
MASRAAAAVAVLALLCAAVHSSEGQLSPTFHAATCPDLEHIVEFHVAETFRRDVGVAPALIRILFHDCFPQGCDAPFFNVSTLVSSFGDRGLDVADLVSLSGAHTFGVAHCPAFEDRFKPVFDTNPAIDGKFATSLRNKCAGDNPAGTLTQNLDVRTPDAFDNKYYFDLIARQGLFKSDQGLIDHPTTKRMATRFSLNEGAFFEQFARSMTKMSNMDLLTGTKGEIRNN

SEQ ID NO: 166662 - protein, 51 aa, Triticum aestivum
  Clone ID: PAT_TA_61080.pep
HLQNMSPYSLEYIIIIMMMMAMSQHPIQFSLIIIMVPYPNQLSASQTAATA

SEQ ID NO: 166663 - protein, 72 aa, Triticum aestivum
  Clone ID: PAT_TA_61081.pep
SISERVRRTKISERIRKLQELVPHMEKQTNTSDMLDLAVDYIKELQMQVKVIKDGRANCTCPAGRPPRSFAN

SEQ ID NO: 166664 - protein, 93 aa, Triticum aestivum
  Clone ID: PAT_TA_61082.pep
PFTPVPIVPKGTPPSATEDFNTSARTFKGNLTSCNRAFLMPQSGPFPLPPATGANPDHAANNKDLELPVGPPSQQNIATAISCRNAVGVIQVV

SEQ ID NO: 166665 - protein, 143 aa, Triticum aestivum
  unsure (1)..(143): unsure at all Xaa locations
  Clone ID: PAT_TA_61083.pep
LIGPSDNNAFQDKGKVYITYANKYWKKVNNRQPFIRFAPVPLVNKXWGKILFSGVNTRKGGQVLVQKFAFANFVERAIFFSDSKETGXAVVDQVDFGGSVNSAPKGTPTAGFLPYKGTFFGFKKGAFVISGPAGQKLLTTKDL

SEQ ID NO: 166666 - protein, 101 aa, Triticum aestivum
  Clone ID: PAT_TA_61084.pep
GGTLSLPWRPGSCCFCLRSSSQPPLLHCVSHEFRVQLFPPFSFRPCVPVLLDRGASDEDLRPRLLRRQLLPARSTAVGTLKKDAQACSSEVKIKIKIIQRE

SEQ ID NO: 166667 - protein, 124 aa, Triticum aestivum
  unsure (1)..(124): unsure at all Xaa locations
  Clone ID: PAT_TA_61085.pep
DYLGNPNXLVPAQSNPPRVGFQVLFKGLVKRFPHKGPPGVGEGKDLYPGGQKFXPLGPSEDPVPFFEPKVKEIKKGPPPQFPKFGFFVQTIVPRKGPLENLFDPPDDPVPNKARVFPPQIAPGF

SEQ ID NO: 166668 - protein, 225 aa, Triticum aestivum
  unsure (1)..(225): unsure at all Xaa locations
  Clone ID: PAT_TA_61086.pep
DNRGLPFPAVRAKLCWPRRHSSGRALVTCASGEAEFVVNDCFALGIGGRYIKCRVSTKYENCVFAEGIPMHVTEPELYDAFHSTTARRILNIRLLRVKGNAIASPSVSTCEEELVREISPFMPNKSFPGQNFRVEXVFPPEENDSLTRATITFDGSLHREAARALDHLEGHFLPXCCQPWQIIQCNHVFHSTLSXSVRVYNVITXXVTSLLESFQSQKGVSYNFE

SEQ ID NO: 166669 - protein, 150 aa, Triticum aestivum
  unsure (1)..(150): unsure at all Xaa locations
  Clone ID: PAT_TA_61087.pep
HASAHASDRYKYELKNKVSNNYVADLATRRNLARLPGIGVLYSELVQGIPPILPHLVEKVPSIHSVLVXITASPVNGLMDEIEFIQRGMXXGVVHLLGETNVVAEQNAGLVKKIIVDYAYNFMRKNFRQPEKITCVPHNRLLRVGMTYEI

SEQ ID NO: 166670 - protein, 53 aa, Triticum aestivum
  Clone ID: PAT_TA_61088.pep
MEQGADSAAARRMARVASHLRPPTSQEEEVAILKGSNWRAEGAAPGGRVGGRG

SEQ ID NO: 166671 - protein, 81 aa, Triticum aestivum
  unsure (1)..(81): unsure at all Xaa locations
  Clone ID: PAT_TA_61089.pep
MAAAGAATPVGAAPRVGLLYDDRMCAHATPDGERXPENPERVRAIRRKLDAEGVPSRCVDMKAKEAKEKYIXLXHTRNXIK

SEQ ID NO: 166672 - protein, 83 aa, Triticum aestivum
  Clone ID: PAT_TA_61090.pep
HAVRKKKKKKKKKKKKKKKKKKKKKKKKKKKKKKKKKKKKKKKKKKKKKKKKKKKKKGGPFLKIQFFLPVLAKFYFFFWGPKI

SEQ ID NO: 166673 - protein, 146 aa, Triticum aestivum
  Clone ID: PAT_TA_61091.pep
LAQPTCSVQPSLPPSESTVTAMAASLGRGDRGAREPPWLRSANREAGGAWLAGGAGDGGWHSGSRRRLAKWIERRRIMLCYFYWRENTLTCGPHVYFDGLPNCSQTLLVWLPHQRLWWDLSVSFTISQCLSEGSTFFENCHHNVGV

SEQ ID NO: 166674 - protein, 108 aa, Triticum aestivum
  Clone ID: PAT_TA_61092.pep
TGKRSEGERGVRIRIAHRQQRVPKEEKPMDRPGKIVPEAEGEGLDPLHSGGRQAKSWDKEMAQAPPLIKGVFRCGHRFPHGDYWWPLTVWVGWLVKEGRPEMMPDEMG

SEQ ID NO: 166675 - protein, 64 aa, Triticum aestivum
  unsure (1)..(64): unsure at all Xaa locations
  Clone ID: PAT_TA_61093.pep
PSRLNPSRRNXGXRWRRTRRPWRGSPSDLTDRRRREACGGRSGGLGTQERTGLVRNFXXXGGGG

SEQ ID NO: 166676 - protein, 86 aa, Triticum aestivum
  unsure (1)..(86): unsure at all Xaa locations
  Clone ID: PAT_TA_61094.pep
SFDAGYGSSIMSPLEGTKEAPEMRFRNPWYAPGVAERIEVVFVLGPPLXLQRETVKRSGPVLIFSGTSKRGSGGALKAGDHGLFGN

SEQ ID NO: 166677 - protein, 44 aa, Triticum aestivum
  Clone ID: PAT_TA_61095.pep
TLTALLAPLAPPICFSLQPKNTRLTSLLERHIFRYRGSKKKVFF

SEQ ID NO: 166678 - protein, 117 aa, Triticum aestivum
  Clone ID: PAT_TA_61096.pep
KRGIKKNGTNPGEGKNLTNPPPKKKVWDPGPPKKKKPFGKTPPPPPGGKKKKRPRGGIINFGQPNNPNRGKGPPPRGTKKKHHGGAPNPPKKNRGAKKTGPQKTQKGPPFGGKKGPL

SEQ ID NO: 166679 - protein, 74 aa, Triticum aestivum
  Clone ID: PAT_TA_61097.pep
PPPPPPPPPPPPPPPPPPPPPPPPPPFFFFFFFLEFFFYPPFSKNPGGGGEKHKKGPLEKGGTNFFLNQTFFWF

SEQ ID NO: 166680 - protein, 100 aa, Triticum aestivum
  unsure (1)..(100): unsure at all Xaa locations
  Clone ID: PAT_TA_61098.pep
MSRGGSAGGGQSSLGYLFGDGEPAKPAAAPAAKPAPAEKPALAAADVTKQIPAXIPGSRANNYYRADXQNTGNXLTDRXSTKVNAXXXGXXXLGYLFXGK

SEQ ID NO: 166681 - protein, 124 aa, Triticum aestivum
  unsure (1)..(124): unsure at all Xaa locations
  Clone ID: PAT_TA_61099.pep
CPCDPAATPAAPPTTAAPIPVPGPGRPGPPVLLPAPAPPEPFPPLDDPPALLPPPPPPPPPPLPPLAAPXXSSPPSPLPPXPXSXSXSXPXPAXQEAPWKRAGTQSRTSRRAPSRLGPGMGVPV

SEQ ID NO: 166682 - protein, 34 aa, Triticum aestivum
  Clone ID: PAT_TA_61100.pep
HIPSLHCEFQITKCVWDATLFADVSWMCYIFIVS

SEQ ID NO: 166683 - protein, 197 aa, Triticum aestivum
  unsure (1)..(197): unsure at all Xaa locations
  Clone ID: PAT_TA_61101.pep
MQSSSKAGGNGDEEHLVCVTGAGSFIGSWVVKELLLRGYHVRGTARDPAGRKNVHLLALDGAGERLTLCRADVMHGDSLRAAFRGCRGVFHVASPVSNDPELVPEAVEGTRTVVNAXADAGVRRLVFTSSYXAVHMDPNRSPDXVVDESCWSDYDYWKQTGNLYCCAKMMXEVXXKEGXTKRGXLELXVVVPXTTIG

SEQ ID NO: 166684 - protein, 91 aa, Triticum aestivum
  Clone ID: PAT_TA_61102.pep
FTGIQTLGRCRAIASLNLLRGRSIAGHCAITIANDVSLPCHPRLDCQAICLLRHSNHGKIQFGSRSQGIPTPLTKTRIIVCVWGGGSSCQS

SEQ ID NO: 166685 - protein, 213 aa, Triticum aestivum
  Clone ID: PAT_TA_61103.pep
MGCISSKALSRSGSLRGKANQGLQRSGLVEEIILSNSKRNGDQFLALLCTSSSAARKSKVDAAEQIETINVSDLLAGLEEENTPEGAEERGDDRKPDGGKTSSPRCAYDGAAGRAVSFRTLEEFDALVSRCGSPEKAEPAPAPAAEPDASVEPPPQSSSSKEQAATATGSSESEPDAAKQLGELSATPGFDFSKSRSLRDWLLGGGQMFSPGS

SEQ ID NO: 166686 - protein, 69 aa, Triticum aestivum
  unsure (1)..(69): unsure at all Xaa locations
  Clone ID: PAT_TA_61104.pep
XQTLNLPTSTXXQTTITSTNLYXNXHTVSXSKXXKSKPNSILTKLLIPTLWLLLGVXVPSIHKDLLLIG

SEQ ID NO: 166687 - protein, 237 aa, Triticum aestivum
  unsure (1)..(237): unsure at all Xaa locations
  Clone ID: PAT_TA_61105.pep
SKSAEVETNCEVSIGSDICEQEQDGHAAPFQELVALEELFSPLEYADDRTSPPEILHETAPAEQEASEAEHEATASRRFEYQSNGENEEDEDRAPETPTYSFAAQNSGKRFLLERKRSLSLSLDGSVSSEVECAEPSTVDQLRSALQAERKTLSAMYAELEEERNAAAIATNQTMAMINRLQEEKAAMQMEALQYQRMMEEQSEYDQEAMQLLTELVTRGRGESRSWXRELELYKQK

SEQ ID NO: 166688 - protein, 140 aa, Triticum aestivum
  Clone ID: PAT_TA_61106.pep
LDQVKKVKNGGSMYVGNINYYHRPLRSGKWAVTYEEWEEEVYPPYANGPGYVISSDIAEYIVSEFDNQKLRLFKMEDVSMGMWVQKFSKTRQPVEYSHDVKFFQAGCFDGYYTAHYQSPQHMICLWRKLQSGSAQCCNAR

SEQ ID NO: 166689 - protein, 213 aa, Triticum aestivum
  Clone ID: PAT_TA_61107.pep
MYHLAKGLYLYATSKEEYSVILLGLDNAGKTTFHEQVKSMFLPNRPDPKLKTVPTVGQNVSTIPLQDMYLKLWDVGGQHSLRKLWESYYTSCHAIVFIIDSTDIGDGNIEHDENLGRLEECRLVLEDVLQHTETEGVPLLILANKQDREDCVETIRIKEGLVKKVMEGDKGSAVRDSRVLALSALTGDGVREAIEWVRTRVQWNKESRPPVMR

SEQ ID NO: 166690 - protein, 66 aa, Triticum aestivum
  unsure (1)..(66): unsure at all Xaa locations
  Clone ID: PAT_TA_61108.pep
MGCWWERXVLAVRRAWFGXXFRXGVRQSGLWRLRXEVSTCEYEDVRVMWEMLSCTVLVSSVAVTRC

SEQ ID NO: 166691 - protein, 76 aa, Triticum aestivum
  Clone ID: PAT_TA_61109.pep
LPTQSPTCAMSSTHAEKQERFPCADLKRARVFPRKSELHITVRIESPVSHYHKFCTVSFNKIITTFVANSLTRQLI

SEQ ID NO: 166692 - protein, 110 aa, Triticum aestivum
  unsure (1)..(110): unsure at all Xaa locations
  Clone ID: PAT_TA_61110.pep
MADVEYRCFVGGLAWATDDQSLQNAFSKYGDVVGAKIITDRETGRSRGFGFVTFASDEAMRQAIEAMNGQDLDGRNITVNEAQSRRSGGGGGGGFGGGGGXGYGGQRREG

SEQ ID NO: 166693 - protein, 227 aa, Triticum aestivum
  Clone ID: PAT_TA_61111.pep
MEKGTPALGWAARDESGLLSPYSFSRRVQKDDDVTIKVLFCGICHTDLHIAKNEWGNALYPIVPGHEIVGVVIDVGPGVESFKAGDTVGVGYFIDSCRSCDTCSKGYENYCSTLVLTSNGVDYDGAITQGGFSDVLVVNQDYVLRVPESLSLAGAAPLLCAGVTVYSPMMQYGLNAPGKHLGVVGLGGLGHMAVKFGKAFRMTVTVISSSPRKREEALERLGADAFL

SEQ ID NO: 166694 - protein, 83 aa, Triticum aestivum
  unsure (1)..(83): unsure at all Xaa locations
  Clone ID: PAT_TA_61112.pep
SITPPPQKLPQSSQTFPPPSTKISLSXKISPXXTETKTMLGNPSSLVNNLSFMVSLSFMKKKSLLVGXSLLLXNPSSWXRLFF

SEQ ID NO: 166695 - protein, 194 aa, Triticum aestivum
  unsure (1)..(194): unsure at all Xaa locations
  Clone ID: PAT_TA_61113.pep
VCVQWPGSYCDTKQSCCYPRSGKPAADFGIHGLWPNRDDGSYPQNCNPDSAFDPSKVSDILSSLRSSWPTLACPTNDGLRFWAHEWEKHGTCAQNLFNEHGYFQAAXPARPAPXLDALATAGISPDGGYYTMGAIKGAIQEGTGFAPHVDCNRDESGNSQLFQLYFCVHADAXRFVECPVQPGGRPCGNRIEFP

SEQ ID NO: 166696 - protein, 125 aa, Triticum aestivum
  Clone ID: PAT_TA_61114.pep
FPHRARNLYSIQYGVIWDRSQVARAEEFIGWLRSFYKFMAPYVSKDPRAAYVNYQDLDLGVNNWTRAAGWSSAEAVARARTSWGKAYFGENFDRLVRAKTEADPGNVFNNAQSIPPLNIGAEEHT

SEQ ID NO: 166697 - protein, 228 aa, Triticum aestivum
  unsure (1)..(228): unsure at all Xaa locations
  Clone ID: PAT_TA_61115.pep
ELWRIARVPGERTYYYPDEVQLVGTCNGLLCICDNRGERTGGTVTLVNPATGEKLSIPPLPGAAQFALNYHCQKWDRAYSFAYHPTSGQYKVVHVPCSFDRVCDYDAAHVLTLGEAAWREVPDSNGKRCNLHAGIVSVDGVTYWVTDGGTARIVSLDLDDEHVASSTMALPSLPDKPDDYNLTEVDGRLGVVLRSPSXTREAWVRDRGKWICPYVLRCKWQQIPRPYF

SEQ ID NO: 166698 - protein, 59 aa, Triticum aestivum
  Clone ID: PAT_TA_61116.pep
IQSYRHQCDRIIISSTYLSKEIYITLLRQRNIRRKGQLLVLRVVLCMIGSLGLLVADEW

SEQ ID NO: 166699 - protein, 45 aa, Triticum aestivum
  Clone ID: PAT_TA_61117.pep
VFLFASMLLIAHILRNILRLESMKTQRIHRVQYASIYFRCTPTRP

SEQ ID NO: 166700 - protein, 122 aa, Triticum aestivum
  Clone ID: PAT_TA_61118.pep
ITQNDYTPSSGSSTRLHARTYRLNWQRLPSKLIRGGTQLIYACRPSTHTYTHTHSHFVYYYSHELRAEVRLSRVICLFEIFFFFLLFLCGGRCMAGRRLRRRRWRKKRSRRGGAGRRRGGRW

SEQ ID NO: 166701 - protein, 104 aa, Triticum aestivum
  Clone ID: PAT_TA_61119.pep
RTTSSATSGRAAMSQQHSSVTGWQRGLFGVLFLAHASLHNDCTHGPGISKQISDSASQNSITVAITTMRAAKHTTPVFLLVNAMPRYLSLFYTVCMFDLFLPTR

SEQ ID NO: 166702 - protein, 221 aa, Triticum aestivum
  unsure (1)..(221): unsure at all Xaa locations
  Clone ID: PAT_TA_61120.pep
VQDHAAELRQPALDAHQHPPLPYRPXGRAQRARSPRRRHGHGFLRLRHSTCQKPVDRAAAAAATHHHIDVDGLLLASPHGPAAGVGLVLPQGHGQAEPHGSSRAGAAKSSVSVCLCLDRDAERCSMPCQCARGGILMAERAWPGTRRARAAQAARELCRSHDAACSRLTALRVVWWCDRTAPRRPCEACLDRWDNARIGGGRRVQSLCSAGGVPAWVDCLR

SEQ ID NO: 166703 - protein, 90 aa, Triticum aestivum
  Clone ID: PAT_TA_61121.pep
KPYPGVFIRAPVVEQVIGASDGRQPVEVLAKLPGRVDKMKSGVSQANTKDDSGDIVAVRQGNVLGTSFHPELTKDERIHVWWLKEILNQQ

SEQ ID NO: 166704 - protein, 205 aa, Triticum aestivum
  unsure (1)..(205): unsure at all Xaa locations
  Clone ID: PAT_TA_61122.pep
MDSALASAAAIADQRQKIEQYRHILASVISSSPPDIPQAKRFLNHMVSDEVPLVVSRQLLQTFAQELGKLEPDSQKEVAHYALTQIQPRVVSFEEQVVVIREKLAELYESEQQWSRAAQMLSGIDLDSGIRMLDDTNKLSKCVQIARLYLEDDDAVNAEAFINKASFLVTNSNXXVLNLQYKVCYARILDLKRKFLEAALRYYGI

SEQ ID NO: 166705 - protein, 82 aa, Triticum aestivum
  Clone ID: PAT_TA_61123.pep
MHLYSYLLQMMELELKKLEDTIKSIHEEMFYLREREEEMQNINRQTNSRMGWLSFLSLGICLSVAGLQLWHLKTFFERKKLL

SEQ ID NO: 166706 - protein, 124 aa, Triticum aestivum
  Clone ID: PAT_TA_61124.pep
VLLHDQGMSSACGLHGGRCCKTWYACSDPRVVLSPGCSTASLHLSATPVVLVIEAHSRRRTPQHYLPGPPNLSTGLQNIAQVYTLLACCSIAICQICSPHDTSLPPSAHISFTENEKLKINQQR

SEQ ID NO: 166707 - protein, 58 aa, Triticum aestivum
  Clone ID: PAT_TA_61125.pep
DAWADAWADAWAPLYCRSVRRGNSRIFFAIRRTQVGLRPTRNNCMTGEKSFCYVVSHC

SEQ ID NO: 166708 - protein, 75 aa, Triticum aestivum
  Clone ID: PAT_TA_61126.pep
GSVLHHLTGHPAHRGLSFDSLGEAYDFYNLYCWEIGFGIRYGKSRSNAERMKLMQEIICGCSLNVCVAGEAGSEE

SEQ ID NO: 166709 - protein, 80 aa, Triticum aestivum
  unsure (1)..(80): unsure at all Xaa locations
  Clone ID: PAT_TA_61127.pep
RIAICFIPISCQLCVKFRWIGNSCLFGRIPLCSCSRGVRLGWGGPPTIFSRAIWYHRLDQQRGARVFVSRESTGSSIISX

SEQ ID NO: 166710 - protein, 235 aa, Triticum aestivum
  Clone ID: PAT_TA_61128.pep
KDGQTREHALLAFTLGVKQMICCCNKMDATTPKYSKARYEEIVKEVSSYLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAEL

SEQ ID NO: 166711 - protein, 191 aa, Triticum aestivum
  unsure (1)..(191): unsure at all Xaa locations
  Clone ID: PAT_TA_61129.pep
MLIGVRNRATLKKTEPAKLPRREREREREREMGGAVKVYGVGASPFVATVLLCLEETGADYELVPLDMAAREQRTEPHLSRNPFGKIPVLEDGELTLFESRAISRYVLREYGGTSATDLPRESSLEESAMVDVWTEVEAHQYQPAXEHXVQQCXILPFIXXARDQAVVDENXXQLEKXLDVYEARXXTHAY

SEQ ID NO: 166712 - protein, 149 aa, Triticum aestivum
  Clone ID: PAT_TA_61130.pep
QGPKGLEGEASYPGQAPPWPPRPTATTRRRLATRVAKGTASTSDGHLLRSPSLHHQRPPPRLHSPLNETGRTDPRHHPPRRTRDDPATPSDGGEGEEKGGGVAGGGLGYRRPSRPCGSNVGALRVFFPQPVDEVLALQERIMHWVGRVG

SEQ ID NO: 166713 - protein, 50 aa, Triticum aestivum
  unsure (1)..(50): unsure at all Xaa locations
  Clone ID: PAT_TA_61131.pep
MTWGSQREREXERAVVRKPNFKNXGDGXTLEQCRERDKEGVEEKXXKKVV

SEQ ID NO: 166714 - protein, 132 aa, Triticum aestivum
  Clone ID: PAT_TA_61132.pep
ADCLQSFKPPPLRGGDASVNSVHLFPKNSDHIVVCNKTSSIYIMTLQGQVVKSFSSGKREGGDFVAASVSPKGEWIYCVGEDMNMYCFSHQSGKLEHLMKVHDKDVIGITHHPHRNLVATYAEDCMMKIWKP

SEQ ID NO: 166715 - protein, 58 aa, Triticum aestivum
  Clone ID: PAT_TA_61133.pep
ITTSTTRLLLKGEDDPHMPWPFLAAASREAKDGRMKAPEASRKNMPATTLYMASVMWT

SEQ ID NO: 166716 - protein, 69 aa, Triticum aestivum
  unsure (1)..(69): unsure at all Xaa locations
  Clone ID: PAT_TA_61134.pep
DAWXKKGITCIFSGVGWFLIFQSALLDLVFPPLALYPQSCDVRVEFVFTNMRIQQRQERGQKERATFFT

SEQ ID NO: 166717 - protein, 45 aa, Triticum aestivum
  Clone ID: PAT_TA_61135.pep
LARTPMRRAGEPEEVAAVVSFLCMPAASFVTGQVIAVDGGRTISA

SEQ ID NO: 166718 - protein, 81 aa, Triticum aestivum
  Clone ID: PAT_TA_61136.pep
CALNGHVGQEGPGKCFRLFQDCEFDKMAESTIPEIKPCNLANIVLQLKALGTGDIIGFHFMKKPSRLTNEHASTEWSRGVF

SEQ ID NO: 166719 - protein, 235 aa, Triticum aestivum
  unsure (1)..(235): unsure at all Xaa locations
  Clone ID: PAT_TA_61137.pep
MEAAISVVTGELVSRFISFLKNKYNSSLSHAQSEKMEERLQHLLMRVSIVVEEADVRYITNSGMLLQLKMLSGAMYKGYHMLDTMRFQNHQESACFDKVRINDSSSNNLYLSIPFKRSRTKTEMDDKAMRLESDGALESLEIVVANMTEFVVFLGGCERMSRRPYDVHLYTNNFMFSRHAEKQKLLSFLLEHNDFHAPAVLPIIGGVGVGKKTLXAHVCADERVRSQXXTTLHLN

SEQ ID NO: 166720 - protein, 68 aa, Triticum aestivum
  Clone ID: PAT_TA_61138.pep
ISPLHFTQHLSTKRTTITHRKSHLYFILTVMQGATDLTSVTTALHTRVFILRSRYRRTTGGGYRGKAY

SEQ ID NO: 166721 - protein, 99 aa, Triticum aestivum
  unsure (1)..(99): unsure at all Xaa locations
  Clone ID: PAT_TA_61139.pep
RTPFRILRQSLGVVGNCTIQGRIQGGEKHHLFPFMFVPEQKIFLPSKLWHGIYGGQKEFQDATNYGQGYWRDLALRVGEEVRSGCLSNLXHHSPTHRHC

SEQ ID NO: 166722 - protein, 183 aa, Triticum aestivum
  unsure (1)..(183): unsure at all Xaa locations
  Clone ID: PAT_TA_61140.pep
MSKVYDWFEERLEIQAIADDITSKYVPPHVNIFYCLGGITLTCFLVQVATGFAMTFYYRPTVTEAFSSVQYIMTEANFGWLIRSVHRWSASMMVLMMILHVFRVYLTGGFKKPRELTWVTGVVLAVLTASFGVTGYSLPXDQIGYWAVKIVTGVPDAIPVIGSPLVELLRGSASVGQSTLTRF

SEQ ID NO: 166723 - protein, 85 aa, Triticum aestivum
  Clone ID: PAT_TA_61141.pep
GANSAMVEYFGAYYFTRSQQHKGKKEITGAGSCRKNDLCHYYILQKRMPSSLRHISRSEEDQRPYWVLQILVTAITAENQHRLRC

SEQ ID NO: 166724 - protein, 119 aa, Triticum aestivum
  Clone ID: PAT_TA_61142.pep
AYAAYMVYKLADDSSGLDSPAQASVSIGGINRSTRKVSLQLHAGSGQQRSTRRNRRRAVEDAVLPCKRADGWVELELGEFFCEGGEDGDVSFGLAETQELGWKSGLIVQGIEIRRKKLG

SEQ ID NO: 166725 - protein, 175 aa, Triticum aestivum
  Clone ID: PAT_TA_61143.pep
MGNASSMLTQYDIEEVQEHCSYLFSQQEIVSLYERFCQLDRSAKGFVSEDEFLSIPEFSTNPLSKRLLRMVDGLNFKEFVSFLSTFSARASLQQKIELIFKVYDIDGKGKVSFKDLVEVLRDLTGSSMSEQQREQVLTKVLEEAGYTQDSTLALEDFVTIIDHPGLKMEVEVPID

SEQ ID NO: 166726 - protein, 147 aa, Triticum aestivum
  unsure (1)..(147): unsure at all Xaa locations
  Clone ID: PAT_TA_61144.pep
HASGPVRRHPAAGHRRAPTSPPVGFRNIVAGRVHPLIHLHSPVSLPFTPRPHPSLFAAGRRRSSTTRTGRHRNSTTAAGRHRSSTPTPPPVVPLLISGREHQLATTAGQPLTRAAAPPXAFLSPNLQHQRRPYSRWKRKRQIGMHIT

SEQ ID NO: 166727 - protein, 88 aa, Triticum aestivum
  Clone ID: PAT_TA_61145.pep
PRVRPRVRKKKKKKKKKKKKKKKKKKKKKKKKKKKKKKKKKKKKKKKKKKKKKKKGGGRFKEPNFTTPGLKSIIFFLGPPKLISWAGF

SEQ ID NO: 166728 - protein, 143 aa, Triticum aestivum
  Clone ID: PAT_TA_61146.pep
ADAFVVYQGHHGDKAVYRANVILPSSAFSEKEGTYENTEGCTQWTIPAVPTVGDARDDWKIVRALSEVAGAPLPYDSVAAVRSRISMVAPNLVRVDEREPSVISAEVKPPVKQQVSPAPFKAAVENFYMTDAITRASKIMAQC

SEQ ID NO: 166729 - protein, 90 aa, Triticum aestivum
  Clone ID: PAT_TA_61147.pep
LLHEAGLPEGVLNIVSGFGPTAGAALASHMDVDKIAFTGSTDTAKVILELSARSNLKPVTLGRGGKSPFIAVDDADIDQAVELAHCALVF

SEQ ID NO: 166730 - protein, 198 aa, Triticum aestivum
  unsure (1)..(198): unsure at all Xaa locations
  Clone ID: PAT_TA_61148.pep
MELVGRLAWLVAAAALALAATVARCDPQVPCYFIFGDSLVDNGNNNYIVSLARANYPPYGIDFAGGPSGRFTNGLTTVDVIAQLLGFDNFIPPYAATGGDQLLNGVNFASAAAGIRAETGQQLGGRIPFAXQVQNYQTAVQTLVNILXDRDTASERLSQCIFTVGMGSNDYLKHYFQPAFYSTGSRYTPGQFGDSLIA

SEQ ID NO: 166731 - protein, 60 aa, Triticum aestivum
  Clone ID: PAT_TA_61149.pep
GEVLWSGRTDASGQNRSQYDAAPRLAEMRERMVARGVSASPVQMPFCTQGNATECAQVDG

SEQ ID NO: 166732 - protein, 58 aa, Triticum aestivum
  Clone ID: PAT_TA_61150.pep
LKEEAIHSYSLRFVYIKCRTYRSVKKLEEVYFQSSSQPDLGRPPIKRKTALDQKPVKK

SEQ ID NO: 166733 - protein, 158 aa, Triticum aestivum
  Clone ID: PAT_TA_61151.pep
DLVVVNPVLVQGPALQPAVNASLTHVLKYLDGSAKTYANAVQAYVHVRDTAAAHVLVFESPAAAGRYLCVADGAVLHREDVVTILRKFFPEYPIPSRCSDEVNPRKQPYKMSNQRLRELGLEFTPVAQCLYDTVVSFQEKGVLPAPPAPAQPAMKEIN

SEQ ID NO: 166734 - protein, 70 aa, Triticum aestivum
  Clone ID: PAT_TA_61152.pep
PFSSHELKIKSSKLLLKKCMLHVQLLCYTNVHLKKRNHKIRNQDQPKLLIEILTKVGTSISEFCIPHGRI

SEQ ID NO: 166735 - protein, 159 aa, Triticum aestivum
  unsure (1)..(159): unsure at all Xaa locations
  Clone ID: PAT_TA_61153.pep
MLHGPTCAGGEKRGKKIMLIGMTSAAATFLFASLYVLIMHRKGKRLWFLLCKKTSSNIEKNYEAMIVSYGSLAPKRFMYSEVMKITSSRNNQLGKGGYGVXVFKGRLHDGRLVAVKFLHDCKGNGDEFVNEVMSIGRTSHVNVVSLFGXFCLKGSKRAL

SEQ ID NO: 166736 - protein, 181 aa, Triticum aestivum
  Clone ID: PAT_TA_61154.pep
PRVRPRVRPRVRPRVRSKHVISARLYREHGPPSEEEEKNNGASWTSYGGALRRDVANGEAIGREASRSGHGLLSKRSAWPGITVSEWRLRPLSQVRRGSRRSAAPFGARRNLAATSSADGWDAANGPCVQRCPTRPCTPTRVQALWSVHGPDLQQRRRLEKKNSTDESLHERRRGTVPKRA

SEQ ID NO: 166737 - protein, 200 aa, Triticum aestivum
  Clone ID: PAT_TA_61155.pep
ILEPCYHGRSIKEANPQNSKLPTSFKDLGTTNKPFPVRTRMLGRAWPLRAPVKAGRVPLWQEVASGVPCMSDEVATAWLDNDGVRSAIHAQSVSSIGPWLLCTDKIDFNHDAGSMISYHKNLTSQGYRAIIFSGDHDMCVPYTGSEAWTKSMGYGVVDSWRPWFTNDQVFGYTESYEHGLTFATIKGAGHTVTDYNHRKH

SEQ ID NO: 166738 - protein, 54 aa, Triticum aestivum
  Clone ID: PAT_TA_61156.pep
VQRVWKSYCKHLLLCVHPSLTISLFLYSLRAGFVCAYVLLLQGYNCTVCTCIYA

SEQ ID NO: 166739 - protein, 87 aa, Triticum aestivum
  Clone ID: PAT_TA_61157.pep
MAILEATLVLLLLLVAPAAGSDDALAASCSGARSFAADSPFASSLRQLFSLLETKARAIGFDIGSSGGVHGLALCRGDVARATCAEC

SEQ ID NO: 166740 - protein, 50 aa, Triticum aestivum
  Clone ID: PAT_TA_61158.pep
KGRPFFFFFFFFFFFFFFFFYFFFFFFFFFFFFFFFFFFFFFFFFLPTRP

SEQ ID NO: 166741 - protein, 202 aa, Triticum aestivum
  Clone ID: PAT_TA_61159.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPEKVPFVPISGFEGDNMI

SEQ ID NO: 166742 - protein, 191 aa, Triticum aestivum
  unsure (1)..(191): unsure at all Xaa locations
  Clone ID: PAT_TA_61160.pep
MASLSTPCFLLFTAILALVSWQALASDPGPLQDFCVADNSSRVLVNGFVCKDPKAVTAEDFFLAAKLDMPRDTKMSKVGSNVTLINVMKIAGLNTLGISLARIDYAPLGENPPHTHPRATEILTVLEGTLYVGFVTXNPENKLFSKELRKGDVVVFPQGLIHFQFYPNPYKPXVAIAALSSQNPGXITIAN

SEQ ID NO: 166743 - protein, 208 aa, Triticum aestivum
  Clone ID: PAT_TA_61161.pep
AMERGIFVSCSAGNAGPGAASLTNGAPWITTVGAGTLDRDFPAYVTLGNGNKYNGVSLYNGKQLPTTPVPFIYAGNASNSSMGALCMTGTLIPAKVAGKIVLCDRGTNARVQKGFVVRDAGGAGMVLANTAANGEELVADAHILPGAGVGERAGNAMRTYASSDPKPTANIVFAGTKVWIQPSPVVAAFSSRGPNTVTPGILKPDLIA

SEQ ID NO: 166744 - protein, 55 aa, Triticum aestivum
  unsure (1)..(55): unsure at all Xaa locations
  Clone ID: PAT_TA_61162.pep
CGTECTGKNKAHGKAHGGGKRCTFLGCTXGAEGTTPYCMGHGGGKPCLFEDQWSV

SEQ ID NO: 166745 - protein, 152 aa, Triticum aestivum
  unsure (1)..(152): unsure at all Xaa locations
  Clone ID: PAT_TA_61163.pep
VVTFDTTYRTNLYDIPFGLFVGVNNHFXSIILAGVLVRQETXETFEWVFSEFVRXMGGRAPETILTDQNRAMEIAIRNVMPDTAHRWCKWHVLKKAKESLGPLYXKNSDFRPEFHKGVNHMLTIDEFEEGWKYLVDKYNLKSHDYMTNLYEI

SEQ ID NO: 166746 - protein, 65 aa, Triticum aestivum
  Clone ID: PAT_TA_61164.pep
GNYPYMWIMHSIHADKHLALPPRGPVPVNYNPPPSCSAPTLAMPAVNQIHLHRNHIFFVHSAHVP

SEQ ID NO: 166747 - protein, 67 aa, Triticum aestivum
  Clone ID: PAT_TA_61165.pep
SGPAPRSSSTTSGSSGHALRAAWTYLPPSSGRSAHQVVLLEEHGWTYLAQVCSAVVRSSYLLAKLST

SEQ ID NO: 166748 - protein, 33 aa, Triticum aestivum
  Clone ID: PAT_TA_61166.pep
DGTILINARFLKHIQKRNTRFDLSMHLRGQTRK

SEQ ID NO: 166749 - protein, 90 aa, Triticum aestivum
  Clone ID: PAT_TA_61167.pep
HHGLLRHGILGVAGHLAVSQFALWVHQMKLVSGLLIGRKQEASNSGCWKVLKLQLNTLCSASLQFSFFLTGASVQFIKSETSLSLTDLFW

SEQ ID NO: 166750 - protein, 76 aa, Triticum aestivum
  Clone ID: PAT_TA_61168.pep
GSVKKDLLLPSTVSYCGRCSLRCVATGFGSLYCARVACYVAAMANRKCSDSRAGATVQAQCRACDESVMEVPERIS

SEQ ID NO: 166751 - protein, 104 aa, Triticum aestivum
  Clone ID: PAT_TA_61169.pep
HDSTVNYPLPLRISNEADQYTLEFHTVRIGGQRPWHEQRTSQTPSLPYGPHSLDYPFSGPGQIMVVEAALVQHLATWSFATGYHLEPSARTTALSRLPHPAPFP

SEQ ID NO: 166752 - protein, 147 aa, Triticum aestivum
  unsure (1)..(147): unsure at all Xaa locations
  Clone ID: PAT_TA_61170.pep
NFFFGAPKINLRGRVLKRGGWEKPGXVTKLNGLEKNPLFPSGGKKKKARTDRLSKNLPTLKGKGNPPFRGPXSGGGGGVTPRGTVTFARALGPALLVFFLFFLARLGGFPRKVLNGGSLLGSQFRVLRPLPPKKFDXGEGSRRGPSP

SEQ ID NO: 166753 - protein, 191 aa, Triticum aestivum
  unsure (1)..(191): unsure at all Xaa locations
  Clone ID: PAT_TA_61171.pep
VRFHPVICSRHHCRFCGGIFCGGCSKGRSLMPPKFGTSDPQRVCDVCGVRLECIQPYLMNQISRACQLPTKDLTDLSTLRSWLNLPWAPTMEYEIYKAANSIHGYCKVGKLNPQKSIPDSILIQAKGLAIITVVKVGMMVTYKIGTGLVIARRADGSWSPPSAISTCGGGYGAXAGAELADFIIGLRNTDA

SEQ ID NO: 166754 - protein, 73 aa, Triticum aestivum
  unsure (1)..(73): unsure at all Xaa locations
  Clone ID: PAT_TA_61172.pep
SSQKYQRVDEKRIYNFTLKSFIQVAWYRSMSCIFAPPIFISLIHTFRREXGVALDAFLSEMIVFEQLKNMSTL

SEQ ID NO: 166755 - protein, 132 aa, Triticum aestivum
  Clone ID: PAT_TA_61173.pep
MILLVLSALDYKPIKRTIWRARLVDAGAAEAVPAAAVGPGAVAEALGADEDLGVPAAPPAPAAVVAADAGEDDPRHDGQPQDDGAVERVPADPALPRAQELHRRRRHPIPLDLQPQLNLLLAAGFPGRAWSV

SEQ ID NO: 166756 - protein, 85 aa, Triticum aestivum
  Clone ID: PAT_TA_61174.pep
GAEEGGTVISGAAGGGVHGPQERRLCGKEGRRGGQRLEVGTGLAVLDRENERETGEQSRVGGKSNKMRGQERNSSKALAKTRREG

SEQ ID NO: 166757 - protein, 210 aa, Triticum aestivum
  Clone ID: PAT_TA_61175.pep
PRVRIMFGRHTEKQKLLNFMLQHSSSSPGGTPAVLPIIGAPAVGKRTLVAHVCKDERVSSHFSSILHLNGDSFRRIADHDRSFLRGKIVVVLELVADVDEKDWAEFCSTLASMDSGSKVIIISRLRSTERFGTVRPIFLNTLSYEEFSYLFKTLAFGSANPAHHPQLARIADELAEEFRTECTLVGTNIFADVMRRNLNVHFWLGMMSRL

SEQ ID NO: 166758 - protein, 147 aa, Triticum aestivum
  Clone ID: PAT_TA_61176.pep
MHRWLIGGCGDMRPPRRRIQEPQVQEEPRPRRRTSSPPKLRKTSSEPIMLSLPKDLAEFRAMSVYGNLKLFTYDQLRQATGDFSPTQIIGEGGFGVVYKGVVGAMVVAVKRLNPEGIQGDREWLTEVSCLRQYSHPNLVELIGYCYD

SEQ ID NO: 166759 - protein, 219 aa, Triticum aestivum
  unsure (1)..(219): unsure at all Xaa locations
  Clone ID: PAT_TA_61177.pep
MTEVSNISDLPTKVPTETPSPPNELDAGGHSDAEDADSSFQSDASSSTASVSESILEYRRIHGRTYHSEKYRSEQVFPNDEQQMECVDLSHHYLLLLLDSKLFLAPIKDNVQNVLDVGTGSGIWAMDFGDQFPSAEVIGTDLSPCQPQWVPPNVRFEIEDASQTWTWEDNHFDFIHIRYLFRALTDWNHVFEQXYRCCAPGGWVESVEADVRLCSDDGT

SEQ ID NO: 166760 - protein, 73 aa, Triticum aestivum
  Clone ID: PAT_TA_61178.pep
DVVCLQGRSACLLLSRGRGSLLFVDGRVHEGVRQENGAAAGGRGRWWQRLSDSLATLFFKKKCIIHRGWMFLK

SEQ ID NO: 166761 - protein, 89 aa, Triticum aestivum
  unsure (1)..(89): unsure at all Xaa locations
  Clone ID: PAT_TA_61179.pep
RPARRGALGGGGRPGGRRARXVARGGRANRVGGFELASAGDGGCPCWWWWSMVRRIGDRGEDGGGFSRRLGLGLLLMASSLSLARRTRG

SEQ ID NO: 166762 - protein, 99 aa, Triticum aestivum
  Clone ID: PAT_TA_61180.pep
RQTGGATNEEERRLWRCPGERSYLPSFLAPSVTSHPLAEVTPASGRRQTRRWCAAAGSDLAREGIPRYKVRSLVEVRRVAVAVSASSRVAEGVRGADRR

SEQ ID NO: 166763 - protein, 251 aa, Triticum aestivum
  Clone ID: PAT_TA_61181.pep
ANLAAAFSSNLSGASPPPSPRSTVPKGMDPPAREMTDSMPVVKMAAPAAGTEQVKGEAHGDKLPMSGKKRTREEVTGTDGLGCAAPVSDPHAPPSPPTFDPRSPPSPVSETHDGDSADWKAARKVLESIITPSRERQLAASKPSDVVASSYIAMLQAANYATFSMTCALELDEKLVALERDNLALWEQLEKEKAARQVAEAELERAKRAAEAERERAKATAVYTPAGGGGVHAGGWRSKRYLRGAREMKRL

SEQ ID NO: 166764 - protein, 79 aa, Triticum aestivum
  Clone ID: PAT_TA_61182.pep
MCTFKLSNNMSISKKKKKKKKKKKKKKKKNQKKKKKKKKKKKKKKKKKKKKKGGRLKKSKLTNPGMQSKNFLKGPPKLN

SEQ ID NO: 166765 - protein, 148 aa, Triticum aestivum
  Clone ID: PAT_TA_61183.pep
KKECDDDDAAARTRPRISPGTRRVEGGEGHPTPFKKDGGARRRHRVGAGKTRHGFLPTSRAHHPGPTLGSTTPAAHQHAPTVTRTPPSSHHGQRSEAGRIQTRHPKTRTGSTAAMREGTTSTGLGGSRPGIAAEAHQTPCPARPCVGP

SEQ ID NO: 166766 - protein, 93 aa, Triticum aestivum
  Clone ID: PAT_TA_61184.pep
KKKKKKKKKKKKKKKKKKKKKKKKKKKKKKKKKKKKKKKKKKKKGGPFKKNQVYKPGHAKKKFFKRAPKNKFTGRGFKTGEMEKTGGYQIKTL

SEQ ID NO: 166767 - protein, 77 aa, Triticum aestivum
  Clone ID: PAT_TA_61185.pep
FGVIRAAYSAPRASSAPRASAAAPSIAARFGQKWPECSQAVWPKRRPPAGAAATALAADLERREGRGRTGLQAPGCE

SEQ ID NO: 166768 - protein, 167 aa, Triticum aestivum
  unsure (1)..(167): unsure at all Xaa locations
  Clone ID: PAT_TA_61186.pep
MCPIKREMSGESGSPSPCSGENFCSPSASPERQQARQAGWTSAPAKRPAGRTKFRETRHPVYRGVRRRGNAGRWVCEVRVPGRRGSRLWLGTFDTAEAAARANDAXMLMLAAGGAACLNFADSXELLSVPVASSYRSLDEVRHAVVEAVEDLLRREALAEEDALSGT

SEQ ID NO: 166769 - protein, 210 aa, Triticum aestivum
  unsure (1)..(210): unsure at all Xaa locations
  Clone ID: PAT_TA_61187.pep
KAKKGDPAGNVAENSRLARSVRSWTPRSTLQPGTXLILLAGRCRGKRVILLRSVDQGVLLVTGPFKINGGPVGRVSCGYVVXTSLRGSTCFGLDEREIEENCSSKDLTDGKAXEKAGEEAFFXEGEKPQKKEGSGGRAADQKAIEKARIGNIKKGDXLASYICSFFKIXRKGGKPHEGAQENEQSLGAEGEGSRGGGTQRVKKGKGLRKG

SEQ ID NO: 166770 - protein, 128 aa, Triticum aestivum
  unsure (1)..(128): unsure at all Xaa locations
  Clone ID: PAT_TA_61188.pep
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERXLLYLGM

SEQ ID NO: 166771 - protein, 159 aa, Triticum aestivum
  Clone ID: PAT_TA_61189.pep
MDALLRRQQELVIQLRALILPALRDADSRSADLAVDLFDGVIDCITGVISKLQSITTAGVEPATAFILGNGISNGAGEGQEEKPVISNAGQKRRRNNEKRSRSLVTIGPHYDGHHWRKYGQKNINGRQHARSYYRCAYRERNWSATKTIQQQDHNGTIN

SEQ ID NO: 166772 - protein, 179 aa, Triticum aestivum; identical to SEQ ID NO: 158260
  Clone ID: PAT_TA_61190.pep

SEQ ID NO: 166773 - protein, 151 aa, Triticum aestivum
  Clone ID: PAT_TA_61191.pep
SLLVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 166774 - protein, 73 aa, Triticum aestivum
  unsure (1)..(73): unsure at all Xaa locations
  Clone ID: PAT_TA_61192.pep
MSCDSNDKXRVPEGRDDXHRMLYEDKLRDAVLLMYANXHDLTNAVNAAEITDKLGLHSLRQRHWYIQSTCATS

SEQ ID NO: 166775 - protein, 35 aa, Triticum aestivum
  Clone ID: PAT_TA_61193.pep
IKPKSNSSIAHLSHKLRSFEQKIFMRSKILLMFKV

SEQ ID NO: 166776 - protein, 188 aa, Triticum aestivum
  unsure (1)..(188): unsure at all Xaa locations
  Clone ID: PAT_TA_61194.pep
NSPQRILDLGCGTGIWSIEMAEEFPSAEVIGTDVAPTQPGWVPPNCHFEVDDIERIWTWREESFDFIFSRDLLLAIRDWPALIDQTYTHLQPGGWVEFQAIVGVLGCDDDSIPEDSYLRKFSTMXGAGFFQVRRLSYRPHEVXKGCFEERGYTNVTERXFKLPFNPWPKDPRMKLLGAWEMGESPAGT

SEQ ID NO: 166777 - protein, 53 aa, Triticum aestivum
  unsure (1)..(53): unsure at all Xaa locations
  Clone ID: PAT_TA_61195.pep
KKKKNKQXKKKSTKNKKKKKKQNRKRNKKMKXNEKKTKEFKKKKHKTKENSLT

SEQ ID NO: 166778 - protein, 231 aa, Triticum aestivum
  Clone ID: PAT_TA_61196.pep
VHLDLKPENILMDATMIPKFADFGLSRIFGEQQTRIVTDNRAGTCGYMAPEYLIRGVVSNKADIFSLGVILIEIITGDRDYPYFHHDSSQRDATTFQQFTEKVLENWRNRFTSTPKYTKEKYAHQVKQCVTIALKCVDPSMEKRPTAKHIIQVFNVADQMETHEELPSVVQCVDKLLALNTTGSKDLTPMSATEEMGDHQSSYWKKSWMRPSLRGLVTDAHRAEHHQTELS

SEQ ID NO: 166779 - protein, 218 aa, Triticum aestivum
  unsure (1)..(218): unsure at all Xaa locations
  Clone ID: PAT_TA_61197.pep
SWDCKGILYLHEDSSMRIIHRDLKPNNILVDDGMNPKIADFGLARLLGEGHTHTKTARAVGTLGYMAPEYAIHGRVSPKIDIFSFGVLVLEIVTGRRNSSSDDRDEVNLISDVWNCWTKGTISQMIEXSLDEHARSQALRCIHIGLMCVQSDPIDRPYISSVIFMLTRDNTEIQAPAQPAFFFGREAAXASPAMTDLISXPGQDVSVNAVTILEPYPR

SEQ ID NO: 166780 - protein, 39 aa, Triticum aestivum
  Clone ID: PAT_TA_61198.pep
GPSQNWFQFDVYILRHLTRICTYVHILPLRFLFGDPIPY

SEQ ID NO: 166781 - protein, 205 aa, Triticum aestivum
  unsure (1)..(205): unsure at all Xaa locations
  Clone ID: PAT_TA_61199.pep
MVKAMEMEAGRQSEVRCVDLWANEFGMRVRIALRELGVPFEYAEEDLRVRERSELVRRMNPALHMVPILIHHGRPVCGSVNIVDYIDEVWGEETRLLPGDPADRADARFWAXFVDHKVXRRPXXRVSWRARGEXXDEFGWEQXQTPXXEXCSGTXVLLFWRRISGFLDIVTIPFSSMFHGVXSSLAGSTLTLVCPKLTQWAKEVQ

SEQ ID NO: 166782 - protein, 175 aa, Triticum aestivum
  unsure (1)..(175): unsure at all Xaa locations
  Clone ID: PAT_TA_61200.pep
MAARRSGAVVAALMAVLVGLAGADFAADRAECADKLMGLATCLTYVQXRHXXRSPTPDCCSGFRQVLGASKKCLCVLVKDRDEPTLGIKFNVTRAMNLPSACNIPATFSDCPKILNMSPDSKEAEIFKQYGIEHEGKNATAAGASTTGTSGGKSADAAAGAGRHAGAFAGSALLA

SEQ ID NO: 166783 - protein, 140 aa, Triticum aestivum
  Clone ID: PAT_TA_61201.pep
RMLDVQTLLELARRNKQAGSKGRRNVAAPPYCCDQDLDQAYYFNQVYVNQHYYLDASCDQVKTSNDYFLEQVGFICYPNLARLRLNYGTHRNLGEVMKHQVPWDPGGSPWHQLEVKLNFKEWGMLVNPTSVLGWAICCSA

SEQ ID NO: 166784 - protein, 108 aa, Triticum aestivum
  unsure (1)..(108): unsure at all Xaa locations
  Clone ID: PAT_TA_61202.pep
MATTSRLLLLLAAVCLLAGAADALRLPPDASFPGAQAERLIRALNLLPGASSGRGGKVGAVAEDVPPGQLLERLVRYPXTTGGRMNLMHHDGYYGVAALNTPIVAYLC

SEQ ID NO: 166785 - protein, 212 aa, Triticum aestivum
  unsure (1)..(212): unsure at all Xaa locations
  Clone ID: PAT_TA_61203.pep
PRVRLYLPKLLRLPPPPCRSASERHGQLPEQGVYAAAAARPRREGGAGGEGGGGGAQEHRPGAAAGGRGGGGGTGVRVAGGRDEGEGGPDEGGAGVAHGAAQERRAAPRGRPPPDGQRPRRRRQAAARRRLAPAPRVHPRVPRACRRHLAQPTHGAQPAVLSSIRRSELDLLHGVLAFLLRSARVHACDPXERLLGFLCFSPKXGSMDSEWA

SEQ ID NO: 166786 - protein, 67 aa, Triticum aestivum
  unsure (1)..(67): unsure at all Xaa locations
  Clone ID: PAT_TA_61204.pep
PRWLFVLFFSAVSCMLWLTSCSLLQFMGPLLLCXTVLHASFRSPNLKXRLNTFREXFRAVWRNYSEL

SEQ ID NO: 166787 - protein, 88 aa, Triticum aestivum
  unsure (1)..(88): unsure at all Xaa locations
  Clone ID: PAT_TA_61205.pep
MNFFSPVATHGHILGGIAGPCKTGLNLAKLLNNTLAFFCXDPLSIIEPRQVFEMVSLYMDKSAGVCQSDFHDCKXLSXLQIIXDHDPF

SEQ ID NO: 166788 - protein, 212 aa, Triticum aestivum
  unsure (1)..(212): unsure at all Xaa locations
  Clone ID: PAT_TA_61206.pep
MASTIMAAASRAVVAKTPFLSGQGRAASATPLRDIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGXQYFDPLGLADDPVTFAEL

SEQ ID NO: 166789 - protein, 238 aa, Triticum aestivum
  Clone ID: PAT_TA_61207.pep
ARVYLRIITSKILGQWRRCSSAAARRGALRGLVARAATVVAPKYTTVKPLADRVLLKTKTAEQKTTGGILLPSTAQSKPQSGEVVAVGEGRTIGDSKVEVGIKVGAQVVYSKYAGMEVELNDSNHLILKEDDIIGILETEDVKDMKPLSDRVLIKVAVAEDKTAGGLLLTNSVQEKPSVGTVVAVGPGHLDEEGKRIPLPVSTGNSVLYSKYAGAEFKGADGTNYIVLRVSDLMAILS

SEQ ID NO: 166790 - protein, 85 aa, Triticum aestivum
  unsure (1)..(85): unsure at all Xaa locations
  Clone ID: PAT_TA_61208.pep
MTERTKKAGTAGKDXPRDGASLRMQITKMEASXHSKDFCESCVKLAVKSKAVAIRGCKDCGLAKAGCAYSMNTDSAVMDRSTIRR

SEQ ID NO: 166791 - protein, 171 aa, Triticum aestivum
  Clone ID: PAT_TA_61209.pep
MANPRVFFDMTVGGAPAGRIVMELYKDAVPRTGENFRALCTGEKGVGKSGKPLHYKGSSFHRVIPDFMCQGGDFTKGNGTGGESIYGEKFADEKFVHKHTKPGILSMANAGPNTNGSQFFICIVPCNWLDGKHVVFGEVVEGMDVVKNIEKVGSRSGTCSKQVVIADCGQL

SEQ ID NO: 166792 - protein, 127 aa, Triticum aestivum
  Clone ID: PAT_TA_61210.pep
MAPKADKKPAAESKVEKAAEKTPAGKKPKAEKRVPAGKTAAKEGAGGEGKTRGRKKGSKAKKGVETYKIYIFKVLKQVHPDVGISSKAMSIMNSFINDIGELAKHAVSEGTKAVTKFTSSAESECVP

SEQ ID NO: 166793 - protein, 54 aa, Triticum aestivum
  Clone ID: PAT_TA_61211.pep
VFWPHDRRGGRRKSGAITRGSACRRAKRPGPDERGRSEPAPTKRRLWGDRGPVI

SEQ ID NO: 166794 - protein, 70 aa, Triticum aestivum
  Clone ID: PAT_TA_61212.pep
NLCSLAWLRLIFLCLVLPQSKQSFSLNILAETPDVVRATPLFLLLQGHWSFSSRTMLTLLLNSKAYVWQQ

SEQ ID NO: 166795 - protein, 77 aa, Triticum aestivum
  Clone ID: PAT_TA_61213.pep
GLPPGCRPVRLPWKRKVVIVSCWSGITGRRGDFSVQFFASLGMLLYCTTPLETNTGILRVRHRRRVCRGSRVVPAGR

SEQ ID NO: 166796 - protein, 107 aa, Triticum aestivum
  unsure (1)..(107): unsure at all Xaa locations
  Clone ID: PAT_TA_61214.pep
MGTRHGFSAWRWXFLIEGAISLVLGAACWLSLPASPETAWFLNAEEKDTMNISXRAQQTRSRKLKEFSWKQVAMAVTEPXIWLCVGCIVLLFPLHLFGFGTIFAFFS

SEQ ID NO: 166797 - protein, 152 aa, Triticum aestivum
  unsure (1)..(152): unsure at all Xaa locations
  Clone ID: PAT_TA_61215.pep
HASGEALESKFGAADAGRXMYIIEQFHDYKMVENRPVLEQAHEIICIVKELELLKCELRGEVVLFFLIAKLPDSWMNFASALNHLKRVFFVVEDLKMTIVGTVDPVAVVGRLRKLFPAVQILSGGPGKEEKKDYKNGRRLLQEGGRQERRGH

SEQ ID NO: 166798 - protein, 74 aa, Triticum aestivum
  Clone ID: PAT_TA_61216.pep
GRVGGLTRFSWQSQQEGRDPPTRWHWMMTSFLCTLVCCVSCCGIFVQKTFLLCRFNSSNRFWLLGFHGWWGSML

SEQ ID NO: 166799 - protein, 89 aa, Triticum aestivum
  unsure (1)..(89): unsure at all Xaa locations
  Clone ID: PAT_TA_61217.pep
RLSAGNKGRMRFKRKRDPNFPVEXTSAAEAKPVPRLAGRRQFGPVAYLGLKEVILILSVVITSLIYFEDKHSCPHSIECAKWKPIRTEV

SEQ ID NO: 166800 - protein, 150 aa, Triticum aestivum
  Clone ID: PAT_TA_61218.pep
MLFSEGYIMCVCCELLGRHNLTSLRLSSLYSISHILFYERVIFYEKRNSFELQCWHYCFVHLEREMVSVQKIAQLCVIPNLDVMVGITEGQLMPPPFQNTPSVRNYSLEKFRLSGIIGEMNVSRYILVFDTSIFTTSNPDGGILCNSFFT

SEQ ID NO: 166801 - protein, 58 aa, Triticum aestivum
  Clone ID: PAT_TA_61219.pep
GKALSCCYCRSSEPQRRARPCGDRTVRRWGGAWLLFFWATLSVGCVLCFCGYCDPPGA

SEQ ID NO: 166802 - protein, 105 aa, Triticum aestivum
  unsure (1)..(105): unsure at all Xaa locations
  Clone ID: PAT_TA_61220.pep
MLDNHETXXSSAHTIIRRKAFLSMYFSSQILWNLRRRKLYHKCQPKGIILHQLGSMPIWHSSDRWRGHAPPGAPLGEAAAQAAASTPPDDGNTARSTVPLPSDSH

SEQ ID NO: 166803 - protein, 58 aa, Triticum aestivum
  Clone ID: PAT_TA_61221.pep
YWYKPPKVLLLIITSAIINFFSSSSSSSSSSSSSSSSSSRRGVPRYYVRTVLDGWLFE

SEQ ID NO: 166804 - protein, 52 aa, Triticum aestivum
  Clone ID: PAT_TA_61222.pep
KKKKKKKKKKKKKKKKKKKKKKKKKKKKKKKKKKKKKKKKKKKKKKKKGGAF

SEQ ID NO: 166805 - protein, 44 aa, Triticum aestivum
  Clone ID: PAT_TA_61223.pep
FYSQTHTGRFCLIEGKREAQNLSPPPCIRNNYNKIIFLNVVSLT

SEQ ID NO: 166806 - protein, 39 aa, Triticum aestivum
  Clone ID: PAT_TA_61224.pep
SFFFFFFFFFFFFFFFFFFFFFFFFFFFKKKKKKFYYWD

SEQ ID NO: 166807 - protein, 120 aa, Triticum aestivum
  unsure (1)..(120): unsure at all Xaa locations
  Clone ID: PAT_TA_61225.pep
ALNDLILFSPRASAAATGSVSFCMHNQSLLVTALVLVLSGLAPADQSTEQLDSTSCRYRHGFRSRACVGARRTECASSYHDGGHTRVRIRLAGXRVSSRAPPPFGLLRGARRRSVRYTRP

SEQ ID NO: 166808 - protein, 55 aa, Triticum aestivum
  Clone ID: PAT_TA_61226.pep
SYRSFMCNRGYRSFMSNRRLHKLHLLSLHENLPPIVQCAPVVTRQDHLISSFLDA

SEQ ID NO: 166809 - protein, 31 aa, Triticum aestivum
  Clone ID: PAT_TA_61227.pep
LMRLCAVSESLFGLNPSARTVYHGGRSTGSL

SEQ ID NO: 166810 - protein, 185 aa, Triticum aestivum
  unsure (1)..(185): unsure at all Xaa locations
  Clone ID: PAT_TA_61228.pep
MEPAAMDRIAARLSAVDDLYFPTAFLRTSPPPPARKSALLDLLSRDAPLFLERYGAALRPDELAPFDVLRNDYEVGWHLRRLRAAAAGEAPAPARVRNRRRAYLHRLVTQGDYFSEEAMREREPYLHHEYLGRFQDPFGRAMVRPXEKFSETLMRRAEEAVIVEKIRXEQIRRGVDPSEWVGGSR

SEQ ID NO: 166811 - protein, 133 aa, Triticum aestivum
  Clone ID: PAT_TA_61229.pep
VPGRPDHPSPSAGPHLPPSPPPPDPRAPLASPRPPPPGTFCRARSIQWPATATARRADRSSDQPGARLLAVPSPVNPSRTTCHHFDQLRRCYFSPYIPPLTPTAPRPLLPVRRAPAPRPSPARETLARGRRTP

SEQ ID NO: 166812 - protein, 115 aa, Triticum aestivum
  Clone ID: PAT_TA_61230.pep
SNSLPVMASLPGACSDLFAVPLLRISAPIDPEQLPGESQDEVASMEVTHSHFSSYAAWNKQYENSRHGSEAAPAIVKIPYRMVLDVLLETLGLPEVEYRTRVYDGSRVVCDCIVL

SEQ ID NO: 166813 - protein, 108 aa, Triticum aestivum
  unsure (1)..(108): unsure at all Xaa locations
  Clone ID: PAT_TA_61231.pep
AVRASPCRPPRGAGRGTMHYLGLLDAPSIAVSRIITAHXVLRMGNHLIKQDLNYILLQFRLHMHYYCLLWMRRLDLDSVWKELNNGCAWCWRANAARCRRRATSATTL

SEQ ID NO: 166814 - protein, 101 aa, Triticum aestivum
  unsure (1)..(101): unsure at all Xaa locations
  Clone ID: PAT_TA_61232.pep
MSMRPKIQTQKSMGGLGFRVFRLFNQALLARQACRLLTNPXSLCAQVLKARYYHHGRLKDTVFSGNASPTWQAIQHGLELLKXGIIWCVRDGRDIRIWRDR

SEQ ID NO: 166815 - protein, 183 aa, Triticum aestivum
  unsure (1)..(183): unsure at all Xaa locations
  Clone ID: PAT_TA_61233.pep
HDWRTRWNIIEGVCFGLQYLHEQSNGPIVHLDIKPANILLDENMLPKIADFGLSRLFDKKQTISTKHTIGTLGYISPEYFRGIITPKSDIFSLGVVILEVITGHRNYPYDIRRSSEDFIKSEVQKWRNCAAGRTNIEIXDTDCEQIKRCIQIGLICVNLDRTRRPTMKEIINMLQGVESMSVH

SEQ ID NO: 166816 - protein, 186 aa, Triticum aestivum
  unsure (1)..(186): unsure at all Xaa locations
  Clone ID: PAT_TA_61234.pep
CYFEWVRHLEDGSVNYIEGAKQPTYLVTADDVDSLLAIEVQPLDDRKRKGEIVKVYANEQRKITCDPEMKELIEKILSIGHVSYEVLLPVKFINMWDPALLAINREGYSIKCNGQRGVVMTEKFRQATTINIPYGRPTEFSIQSAKGAEYNLKPAKSSPSRDAIVLILXLYRMXALEKSKGRKKGI

SEQ ID NO: 166817 - protein, 65 aa, Triticum aestivum
  unsure (1)..(65): unsure at all Xaa locations
  Clone ID: PAT_TA_61235.pep
IPQLAVIGYSESLTTIYTAQLMAKWISHFMDGGCRSPSDIDVRRDALEWXKIMWHYSTYYSRRTC

SEQ ID NO: 166818 - protein, 169 aa, Triticum aestivum
  Clone ID: PAT_TA_61236.pep
MCCGAEVADPGEHRRRLAAGDDDGGDGREEHALSPPPVGTTMWGRRQAQEMSAMVSALAQVVAGGVGEGVMASSTKRPAEHEAFAEEAWWSTSYGGGDGDGGAPSAASSFLADYTAAPAASYSPHGAAAGDEELPSPSSAESGGSGGTPRKRYRGVRQRPWGEVRRSGT

SEQ ID NO: 166819 - protein, 158 aa, Triticum aestivum
  Clone ID: PAT_TA_61237.pep
MKWTMLKLPRASGNSGKSGVIVWTTSMTNTMLGFLADLVAKGKRTSSGFRETHLKQCAAVLNEQFKLTITSDQVRNHLKKWRKIWVRVVNLKNLSGALWDEDTCTIRLSDEHYAGHCMTHKPDAPFLNNSIEHYHAMATIFGTTGAKGMNARSGKDLL

SEQ ID NO: 166820 - protein, 141 aa, Triticum aestivum
  Clone ID: PAT_TA_61238.pep
EMEKKHMKMAILRQEQTFRQQVHELHRVYEVQKRLMKEMQAVKMSPAQAREDTRPEPMLDTDRPQWHINSGEKTARFTEDFNLELTLATGGDTRKQEMTSNSESGATVTSSTSAESESGQRFPKSNVDLRVQHESKRHDDQ

SEQ ID NO: 166821 - protein, 233 aa, Triticum aestivum
  Clone ID: PAT_TA_61239.pep
VVTAVMAPWGLGGERSKGLRPKMTITIFLKIMGLAFLEPVIDQNLYFMGAKLTSAGFATARGDILPFFTFVLALLLRMEKVRLRSLHSQAKIAGTVLTVAGAVLMVLYHGPIVQFPWTKGQHHATASGQGVGSAADARDWLNGTIMVIIACVAWACFFILQSNTLKSYPAELSLTVLICGMGSLMSGGIALVAERANTQAWVIGFDMRLFTAVYAGIVCSGVAYYVQGIVSSQ

SEQ ID NO: 166822 - protein, 168 aa, Triticum aestivum
  Clone ID: PAT_TA_61240.pep
FWTILNTLGGGGGLVPEKRSQPRRPCGLKCRVWLRATGREVRRRPDASLTRSGQSTDPEGAGWTKRLQLGSAPPDQTPCPWDECSQLCRGTDKECSATCTCSGEAYDFYNLYTWEIGFGIRYDKIRLNAERTKCMEEIVCGCSGLGQCTPQVLLVTVQLRLYMLGEQS

SEQ ID NO: 166823 - protein, 97 aa, Triticum aestivum
  unsure (1)..(97): unsure at all Xaa locations
  Clone ID: PAT_TA_61241.pep
PTRPGVPPRDSVSDPPVSVSGTGTLLLKVVRAFPGSMASVTYFSAVAPGMSLVEKQSLXHGSDXSTFFFXVLRPXLXGFSLPLLTLKKQGHLVSLNL

SEQ ID NO: 166824 - protein, 74 aa, Triticum aestivum
  unsure (1)..(74): unsure at all Xaa locations
  Clone ID: PAT_TA_61242.pep
MDRAMKVFVVVFLLLVATGFQGAAQVALARDCTSXSRGCXXXCLSDRNCASVCLTEYFTGGKCDHRRCVCTKDC

SEQ ID NO: 166825 - protein, 99 aa, Triticum aestivum
  Clone ID: PAT_TA_61243.pep
IVLPRGGQFSSIYKRKSNTTARAVSHVSFIKKRTSTPFQKIQRTCLLLHRCRPIIRKKARSKTSPALNDEDLSLYDGHVYKHYNHNVTNRTDTRTLLHT

SEQ ID NO: 166826 - protein, 161 aa, Triticum aestivum
  unsure (1)..(161): unsure at all Xaa locations
  Clone ID: PAT_TA_61244.pep
PSSADAWGGGGGGVKVWRREDGKGGATRHVMERVLRKGESAVTAIGVAAEARVVYVASSDGGVTHWQWRRGAYRESAPRNGGALRGHKMGVLSLAGGGRVXXSGSXDRTISVWGGDEGXXHSRLGVLSGHTGPVKCVGMDEEEAXXADGHRGGVGYRGSLG

SEQ ID NO: 166827 - protein, 112 aa, Triticum aestivum
  unsure (1)..(112): unsure at all Xaa locations
  Clone ID: PAT_TA_61245.pep
ATVSLPPRLYPQLLTAREEDKGRDCLTSSMSPTPRATTTVAPRWEDSDXQGVXAVGALQARTEGATAVAATRLFAAHAMASSNSEGSMPLSLWIFLPGGAPLTTFRQALSTT

SEQ ID NO: 166828 - protein, 53 aa, Triticum aestivum
  Clone ID: PAT_TA_61246.pep
HDDYSINREGGGADKPLKSTTLFFSSIFVQPYSLNVLSLLPSDYKIVRPVCRL

SEQ ID NO: 166829 - protein, 45 aa, Triticum aestivum
  Clone ID: PAT_TA_61247.pep
FANSWLPLDVMWMFILLSAISRPHPVKKKKKKKKKKKKKKRGREK

SEQ ID NO: 166830 - protein, 65 aa, Triticum aestivum
  Clone ID: PAT_TA_61248.pep
PRFRNYVPGAWGGVLTDVCWVANSWLPLDVMWMFILLSAISRPHPVKKKKKKKKKKKKKKRGRGG

SEQ ID NO: 166831 - protein, 88 aa, Triticum aestivum
  Clone ID: PAT_TA_61249.pep
QGGPDLARVAAAAARVGEGQKKGAARRSRRSTGAPRGGPAPRPRSGDGPLLGRRRRPVRQGQGPRVLGGGPGVLRGGSPLGRFTVGGT

SEQ ID NO: 166832 - protein, 115 aa, Triticum aestivum
  Clone ID: PAT_TA_61250.pep
KQAAAYNFVASQIQYSSRGSGRRLGFGVHLLLHEAKESPPGARTATSSSLLLPRPPGGHLLRAALGAAERRRGFRLVHAPQLLLVGVPEHVGLHEVSSHHRRHSLSPPLLLLNYS

SEQ ID NO: 166833 - protein, 61 aa, Triticum aestivum
  Clone ID: PAT_TA_61251.pep
MGFFFFFFFFFFFFFFFFFFFFFFFFFFFFFFFFFTITFLLFTCSFAHILPPAITGRKLNT

SEQ ID NO: 166834 - protein, 78 aa, Triticum aestivum
  Clone ID: PAT_TA_61252.pep
HVNAVSTVSLSDPSPVNSHTGKGQFAPFSRLCIATFLKHIINFLSGKMNVPRSNKDQARNSSRKHKKNDADQAMNQQP

SEQ ID NO: 166835 - protein, 237 aa, Triticum aestivum
  Clone ID: PAT_TA_61253.pep
RLGLHKPRGGGGVVTEIRAAPAHTRGNDRPAGAPCRICAYAGSHWRGGGGDLVQGHLHATRGGKLVMFVFSSITGQWCIAASPSWSSLGIVEPPCNGLSHFNYVRGCFYWPALWKDKLLMLDTRLMEFSIVNILTGYHVQLINQPGQSVCMSTIVDGTEGALEMFTLVGSYSYATFHLYHTTQQNNGESPKEWQLKNVIALPPQCHYFAVGATERFLFLRCIRIAQWDDNAHGLLPR

SEQ ID NO: 166836 - protein, 59 aa, Triticum aestivum
  Clone ID: PAT_TA_61254.pep
PLARPAPFFFFFFFFFFFFFFTQHVYIPDSLVGYYYIARTARISRIAQPVVYLLTSTSA

SEQ ID NO: 166837 - protein, 56 aa, Triticum aestivum
  Clone ID: PAT_TA_61255.pep
NGRPLFFYFYVLLGGFFFILYFFFFFFFFFFFLKKNFFFPPPFFFFFRYIKRSLDP

SEQ ID NO: 166838 - protein, 46 aa, Triticum aestivum
  unsure (1)..(46): unsure at all Xaa locations
  Clone ID: PAT_TA_61256.pep
PQIIGTGSDYIVVLVPSDWGGAYVLLQWNSYXVAGCMHDWICPSHL

SEQ ID NO: 166839 - protein, 161 aa, Triticum aestivum
  Clone ID: PAT_TA_61257.pep
RLHSHWVQGRRGAGDVDDRKSTSGFIFFLGSSPVSWQSQKQKVVALSSCEAEYIAGATAGGEGVWLIRFLAHLLGKEAAPTTLLVDNLSAIQLCKNPVFHGRSKHIETRYHFIRESVENGKIVVEYVNTDDQLADILTKSLGRVRFQAMRERIGIVDIRNI

SEQ ID NO: 166840 - protein, 170 aa, Triticum aestivum
  Clone ID: PAT_TA_61258.pep
IDGTQILTFSQHQRSAGFHVLTGWFLRTTLRERTKWCVERKAKFREGWHFPRTERYIIHRSFCFHVCAHTARAHRKETEEIKEAMRHRSTYTGDRKRNRAITLPETPKKNLAICSISARLPQERRPPEGEVRSIYPSRPRERGGEGGSGEDRGVLGHSAAPSSSQLPTAR

SEQ ID NO: 166841 - protein, 113 aa, Triticum aestivum
  Clone ID: PAT_TA_61259.pep
MKLIAAYLLAYLGGNSSPSAADVKNILDSVGAEADEEKLEFVLAELKGKDITEVIASGREKFAAVPSGGGAIAVGAPAAASGGAAAPAAESKKEEKVEEKEESDEDMGLRGGD

SEQ ID NO: 166842 - protein, 79 aa, Triticum aestivum
  Clone ID: PAT_TA_61260.pep
VTIKKYIVAILYNIMCPLIYIVTDSILIGACFLHPCWFMNMDIQIFLGTNKKDKWIRKTQSNVRVVKTAMALYIWPVVK

SEQ ID NO: 166843 - protein, 102 aa, Triticum aestivum
  Clone ID: PAT_TA_61261.pep
GSPARASAAPAPVSASPAATAARRPAAPARAAQKQNAAAPPGAAAAPGSPAARRGRRTPTTPRLRRLRCCRSASSSAACPSSSSWFPGAAPRPPRSPPRKRG

SEQ ID NO: 166844 - protein, 90 aa, Triticum aestivum
  unsure (1)..(90): unsure at all Xaa locations
  Clone ID: PAT_TA_61262.pep
QINKSIIQGGRGGGKNAEGSGNPLLRTTNGHVGRQGWEFDPAADDPDEGAAVDAARRDFTGGGDXMIXSSXLLMRMQVSILSFLKPTHSL

SEQ ID NO: 166845 - protein, 193 aa, Triticum aestivum
  unsure (1)..(193): unsure at all Xaa locations
  Clone ID: PAT_TA_61263.pep
VIHLSATLGAGVEVVVIATGATVARDLPIKGRQLEGIHYAMEFLHKNTKSLLDSELGDNAYVXAKDNHVVVIGGGDTGNDCIGTSLRHGAKSVTNFELLPQPPPERANDNPWPEWPRIYRVDYGHTEVRQHTGKDPREYCIMSEEFMDDGSGKVKGINTIRVEWTKSPSGGXDMKKDKGSQQEFPANLGLLTM

SEQ ID NO: 166846 - protein, 135 aa, Triticum aestivum
  unsure (1)..(135): unsure at all Xaa locations
  Clone ID: PAT_TA_61264.pep
LSLLFSCCCRRGGEPSXPXQIDGHPLPQTLLSTPLLGRRVVAKPKGKRPLRAAIAVIEYCNGGAXRYSEGLAIACERCNGALASAPDAAMGRSSVLKWGTQGRCNGALARAPSRGCDGERARAGGGRXXALPRLQ

SEQ ID NO: 166847 - protein, 138 aa, Triticum aestivum
  unsure (1)..(138): unsure at all Xaa locations
  Clone ID: PAT_TA_61265.pep
TSGRVSSLRSSRKLSSSLCXALGQPPLLEVPSPVHLPAVTVPSAAPRGPPPPAPRPRPALPLCRGCPIGRKERHPPPGGTKDLLLVHACCWELRRGEKGGGGEVGGEARWVVLCWCGEEMDREEAPPHPLFDVKRKRG

SEQ ID NO: 166848 - protein, 206 aa, Triticum aestivum
  Clone ID: PAT_TA_61266.pep
EFSPRSFFHPDSFLTSAAGRRPSWGRQLRVGSWATVLQEASREHPISRVSTPGFWSSHRRLPLPPLSVPLPPSRGGKNKIITARDQTLHLMGWRFGTSTVDSLHLSDTGLPKGGGDRTGPAWRHRGCWRRKSGPTALDHGSPPAPRNDMHVRRIWAAQVPMEIRGSRRSHGKGRGGEGAHATGLATTQVVVATVAGEGRWCRHALS

SEQ ID NO: 166849 - protein, 157 aa, Triticum aestivum
  unsure (1)..(157): unsure at all Xaa locations
  Clone ID: PAT_TA_61267.pep
QYKFCKRHMLQVTTTPPSAQTSIDILHRSNNEWSSSPIHMFKEIKHVPVLHLKAPRGHISAHPQPVVEEDAGPICHVGPLVVPHVHEALELLPPPHGVVAPLLLAPPLDCQHLGLHRRLXVPLLTAAVGRRHGFRCVPASLYAPPPRGVCVRTAWAD

SEQ ID NO: 166850 - protein, 80 aa, Triticum aestivum
  Clone ID: PAT_TA_61268.pep
LGNPRVFPVKKKLNPPPPIEFWGPYKKTFTLHARVSKVGFFKTGPPFFFFFFFFFFFFFFFFFFFFSPPLPPFFFFFLIF

SEQ ID NO: 166851 - protein, 187 aa, Triticum aestivum
  unsure (1)..(187): unsure at all Xaa locations
  Clone ID: PAT_TA_61269.pep
PPTLSVXDPARGGRXGDIYYATEQPEQPMGTLEMCMTGLDKKKGSVFFKTSADGHVSCAKEMTGGSGISDIIPGMGGCDFDFEPCGYSMNAINGSAFSTIHVTPEDGFSYASYEGMGMGAXGLGYGDIVKRGLRCFGPSXVSGGGTIXGGRGHAGTWGKKLXAEGYDCDNGWEXELXGGGVLIYXSF

SEQ ID NO: 166852 - protein, 30 aa, Triticum aestivum
  Clone ID: PAT_TA_61270.pep
MEIRARAPGKIILAGEHAVVHGSAAVAAAI

SEQ ID NO: 166853 - protein, 120 aa, Triticum aestivum
  unsure (1)..(120): unsure at all Xaa locations
  Clone ID: PAT_TA_61271.pep
GPARGGGEGQNQTTRRRAQNHATRRPRGFLSRPSSLPTHSQVSAIVPAMHPTSGTXPXEGMHHVRAAGRPVTASCEAVRSRGARAVGVKPMARRGVAVXRRRRARRRRPRRGKTGRSARR

SEQ ID NO: 166854 - protein, 207 aa, Triticum aestivum
  Clone ID: PAT_TA_61272.pep
SYVAGETGGAVGAASMVFRKSNPHYAHLLLHHAQQLFEFADGYRGQYDSSIAEVKSYYAWGGGYKDELLWAALWLHRATGKPGYLDYVVDNAHDFGGTGWAITEFSWDVKYAGVQILAARLLLRGEHTAEQKRTLERYQAKAEHYVCACLGRNAQAGGEDANVERSPGGMLYIRQWNNMQYVTNAAFLLSTYADYLAEAGVETGTCT

SEQ ID NO: 166855 - protein, 77 aa, Triticum aestivum
  Clone ID: PAT_TA_61273.pep
MDLILGARKNGSPPPTRAFFFFFFFFFFFFFFFFFFFFFFFFFFFFFLFKRFLHSESHHRVNDDPPPPPQMTESVQG

SEQ ID NO: 166856 - protein, 94 aa, Triticum aestivum
  Clone ID: PAT_TA_61274.pep
RQVPPEGHMLDRSSTSITVPTVKITVRRCYRFVQLKLGTLLIPLYYKLIPQRRRPWPPIAAATPTMQRATSILSPVAEQPLNALWTPLRNPWLL

SEQ ID NO: 166857 - protein, 71 aa, Triticum aestivum
  Clone ID: PAT_TA_61275.pep
RRHHQEQSITTHKITQEAGTDYVNYLCVQNILTCTTPETFLTGSGLINFLINTQARACCRNQLMTKGERNR

SEQ ID NO: 166858 - protein, 59 aa, Triticum aestivum
  unsure (1)..(59): unsure at all Xaa locations
  Clone ID: PAT_TA_61276.pep
CGRFCIGRWPIGTGNSPSSSSRSYPPQYRPPWHRGGGSCWGCVFPPPPKHPGWIAVXWG

SEQ ID NO: 166859 - protein, 50 aa, Triticum aestivum
  Clone ID: PAT_TA_61277.pep
NSGGVFHCFFTSEACHHTRVTAAVDQCESALQLLGYRNARSLVLCCGRVG

SEQ ID NO: 166860 - protein, 180 aa, Triticum aestivum
  Clone ID: PAT_TA_61278.pep
MRGISGCKTWQPTRSAPGSRISVQDLDQLYAPVVCHQPFYRFLQEIFMFFCGAEIILFLQLDMASSATISSVGAQAALVSKPRNHGIGGLKASSSINFELGSSGLGKTGSLLASVTTRVVPKAKSGARILPEASYKVAVLGAAGGIGQPLGLLIKMSALVWELRLYDIANVKGGGGGLKH

SEQ ID NO: 166861 - protein, 125 aa, Triticum aestivum
  unsure (1)..(125): unsure at all Xaa locations
  Clone ID: PAT_TA_61279.pep
HITCKFEGADGGRDNLKLVGMWASPXVLRVQLALRLKGLSYXFVEMEGEQGLXKNKGERGRLNSKLPGLIHGGKPIRGKSLSMIQYIDEAFVGASPSLLPGDPSERAMGRYWADFIDDTLVKAMH

SEQ ID NO: 166862 - protein, 163 aa, Triticum aestivum
  unsure (1)..(163): unsure at all Xaa locations
  Clone ID: PAT_TA_61280.pep
MATRIQFENNCEVGVFSKLTNAYCLVAIGGSENFYSTFESELADVIPVVKTSIGGTRIIGRLCVGNKNGFLLPHTTTDQELQHLRNCIPDQVVVQRIDERLSALGNCISCNDHVALTHPDLDKATEELIADVLGVEVFRQTIAGNILXGSYCAFSNRGGLGHP

SEQ ID NO: 166863 - protein, 89 aa, Triticum aestivum
  unsure (1)..(89): unsure at all Xaa locations
  Clone ID: PAT_TA_61281.pep
PARFRHXVXVRHDXQXVXXIKKIXADTKQRVXVRRAVHALPVARRGGGRGVSAGCCGDHGRELPAHSTQELAGGGVAPHPADRRAXSVG

SEQ ID NO: 166864 - protein, 75 aa, Triticum aestivum
  Clone ID: PAT_TA_61282.pep
LFFLVGLRGRVRVLLLFLDGLEKYGRGDWRNISRFAVRSRTPTQVASHAQKYFIRQANAATRDSKRKSIHDITTP

SEQ ID NO: 166865 - protein, 35 aa, Triticum aestivum
  Clone ID: PAT_TA_61283.pep
GGYDNEDKGGRGGGLSALKIGGPSTHTNFPGCMTT

SEQ ID NO: 166866 - protein, 34 aa, Triticum aestivum
  Clone ID: PAT_TA_61284.pep
FPPPFFFFFFFFFFFKHKLVFEYTFYLFLNREYT

SEQ ID NO: 166867 - protein, 62 aa, Triticum aestivum
  Clone ID: PAT_TA_61285.pep
NNGSKPQHTKFLAMNIFIYLITMPSSKSRLSRYHHSNSWCRQAAKPLYKLRFHLKLISSGSI

SEQ ID NO: 166868 - protein, 68 aa, Triticum aestivum
  Clone ID: PAT_TA_61286.pep
RQITISRIRHLTVHIKVRPPLCTFSDLHERTKLCHRSNSCTSPEKKKQFHPLRSRPINYRKLATINGN

SEQ ID NO: 166869 - protein, 130 aa, Triticum aestivum
  unsure (1)..(130): unsure at all Xaa locations
  Clone ID: PAT_TA_61287.pep
MEDLYSIHPGISRGGEGGAACSEASGVAGGASSPPPPPPPADLTELMKAQIAGHPRYPSLLSAYIECRKVGAPPEXAALLEEIGQPERRGGGATAAGEIGLDPELDEFMEAYCRLLSRDKEEPVPRWTRP

SEQ ID NO: 166870 - protein, 36 aa, Triticum aestivum
  Clone ID: PAT_TA_61288.pep
VQVGPYNVCSREGSSWVIVFVPVIYAGLLSCAPGCW

SEQ ID NO: 166871 - protein, 55 aa, Triticum aestivum
  unsure (1)..(55): unsure at all Xaa locations
  Clone ID: PAT_TA_61289.pep
CRRPSVPGCLDVGCCFCCSAAPXWFFCVFFGRFLLGLVCLSSLLPPSRRRRKRAG

SEQ ID NO: 166872 - protein, 166 aa, Triticum aestivum
  Clone ID: PAT_TA_61290.pep
PTRPAATGAAAPAPAAVQPLRQFKLDPQSELRVEVLPDATLRVRLVSGTAEIFGTELPPEGWLTIPPRSKIAIFTWHGATVELDGVSESEYTYDETPMVIYGNTHAILDARRVRARAVYGGDLEASQGPIVIVARPTDSGKSTLGKMLFKWTDELGWKATYGDVDI

SEQ ID NO: 166873 - protein, 48 aa, Triticum aestivum
  Clone ID: PAT_TA_61291.pep
ASVVRQMKDSDMAMQWSLIYQLTSRLRVIFQSTPSNRLLFEYSATSQD

SEQ ID NO: 166874 - protein, 133 aa, Triticum aestivum
  unsure (1)..(133): unsure at all Xaa locations
  Clone ID: PAT_TA_61292.pep
RCSFTDTNYTXQITPFYKNYSXKKFEILSLHCNQMLKLETTRASHIPDFMCTIYKTKYPVFKNXFQKAPDSILLYKVLTAXSYLVMLDXRLNRNFTEVLLDNTGLVMIRYTADTTTFLFANDIPNALEVDSLH

SEQ ID NO: 166875 - protein, 109 aa, Triticum aestivum
  unsure (1)..(109): unsure at all Xaa locations
  Clone ID: PAT_TA_61293.pep
PHYTGLDYEEVGSPGNHEELVSIKKYSTYDNIHKDGPYPAVFETSSLNTWSGVWEAAKWVAEGRELTFXDPKRSVILNLTTDVAEESKXLETKELATETAFLIKMVNNT

SEQ ID NO: 166876 - protein, 106 aa, Triticum aestivum
  Clone ID: PAT_TA_61294.pep
AHHVQCMPAVLRTAANLAGGHVLSPRPRPEVASGMSAIAAIGAALRLRLLVRMLRVGELIALTTLLSWSSPARLLWPPLLCALRVAPLQPPLRAPPPRAFQARVRG

SEQ ID NO: 166877 - protein, 57 aa, Triticum aestivum
  Clone ID: PAT_TA_61295.pep
ALVCSLCHSVGRKHCAAINLPLLMLLTHILELRECEITASYKCFEVSSISVHTVFMF

SEQ ID NO: 166878 - protein, 50 aa, Triticum aestivum
  Clone ID: PAT_TA_61296.pep
PRVRPRVRIFDGCCKCQKFVLAVFPMFLESICSSDGSGEDCMSSNSVELN

SEQ ID NO: 166879 - protein, 71 aa, Triticum aestivum
  Clone ID: PAT_TA_61297.pep
ATNAPALKRPLFQLATTSRLQAQAHHLNSRCTRTAHRPHRPLTYAPKQDPASQPATNRTYSSTPRRAHLAN

SEQ ID NO: 166880 - protein, 115 aa, Triticum aestivum
  unsure (1)..(115): unsure at all Xaa locations
  Clone ID: PAT_TA_61298.pep
DRNFWLVACISMTKIHGNYITHGSFTXQRVRCHSFSMQRNXYSIQDARTTRRIRSTLGYSICSTIPTQDRSGRGSAPRAAFTEGGGIPSDDQISCTACTWRPDRQCVNQLGHHPA

SEQ ID NO: 166881 - protein, 182 aa, Triticum aestivum
  unsure (1)..(182): unsure at all Xaa locations
  Clone ID: PAT_TA_61299.pep
WRTLFTSCVLCWTIMCSRSLLRCFKNWARLCPFTTSFSLELLVPIVSASMALASISSGSTFFLFTVQCLLIRPLARHDSLLPCHLLVEHRVVHCCHVHLPGTHTKQAAEPCLHICQAYDSQDHGXRCRGRSSTSLPPPDTITSVRCSASILPSRACAWRRVLPRLVRSGTRTLRHRCHAHAW

SEQ ID NO: 166882 - protein, 114 aa, Triticum aestivum
  unsure (1)..(114): unsure at all Xaa locations
  Clone ID: PAT_TA_61300.pep
MDYYNILKVNRNASLEDLKKSYRRLARTWHPDKNPTGGAEAEARFKQITEAYEVLSDPEKRAIYDQYGEEGLKGMPPPGSXSRTGTASGSSGPSNFRYNPSDPDDIFNEFMASN

SEQ ID NO: 166883 - protein, 227 aa, Triticum aestivum
  Clone ID: PAT_TA_61301.pep
DQQGRHVPRLADALGWYHWSSGGDVGILSKYPITADYGVISGPARSGGVKIALDGTNKEINFFVAHLGYTPYGPYDTCFDHYPVDKIIEREAQSGRTPQMKATLAGMKSQLDNADEIPTFLVGDFNAPSHLDYTEGLKDKNCGYSDIKWPTSVLPEEAGLIDSFRVAHPDPVKEQGITWSPIYIWNGGRRRPEPLDRIDFVLHKGKGLKVTDSQTVVGEPKPQPNHK

SEQ ID NO: 166884 - protein, 140 aa, Triticum aestivum
  Clone ID: PAT_TA_61302.pep
SVPPLGNIILSTHPWPLLLLQKNAAQNRDHTAPPAGGIDRASAGPKSKLALPGVDEVLERGHLVPGRGLVVVLDGAVHVVRRRPKEHQPAYSNHPDLMINQTTEDWRSNERDQQNASCLPCGEQRHLPRRDVPAQPPHPR

SEQ ID NO: 166885 - protein, 52 aa, Triticum aestivum
  unsure (1)..(52): unsure at all Xaa locations
  Clone ID: PAT_TA_61303.pep
PPPGGXPPPLFFKKNSPEDRDNIWQKKLEMQYGMLLMPNILETCHTRMSHSF

SEQ ID NO: 166886 - protein, 97 aa, Triticum aestivum
  Clone ID: PAT_TA_61304.pep
PRVRDALRSAARLAGHLVEAVDGGVQELFVNEKRIELEARALLGTIARYRKQSDQWLAATNAVNSILKEIGDFENWMKIMDFDCKSINAAIRNIHRS

SEQ ID NO: 166887 - protein, 196 aa, Triticum aestivum
  Clone ID: PAT_TA_61305.pep
QGSSSTSTPTPPPTPSKLHLLQAGECTSPAPMTDHAQTHRPAAAPRQQLAATVKPSGGSIGYLQSTVAAGEHHQQEGAAALLYQQYSKSTNTFASTYSLLNLVNAASMGVASAAAIDELSTLVGHGAAQLPSYHSPASSGGHHDHFVVPLPTPPSQPITPLGTLPMSLAAISDKIWDWNPIPDAAVGRDYGGASFK

SEQ ID NO: 166888 - protein, 145 aa, Triticum aestivum
  Clone ID: PAT_TA_61306.pep
PRVRRLSPFVDYMDCFDSDPHALGMYMVQQLNKHQGFVYCHMVEPRMAIVDGRRQIPHGLLPFRKAFNGTFIAAGGYDREEGNKVVADGYADLVAYGRIFLANPDLPKRFELDSPLNKYDRNTFYTQDPVIGYTDYPFLEGSNAE

SEQ ID NO: 166889 - protein, 132 aa, Triticum aestivum
  Clone ID: PAT_TA_61307.pep
WEKSPAWRWLVGRTRDSKPFFFTFAALCGVVPGVVGYGVMQLTSSRNDKLEAHLRSNARPETTMMGQINRERLAEFLGEIQRKENTNDRYVAALKGETLTRKRYERIQPVPQQAAQENAKDQKATQENAKAK

SEQ ID NO: 166890 - protein, 148 aa, Triticum aestivum
  Clone ID: PAT_TA_61308.pep
AATRQAGRWQTRASAVGRRSRGREELQPDASGGHRWLSAAIDGNLNAPAPKARLIFYRQQGTASLLAPVGSLGSPPSGSGQHRLLALHPSVPDLATAGCGEEDEVRHATTKEGAEPATGFFLVKEGTGQRLYLDHNRIGSHWWRSSAA

SEQ ID NO: 166891 - protein, 159 aa, Triticum aestivum
  Clone ID: PAT_TA_61309.pep
ALHIVGDFVALIDSLGQERVFVVGHDWGAIIAWSLCLFRPDRVKALVPLSVPFIPRSPAVKPVDAVRALYGDDFYICSFQEPGAIEAEFKRLGTELVLRKFFADRTPGPLFIPKSGWGSPDDEVPLPSWITEEDVKYYTTQLDKSGFTGGLNYYRALNK

SEQ ID NO: 166892 - protein, 210 aa, Triticum aestivum
  Clone ID: PAT_TA_61310.pep
GRCRRRRQRRPRTQPPLLLLLPPPSPRPRPGERSVVVRVLRDYGSIPKREPFSSSRSILDEFFKQEKPLVQRTKDHITDYCTTLEGDDCCSCWDAYFELNKLEQELPQEEISRMVKDSRSDPRYLISSIHHRSDLRKKMAEKAHNSAPSNSPGQTAKPRPFPVPDGLPKTQEEIDEDEEALMPESPYTRLLRRMGRFPDWYTPRPDHETD

SEQ ID NO: 166893 - protein, 205 aa, Triticum aestivum
  Clone ID: PAT_TA_61311.pep
EPGGTRREEGKGREEEITEPSARTGQQAPRSRTGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGGTRG

SEQ ID NO: 166894 - protein, 245 aa, Triticum aestivum
  Clone ID: PAT_TA_61312.pep
MPVETAYDPKDMLFRHLGPTGLKVSVFSLGGWLTYGGTQKGDIVKQILQTAWDHGVNTFDTAEVYANGESEIEMGRALKELNWPRDEYVLTTKVFFGTGRKEPNTRGLSRKHVVEGLKSSLKRMEQPYVDVVFAHRPDYATPMKEIVEGFTQVIRNLNLAYYWGTSEWSAAQITEATQIAERYNLIAPVVEQPQYNAFHRERFETEYAPLYDQFQYGTTIWSPLASGLLTGKYNNGIPDDSRFAT

SEQ ID NO: 166895 - protein, 49 aa, Triticum aestivum
  Clone ID: PAT_TA_61313.pep
NPLLWSPDAPREPAPSTSSRAMAWSTVRSSLASLCGRRAAISHDMYVII

SEQ ID NO: 166896 - protein, 81 aa, Triticum aestivum
  unsure (1)..(81): unsure at all Xaa locations
  Clone ID: PAT_TA_61314.pep
LCATRSPAGGTCCPSWTATASSATPTLTATPSYRAAPAATTGGPSESYXSAPTSTSRSRSSTSTDSPPATGAGARRASAST

SEQ ID NO: 166897 - protein, 56 aa, Triticum aestivum
  Clone ID: PAT_TA_61315.pep
NKKSRMALQPLSWCTCFVIILIVASTSFAVDYDCSRSLSVVTSHCKEELTWVISSG

SEQ ID NO: 166898 - protein, 94 aa, Triticum aestivum
  unsure (1)..(94): unsure at all Xaa locations
  Clone ID: PAT_TA_61316.pep
RNSMEYGDKDGLFRMLLRDSRDDDMELTPNSDGLLKRLFRDKEDRPGDDDQKEGFFSRIFIEXSEERXYSMHGKLADEERVGKSLQDDDREGRS

SEQ ID NO: 166899 - protein, 83 aa, Triticum aestivum
  Clone ID: PAT_TA_61317.pep
MVAVKRLHPGHDDRTSQEQFMAEVGTIGRTHHINLVRLFGFCYEADVRALVYEYMEHGALDSYLFDRSRDLGLQTMRAIAVGR

SEQ ID NO: 166900 - protein, 76 aa, Triticum aestivum
  unsure (1)..(76): unsure at all Xaa locations
  Clone ID: PAT_TA_61318.pep
GESLXHRSXPPSMNESSTSLPSIGTRGRRNGSKKGVDLDPDQIYWPRRRKEKSKPIATHRHAPILSHSSWQRRRRR

SEQ ID NO: 166901 - protein, 247 aa, Triticum aestivum
  Clone ID: PAT_TA_61319.pep
NLFGTEFSVMSETERRQTTKGIWMSKNKRETSAGTPMSENILVMDVEGTDGRERGEDQDFERKSALFALATSEVLIVNIWEHQVGLYQGANMGLLKTVFEVNLQIFLKDKQSTPRSLLFFVIRDHLGTTPLGNLRTTLIQDLTKIWSSLSKPQGLEGSRIEDYFDFGFAALPHKILQADKFTEEVQKLGARFTAGHRHGKAGLHGDQELEGGLFLSEYHRRIPADGFSVYAEGIWDQIVNNKDLDLP

SEQ ID NO: 166902 - protein, 173 aa, Triticum aestivum
  Clone ID: PAT_TA_61320.pep
RRVRWAASAAEAKRAARGGCRQAGGPASGQGHPAKRAAGHPGAPPPAFSRSDLNEGRNLHSNCIGIGTVIVIGHRKQVAKGVAPTIHPHRTLLVDIRNDSTTLRGSPPLTLLQALFGEYIVLVQDVVLCRVCVCVVSVCVSCARRLLSIYRNCNRQKKNDISVVENMFLQFSV

SEQ ID NO: 166903 - protein, 141 aa, Triticum aestivum
  Clone ID: PAT_TA_61321.pep
MDPMAQQQQQQAQGEQPELNAFGKLTAQFLQYGANASNNISTAFDSMDTKAWIRLIVIVGGYMLLRPLALKFITKGAVQKMEDDDANEKRKAQISPNELRGLVEDEPEIDADGDGTGADWGQKARVRQRTMLKDLLEAEER

SEQ ID NO: 166904 - protein, 209 aa, Triticum aestivum
  unsure (1)..(209): unsure at all Xaa locations
  Clone ID: PAT_TA_61322.pep
MEGETNKRLATLVGCNYVGTRYELRGCINDVDAVRAALVARFGFAPADVAVLTDGRGAEVLPTGANIRRALAEMVARAAPGDVLFFHYSGHGTLVPPRHGDGGAEEEAIVPTDFNLITDVDFRQLVDRVPPGASFTIVSDSCHSGGLIDLEKEQIGPSVGSGPGAPPTATARTARXLPYGVLLDHLSAVSGMPSSHHVADHLVALFGAD

SEQ ID NO: 166905 - protein, 197 aa, Triticum aestivum
  Clone ID: PAT_TA_61323.pep
MSSMASSKGLLVFALLLAAAILVASSPSTDEHPEAKKEENEAGIENFHFGHGGHHGHGGGGGGYGGGGGGYGGGGGGGYGGGSGGYGGGGYPGGGGGYGGGGGYPGHGGEGGGGYGGGGGYPGHGGEGSGGYGGGGYPGGGGGYGGGGGYPGHGGKGGGCHWGCCGHGLFHHHGCRCCARADEVPEPMYRAPAEVPN

SEQ ID NO: 166906 - protein, 62 aa, Triticum aestivum
  Clone ID: PAT_TA_61324.pep
GVEFVEGVCSGRPGPGSSWLGSRGASPGPTVKVTDLNRRERPVLPVSYDPPPRSRRGPWKKC

SEQ ID NO: 166907 - protein, 34 aa, Triticum aestivum
  Clone ID: PAT_TA_61325.pep
DTFELLWSIYQVLSDNVNLHGFLLCNVMSVSGCS

SEQ ID NO: 166908 - protein, 66 aa, Triticum aestivum
  Clone ID: PAT_TA_61326.pep
CNTNYVPNSPKKSMYQICCRKLATPSIVTNTKICTVRWNKCSKTDDGPRRWCRKEQGSFLASMGTS

SEQ ID NO: 166909 - protein, 76 aa, Triticum aestivum
  unsure (1)..(76): unsure at all Xaa locations
  Clone ID: PAT_TA_61327.pep
ADIYDAASFEPAIQGCEFVFLVATPLQHNSGSSKYKDTTEAVVDATRTILQQCERSKTVRRVIHTGSVVTAXRRLR

SEQ ID NO: 166910 - protein, 128 aa, Triticum aestivum
  Clone ID: PAT_TA_61328.pep
PRVRPRVRKEEDGGRGDRQLHRHHPRHHPAAARRLLQVRLRDRVLDLLAAHLLRLPPRHHLRRLGHHQVGLHAGGAPLPLPLGDPWRTCSVSGTSRLSEMRVAVHGAAVLPTCVLMLLYICFLFVLDD

SEQ ID NO: 166911 - protein, 256 aa, Triticum aestivum
  unsure (1)..(256): unsure at all Xaa locations
  Clone ID: PAT_TA_61329.pep
RETNSQDRIIGAHFFSPAHIMPLLEIVRTERTSPQAILDLITVGKIIKKVPVVVGNCTGFAVNRTFFPYGQAAHLLVSLGIDLFRIDRVISNFGMPMGPFQLQDVAGYGVALAVKDIYAAAFGTRNFHSGLVELMAKNGRQGKINGKGYYLYEKGAKPKPDPSVQHVIDEYRRQTKKMPGGKPVTLSDQDILEMVFFPVVNEACRVMDENVVIRAADLDIASVLGMGFPXYRGGLIFWADTXGASYIHSKLSKXAE

SEQ ID NO: 166912 - protein, 71 aa, Triticum aestivum
  Clone ID: PAT_TA_61330.pep
CAKKKKKKKKKKKKKKKKKKKKKKKKKKKKKKKKKKKKKKKKKKKKKGGAFLGDPFFFPGGGKFLFFFWGP

SEQ ID NO: 166913 - protein, 58 aa, Triticum aestivum
  Clone ID: PAT_TA_61331.pep
SWSTEWHALDCLHQSTYGASWQASDRVGRTPELAVPGEPCVHVGSARAALRSYSRTRV

SEQ ID NO: 166914 - protein, 41 aa, Triticum aestivum
  unsure (1)..(41): unsure at all Xaa locations
  Clone ID: PAT_TA_61332.pep
KEHLAASLTSARPRNRSGGAQEATRRRRPGSQLLKIGXXIN

SEQ ID NO: 166915 - protein, 189 aa, Triticum aestivum
  unsure (1)..(189): unsure at all Xaa locations
  Clone ID: PAT_TA_61333.pep
MAEADITRYWCHECQQAVEEAMVEELKCPLCDGGFVEEMTVEQVEALTEQGATQWDPLDNPFEQAGSPGDSDDEDNSDIGREFEGFIRRHRRASALRRVLDSIHDDLRDDRERDNSVLISAFNQALALQGAALDPDEDRGDHGNANNDDGLLDEYVLGAGLSLLLQHLAENDPSRYGTPXTKKEAVEAL

SEQ ID NO: 166916 - protein, 78 aa, Triticum aestivum
  Clone ID: PAT_TA_61334.pep
SGSGSSETPGKKPPLSPSRSASRRVQCPAPLPWPPSAVTVAFLPPVMYSFSAVRKSAQYGSAQEVETDSASSARSRYL

SEQ ID NO: 166917 - protein, 164 aa, Triticum aestivum
  Clone ID: PAT_TA_61335.pep
GGGGSGVSVESVVTEAFFNGIKSRAGNGCAGKSFYTRPSFLSAARANPNFGKGRTTDDGKREIAAFFFYVTHYCDRKYTQWPCASGKGYYGRGPLQLTWNYNYGAAGKSVGFDGLNNPEKVAQDPEVAFKAALWFWMNNVKQVLPRGFGATTRAINSGECNGGN

SEQ ID NO: 166918 - protein, 61 aa, Triticum aestivum
  Clone ID: PAT_TA_61336.pep
YVSRFSLDRKRTRLHVQDVSERRKIINRTLFCGHKACDTGMVRRRLLTQWLFHRRRKILIA

SEQ ID NO: 166919 - protein, 93 aa, Triticum aestivum
  Clone ID: PAT_TA_61337.pep
FLLHDRNRTLPIPRQLSVSKPSFGLSTLGFRYFSRASSSLPCPCLPSPCNRLDLHSPNVIEPQPSTTFGLVVFRVLSLHLLRFPYSQTTVFSL

SEQ ID NO: 166920 - protein, 66 aa, Triticum aestivum
  Clone ID: PAT_TA_61338.pep
SRLPGNFPSVFCSVFCWVGCAVVMFYYDRWCVFLSGQFGPDESTDWGNIPLESYFVFSLSIIVCGR

SEQ ID NO: 166921 - protein, 103 aa, Triticum aestivum
  Clone ID: PAT_TA_61339.pep
DRVRRQVRSSYASVSFAPWVPLAEDGVAGIEEIYSQFLLAAPSSADSNSTQQPAKVHQEKSDDKAEALSSSKKGSCATGKGAGIAKKSRQLLLYVIYAEINYL

SEQ ID NO: 166922 - protein, 249 aa, Triticum aestivum
  unsure (1)..(249): unsure at all Xaa locations
  Clone ID: PAT_TA_61340.pep
MAMFPCLILSLLLTFASAQLTTLSAGSTLAVEDYTMFQDDDGPSFNNNSRLAVLDDKGWFSSTDGLTAHGSRRRLTLEHDGNLRMHSLDASSGRWVVTWQAILQMHYVHGLCGKKGFFEYSPRLRCSCPPGFEMVNPNVWSKGCRPTFSYNCGQDRYSFIQIPQTDFYDFDLGVNDSISFEECRNICLGMCSCIAFSYRLTGTGVCYPKGLLFNGYKSLAFPGSVYXLEVPLTADIQIQVSESPQSALT

SEQ ID NO: 166923 - protein, 109 aa, Triticum aestivum
  unsure (1)..(109): unsure at all Xaa locations
  Clone ID: PAT_TA_61341.pep
MFVKDATRFSCFGHEVVELGIMFHATFFSQVQYVPTVYPDDPQGLQCVLQYLTEAYGGLPIYVQENGKXKASANDILDDTDRVEYLKAYIGSTLDALRNGANVKGYFAW

SEQ ID NO: 166924 - protein, 219 aa, Triticum aestivum
  Clone ID: PAT_TA_61342.pep
MANICGGRERARVAADYRPSSPDEESGLQEPNSGTMNSKASSSATTGFMASVDSDGTNGATKQGCFLEGQILEAPNLRKFTFLEIQTATKNFRPDRLIGFGGFGWVYKAWVDEKTMNPTTSGPHMAVAIMHGKEEWQKFLTVNLRSDINLLGRFSHPNLVKLLGYCWEGKEVFLVNEFMAQRSLEYHLFTVSGRCPPLSWEPEAEIAIGAARGLAFLHA

SEQ ID NO: 166925 - protein, 238 aa, Triticum aestivum
  Clone ID: PAT_TA_61343.pep
MSMSAEETSKVRDGFPRPFPNIPSNVTEQFRLNGKVCVVNGAADGLGYAVAEGYAEAGGNVALWYNSNDAAIEKARSLSEKHGIKASAYKVDVSDAQQIQDALKKILDDYGKIDVYVANAGMAISKPILEQTIEEYKKQMSVNVDGVVYSAKYAGEIFKRQGFGNFIITSSMSAHIVNVPTDQPVYNGSKAFITHFGKSLAREWREIARVNIVSPGFFDTRWVRAPELSTRHTRWAVL

SEQ ID NO: 166926 - protein, 151 aa, Triticum aestivum
  Clone ID: PAT_TA_61344.pep
PTRPAQGSGGALDWRSKLVTQRGAVVATEMKNNSCKLARWTVQSILASADVMKLGFVSRVTPRSNDKHVVLGVIGWKPRDFANQMNLSLNNGWGIVRTIADMILSSSTQDAKFVLVKDPNKSILRLYEVPTGSFDDDDEEEVEEPQGEEEQ

SEQ ID NO: 166927 - protein, 117 aa, Triticum aestivum
  unsure (1)..(117): unsure at all Xaa locations
  Clone ID: PAT_TA_61345.pep
DTRXHWSMGPAICYVSCLKIYFVKSISRLLRLTAVLFFFSLPPFFFPSIISSPHKIKINITKLYINSAIFLRGKFGQVTYSYCAIQSHDNMPCMRRIAARPNVRNMCVFHRSVKLGQ

SEQ ID NO: 166928 - protein, 74 aa, Triticum aestivum
  Clone ID: PAT_TA_61346.pep
APGVWGCGGIRRGGEGRGRGGISCRLDVGAPYCGELVLPMSQRSLRRPAAGPSMPYSPSLFVFLLFQSGHSIAK

SEQ ID NO: 166929 - protein, 100 aa, Triticum aestivum
  Clone ID: PAT_TA_61347.pep
GSVWSGLRSASFLVFSMGWVSSMGRDRWSQSSARGATAVSRPLRRAAFGVFFRCAWSPRNRRCQRCPRICCYRTHPLRRRSSTPGRVAAAGRAPASVRAV

SEQ ID NO: 166930 - protein, 174 aa, Triticum aestivum
  Clone ID: PAT_TA_61348.pep
MAPVVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFNNLRQVQCVSFIAFRPPGCEETGKA

SEQ ID NO: 166931 - protein, 64 aa, Triticum aestivum
  unsure (1)..(64): unsure at all Xaa locations
  Clone ID: PAT_TA_61349.pep
MEDVAKFLFGISGNVVALFLFLSPXPTFWRIIRNKSTEEFSGVPYNMTLLNCLLSDWNRLPLLS

SEQ ID NO: 166932 - protein, 72 aa, Triticum aestivum
  Clone ID: PAT_TA_61350.pep
MALEGRGRKIGFFKTAAPFFFFFFFFFFFFFFFFFFFFFFFFFFFFFFFFFFPHMVTPDLFYMGLQSSKKET

SEQ ID NO: 166933 - protein, 120 aa, Triticum aestivum
  Clone ID: PAT_TA_61351.pep
METAYAPPMASQVMKSGLVSSKPRGLSGASLTRRPRFVEKAVKSDKGTYQVVQSINGDPFIGSLETPRTCRPLGGGDLCNLPEYRTDERPFLRGMEVGLDHGYVLRGPWGLSRAGADHAG

SEQ ID NO: 166934 - protein, 181 aa, Triticum aestivum
  unsure (1)..(181): unsure at all Xaa locations
  Clone ID: PAT_TA_61352.pep
MGEGSHYQVDWRNTGNFVGGKGWNPGTGRQVLSDILSYKSFDLHYAXTINYGGSFNPQGNGYLCVYXWTRGPLVEYYVIESYGSYNPGSQAQHRGTVYTDGDTYDLYMSTRYQQPSIDGVQTFNQYWSIRRNKRTSGSVNMQNHFNAWRSAGMNLGNHYYQILATEGYQSSGSSSIYVQTS

SEQ ID NO: 166935 - protein, 101 aa, Triticum aestivum
  Clone ID: PAT_TA_61353.pep
RENVSLKLYLHGFWQLVYSIMYICYDRLLLPKDTNPLHCIPRKEANFLFPFPNQSVAIHFPFPLRHCTVFAFNKVIVVGAQRTHSRRHRDTRKTRLRSPSA

SEQ ID NO: 166936 - protein, 84 aa, Triticum aestivum
  Clone ID: PAT_TA_61354.pep
PRVRPRVRRWPGCRVAWEGFSDASDADLIAEHEIWAAVHPLAKNEAFNCSTGDAFKWKQLWPLLTDRFPAKRAGYEARGHALRP

SEQ ID NO: 166937 - protein, 120 aa, Triticum aestivum
  Clone ID: PAT_TA_61355.pep
MGLLDQLWDETVAGPRPDHGLGRLRKYSSFSPSTAAATDVAPAVTRSITIARPPSLSVPSGESSSLPPSPASAPDSPFAAATSRRDGWRAFRRKSKMANVDVVRPETAVGPRSPPCTTGW

SEQ ID NO: 166938 - protein, 46 aa, Triticum aestivum
  Clone ID: PAT_TA_61356.pep
EVIALQVPEVACQVMVWSLKLQKWIIWSLNLSWMCKFSPQPTGRVG

SEQ ID NO: 166939 - protein, 166 aa, Triticum aestivum
  unsure (1)..(166): unsure at all Xaa locations
  Clone ID: PAT_TA_61357.pep
MQGAGVEGRSRGSPSAMDKADESAKKARLDLPDGHLVKQELVAHDAAAGGGAIVAVAEHSPRAELAVKIDMCVLHCPLCTLPFKPPVFQCKGGHLACGGCVAQQPSGQCGACTDGCGFFDPCPALDAVVSSTRIECPNAGCQRYVTYHEADEHRXACPHALWRCTE

SEQ ID NO: 166940 - protein, 161 aa, Triticum aestivum
  unsure (1)..(161): unsure at all Xaa locations
  Clone ID: PAT_TA_61358.pep
DVCCARREVIEKYTMLTRDVGMELLRLLCEAMGLRPDYFEGDLGGADVIVTLNHYPACPDPTTMIGLPPRCDRNLLSLLLPSAVPGLQISHNGKWMNVEPLPNAFIVNFGLPLEVVTNGMLKSIEHRVVTNATLPRMSXGTCITPTKDCLIXPGEEFLSDE

SEQ ID NO: 166941 - protein, 126 aa, Triticum aestivum
  unsure (1)..(126): unsure at all Xaa locations
  Clone ID: PAT_TA_61359.pep
KKKKKKKKKKKKKKKKKKKKKKKKKKKKKKKKKKKKKKKKKKKKKKKKKKGGAFKKKKIKRPGXKKQKLFKKENQKKKNGPGLKKGEKKKNLGKKKKKVLKKKPFLKNGKKKKKPQKKPFSKKVAT

SEQ ID NO: 166942 - protein, 174 aa, Triticum aestivum
  unsure (1)..(174): unsure at all Xaa locations
  Clone ID: PAT_TA_61360.pep
ELASRHASPAAFRHGNKFRWSRRIHRSGEFLDKACVRXRSRGATRSRRSPWRLCTVSEVQQAKTLLAVTPIFACTIVFNXTVLAQLQTFSVQQGSAMDTVLGGAFRVPPASLQAIPYAMLLLLVPAYELLLVPFMKRLTGTRSGITPLQRXIGVGLGTVAFSMVAGATVERRRR

SEQ ID NO: 166943 - protein, 54 aa, Triticum aestivum
  Clone ID: PAT_TA_61361.pep
APHHCLSLDGGKDNGAKGELICARGVKAQYRYDVRLIYFLLLQEPNIYTLISYC

SEQ ID NO: 166944 - protein, 155 aa, Triticum aestivum
  Clone ID: PAT_TA_61362.pep
MSASTSIPCGSKSAGGNGNGVDRLSSLSDDLLHHVMSFLPMPEVVHTSLLSPRWRFLWCSTPFIRIDSEDFMDQCKLEKFGDRLLLLRDVMDHHLLDGLPHATTLELHAPLHERAFEGGMLTCPAFSNLTSLVLGDWVMTADFYPLHRILQLSDS

SEQ ID NO: 166945 - protein, 226 aa, Triticum aestivum
  unsure (1)..(226): unsure at all Xaa locations
  Clone ID: PAT_TA_61363.pep
DFIWGVMDIIPKTDFPDIRMRCAIHSAENGSLMVIPRENKLVRLYIQLKEVTPDASGRADRSKISPDVIFKAAQKIIHPYKLDYEYCDWWTAYQIGQRVGTAFDSHERIFLAGDAVHTHSPKAGQGMNVSMQDSYNLGWKIALVVKGIAKPDILKTYQSERRRVAQDLIEFDHRFSRLFSGRPAKDVMDEEGVSMXRVQRRVRKGNMFASGLSVEYGPSNIVAKAR

SEQ ID NO: 166946 - protein, 89 aa, Triticum aestivum
  Clone ID: PAT_TA_61364.pep
RWLAPHHWLLFDGGKEKGAKGVLLCARPSKYSIAMMCGFSISSYCMFPILQIVKLVLDFASDFSVAFSISMFLLNDHINLAGVCTCDFG

SEQ ID NO: 166947 - protein, 59 aa, Triticum aestivum
  Clone ID: PAT_TA_61365.pep
RYHPLRGDPLRLLQTRRQRHRRRHRLIIFFFFFFFFFYVFLNLKNKVSVIESEACCCLV

SEQ ID NO: 166948 - protein, 127 aa, Triticum aestivum
  Clone ID: PAT_TA_61366.pep
ARITVKDTTSTRMARQMAIFSTDTPRFDRCSIESEGCLTPTNIPRAELRSNNATSRGRHLRSIRCPVLLPHRAVRRLHLTTLICCSYLVLSWIDLRQRRCRRSKLSHLYPDCDCGTCKTSHPGTDRA

SEQ ID NO: 166949 - protein, 94 aa, Triticum aestivum
  Clone ID: PAT_TA_61367.pep
MAWRKKNGGESLSPGASPCRDDEREKVPRGHVPMVTGCGARVVVPVRLLRDPCIAELLDMAAQQYGYGQPGVLRIPCDAGHFRRVVDGALHRAD

SEQ ID NO: 166950 - protein, 131 aa, Triticum aestivum
  Clone ID: PAT_TA_61368.pep
IRVYIPQPSSMKVTVPSFAPYLVFTFTRYQHLALTQRLGQTYLTPRAIPSTAGFISRGGLQQRVLARMATLVTAAPASASVLAMTTPSSGIQSTITLPWQESMDMLLQKRKTRSGDSSICFCLLAINHRYN

SEQ ID NO: 166951 - protein, 110 aa, Triticum aestivum
  Clone ID: PAT_TA_61369.pep
PLVRQLESSSHGSATGARLNCHALHLVSLRSGAAAVDFSDRVGEVTKTVYLGSDAGGPRPHRVITQLTARWCCAAGWPATCSSRRSRDRLAVVAVKHLNHRDYRSCNEAL

SEQ ID NO: 166952 - protein, 138 aa, Triticum aestivum
  Clone ID: PAT_TA_61370.pep
LGLERFGGDQAMATALRHAARRFGTRAAAEAEAEAIIERSPLYTSTRIVDSTTGRDLTPNQRKDAIFRLAQIHAQKEDLYNTIAAWQADYTAKGNVVTRKNNLLLKQLSQHVKPRPDDPRWRSSQRAVYFNDFLKLRG

SEQ ID NO: 166953 - protein, 145 aa, Triticum aestivum
  unsure (1)..(145): unsure at all Xaa locations
  Clone ID: PAT_TA_61371.pep
MALLMEPGSEPLTEGEKADLAAIAAIKESAAREYREEGNQFVKKGRKHYPDAVDCYTKAIAQMGALAAPNPDASVLFANRAHVNLLLGNHRRALDDAEQAVRLSPSNLKAHYRAAKAALALDQLPQAASFCRXGLEHDPANEELK

SEQ ID NO: 166954 - protein, 166 aa, Triticum aestivum
  Clone ID: PAT_TA_61372.pep
LFDLSTGMASTKALSDRAHREDSPVRRGRTDIKRTVDPAKVCIEDKLETSTRSSLSSKSDASPMKKLLANQIAKEVESKRKPPSVVARLMGLEDDLPAQEQALHSAKSNLRRSHSHDKYAATKRALQQQEQHLYSKTTRKHTGPKETVEFKDVYAVCEEPLRTHHL

SEQ ID NO: 166955 - protein, 83 aa, Triticum aestivum
  Clone ID: PAT_TA_61373.pep
VCQNTDANAIAGRHTPGTFTNRMQTSFIEPGLLILTDPRTEHQTIKEAALGNIRTIDFCDTESAIRYIDIGIPANIMGKQSIG

SEQ ID NO: 166956 - protein, 84 aa, Triticum aestivum
  Clone ID: PAT_TA_61374.pep
CLCGTRAATTTAAKELQLSRAHSCFTDYVWSVQKIGGFRIFGSSLRHHPSCPQLKGQMSETVVFVLASREDDLLCTFHLLSRPS

SEQ ID NO: 166957 - protein, 114 aa, Triticum aestivum
  Clone ID: PAT_TA_61375.pep
IFHSHILAESAALSSAIYKRGTESGKQMGSTLTLHLTNILLSSQQYMLYFIYLCIYSPCRRMAVSGKCFCICARILVSMFLYRRFLYGHVWWIETGERVTAIHRTASIKFCGLH

SEQ ID NO: 166958 - protein, 142 aa, Triticum aestivum
  Clone ID: PAT_TA_61376.pep
MSKTLKVAAIQAEPVWQDLQGGVEKSIRLIQDAASNGANVIGFPEVFIPGYPWSIWANSPVENAAWINEYFKNSLERESPEMDQIRAAVREAGVFVVLGYSERYRGTLYIAQSFIDETGTIVLHRRKIKPTHVERAIYGDGQ

SEQ ID NO: 166959 - protein, 44 aa, Triticum aestivum
  Clone ID: PAT_TA_61377.pep
ARDMYPVVVAHPVHRLNPADRRRSVSSSALDVDIPSADFSFSQG

SEQ ID NO: 166960 - protein, 77 aa, Triticum aestivum
  Clone ID: PAT_TA_61378.pep
KKKKKKKKKKKKKKKKKKKKKKKKKKKKKKKKKKKKKKKKKKKKGGARFKEPNFTTPAWQGKSFFLGPPKLISWAGF

SEQ ID NO: 166961 - protein, 46 aa, Triticum aestivum
  Clone ID: PAT_TA_61379.pep
SEMSWLSNLLSDHQGLMHMNLDTEEGGIGMNLWDGLHLGVHVLAAI

SEQ ID NO: 166962 - protein, 130 aa, Triticum aestivum
  Clone ID: PAT_TA_61380.pep
GRRGQGQNGRVGTVTLFCAGAGEVDTQQQEVRPHLQARGEQGPQRLGHEPSTQTHLASALEHGAHPHRIDRRRRGAEEATAGRQEAFAQQGPERCWPSQPLPPPPNINGCHHRHLKSGPDAQADEWCSLP

SEQ ID NO: 166963 - protein, 99 aa, Triticum aestivum
  Clone ID: PAT_TA_61381.pep
WIPRSDQKSKQNRLAATLNQSSKGSEHGTDINGTDGVKPPGLRPRHRRKEHHDDRDRTLAWNTIGRRTAKGTDYEYRTCDLPVAERWKRREEKKSPRVR

SEQ ID NO: 166964 - protein, 123 aa, Triticum aestivum
  unsure (1)..(123): unsure at all Xaa locations
  Clone ID: PAT_TA_61382.pep
KKRERKKKRWXKKKGETKKGXAEKKKEDHTRAVEKTKHNTAAKNLPKQGEEFSKKRPPHILKRRKQRKAFNVKTHRRQKRVYCKREQKRRETKSYQPHNKDKKSPTKKKKKGPKKKKNKSFSI

SEQ ID NO: 166965 - protein, 207 aa, Triticum aestivum
  unsure (1)..(207): unsure at all Xaa locations
  Clone ID: PAT_TA_61383.pep
MVSLKLQKRLASSVLKCGKGKVWLDPNEVNEISMANSRQNIRKLVKDGFIIRKPQKIHSRSRARRAHEAKQKGRHSGYGKRRGTREARLPTKILWMRRMRVLRRLLRKYREAKKIDKHMYHDMYLKVKGNMFKNKRVLMXESIHKSKAEKAREKNXLLDQFEAKRAKSKASREKEACQEXKRLAQAPRDHAPAPAAAAPAPAPAAAA

SEQ ID NO: 166966 - protein, 65 aa, Triticum aestivum
  Clone ID: PAT_TA_61384.pep
SDFIARIMGLSEAPPSYRLTPHLSCDPSGMTFAFGGAGVYEVPDKKVPTLATQVNAFTRLLNAGG

SEQ ID NO: 166967 - protein, 185 aa, Triticum aestivum
  unsure (1)..(185): unsure at all Xaa locations
  Clone ID: PAT_TA_61385.pep
IACLLHLCPSLSRDDALLHLPXQADLSRAIASASDSVSAPTQAAFLKAAEAAHHPMPHALALFVSSVLPKVERDARMLLCVNRALTAPELDRLSDMLVPSPLPEDLYPPPPLVTSWVAAVIKSRIEGCKYSQETSRQLVEAALSKYAQQIGQHYELHLVCGINLFIQSEAFWHINFLARPKDACW

SEQ ID NO: 166968 - protein, 176 aa, Triticum aestivum
  unsure (1)..(176): unsure at all Xaa locations
  Clone ID: PAT_TA_61386.pep
GLRGCRGEEGQMLRRRHSEVGQWRLCGKAGQVRAHARALLSVHARVLALQLASARTPPHARRPAQPPGTPPSSYPRSRFPKTPPQTPVGRXRRSSFGSTAGQRRTTAKDGCGHAGGEHLPGDQHLLLSSSQPAAHSVHTHSMCPVFRISDWACVLALATFTWGILEFPRTCAGIEY

SEQ ID NO: 166969 - protein, 91 aa, Triticum aestivum
  Clone ID: PAT_TA_61387.pep
QPIKRMLNHDESRAFYTTIASATPPTRAVKRPPHALRGWSASADSASVNQGRRSASAAVSLLSGLQASSPLRTSKPAADSDGNISRSRLGG

SEQ ID NO: 166970 - protein, 213 aa, Triticum aestivum
  unsure (1)..(213): unsure at all Xaa locations
  Clone ID: PAT_TA_61388.pep
MSMPLPGRTLVDLDGDXLAHCARHLGARDVASLAMVCRPLRAAAYCDAVWYHLYRGQWPFQQVPHGALGIRELYIRRHTEVHQMKFDDPLSSIYYLDPTEPTPIHLMLDRNXXWFSQGPVVKRLRLGLDMELVETYRTHSARITCMRLFPLIDTPLYRSDAHRNEKALVTSSTDRTVRLCWKGQSRCYKGHSGPVTALADKLLDDGECKILAT

SEQ ID NO: 166971 - protein, 63 aa, Triticum aestivum
  Clone ID: PAT_TA_61389.pep
RRQADLQDGAAGGPRRVQERLQLLRLPREQGLLLGRRRRHLLLPQVVRRRSWRRRWTRVVIMC

SEQ ID NO: 166972 - protein, 117 aa, Triticum aestivum
  unsure (1)..(117): unsure at all Xaa locations
  Clone ID: PAT_TA_61390.pep
HASARPASNTPRAHRRRRRPLPPSPDGVRAQGLRLPRPRRVLGGGGXXPLVLGRLRXAEGPGGGXEEGXAKRGRAPSGRNEGGGTVSAPATGAVLDERSRQVNDYYEEEIKIDPLCQ

SEQ ID NO: 166973 - protein, 90 aa, Triticum aestivum
  Clone ID: PAT_TA_61391.pep
KKKKKKKKKKKKKKKKKKKKKKKKKKRENRSKETQASKRIHAKIITFFIGSPKIHFTGAAFFKGPPVKPLAFPNLFPFFPIPLSPAGGLP

SEQ ID NO: 166974 - protein, 78 aa, Triticum aestivum
  Clone ID: PAT_TA_61392.pep
PLLHYPSITTLPCLFIALYLVISLLADTRGLCMTTLFTVKTLSLPQNTCTGMHDTHYSLYQINADDLTNLPSPSNASC

SEQ ID NO: 166975 - protein, 193 aa, Triticum aestivum
  unsure (1)..(193): unsure at all Xaa locations
  Clone ID: PAT_TA_61393.pep
RRLAGRAAGRVGNDATPHGLSADPEAFARNRALDVIHGTWGADAYDALGRVFPEVLQKRVAVEFKEPDWFMAGSKIFXPSGGLNVPMGTHNLMHAQSILVVLGYPRXFLMGLVEGFRMNGLDGGWEGNYLYPGGQXYLYPLGLADDPVTFAELKVKEIKNGRLAMFSMFRVLRSAIVTGKGPLENLLHHLDYP

SEQ ID NO: 166976 - protein, 105 aa, Triticum aestivum
  Clone ID: PAT_TA_61394.pep
GDKPPIIVENNLLEYLVNVFATGKSEDLVRFTLRAPTSAIFRFRQFDATHRNHTKLCQNQDHPLNLPLKLGKNRPRRNHWGQKDPHQNHQTLLSKQKKSPYQDPS

SEQ ID NO: 166977 - protein, 78 aa, Triticum aestivum
  Clone ID: PAT_TA_61395.pep
KKKKKKKKKKKKKKKKKKKKKKKKKKKKKKKKKKKKKKKKKKKKKGGAPLKEPNFPTPAWQGKIFFMGPPKLNSGPGF

SEQ ID NO: 166978 - protein, 33 aa, Triticum aestivum
  Clone ID: PAT_TA_61396.pep
DGTILINARILKHIQKRNTRFDLSMHLRGQTRK

SEQ ID NO: 166979 - protein, 67 aa, Triticum aestivum
  Clone ID: PAT_TA_61397.pep
IKFGGPIKKILPFQPPVVKLGSLKRPPLFFFFFFFFFPFFFFFFFFFFFFFFFFFFFFFFFFFFFFL

SEQ ID NO: 166980 - protein, 189 aa, Triticum aestivum
  Clone ID: PAT_TA_61398.pep
RQPSDRSTAAQLLDHPFVASAAAAGDYKAAPAKQQYTSPKSTLQDALWDSDTDDEADEMSATPAERIGALACGNSALPDWDSDDGWIDVCDEVHRVPDSPPADAGYDLVWPEESDAEREPFAVAADDSNDIPRNAVVTDSSIWQDSYVRPVHLGSCRNQFHPFQSDGDENLRFDRRCNKDRVMEFIFLL

SEQ ID NO: 166981 - protein, 110 aa, Triticum aestivum
  Clone ID: PAT_TA_61399.pep
MSSSEVACTLAALILHDDGIPITSEKIATVVKAAGIKGEAYWPALFAKLLEKKSGDDLILSVGSGGRGAPTAGAGAPAGGGAAGAEEKKGEKKEEAQEESDDDMGLNLVD

SEQ ID NO: 166982 - protein, 91 aa, Triticum aestivum
  Clone ID: PAT_TA_61400.pep
MHATRFLLKRSVWKGPHLVPLPIVWPKSTSDKVPPVRTQARSATILPNFVGLKFEVHNGKDYHEVTITEDMVGHKLVQESPIFGTRGSLLG

SEQ ID NO: 166983 - protein, 33 aa, Triticum aestivum; identical to SEQ ID NO: 166978
  Clone ID: PAT_TA_61401.pep

SEQ ID NO: 166984 - protein, 134 aa, Triticum aestivum
  Clone ID: PAT_TA_61402.pep
PPPPPRLKGPYRGGSLSPSGLTNFWKGDPVGPFWFFPNWKKGDFRQSHLIGERQGFSHSQGVKSGPRQCILGAPKKKIIRRKPGLGNLESLKRAPPFFFFLFFFFFFFFFFFFFFFFFFFFFFFFFFFFFFFFF

SEQ ID NO: 166985 - protein, 78 aa, Triticum aestivum
  unsure (1)..(78): unsure at all Xaa locations
  Clone ID: PAT_TA_61403.pep
KKKKKKKKKKKKKKKKKKKKKKKKKKKKKKKKKKRGGPFKKIKLKKPVNEKKKFFKRXNQNKINWPCFKNVETEKTLG

SEQ ID NO: 166986 - protein, 137 aa, Triticum aestivum
  Clone ID: PAT_TA_61404.pep
WMWCVCVFAPCVGLYLLCHSRFARLFPCSAGACCWSSVPPLLLGGRGGLFLGLSSFCIVFSLLSVHVVARLVSSACRPRLLPAWPGPCGSGGCRRLSVRIPWCRGRSLFLRSPRLGSVSVVGALSPPRVSCLFLKAV

SEQ ID NO: 166987 - protein, 96 aa, Triticum aestivum
  Clone ID: PAT_TA_61405.pep
VASKLSIIRMDQLLFYFVEDKVQIMNNGITSQLGTITHVLNLIESDTSKSSLACKYYYIVMTGTINYLTCIIGTAKTFRSCFNKFGEDHFICILHI

SEQ ID NO: 166988 - protein, 71 aa, Triticum aestivum
  Clone ID: PAT_TA_61406.pep
KLARRCDTLIRLVEKENQECDERDRQARKDKKNMTPTKRPSSSSPMDSPMQTPSKRGRRDGSAPSGKRRRR

SEQ ID NO: 166989 - protein, 164 aa, Triticum aestivum
  unsure (1)..(164): unsure at all Xaa locations
  Clone ID: PAT_TA_61407.pep
MPPARLAAPAAVLLVLLHLAATATATNFTCSAPRGTTCDSAIGYRVPNATTYGDLLARFNTTTLAGLLGANGRPLATSPKTRVAAQATVRIPFSCLCAGNGVGQSDHKPVYTVQPQDGLDAIARNFFDALVTYQXEIATGNKIXDGNLITIGQKLWXIPLPCSC

SEQ ID NO: 166990 - protein, 86 aa, Triticum aestivum
  Clone ID: PAT_TA_61408.pep
YLELSSIMDSPLPYIIYLGYVYKTLITNTTVLRCSVLQYHALPVYFVLHVVNAVLLWKYRCLLMDYIAANQNERTFLTPLGVTERL

SEQ ID NO: 166991 - protein, 58 aa, Triticum aestivum
  Clone ID: PAT_TA_61409.pep
KPTKSYLLYVGSSPSHLEPAWEDMNSWYQVQRQTKVLTLMKQRDISSRYIPQMVASGR

SEQ ID NO: 166992 - protein, 61 aa, Triticum aestivum
  Clone ID: PAT_TA_61410.pep
KNFYFACPGSLTWIFLKRPPLFFFFFFFFFFFFFFFFFFFFFFFFFFFFFFFFFFFFFFRT

SEQ ID NO: 166993 - protein, 100 aa, Triticum aestivum
  Clone ID: PAT_TA_61411.pep
RKQFMLFAVSPRTSVTIYRKTKKPTQRNTTGAPARLQIAHSTRRQQGHNVPEPFNYNHPSELSRKFFFPFFHWRHARIMGHPIQPATPIGALGPPGWGSF

SEQ ID NO: 166994 - protein, 53 aa, Triticum aestivum
  Clone ID: PAT_TA_61412.pep
SSPMSHSSSLPPLTAAPGGCYLVFEDICSRSSNACRVVPVDQGINGLAVVRVP

SEQ ID NO: 166995 - protein, 187 aa, Triticum aestivum
  unsure (1)..(187): unsure at all Xaa locations
  Clone ID: PAT_TA_61413.pep
KIVYARKDKCLKEGNNKQDYWRHPWDRHELQQLSITMDDFEEAITEIVQPSMRREGFSSVPDVTWACVGGLDSLKKELDRSIVQCIKYPEYYKKFGVNMQAGVLLFGPPGCGKTLIAKAVAHDSGANFIHIKGPEVLNRYVGEXSESDIRKIFTRARINSPCILFFDEVDALTTKRGKEGAGWLNVS

SEQ ID NO: 166996 - protein, 197 aa, Triticum aestivum
  unsure (1)..(197): unsure at all Xaa locations
  Clone ID: PAT_TA_61414.pep
NNCSMKKKVERSLADGRITQIVYKGAHDHPKPPSTRRNSSGCAAVIAEDHTNGSEHSGPTPENSSVTFGDDEADNGAEPETKRRKEHGDNEGSSGGTGACVKPVREPRLVVQTLSDIDILDDGFRWRKYGQKVVKGNPNPRSYYKCTTVGCPVRKHVERASHDNRAVITTYEGRHSXDVAGRQGGPGASRAXPTSSS

SEQ ID NO: 166997 - protein, 110 aa, Triticum aestivum
  Clone ID: PAT_TA_61415.pep
SRGSRRRCFGFGVHLLLHEAKESSPAARTTTTSSLLLSSGTGVLLVLAALRAVERRGGFRLVHAPQLLLVGVLEHVGLHEVPSHHGRHISFSNKFFLRCCCCLLLPNCLG

SEQ ID NO: 166998 - protein, 87 aa, Triticum aestivum
  Clone ID: PAT_TA_61416.pep
HMYNNIFQKQQYYAQSNHHGISISQDMAFQSINFRDISNLQNKRESSLTFEREREGKKDVPVGHRQSVQCRPRQHRLVHGGGDSCSS

SEQ ID NO: 166999 - protein, 170 aa, Triticum aestivum
  Clone ID: PAT_TA_61417.pep
ATKGDDQDEVSEEDVHKMPYLKAVVLEGLRKHPPAHFVLPHKAAADMEIGGYLIPKGATMNFMVAEMSRDEREWEKPTEFVPERFLPGGAGEAVDVTGNREIKMMPFGVGRRICAGLGIAMLHLEYFVANMVREFEWQEVAGEEVDFAEKNEFTVVMKKPLRPRLVPRRA

SEQ ID NO: 167000 - protein, 161 aa, Triticum aestivum
  Clone ID: PAT_TA_61418.pep
LRTPSNPAPVSGKTDKATGPNPSTKLEALHAQRLFLDQSNSFIPSTSAAWPRPQTRRSGAATCRAALREPYSIHTAQDRLSLKLDWIDGRSPRSGRRGGSVSVEKLRAIADAAADRAEMRDIIGRHGDNWNHLVLHSTNYLTLAVLRHGCARARRARRGRA

SEQ ID NO: 167001 - protein, 26 aa, Triticum aestivum
  Clone ID: PAT_TA_61419.pep
FTVSRTYYTVKWENYTVNGGSLKHII

SEQ ID NO: 167002 - protein, 158 aa, Triticum aestivum
  Clone ID: PAT_TA_61420.pep
SSSSSTPSSSSSAATSSSSSSSSSLSSSSSSSSSSSPPPPSCSSCSSSSSSPFSSPSPICFFLASLALGLSYSSPSEISSSPSAKSPSSSPSSSSPSSSPASVGADSSPLFPPILKSGIPQIMPSVSVPVPTVSRSARTSSSPAAGCMAVSICRGLLL

SEQ ID NO: 167003 - protein, 109 aa, Triticum aestivum
  Clone ID: PAT_TA_61421.pep
PGLHMNVFRDLASPEASLREAAAEALVAELRDVQRAYEKEKAAREEGEGEEGDRDDGPSQMMEAEKEDGLDNCAPAVRYAIRRLIRGISSSREVRNAVLSLGQNLRSVM

SEQ ID NO: 167004 - protein, 140 aa, Triticum aestivum
  Clone ID: PAT_TA_61422.pep
MGSGNLVMKKVVKPSSFDLDIQLDKSWTEDVTCPICLDFPHNAVLLRCTSYEKGCRPFVCDTDKSRSNCLERFKSAHGQPVNVKVSAVNIAPRDSIHFISSNTNNHPACPLCRGDVIGWAVIGEARQHLNQKKRCCEESC

SEQ ID NO: 167005 - protein, 49 aa, Triticum aestivum
  Clone ID: PAT_TA_61423.pep
LLPVLEVGLLCSNDSPCDRIKMSDVVVMLKRIQMKYTAWTTETSQSATS

SEQ ID NO: 167006 - protein, 96 aa, Triticum aestivum
  unsure (1)..(96): unsure at all Xaa locations
  Clone ID: PAT_TA_61424.pep
LRDAAIQAESSRRLAGRTMRPAVYSQRDRHHRKELSSAFGDIDKRICICKIAASAHPASRESTXRMNLPGTTDSSDTHCDGYNDRFWLVKGRPGVG

SEQ ID NO: 167007 - protein, 111 aa, Triticum aestivum
  Clone ID: PAT_TA_61425.pep
NPHVFGGYGPISIPTHPSAAGPLPSICAAGTFPPLEPNRGRGTGGDAAPWLRGVQGSRGGHGVGRHEGARVTVTCDASGRGYGALLHGEKRGGLGEVTPRRWSGFSAPLLR

SEQ ID NO: 167008 - protein, 86 aa, Triticum aestivum
  Clone ID: PAT_TA_61426.pep
NNLGLCGSLLNISCKHGSSPTTTSDVGKEHHDELETMWMYCSVIAGTIFGFWIWFGTLFFWKPWRCAFLSCIDAMQQKVMRKMKDI

SEQ ID NO: 167009 - protein, 103 aa, Triticum aestivum
  Clone ID: PAT_TA_61427.pep
PRVRAEIVDPSLHYNYSESEVLNCVHIGLLCVQESPSDRPGISNVILMLVGRSTTLPAPSRPAFLFRLNNENHVHGDLNDLLDDSNKSNPSFNKLTITEFEPR

SEQ ID NO: 167010 - protein, 182 aa, Triticum aestivum
  unsure (1)..(182): unsure at all Xaa locations
  Clone ID: PAT_TA_61428.pep
MPSLLFRLVRALLNLVKQTLYPAAKPGRGVPVLGGSDAGFKRPAVLTCPRYIISVICEFAMLICITGTLCYYFTYDLPPEFSVHLTPIPSNSSVGAPAATTSIPRAFDVVLHASNRRAIGEVPPPRGGEMVTYGGYTVXASGHAPDFCVPWKGALEVPFELAWDWDDGVYLPEHLRGLIAAA

SEQ ID NO: 167011 - protein, 126 aa, Triticum aestivum; identical to SEQ ID NO: 141118
  Clone ID: PAT_TA_61429.pep

SEQ ID NO: 167012 - protein, 102 aa, Triticum aestivum
  Clone ID: PAT_TA_61430.pep
DCPTFFDSYCATFYWYKKMDNGRHQMYSTPRLKYMTFVAKPTSDSEQPRTAAQRQNSTDSPRCRRAAPRSPPSSPGSSSRSPGTPCPATGCPCAAACTPAPT

SEQ ID NO: 167013 - protein, 122 aa, Triticum aestivum
  unsure (1)..(122): unsure at all Xaa locations
  Clone ID: PAT_TA_61431.pep
ERRNNIQNILKTNLSMAXLAEVVICNTSMELEPDALALLPNALPLGPLVAPTPRPVRHFLPEDLAWLDEQXPGFVIYVAFGSSGLRGEILDHGSAELMVHAVGSPSLVACGCVYHLNSKRTD

SEQ ID NO: 167014 - protein, 99 aa, Triticum aestivum
  Clone ID: PAT_TA_61432.pep
MTMEEALISPELRDVLAKVAVFLLVQGLVYLILTNSSDVFSKSKRLRSLSFRPMRSMSVRRVLAPLSDIPVGTDENSPSPLLSSSSSWSSRRWGSRKED

SEQ ID NO: 167015 - protein, 85 aa, Triticum aestivum
  Clone ID: PAT_TA_61433.pep
PSVRPRVRKKKKKKKKKKKKKKKKKKKKKKKKKKKKKKKKKKKKKKKKKKKKKKKKKKKKRGGRFLKKKFFVPGVGNVKFFFWGP

SEQ ID NO: 167016 - protein, 135 aa, Triticum aestivum
  Clone ID: PAT_TA_61434.pep
MASTACFVIVSKNDIPIYDAEVGSAPKKEDQAYQHQFILHAALDVVQDLAWATSTMFLKSVDRFNDLVVSVYVTAGHTRFMLLHDSRSEDGIKSFFQEVHELYIKIFLNPLYLPGSRITSSHFSTKVRSLARKYL

SEQ ID NO: 167017 - protein, 126 aa, Triticum aestivum
  Clone ID: PAT_TA_61435.pep
TPWGCLLQIRTQRRNDHPRKVMVEVFEVNVEEHKLVRLSSATAFQEHAVFVGLNESVCLHTKDYKELRPNHVYFATPWLTQEANFGLRGWKGVVIYDLENQTFEEVLPASKYSAFCPQQVWFIPNI

SEQ ID NO: 167018 - protein, 113 aa, Triticum aestivum
  Clone ID: PAT_TA_61436.pep
MVESASSPMLSIDVEFSGGLEMLFSNKRQHALSIPAVGQDGKPADIAYLINYLCQNVMDDSRKDLFVLDSHLRPGILVLINDADWELEGEEAYEIQSGDNILFVSTLLEVRML

SEQ ID NO: 167019 - protein, 59 aa, Triticum aestivum
  Clone ID: PAT_TA_61437.pep
THYAMSTVKPILTNAGKFNAHLVPASSTRVHIYSLHPIIQERFSSKNVLILWDGGSRFY

SEQ ID NO: 167020 - protein, 134 aa, Triticum aestivum
  Clone ID: PAT_TA_61438.pep
VIKPAPFLTKTHHMVEERGTDEVISWSEHGRSFVVWKPVELARDLLPLHFKHCNVSSFVRQLNTYGFRKVVPDRWEFANENFRRGEQSLLSGIRRRKATGTTTPQSSKTCGTGVNVAFPPPLPALSPASVSTFG

SEQ ID NO: 167021 - protein, 105 aa, Triticum aestivum
  Clone ID: PAT_TA_61439.pep
GLFPTCLAEHWVGSSYPFCVDFIEFQEQHMKFQDLVVTINVNLAAQSCMAATDFAKSACDMFVFKLARSLQRFLFIGIREHTRVFFETEAKDLPRILIKRGESTT

SEQ ID NO: 167022 - protein, 199 aa, Triticum aestivum
  unsure (1)..(199): unsure at all Xaa locations
  Clone ID: PAT_TA_61440.pep
VPSSQSVTAIYNTYRATQVAFPGEKDDVLRRAEQFGRAFLQERRASNKLNDKWVIPKDLPGEVEYALDFPWKASLPRVETRFYLEQYGGGDDVWIGKVLYRMPLVNNDLYLEAAKADFTNFQRMCRLEWHGLKRWYERNNLEMYGXSANSALRAYFLAAANIFEPTRAAERLAWARTAMLAEAVSSYFQRNGCAPELRE

SEQ ID NO: 167023 - protein, 48 aa, Triticum aestivum
  Clone ID: PAT_TA_61441.pep
KAGGEKWKSLSDAEKAPYAAKAEKLKAEYTKKIDAYNNPQAGEASGDE

SEQ ID NO: 167024 - protein, 169 aa, Triticum aestivum
  unsure (1)..(169): unsure at all Xaa locations
  Clone ID: PAT_TA_61442.pep
MADDAASAPPTAQLAAASISSPPSSDLEPPTSRTRIRAILDAGXAMAGERVVVGGWVKTGRQQGKGEFAFLEVNDGSCQGNLQVMVEKDVHPLAQLTHTGTSVLVEGVLKKPPAEAKQRIELKVERVIELGEVDAAAYPLPKTKITLETLRDFVHLRARTNTKGAVARI

SEQ ID NO: 167025 - protein, 89 aa, Triticum aestivum
  Clone ID: PAT_TA_61443.pep
TKYFMIAARDLTRPTILSSIYATASLRASPVPSPTPVVTGAAATSSRAPDLSLLLSFSKNRAHRRHHGCLRSYRLPASIPCPFFLRPVR

SEQ ID NO: 167026 - protein, 157 aa, Triticum aestivum
  Clone ID: PAT_TA_61444.pep
RLVLRRTGSSPESVDRVSNEDALVRFGEDELEDTSPLAIEPGSYRIPWPCRSLSPCPGRRGEVEGLLPGRATRCRRRRRRRTRGTPRSRRGISRWSSSATPLYREEVHVYGSDGDQAEIARSCVSQDEVTLSWLHLSALRIFHTWPCSFCMNADGVM

SEQ ID NO: 167027 - protein, 162 aa, Triticum aestivum
  Clone ID: PAT_TA_61445.pep
NLVFLKRPPPFFFFFFFFFFFFFFFFFFFFFFFFFFFFFFFFFFFFFSDINLLNKLIQYCMAQAGEQAIILLFYTTTIWNLNIMGLAIVPESVMHYMITHVFAPRAITGIESLTNHIMNRFSACMAGWEGRTHHRKHHESYSYGTHDCRPSCMFLASARTRG

SEQ ID NO: 167028 - protein, 128 aa, Triticum aestivum
  Clone ID: PAT_TA_61446.pep
NDHVEPTEPKDFPQEPRAGPSQARTPRVLPSQNAQLRSMAEQIVVRQEQIEVEQQQILAHLGQIQVEQQQILAHQEEIQVEQQQIIAGQQQQRHLLTRILAWLQEHSARKTPPAAPCAAGSAHTAGLE

SEQ ID NO: 167029 - protein, 221 aa, Triticum aestivum
  unsure (1)..(221): unsure at all Xaa locations
  Clone ID: PAT_TA_61447.pep
MASRLEFENSCKVGVFARLTNAYCLVLAGGAGNFTSVFEAELAYTVPVVKASIGGMRILGTLCVGNKNGLLLPHTTNDQELQHLKNSLPDEVVVQXDERLSALGKCIACNDHVALTNPDLTRETEEIISDVLGVEVFRQTIAGSILVGSSCAFSNKVGLVHXHTXVEDLDELSTLLQVPLVVGTVNRGSEGIAADIVVNDWAAFCGXDTMGTELLVVESVF

SEQ ID NO: 167030 - protein, 238 aa, Triticum aestivum
  Clone ID: PAT_TA_61448.pep
RLEDLGQPLVPPYPCVEEFLGDAGDTRDVLAKPLLFLQVTQLKCGGFVIGLHMCHCIADGFGILQFIKSIADFACGELIPTTLPVWKRDTFTARMPPPITHVYPAYKTFIQGLDCTGDDVMLSTPPQSMEVQYLFFGPKEVAILRSHLPEHLSKSTTTFELLTTVMWRCRTLALGYGSSQKVRIMFTLNTRGRSINGESIVPRGYYGNAHFSPMVEITVNELVTKPFEQVLELIHKVK

SEQ ID NO: 167031 - protein, 67 aa, Triticum aestivum
  Clone ID: PAT_TA_61449.pep
MLCPFVSRHNSMLYRESSCSPKPLFLCSWNAAYESLLGSNKPFPQPIPLHEMVDFLVDIWEQEGLYD

SEQ ID NO: 167032 - protein, 113 aa, Triticum aestivum
  Clone ID: PAT_TA_61450.pep
LTKICFCRILYNTSAMAGEVGKWGSSFKRSWALIPLVAHGIIVVVVGLAYSFISSHINDDAVSAMDASLAHVAAGVQPLMEANRSAAVVAHSLQIPSNESSYFRYVINQEPLG

SEQ ID NO: 167033 - protein, 75 aa, Triticum aestivum
  Clone ID: PAT_TA_61451.pep
MSCNCGSGCSCGSDCKCGKVYPDLTEQGSAAAQVAAVVVLGVAPENKAGQFDVAAGQSGEGCSCGDNCKCNPCNC

SEQ ID NO: 167034 - protein, 197 aa, Triticum aestivum
  Clone ID: PAT_TA_61452.pep
MRRTPPTYGRRAGRTDTRLATPRRGCTEEEVEDDVVVCVQRAAMPWAARLLSVACVSVAAKMEEYCAPALSELDAGGGYEFCFASVRRMELLVLSTLGWRMAAVTPFDYLPCFSSRLDRHDGRGGGGLDPAGVALKSIGSICATAEAGSVLDYMPSTAAAAAILVASYEALLTKEALESKMDNLSPSCPIEKVSCTN

SEQ ID NO: 167035 - protein, 144 aa, Triticum aestivum
  Clone ID: PAT_TA_61453.pep
MSAMVASSLNPEAPLFIPAAFQQVEDFSPQWWDLVKSTAWFRDHWYHQHQQLDDMADSLIAFEAEDAIDDDLLHGFAVEASQPQPPAALKTDGVLKALSLASPSPKVGNALRVFSEKPRYTEKPTKYAGSPRSGGAPRFIHQPR

SEQ ID NO: 167036 - protein, 49 aa, Triticum aestivum
  unsure (1)..(49): unsure at all Xaa locations
  Clone ID: PAT_TA_61454.pep
IHGPCFNNVGTGKTLGFPNXIAWKKIPFSPVGEKAKRPAPIAFPKSCPP

SEQ ID NO: 167037 - protein, 216 aa, Triticum aestivum
  unsure (1)..(216): unsure at all Xaa locations
  Clone ID: PAT_TA_61455.pep
MAAGAGGDDLKLLGMWASPAVLRVRLALSIKGVSSYEYQEEDFDNKSELLLRSNPVHKMVPVLIHAGKPVCESTVIIQYLDEAFAGDGRPALLPADPYERAVARFWAAFIDDTLLKAMYQASWSKTEEEKVEGKKKVAAALKTLDGALRDVAGGKPFFGGDAPGYVDTVLGGLLAWARSXDVINGVKTIDPVTMPLLAAWXDRFGALDAGGGGHAM

SEQ ID NO: 167038 - protein, 131 aa, Triticum aestivum
  Clone ID: PAT_TA_61456.pep
RGIQRPAACAAPTPSGEASRHLRLVPLASRPPPLAILSCGLPERRSSNFPVAPSPCCDAATPGPSLPGSPPRNPLIPQEGRPPSVLLVPLRLLLHGQRLAPPNSGGDITPPQPPPCPPPLSEASHNGGSRL

SEQ ID NO: 167039 - protein, 178 aa, Triticum aestivum
  unsure (1)..(178): unsure at all Xaa locations
  Clone ID: PAT_TA_61457.pep
MARVALVLTICFMGFYPSLAWSSNSNHTDFLSCLSTKIPSQLVLTPSSRSFKPLLVSSIRNARLVAPATASPPLCIVTPTQASHVQAVVRCGRSHRVPVRVRSGGHDNEGLSYRSATPNGEAFAVIDLSKFNAVRVDAHAATAWGRSGTTLGELYYRVAXAAPGLGFPAGVCPSVGVG

SEQ ID NO: 167040 - protein, 109 aa, Triticum aestivum
  Clone ID: PAT_TA_61458.pep
MPLGGAPDPFADNDALPPSSFDPFADARADDAVGGGAGVDEAYVHLRVQQRNGKKTLTTVQGLSASYNYAKVLRDLKRELCCNGTVVEDKELGNVIQLQGDHRKRVAGF

SEQ ID NO: 167041 - protein, 53 aa, Triticum aestivum
  Clone ID: PAT_TA_61459.pep
KKKTHVLLGLMNAGQFWHWRVIGASRSAQFGPVARQPSIRRTTTTRSLPADAG

SEQ ID NO: 167042 - protein, 206 aa, Triticum aestivum
  Clone ID: PAT_TA_61460.pep
QESKDAATTSLEQTRKDATDGLTTSRFVAHAVFRSLLGTWKLERDLISKLPSHPSGHFSGTAQFLLREKTTDGLRCAGNPSEDSTNGDELVMEYLYIEEGEFKTSQGFGFKATRRYVWRYNELKDVLSVWFTKPDDLKRADYLFHDVEFTKPTEKGWAAKAGHLCIDDYYDVKYNFAFQAVNLKEWQIEYTVKGPEKDYTITGELY

SEQ ID NO: 167043 - protein, 160 aa, Triticum aestivum
  unsure (1)..(160): unsure at all Xaa locations
  Clone ID: PAT_TA_61461.pep
VTAASGGVGTFAVQLASLAGHHHVTATCGARNLDLIRSLGADEALDYDTPEGAALRGPSGPKHDAVVHCGEGFPWSAFKPALADAGGVVVDLTPRLASVAVAELHWVLFSRKKLVPLIASAKEEDMEALLGMVSXGKLRVVIDSRYPLXQAHEGWAKSMS

SEQ ID NO: 167044 - protein, 65 aa, Triticum aestivum
  Clone ID: PAT_TA_61462.pep
IPEQTINTRIIRQKQCYIRPSVKFHYIYNTKKQCTSFTTFHRHLYAHRPKNYLSILVYLICILIN

SEQ ID NO: 167045 - protein, 150 aa, Triticum aestivum
  unsure (1)..(150): unsure at all Xaa locations
  Clone ID: PAT_TA_61463.pep
MSDCSTGTDSPRADSVDEQPPADAESPGGGQSKRDHPSPSSPLPPPKRSRRSVEKKVVVGADSEXGERAKTNGEGPPPPDSWAWRKYGQKPIKGSPYPRGYYRCSSSKGCPARKQVERSRADPTVLLVTYSYDHNHPWPAPKSGWQPNKS

SEQ ID NO: 167046 - protein, 69 aa, Triticum aestivum
  Clone ID: PAT_TA_61464.pep
ERAVRAEPADAEALSRYATFLWRARDDAEAAEETFQQAIAADPGNAHYAAAYAHFLWNTGGEDTCFPLD

SEQ ID NO: 167047 - protein, 93 aa, Triticum aestivum
  Clone ID: PAT_TA_61465.pep
KRGDGKNPGVPQLNRLEKNPLFARWGKTKKAPPDPPSQNLPTLNGKGNPPFTGPLTPGGGGVTPRGTVTFARALTPAPLVFFPSFFATLAGFP

SEQ ID NO: 167048 - protein, 129 aa, Triticum aestivum
  unsure (1)..(129): unsure at all Xaa locations
  Clone ID: PAT_TA_61466.pep
MAVEVRRATAPRGGARPAEGRGARXXAGVFLLLPIRHTEVGGCVFFFASLAYLMRRWREKIRFFTPVPVVGLSGIFSLCGPRGSLLFPLRFFRVAFFPAGVFPRGGVGADFPLFLRPAVARGRAPAPPP

SEQ ID NO: 167049 - protein, 85 aa, Triticum aestivum
  unsure (1)..(85): unsure at all Xaa locations
  Clone ID: PAT_TA_61467.pep
XHHXRPAHXPIAEKRIHPLPHRNMHQHQGISHRDGEAGTPGPMMPPSKDEEEEEPPRKPPVSTTCFILGFFAALCCCCLVDEPLM

SEQ ID NO: 167050 - protein, 79 aa, Triticum aestivum
  unsure (1)..(79): unsure at all Xaa locations
  Clone ID: PAT_TA_61468.pep
MAAPKPITRLISHVILDLDGTLLNTDCIVSQVLKPFLVKNGKKWDSKKAHKFVGKTPYEAAAVGXEDYGLPYSTERVPS

SEQ ID NO: 167051 - protein, 196 aa, Triticum aestivum
  Clone ID: PAT_TA_61469.pep
ICTRQIPNCWTPRPPQALGWLLSVPGASGSVLEVVVPYSRASMAQLLGKLPLQFTSKQAAEDMALAAFNRALKLSGPGLCLCLQVMGVGFTGSLASARPKHGDHRFYVSTRTQNCLRTSHVTLSKGLRSREEEDKVSSCFVLKAIADACRISATIQSDVQEPEIPKESVEQFDEDQELQQVIDGQVCMKVYHFADP

SEQ ID NO: 167052 - protein, 84 aa, Triticum aestivum
  Clone ID: PAT_TA_61470.pep
SLISGFGQNLLIARFYCVMQGASNKLNGCTDMLVLPQCRSYSHVLSSCICIGSHLVEFGYAFHSCSYPNIFIYRKPILSATCPE

SEQ ID NO: 167053 - protein, 115 aa, Triticum aestivum
  Clone ID: PAT_TA_61471.pep
NDFQPSSKQRRLFVPHVDNSDGLLWAAQVRLIPNCSFFFYSPYSICINSPNIYYFEALSTLCRGLSPTSMYVGDIFEVWRGGLGVGLAPCCCWSCRPLRCLCLLVAFLGCGGVVF

SEQ ID NO: 167054 - protein, 113 aa, Triticum aestivum
  Clone ID: PAT_TA_61472.pep
MSMFRAKKLDLGCFVNVRTLRDHTKRKVFEAHETERQALRYIIRNTTLPPRVRAEAQLQLTQMHCYTRPTQIRNRCIMGGQGRGILSDFKLSRYNFRMEAMAGNLPGVKRASW

SEQ ID NO: 167055 - protein, 89 aa, Triticum aestivum
  unsure (1)..(89): unsure at all Xaa locations
  Clone ID: PAT_TA_61473.pep
MDHAAEAQRTDLMTITRHALNEQGRHPESRGDFTILLSHXLGCKFVASAVNKAGLAKLIGLAGETNVQGEEQKKLDVLSNEVFVKALVS

SEQ ID NO: 167056 - protein, 237 aa, Triticum aestivum
  Clone ID: PAT_TA_61474.pep
PRVRMNSSCADVLLFAAHRWQMSKPSLVSESKDVFDQKASNKYWIDVQLRWGDYDSHDIERYTRAKFMDYTTDNMSIYPSPTGVMIGLDLAYNLHSAFGNWFPGSKPLLQQAMNKIMKSNPALYVLRERIRKGLQLYSSEPTEPYLSSQNYGEIFSNQIIWFVDDTNVYRVTIHKTFEGNLTTKPINGAIFIFNPRTGQLFLKVIHTSVWAGQKRLGQLAKWKTAEEVAALVRSLSV

SEQ ID NO: 167057 - protein, 91 aa, Triticum aestivum
  Clone ID: PAT_TA_61475.pep
AFGGHRIPTGSSQALLAYDGGGAAAAPRPPSPSGFTPAPYLNISTLCRPDQITSSADICAGLADVISRRYLVCPPYYLVDITSCCRFGRDG

SEQ ID NO: 167058 - protein, 241 aa, Triticum aestivum
  Clone ID: PAT_TA_61476.pep
PRVRDELKRRVELDRRSMALLWKELEEERSASAVATSQAMAMITRLQEEKAAMRTEAAQYRRVMEEQSAYDRDDAERLAGVVRELEAEVEGYKARLRDHEIVGEIRDHMRLLPCQREGETGGVPGAAGEEFSGGGSEDDENARAWKQLRGLTDRLHRLSNNSSGSVQEPEPTDVEQEEEGGGGKEEDTTEASVVGKRVRNGDNFTKWQHLQSIETTSKGSTHGHRHRGDYGGGEGDDTAAL

SEQ ID NO: 167059 - protein, 160 aa, Triticum aestivum
  unsure (1)..(160): unsure at all Xaa locations
  Clone ID: PAT_TA_61477.pep
PRVRRPLAIRTSAEYAQELLRRAEGERDWIVGVRRRIHAHPELAFQEHRTSALVREELEGLGITACAVAGTGVVADIGSGLPPIVALRADMDALPIQELVEWEHKSRVDGVMPACGHDAHTAMLLGAAKLLHQRKDQLRGTVRLLFQPAEEXGGAGASHM

SEQ ID NO: 167060 - protein, 76 aa, Triticum aestivum
  Clone ID: PAT_TA_61478.pep
ASIVLAKSLNSKKIGIFVSRISSIFSVLLCEAYRKKLLKYCISLRDQKSVHFVRDMKLLVEKKLFFFYRSLWIYKV

SEQ ID NO: 167061 - protein, 99 aa, Triticum aestivum
  Clone ID: PAT_TA_61479.pep
FAGCVYRINQPLVCRHKQNRHIIYYHTLAKVGASFEEGEAYRAKTGSSSLCFNQVLFLMHKVTILMALVLIGVSSCVWHILVMTSIINDKLHKLPEIDD

SEQ ID NO: 167062 - protein, 86 aa, Triticum aestivum
  Clone ID: PAT_TA_61480.pep
TGVMMHGYGLVKKLCTELQDFMRMHDFSSIEDFRGASLPYFTTHTDLVQRQKEAIKQRKAIRMGLQSDKDWTGDGFVKETESMVSN

SEQ ID NO: 167063 - protein, 193 aa, Triticum aestivum
  Clone ID: PAT_TA_61481.pep
RQSVAAVVKPSLDGGAPATASFRLRNGSLNSVRLRRVFDLFDKNGDGQITVDELAQALDSLGLVADREGLASTVGAYVPEGAAGLRFQDFECLHRELGDALFGALDDVPEDGEAGAGGDEEEMKEAFKVFDVDGDGFISATELQEVLKKLGLPEGSSLATVRQMICNVDRNSDGRVDFGEFKCMMKGITVLGA

SEQ ID NO: 167064 - protein, 78 aa, Triticum aestivum
  Clone ID: PAT_TA_61482.pep
DAWADAWVRGKQRIWVMQRRTLTNLTTGSRGQTLEHVVCLGDRQKADTVVAGGFLQRSLFSAVCFRGLVIQIILCIRL

SEQ ID NO: 167065 - protein, 240 aa, Triticum aestivum
  Clone ID: PAT_TA_61483.pep
GFNSYCSFDGTQNQTTVCQCPEHYEFFDKERKYKGCRPDFEPQSCYLDEAAAVAKFEMTPINGADWPLADYEEYSPIDENECRTLCVIDCFCATAVFRASTNTCWKKKLPLSNGNMAADVDRTVLIKVPRSNNSESQLSSGSTKWKEDKKYWILGSSLFFGGSVLVNILLGSILLFGTYCGISTTSKKKLMSSQSSGSSILPPKIFTYNELEKATSDFREVLGSGASGTVYKGQLQDEHA

SEQ ID NO: 167066 - protein, 196 aa, Triticum aestivum
  Clone ID: PAT_TA_61484.pep
PRVRNNGSFIYPRAVPGANASRSFVIGETPFPYSTEWFQYIILNNTNWKPEDIGPDAYQATEEVNPFNVQTWEGDLSKFRDRGSKIIHWHGLQDGLISSDNSMDYYNHVSRTMGMSNTELDKFYRYFRVSGCGHCSGGDGANRIGNNLSNLGGKDPKNNVLLAIIKWVEEGCSHYHRHALWQWSLPRAGLTTNAGT

SEQ ID NO: 167067 - protein, 94 aa, Triticum aestivum
  Clone ID: PAT_TA_61485.pep
PTRPPTRPLVPPHKYVPWVVVDGQPLYDDYENFEAYVCKAYKGHPPKICQGLGRDYPIVQQVVEAGTGVTYNSGDFELDEGVEDEIKMVQGDDN

SEQ ID NO: 167068 - protein, 77 aa, Triticum aestivum
  Clone ID: PAT_TA_61486.pep
NYSTCNMYLPYNIFFVREILLYKCLLAVSMHSCQTPSLANSLPYCGKLKILVCAVVHKDCNLPAKVKQIIKYDLCAF

SEQ ID NO: 167069 - protein, 105 aa, Triticum aestivum
  Clone ID: PAT_TA_61487.pep
MASVMAWGAGAAVAAFLGRAGLVAWRRSRGGVGAMGKAFYKGGFEAKMTKKEATLILSLNERAITKDKVRKAHRTLMLLNHPDRGGSPYLATKVNEAKEFLDKNG

SEQ ID NO: 167070 - protein, 96 aa, Triticum aestivum
  unsure (1)..(96): unsure at all Xaa locations
  Clone ID: PAT_TA_61488.pep
DLADAVLLIAAILPDRDISYMLKICKILGMAALVEVHDEREIDRVIGIAGIQLIGINNRNLETFEVDISNPKKLLEGERGQLIAQXDIIVVGESGL

SEQ ID NO: 167071 - protein, 131 aa, Triticum aestivum
  Clone ID: PAT_TA_61489.pep
MAFAVSDELLGTFVPIAVYWLYSGLYIVMDRMEIDDYRLHPKGEEEVKNVVSKWTVVKGVLVQQGFQIAVSLLLFTIIGDDSGTVRKQPSALVIALQFIIAMVVMDTWQYFMHRYMHINKVLVKHIHSKHH

SEQ ID NO: 167072 - protein, 114 aa, Triticum aestivum
  Clone ID: PAT_TA_61490.pep
KPEFTLKKTSHTHAHGGTDSIQSCVGASCVHSVGQVYAWDEPRAVCRAFARAVTWLPCISIGTILPKQHERAGKLSAYTLRAQRCRPHHQSPPAPRPPALGLLLGSKTRREREE

SEQ ID NO: 167073 - protein, 196 aa, Triticum aestivum
  unsure (1)..(196): unsure at all Xaa locations
  Clone ID: PAT_TA_61491.pep
MDMERVTIHTAACFTIAFVVLTTIISKIIARIRTVHLVRKGERSPITLRPPHVVSGAPLMAALLTLVTPKKGLHAAIHELHMKMGSVFTVNLFGLKKVTFLVGPEVTPHFFKGSPSDIDFXDTAKIIVPVLGPGVLXGVDMATRNEQIPILYQGDTAGRGLRRDVHSMVCEGEDYFGKWGQRARVDLKHELGHLIV

SEQ ID NO: 167074 - protein, 155 aa, Triticum aestivum
  Clone ID: PAT_TA_61492.pep
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKK

SEQ ID NO: 167075 - protein, 190 aa, Triticum aestivum
  unsure (1)..(190): unsure at all Xaa locations
  Clone ID: PAT_TA_61493.pep
VLEMLPASSCCCCCLLQALQEAIWTKWGGYLQQYLELHGRARRSGPGAANLKRYPLRRAVPRSEAVLSGAGEALGGGQRSAAAPPPTRRVGEAPSSGRGLDWRRXTGGWPWERGDPGDRKQAAAATGMERICSARKTTAIAIQIRGTSVLSSLFTWSGRFLKRHIFRNGGSNSFGASIYFATVFTNVIRC

SEQ ID NO: 167076 - protein, 94 aa, Triticum aestivum
  Clone ID: PAT_TA_61494.pep
KKDGKEAGPKEPTRAGAKSKTAENPPAPKQRQSPTKVTKKKTGGNADQKIGNREKARPTLFRSFFIFFFFFFFFFFFFFFFFFFFFFFFFFFFF

SEQ ID NO: 167077 - protein, 74 aa, Triticum aestivum
  Clone ID: PAT_TA_61495.pep
MDLSMKVFVVVLLLLVATEDQGPVQVALARDCKSQSYKFKGMCVRDDNCASVCLTEGFPRGKCKGFACSCHKDC

SEQ ID NO: 167078 - protein, 152 aa, Triticum aestivum
  Clone ID: PAT_TA_61496.pep
MVATKTGELRALFLSLDRDADGRISAAELRGCMRATLGEDVPAEEAEALVASVDADGDGLLCESEFLELAQQAAWTGADEENDELRIRALKEAFGMYEMEGQGCITPASLGRMLGRLGAERGAGECRAMICRFDLDGDGVLSFDEFKIMMSG

SEQ ID NO: 167079 - protein, 107 aa, Triticum aestivum
  unsure (1)..(107): unsure at all Xaa locations
  Clone ID: PAT_TA_61497.pep
KRGDGKNPGVTQFNGFEKNPLFPSWGKNKKAPTNRLSKNLPTLNGKWNPPFSGPLTPGGGGVTPKGTVKFAXGLKAPPFGFFPXFFAKLAGFPREVLNGGPPLRSQF

SEQ ID NO: 167080 - protein, 67 aa, Triticum aestivum
  Clone ID: PAT_TA_61498.pep
GAILKLGLTLLWFSGIAAVIMKPRPVEQRVNDGLNNESTIASQVRYHLVMVACPTLSICRQAIISAA

SEQ ID NO: 167081 - protein, 50 aa, Triticum aestivum
  Clone ID: PAT_TA_61499.pep
YRLFIQAHLNGNNLWPLLYTNVADLRKYPGFYPMLIRTCRGTPTCSPRWQ

SEQ ID NO: 167082 - protein, 76 aa, Triticum aestivum
  Clone ID: PAT_TA_61500.pep
TPAPEIKFGGPIKKGFTFACPGEVKLGFFQNRPPLFFFFFFFFFFFFFFFFFFFFFFFFFFFFFFFFFFFFFFFRT

SEQ ID NO: 167083 - protein, 138 aa, Triticum aestivum
  Clone ID: PAT_TA_61501.pep
RASSCPYQRMEAFFKALNLDQPGPTGFFIRREPPSWYPPHVSLIGLSKLIITECSPIRKRRPRSCRSAEVGGMHRMVCIILTSMTIQIWYIACDRTPLFTVCRWALLVFTIVRAWIGLSAWNLSQVNHLLLPPSEARR

SEQ ID NO: 167084 - protein, 50 aa, Triticum aestivum
  unsure (1)..(50): unsure at all Xaa locations
  Clone ID: PAT_TA_61502.pep
TRPLYVNEMRYNALKECIFLRYIRSILVXCXLXDDTLCIGIGFYFHLTYE

SEQ ID NO: 167085 - protein, 102 aa, Triticum aestivum
  unsure (1)..(102): unsure at all Xaa locations
  Clone ID: PAT_TA_61503.pep
HRGDGKTPGVPQLNGFEKNPLFPSGGKSKKAPPDRLSKNLPTLKGKGTPPCTGPXSPGGGGVPPRGTVTLARALAPALFVFFPSFLARLAGFPRKALNGGPL

SEQ ID NO: 167086 - protein, 160 aa, Triticum aestivum
  Clone ID: PAT_TA_61504.pep
PQGGTPPPRFLKTACLGKKTLPPKGRGFGVSKRDFPQRLVFLTKKNRGGAVFSPFGGVNLVVVPWQQKMVSVFQPRGPPFPRFTGLGVPPFSQTFLGCGGGNPAFSLPFWWPFFFSRLGLLGGFWFPFLEKKKKKKKKKKKKKKKKKKKKKKKKGGPLAI

SEQ ID NO: 167087 - protein, 179 aa, Triticum aestivum
  unsure (1)..(179): unsure at all Xaa locations
  Clone ID: PAT_TA_61505.pep
NVCQLSREHSPGLVEVASASASNPVQIILTPPTPIIPSGPAAIDRRSEDTNKEVHRLPDVSEEKEVVAKTDFSDEKQVYNEHDAHDEKQVYTSDIGKEVYDVGVEKKVQNLKLHDGHDEKQIFDPSLGVHDTEKEALYIQNLHDADQRRHSNSTESTETSQSQAKTKPFCYKRHXRQVQ

SEQ ID NO: 167088 - protein, 70 aa, Triticum aestivum
  Clone ID: PAT_TA_61506.pep
IIFSRWAHCKMSKLPLPYSVHPNGVHLSPSTREDLRRRWSSGGGGRGSAPLALLLTQPGKPGPLPARCWG

SEQ ID NO: 167089 - protein, 176 aa, Triticum aestivum
  Clone ID: PAT_TA_61507.pep
RTRGRRINLASWSPWTPALHLRRWLVLSDTVRALLHCITLLPRLLDLQAPLPPSPPKARDFRSLGRGIENQMDFFWCSWRGRSGFTFVFSCVLFFNFAGSAHVSNSICYSTCSGFHLLKISSIVTSASFYLAFTDQWCCCVNLCRCVELGGGFPVKKKRSVGHFSAGKGGCPCPGG

SEQ ID NO: 167090 - protein, 222 aa, Triticum aestivum
  Clone ID: PAT_TA_61508.pep
PRVRPRVRGRVGGRVGARARPNFVLIDARRMLFTTKAWNAQLAGAAAILVVDSKDEPLITMDNPEDTGTKHLENITIPSVLITKKLGEDLKKSAENGDMVSVLLDWRESLPHPDERVEYEFWTNSNDECGPKCDMQMDFVKSFRGTAQVLEQKGYTQFTPHYITWYCPEAFTVSKQCKSQCINHGRYCAPDPEQDFSKGYDGKDVVVQNLHQVCVFKGANDT

SEQ ID NO: 167091 - protein, 103 aa, Triticum aestivum
  Clone ID: PAT_TA_61509.pep
EIYNFAFAWAREKGQKSLPLETAIGMWRLLFAERHWPLIDHWCQFLQVRHNKAISRDTWSQLLEFVKTIDPQLSNYDEEGAWPYLIDEFVEYLTENGCVQRNK

SEQ ID NO: 167092 - protein, 115 aa, Triticum aestivum
  unsure (1)..(115): unsure at all Xaa locations
  Clone ID: PAT_TA_61510.pep
LPLQLVRLEFAGVECAAQQLXQGQKAYVHRLYVEAFEQRHSLQEAEPLPAAMLLHASSSSNSLPMLQNAAPAAPPPLPATPLWFPGNQELDLQIVDDLSGGQGNFGFQMFQSNFG

SEQ ID NO: 167093 - protein, 58 aa, Triticum aestivum
  Clone ID: PAT_TA_61511.pep
LPEQVGQAHHTYTSATLEYSKELTVHSRIRTHAYMSHKYICTHSVCARYRHGHRPDAW

SEQ ID NO: 167094 - protein, 178 aa, Triticum aestivum
  unsure (1)..(178): unsure at all Xaa locations
  Clone ID: PAT_TA_61512.pep
MRFLTIQRPILAAVAGLARPAFTPVAPLGVQLANSLVQGQRFASVKSQGAYKKKPKRGIPKKLGAKRTGDQFVIPGNILYKQRGTLWWPGENCIMXRDHTIHSMATGYVKYYRDPARHPDRKYXIGVVFDKNDTLPYPQHAERKRKLGMXRFPXKEAAAKPEISPSGIPFQVTRIEAR

SEQ ID NO: 167095 - protein, 93 aa, Triticum aestivum
  Clone ID: PAT_TA_61513.pep
TNIKTSQRFHISLKREYKRRYLRRLAEELPLGELREVARQEAGPDGVRVSGGVEGPGHGGGVDGVRRRRERYHVHQEVLRQALDLAGGRRVHV

SEQ ID NO: 167096 - protein, 117 aa, Triticum aestivum
  unsure (1)..(117): unsure at all Xaa locations
  Clone ID: PAT_TA_61514.pep
VSQTSRLAPAVVHRQAWRLQRARCALKPPVAGQRRIRIGRAPEEREMNPNRKTSLQWSVRAYAEKGDGPVVKTAPKFIKRGVVGHNQNYLLCPSLNCXLVYYVNCMLNHGAVSLRNR

SEQ ID NO: 167097 - protein, 81 aa, Triticum aestivum
  Clone ID: PAT_TA_61515.pep
KKETRQRLTQQPKKHLHPPPPQMRHAKKIRHAQSSRKNSTSATFVNIECQNTFTGDMFVRELHVMDALPYRRGQIRSKTLS

SEQ ID NO: 167098 - protein, 217 aa, Triticum aestivum
  unsure (1)..(217): unsure at all Xaa locations
  Clone ID: PAT_TA_61516.pep
PKPAFYLLFILLKLLNSRLWSTNLILSTKWPKSVHQGCGKEFTDPDEKCEYHPGPPVFHEGQKGWKCCKPRVLTFDEFMEIPPCTTGTHSTTDKPPQLEEKPQQDDAALAQKIDALNAATPSRAPIPTAQHAPTPPPPAPESEDDDPSLEIADGVGCKRRACGATYKKSSSRDNEECVHHPGVPIFHEGSKGYSCCKRXVLEFDQFMKIEGCKTKDK

SEQ ID NO: 167099 - protein, 150 aa, Triticum aestivum
  unsure (1)..(150): unsure at all Xaa locations
  Clone ID: PAT_TA_61517.pep
IEIVNLLLCGEAVPNVFDGKMDLGGGMSLKGIPNDVEVGFLTLLESLNLCKVGQYLKCPKWPIWVXXGSESHYTVLFALNPNVQEENELEERESKIRRAFDAQDQSGGGGXIAVEGFQQVLRDTDITFPSDKLDDLCXAGVIVWSEVWQA

SEQ ID NO: 167100 - protein, 166 aa, Triticum aestivum
  unsure (1)..(166): unsure at all Xaa locations
  Clone ID: PAT_TA_61518.pep
MTTLEELEDLYRRDRDDNIRDXDYNSQKKPTGGDADRRDAXTEEDEDILDEEDLRLXTQDIDTRKRLIENDSRMMKSELSRISHEKADMXEQIEENLDKIANDRQLPYLDGNGGELLDLDPTAESSEEGANIDLDATRVGQSAVIKTSTRQTLFLPLIDPRGRRHA

SEQ ID NO: 167101 - protein, 179 aa, Triticum aestivum
  unsure (1)..(179): unsure at all Xaa locations
  Clone ID: PAT_TA_61519.pep
MADGDSAAAYASPRSPLPPETPSTQKRRQRGLVSRVWKGIFGRRXDVEKLLQALSKEEEALRSRVHRRARASRASAHNVLALASALEIAAVGYAIMTTRSPDIPWQMRAARVLPMFLVPALAALIYSAITSIAKFLDNRDQHTLEKLRAERQAKIDELKEKTNYYTTQQLIQRYDLDPA

SEQ ID NO: 167102 - protein, 192 aa, Triticum aestivum
  unsure (1)..(192): unsure at all Xaa locations
  Clone ID: PAT_TA_61520.pep
MLLIGLTGSIATGKSTVSSMLSSQPYDLPIIDADILARKVVEPGTRGYQAIVKHFGPTTPELLVEPSDKMPEDGPDGKGRPLNRPALGRXRVFGDSEERKKDRSVLNHIVHPAVRWXNVQICSRILTSVATGAVVLDIPLLFESGLDNFVGVXGLAVXVRDPXIQMQRLRXRDPHLSAEDAENRVRSQTDVR

SEQ ID NO: 167103 - protein, 102 aa, Triticum aestivum
  Clone ID: PAT_TA_61521.pep
PFGHNLVAVDIARDEVAANKLGLKEMATYVIYGTGAFFAGWVLSAVVSAIDSIPLLPRILEMVGLGYTVWFSSRYLLFKDNREELFAKAYDLKMRIVGSGDA

SEQ ID NO: 167104 - protein, 136 aa, Triticum aestivum
  unsure (1)..(136): unsure at all Xaa locations
  Clone ID: PAT_TA_61522.pep
VLKATYWAGAFVWHASARGYILLEGAHFTLGQLTPRRIKTETRQTAATPDRLLSHQTPXQGSCPRARTSGRLFLLVILLCCDGLDPCCGPLLFFCLKCEGTVFALLLAHLIPLLLVVAWTSLLCTGHIITMVGNLI

SEQ ID NO: 167105 - protein, 50 aa, Triticum aestivum
  unsure (1)..(50): unsure at all Xaa locations
  Clone ID: PAT_TA_61523.pep
LTPRTRTTKIPAPLQANKFQTDTVHXCHPPPPKKLREIFNLQVIQPKSLH

SEQ ID NO: 167106 - protein, 39 aa, Triticum aestivum
  Clone ID: PAT_TA_61524.pep
LPTPRIFIDIALKLQIKPLRAVREKTKKAQEHHRFWFFY

SEQ ID NO: 167107 - protein, 166 aa, Triticum aestivum
  unsure (1)..(166): unsure at all Xaa locations
  Clone ID: PAT_TA_61525.pep
PTRPPHFLLLLLPREERSLVCCPPSRAWEAAKMLDIQKRRVQLLLFVAGVLALSMTAEKCRELVGKEAASKSGQFTFMNCFDMGSGSLACAGKEGVKLYVNNLRSAHIETVRQRALEKALADALTEGLSPAEAAKQAQKIGAKATKVAACXATRILGPLLSRGWDS

SEQ ID NO: 167108 - protein, 110 aa, Triticum aestivum
  Clone ID: PAT_TA_61526.pep
RTRGRTRGRTRGVKNIEVDRLRLSFTTAKNSTLVPVDSGSDEESDEDQGCSDIDDTVNSIGGQMTVDKPMDEGLDRICSGLHAIPRKNKARSAKKRSHKLSSRKFYKIFS

SEQ ID NO: 167109 - protein, 209 aa, Triticum aestivum
  unsure (1)..(209): unsure at all Xaa locations
  Clone ID: PAT_TA_61527.pep
PRVRPRVRSDLSSSSSSSPALSVWSNPIGWLVHVLLRKLDAKAGSYREPALSYLFLANNTHYVAKKVGGGTKLERILGEEWAEAQMAKARGYVDVYVRAAWGSKVLLGGAVEEAVVQMVAMQEKWVAADDEMGEALRAAAKEAVVPMYRLFYRRQGAVARLTPGXVITMIDGLFGGRNAGAGDESVAAAGRRRSSQQQQQQQEVPVEIK

SEQ ID NO: 167110 - protein, 218 aa, Triticum aestivum
  unsure (1)..(218): unsure at all Xaa locations
  Clone ID: PAT_TA_61528.pep
CFQLLLMYMSQFEGLISQSSLERRTASKYFIFLFFNVFLGSIVTGSALEQLDTYLHASANDIPRIIGVAIPMKATFFITYVMVDGWAGVSLEILRIRAFVLYHLKNFFLVKTEKDREEAMDPGSICFYWSEPRIQLYFLLGLVYAAVTPLLLPFILVFFALGYXVVYRHQIINVYHQRYESGAAXWPNVHLRIIVALIASQLLLLGLLSQKVWEEATP

SEQ ID NO: 167111 - protein, 74 aa, Triticum aestivum
  Clone ID: PAT_TA_61529.pep
RWCQGAESAEPVEEPGECSGNASAAGRWWFCCVVTARRARKLTTPVVSRGDVDEEVGEEEAVLLALGSDMEFFS

SEQ ID NO: 167112 - protein, 150 aa, Triticum aestivum
  Clone ID: PAT_TA_61530.pep
SAQGRHKAAHRDATSSPADRGRMGWAATLVFALAACWRGRSRWRSRRRCGDARGCVGGCARGGVRGAVVVTLVAVLVGALAVAFAAPLLVTLVAVLVVPLAAAAATSKSKWPLSMQMALTFVGFSRRFAGIFVALFLECVQKDWTLGVGF

SEQ ID NO: 167113 - protein, 196 aa, Triticum aestivum
  unsure (1)..(196): unsure at all Xaa locations
  Clone ID: PAT_TA_61531.pep
MAPTATATATAAEQSQQHTKKAVGLAALDASGHLSPLAITRRSTGDDDVVIKILYCGICHSDLHSIKNDWKNAKYPMIPGHEIAGEVTEAGKNVTKFKAGDRVGVGCMVNSCQSCESCDKGFENHCPGMIFTYNSVDRDGTLTYGGYSSMVXXVHEPFVVRXFPDAMPLDKGAPLLCAGITVYSPMKYHGLERSRD

SEQ ID NO: 167114 - protein, 70 aa, Triticum aestivum
  Clone ID: PAT_TA_61532.pep
ATPTSLRYGRWVSLLHEKFLVCDLYEPKLWVFRITQSGEESDYWNKWDALRALIYYFDYMREGQETDAWM

SEQ ID NO: 167115 - protein, 130 aa, Triticum aestivum
  Clone ID: PAT_TA_61533.pep
NGHSKTLLPWWSIRVLFPENCNSATCNSTFCFTFVFLIEKSFWVDSQARGNAAVDDGAVPLYDREFTLGSTPMGDSSNAEGKKDKDDSRCFNCGSYSHALKDCPKPRDHVAISNARKQHNLKRNLSNVGN

SEQ ID NO: 167116 - protein, 97 aa, Triticum aestivum
  Clone ID: PAT_TA_61534.pep
HTTVPNCFAVHRSVASRDESDRSTVAYSRKSTSLPASEVVVVKFLNAATPQTFARPSSPSLPRRRLSGHISVKLRYPEPLPVNACLTAAAELHGHSS

SEQ ID NO: 167117 - protein, 56 aa, Triticum aestivum
  Clone ID: PAT_TA_61535.pep
GKATTLRYGRWVLILARNFWCLTWTIQSCGCLESGNQLKRVKIGTNGMHFVIDLLL

SEQ ID NO: 167118 - protein, 61 aa, Triticum aestivum
  Clone ID: PAT_TA_61536.pep
LVYQYTLLVYGFGLAPAREITLVDKVKHGEYFMEAAWPLGEAIEAVAPKKRIQHDPPVNVA

SEQ ID NO: 167119 - protein, 71 aa, Triticum aestivum
  unsure (1)..(71): unsure at all Xaa locations
  Clone ID: PAT_TA_61537.pep
PKPALTPPGAPEAELRRSTPGAPGRXXARDRPGPPRRPRAHCSPSPYCRWPRSCRWRGSGALLRVLAGNSW

SEQ ID NO: 167120 - protein, 46 aa, Triticum aestivum
  Clone ID: PAT_TA_61538.pep
KDRRAAYQGLLFSLFSSDSVNDVVHTKIFLNVEESTRFSPKFSKNS

SEQ ID NO: 167121 - protein, 80 aa, Triticum aestivum
  unsure (1)..(80): unsure at all Xaa locations
  Clone ID: PAT_TA_61539.pep
SGLLVDRLALSHVRERRLPLVLALAAAVVGVLTDASTRAEAELKASYKNETSQTKKEEKRREKKNRQQKIIKXXKKKNNN

SEQ ID NO: 167122 - protein, 61 aa, Triticum aestivum
  Clone ID: PAT_TA_61540.pep
MVYGWMCGCVCTYSKQLYYASAFPHCYIERKTGSLIIVWIDWQLSKVNPNELGMCAGHIYG

SEQ ID NO: 167123 - protein, 99 aa, Triticum aestivum
  unsure (1)..(99): unsure at all Xaa locations
  Clone ID: PAT_TA_61541.pep
MMNDLYVKYGSVFMGYFAKWGDEGIVDLKLEFEKLLMLISSRCLLGKEVRENMFDEVYTLFHEIEDNGVTLISXLVPYXXSPANRQRDRARIKLTQILS

SEQ ID NO: 167124 - protein, 72 aa, Triticum aestivum
  unsure (1)..(72): unsure at all Xaa locations
  Clone ID: PAT_TA_61542.pep
AEQICYSEHSAVKHITMTIGTEXRPDYCLGLHLWQMLSYGCTRFHICVQTTNKGHTVVVVADCFSSSAKDVV

SEQ ID NO: 167125 - protein, 172 aa, Triticum aestivum
  unsure (1)..(172): unsure at all Xaa locations
  Clone ID: PAT_TA_61543.pep
PRVRKTKNGDFRSSGILHGCSCSPLPCAYSIHHDYLSCLCTRNHNGGCITDERGALLSFRAGIRSDPQNLFSSWNGQDCCXWSGVRCSNRTGHVVKLDVRNDLFFDDIYRNWYSENSHGMRGNISSSLVALHHLEYLDLSGNYLGGVDVPIPRFLGSLQSLRYLNLSCMDFH

SEQ ID NO: 167126 - protein, 87 aa, Triticum aestivum
  Clone ID: PAT_TA_61544.pep
STSPRLTTGVDNFLARRAGTTQENHPLPAAEAFPLHSAGYSTGYGDSAPWHQRAPATPAPDLPFDTMDADEMLLVDMLSQHHEVQDA

SEQ ID NO: 167127 - protein, 48 aa, Triticum aestivum
  Clone ID: PAT_TA_61545.pep
DAWATPAGGRYHDLCRRGHGRGAVAPSLFLSTKSLSTEQMIELSLCIR

SEQ ID NO: 167128 - protein, 47 aa, Triticum aestivum
  Clone ID: PAT_TA_61546.pep
PFGAISRSYPFVTSRMLGWAIDKAPPLSARVDIVLSKSSCCLQFFFY

SEQ ID NO: 167129 - protein, 179 aa, Triticum aestivum
  Clone ID: PAT_TA_61547.pep
FPFSRSPRPVMAAPAPGAGAVEVSMGFTSRIGVRVTQDAKAKALVAAKIKEGEDKVRMIGQYAVRTDRAIDALEKKVQDLEAVMDLELMLGQYCADLSDMHKARHYYRAVSLSEKEELSLRQIDDFAAATIAEYEASVGPVPAFDNHLSLFSKDIPLEFPEPLAPPPASSAPASASHHE

SEQ ID NO: 167130 - protein, 82 aa, Triticum aestivum
  Clone ID: PAT_TA_61548.pep
NLFACLRELSGKIDQNPWEANRSREWLRARRRRPWRRCGGGGGDRTGRAARRPRGSGECAGAQRPRGSRGGEVARHEGWERG

SEQ ID NO: 167131 - protein, 165 aa, Triticum aestivum
  unsure (1)..(165): unsure at all Xaa locations
  Clone ID: PAT_TA_61549.pep
KMSVHLFNPTNTCTRLSNKRFINYHFSLVKSPMPPSIAVAFPPSVDARTYALDRSELRARRVPERVRVKQRHRLSPLPLHLRDGXALAVVRVKQRHPLFLPLHLRDGDAVAVVCLSLPLALHLRDGDAVAVVSLWRKSSRGTLQLRTVRGDDGELRPRPGELALR

SEQ ID NO: 167132 - protein, 94 aa, Triticum aestivum
  Clone ID: PAT_TA_61550.pep
RREAVQEIWIQAPSQIVDPLPQIKTFGLETMLSQLYDLFEKGDSNIIGVWGKEVLARRRFYMFSTMILKRRPMIIRLLSLLKYPLHEGSDTVEI

SEQ ID NO: 167133 - protein, 84 aa, Triticum aestivum
  unsure (1)..(84): unsure at all Xaa locations
  Clone ID: PAT_TA_61551.pep
GNLXAHLRSQVGTPRTPGRSVDTYLFALYDEDLKPGPVSERSFGLYQADLTANYDIGLAKGSASPSTSGQIGVTAAPAQVLASA

SEQ ID NO: 167134 - protein, 142 aa, Triticum aestivum
  unsure (1)..(142): unsure at all Xaa locations
  Clone ID: PAT_TA_61552.pep
MVKAVAVLTGSEGVKGTIFFTQEGEGPTTVTGSVTGLKEGLHGFHVHALGDTTNGCMSTGPHFNPAGHVHGAPEDEIRHAGDLGNVTAGVDGVASINITDCHIPLTGPNSIVGRAVVVHGDADDLCKGGHELSKXTGNAGAR

SEQ ID NO: 167135 - protein, 119 aa, Triticum aestivum
  Clone ID: PAT_TA_61553.pep
LEATLQYQSSQQKALSPLPSPRASAQDDSFQESQSRRINLLGPFSLSWRDKNKGKQNNASDCTDAKLTDAHEQREEAPSIDDEKHGETQKPDGEWTVESPRGNDKGGVAQERQNSYYHQ

SEQ ID NO: 167136 - protein, 105 aa, Triticum aestivum
  Clone ID: PAT_TA_61554.pep
TERWMNLKRCAEPVISPILTCSSSSMILPSAILMYSVCNISKDILRSFQMHFFFSRRFSLNFNLIMVFRLCPSCFLVVVSKHTMTYETENSDEAISASVTFGGKK

SEQ ID NO: 167137 - protein, 66 aa, Triticum aestivum
  Clone ID: PAT_TA_61555.pep
TSISQNGLTVFWVVLWRPRHLCRQNLLDIYAGLYMNIKKRNYHLLSYIKLTQEVLSGCRFAYMNHA

SEQ ID NO: 167138 - protein, 170 aa, Triticum aestivum
  unsure (1)..(170): unsure at all Xaa locations
  Clone ID: PAT_TA_61556.pep
MSAYLNPVPGFSSFTNLRKLMLDSVSGDIQCMLLPACSMLEWLSIVRCTLHSLTTSQPLRQLRYLCVHYCFNVQKLEVQAPNLNTFIFGSLETHPVSFIIDGCLEIQEVTIXXPIWRSDLFDYAFANHGMANVPKLSVELAIDSKVPGMCXMPXVXFVNLKHLILTRCTC

SEQ ID NO: 167139 - protein, 82 aa, Triticum aestivum
  unsure (1)..(82): unsure at all Xaa locations
  Clone ID: PAT_TA_61557.pep
LQVQEMASFICGAPPISGNLESVALVKNGHXDCGATILVHIHFLRESQYILPKPTLXYLCCCXISLKLTKLGVXILSIHIVL

SEQ ID NO: 167140 - protein, 84 aa, Triticum aestivum
  Clone ID: PAT_TA_61558.pep
LSSLVAFRIVQHLILISDACTRCKILGAQHGFQIAFQMVSKCRSHTLLFIIISLTMCYSLLRAKHGTVSMTSYVTGQQTAQDIL

SEQ ID NO: 167141 - protein, 49 aa, Triticum aestivum
  Clone ID: PAT_TA_61559.pep
ARNVVETQPRTRNLEKKNPVDLALRRGSKPASTHGGGGDNRGREGPQGG

SEQ ID NO: 167142 - protein, 144 aa, Triticum aestivum
  unsure (1)..(144): unsure at all Xaa locations
  Clone ID: PAT_TA_61560.pep
PHVPLAVRHFCRDASCRSLQKIQICSRSYSEFFGQLPALHRYPGFLCLCRDPCLCLQSQAFNFPMGQGAKEPLEPTHVVVETRFPWVLVFWCRVVNESVDAIIPLATLDINPKRVACPPFFSFFLXFFSFVIGSRKGNSRAFSF

SEQ ID NO: 167143 - protein, 159 aa, Triticum aestivum
  Clone ID: PAT_TA_61561.pep
VSNFSAAKMERLLALAAVPPAVNQVELNVGWRQEKVREVCARHGVVVSAYSPLGAYGASWGSDAVMHSGVMHHVAAAKAKTVAQVALRWVYEQGVCFVARSFNKERLKQNMDIFVDWELSDEDKAMIATIPQKRACQGDYFVSPDGPYKSLEELWDGEM

SEQ ID NO: 167144 - protein, 100 aa, Triticum aestivum
  Clone ID: PAT_TA_61562.pep
KKKKKKKKKKKKKKKKKKKKKKKKKKKKKKKKKKKKKKKKKKKKKIIKKKKKKRGGPFLRNPFFFPPLCRFFFFFFFPLFFFLGRVFTPWGLENPWFPPF

SEQ ID NO: 167145 - protein, 153 aa, Triticum aestivum
  Clone ID: PAT_TA_61563.pep
MPPSVRTVSIPFADLKERGRDLSGKIEEGLGPDGLGIISISGVPDFPALRRTLLHLAPKVANLPEDVKKGLEDPDSRYNFGWSHGKEKLESGKLDTFKGSYYANPILDVPTADDVLVSRYPSYCRPNIWPADHLPELEIAFKALGKLMFGSWL

SEQ ID NO: 167146 - protein, 224 aa, Triticum aestivum
  unsure (1)..(224): unsure at all Xaa locations
  Clone ID: PAT_TA_61564.pep
MARGLLTICVSALLAVAGAVTPADTVFYNGNIYTMNPSNDMVTAMAVRGGKIEYAGDKKTVHSYIGKKTKVIDLEGRMVMPGLVDSHMHLISGGLFLLKCDLSYQTLTIAQVLEHIQGCIDGETGKGDDDWIEVVNMDYAGLVSKSGNVGKAQLDKLSTKRPVIIRSSDYHTILANSRALELSRIDASTKDPAXGKIVRLRGSQEPAGPLQDGASSLLAGPPLH

SEQ ID NO: 167147 - protein, 130 aa, Triticum aestivum
  Clone ID: PAT_TA_61565.pep
PRVRPRVRDLRIPNGTYALTAQDCIQCHCSSNTFQLNCTALQGKKGCPAVPVCSGGLKLGDTSGTGCESKMCAYSGYSNSSSLSIQTTPLKNQTAPACEKGGSSRSVFAGSMWRISAISFHMVLILVCFL

SEQ ID NO: 167148 - protein, 251 aa, Triticum aestivum
  unsure (1)..(251): unsure at all Xaa locations
  Clone ID: PAT_TA_61566.pep
APAKTVLVDNTSSQDVAELYPLALSRGISIVTPNKKAFSGSYKLWQDIFSAAESSGARVYHESSVGAGLPVISTLKDLVETGDKVTKIEGVFSGTMSFLFNSFAPTEGQGGKWSEEVKKAKSLGYTEPDPRDDLNXXLDVARKLTILARLAGIPVESPTSFPVQSLIPKELESVSSGDEFLEKLPAFDSQMEETKAAAEKXGKVVRFVGXIDAASKQSRLAXSXFDRSHPIAALXKGSDNIISFYTERYGS

SEQ ID NO: 167149 - protein, 235 aa, Triticum aestivum
  Clone ID: PAT_TA_61567.pep
KALAPSLIYLQLCHLHDDQKNSAPISVMSVSNANAALTSITPPSPQSTEAEHMPLSPESDTRIRAASTSSIPYDFITVEGTVSITILLDLFLFITGAAERGTLWSPSPTDAWCSTAIFLRRLCILMCIDRASGEAKDLKHNWHSVLGNNAHRSSSLEAESSSHDVFWHLSRRPYLSPAMLGAPLGCFLRRLLWTAMGLRVRPRKGSSSCSACTSASSPSAACLWYPGLQVLAHAS

SEQ ID NO: 167150 - protein, 109 aa, Triticum aestivum
  unsure (1)..(109): unsure at all Xaa locations
  Clone ID: PAT_TA_61568.pep
SCSSITDDGLAALTNGCKKIKLLNLCYCNKITDSGLSHLGALEELTNLELRCLVRITGIGISSVXTGCKSLVELDLKRCYSVDDSGLWALARYALNLRQLTISYPSYWP

SEQ ID NO: 167151 - protein, 245 aa, Triticum aestivum
  unsure (1)..(245): unsure at all Xaa locations
  Clone ID: PAT_TA_61569.pep
DLVNTARRWALDICELRKPWIKSLYKTDKLEPLGEAREILKFARAQARKQAANLEHPLVCIDVIEEGIISGPRAGLWKEANAFQSLLFSDTCKSLLHVFFSQRATSKVPGATDLGLMPRKITKVAILGGGLMGSGIATAMILSNYPVLLKEVNEKFLNAGIDRIKANLQSRVRKGKMTEERYEKALSLVTGALGYEKFKEVDLVIEAVIENVKLKQQIFADLXEKYCPSHCILATNTSPIDLNLI

SEQ ID NO: 167152 - protein, 161 aa, Triticum aestivum
  Clone ID: PAT_TA_61570.pep
RLMLDRNRLRVQRPQESTMSFPSLSGFLSFCPRSKSLLANTRIFQCPADAEDSLSCRLTHLIPWPKYSWLYEHDESFDLDGHVGLTFRYNILTTIYNILFNYSAMRGICFISARRFLGGKRTIDGFGWPAIQVYLNVEHGSDFLFGLLCASDFSRKEQGIR

SEQ ID NO: 167153 - protein, 103 aa, Triticum aestivum
  Clone ID: PAT_TA_61571.pep
KGLKLFQCPKDLAQEHYKDLKERPFFPNLIDYITSGPVVCMAWEGDGVVASARKLIGATNPLQAEPGTIRGDLAVQTGRNVVHGSDSPDNGKREIGKFCQWRI

SEQ ID NO: 167154 - protein, 46 aa, Triticum aestivum
  Clone ID: PAT_TA_61572.pep
SKTVFILIIRKDRLKSQGRAYVNQRIFKTMSTDVQTKVHRSKHHPT

SEQ ID NO: 167155 - protein, 98 aa, Triticum aestivum
  Clone ID: PAT_TA_61573.pep
KMPTVYSCCCVLLMMLYGDADFSNRSAGVLQTTSDVLRKQKYPAYADTKLWLIHIVPCQYGIDIAEQILYYSTHCFPLIPGAQIVAPPSNRLINCNCV

SEQ ID NO: 167156 - protein, 160 aa, Triticum aestivum
  Clone ID: PAT_TA_61574.pep
RSWTRIRHCWKFELREGRGIPYEKTTDVIIDSRRDVRLLGPKSMVTLLIVDSERLSPRHANSQHHHHQRVAAVVPAPGEVGGALLHASTTRHGGMLNGALSSSTSWGEDECGGLGASGSTTSAARSSNRTRCSTVPALAVISMIAWSGRLCSVARLLRSC

SEQ ID NO: 167157 - protein, 225 aa, Triticum aestivum
  unsure (1)..(225): unsure at all Xaa locations
  Clone ID: PAT_TA_61575.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIXVDLCLDRIRKLSDNCTGLQGFLVFNAVGGGTGSGLGSLLLXERLSVDXGKKSKLXFTVYPSPQVSLLVVSXNSGLVTTHSLTXPMSLSFLDXAIYDICRRSFDIERPHTP

SEQ ID NO: 167158 - protein, 111 aa, Triticum aestivum
  Clone ID: PAT_TA_61576.pep
PRVRPRVRPRVRPRVRQSALDYLEMQPDLSALVRGAHTFRCPNLGLTSWVRLPIHDADFGWGRPVFMGPGGIAYEGLAFVLPSATKDGSLSIAISLQAEHMEKFRKLILDV

SEQ ID NO: 167159 - protein, 133 aa, Triticum aestivum
  Clone ID: PAT_TA_61577.pep
MMLLFPEGTTTNGDYLLPFKTGAFLARAPVQPVILRYPYKRFSPAWDSMDGARHVFLLLCQFVNHLEVVHLPVYYPSEQEKDDPKLYADNVRKLMAVEGNLILSDLGLAEKRVYHAALNGNNSLPRALHKKDD

SEQ ID NO: 167160 - protein, 219 aa, Triticum aestivum
  unsure (1)..(219): unsure at all Xaa locations
  Clone ID: PAT_TA_61578.pep
MRTQTMRLRCDLPAHNSVRYTSRNQVKMKTPTTKLMFDLPAHNSVPDKYIMPAEKRPRRHELVDDGLSVALPVVDLKKGRPQVARDILEAGKEFGFFQVVNHGVGEDVVQGFREVAAEFLRLPEEAKLEYYSEDQSKAFRVISGCITSHKLMNEWPTQPEIFRGASCQLLGSGAGXGXKLLRLIAEELGLDDHNFFKGDLTGGEXXMNVHYYPLCPDPT

SEQ ID NO: 167161 - protein, 188 aa, Triticum aestivum
  unsure (1)..(188): unsure at all Xaa locations
  Clone ID: PAT_TA_61579.pep
MAMTAYSNQAQAMMRDYLLADPLVPYTSVLIGVFLCKMAYDLTRILSSFYFKGYSSLTKIQRVEWNNRXXSSAHAIFIAAVSVYLVASTDLFSDQLNGPINSRNFDHLHLXLXXFSVGYFITDLAMIFLXCFLPLVEWKYVLHHTLSLVAIAYTMLSGEXGQVYTYMILISEXTTPEINMRXWFLDTA

SEQ ID NO: 167162 - protein, 258 aa, Triticum aestivum
  unsure (1)..(258): unsure at all Xaa locations
  Clone ID: PAT_TA_61580.pep
HASDEACLLRHSNVSFFGVADMSWLTGLCNAVNATQPELFKTQLGALMNNLSSRAASSPRLFAADTVDLTPFTKIYGMSQCTRDLAGDDCNRCLAVAVSYIPKFCDGREGGRVATRSCSIRYELYPFYNAQAAEAAMSPPAPPPPAVNGSDHSGPAERAGNDDATAKIALFVSIPVAAVLLGGVDSCFLXLCKRKNKKPREHVLLSSAESEDRTDMRSSESLLYDLSTLRAATDNFSEXKKLXEGGFGPVYKALCRMG

SEQ ID NO: 167163 - protein, 81 aa, Triticum aestivum
  Clone ID: PAT_TA_61581.pep
AAHVVGSGFSKQVFLFHSHAWSRWLPALPVKMPQVSMSVTSVGCIRLEESKPVRVTLYAGRVLASLDSRVPILSARVSDAW

SEQ ID NO: 167164 - protein, 141 aa, Triticum aestivum
  Clone ID: PAT_TA_61582.pep
TDAIASILGIPASQVQHKSFYECIRESCLDDAVRCLESAKANDSIAYLRFWSRDPRRPEDFEDEESVADGELTIDAENGDVAVGSEEPSHYFSNNHTSSPSPDQTRSGEGLMAPSRQRRADSRRSSDSEGGWCQAGWCYGP

SEQ ID NO: 167165 - protein, 62 aa, Triticum aestivum
  Clone ID: PAT_TA_61583.pep
KSASPSLRQQCECVKMQTLRHHSLISYWSFFFDASQAFICFSLSSKYGELTRAVIVHRRPGL

SEQ ID NO: 167166 - protein, 79 aa, Triticum aestivum
  Clone ID: PAT_TA_61584.pep
PRVRKKKKKKKKKKKKKKKKKKKKKKKKKKKKKKKKKKKKKKKKKKNLKKKKKGGPFLKIPILLPVLSNFLFFFWGPLI

SEQ ID NO: 167167 - protein, 81 aa, Triticum aestivum
  Clone ID: PAT_TA_61585.pep
TPAREFNFGGPIKKVLPCKPGFVNLGPLKRPPLFFFFFFFFFFFFFFFFFFFFFFFFFFFFFFFFFFFFFPRVRGRVGERV

SEQ ID NO: 167168 - protein, 123 aa, Triticum aestivum
  Clone ID: PAT_TA_61586.pep
INTGLLRNHRPPKWSSVLGCQMHGQDGECCCGFHLNYFSSTPSPLAHRRRTCRTHGDDPIHRLFRRSHPRQLAATHEPPPSVACLWRRAPRPRSCAAGVTQRRWRRPAPSLLWRRARPSPDRR

SEQ ID NO: 167169 - protein, 52 aa, Triticum aestivum
  Clone ID: PAT_TA_61587.pep
LLRFVLKGRYQCLVWMRNIPARGYPRSSRKMVSCFHHYKVEIFNEVLDRKHS

SEQ ID NO: 167170 - protein, 61 aa, Triticum aestivum
  unsure (1)..(61): unsure at all Xaa locations
  Clone ID: PAT_TA_61588.pep
LILSKEGAISSLKEWLVDSAIGSNPVLQLIAGIVFMQEQDYXEAVKHTHTQRKNSGHFIIF

SEQ ID NO: 167171 - protein, 99 aa, Triticum aestivum
  Clone ID: PAT_TA_61589.pep
HCLTPSMARSMNTFHTAVVLSVLLFICFANHGQCRNLEQVMENGSKVHLPYGLCQPRTCVDMPDCYCCSIDNTCHPSSETCIKACQSSFSTRVFRSPPI

SEQ ID NO: 167172 - protein, 247 aa, Triticum aestivum
  unsure (1)..(247): unsure at all Xaa locations
  Clone ID: PAT_TA_61590.pep
EANGYDNLASADGAPVTLNGKKAYGVFISPGTGYRNNHVSGSATGDQPEGMYAVLDGTHYNGGCCFDYGNAEISSKDTGNGHMEAIYFGDNTVWGSGSGKGPWIMADLENGLFSGKNPKNNAADPSINDRFISAVVKGKPGTWSIRGGNAASGGLSTFYNGAYPDGGYNPMKKEGAIILGIGGDNSVGAQGTFYEGVMTSGYPSDATENAVQADIVAAKXATTSMTSGTALSXGSSVSLKVTXSGYT

SEQ ID NO: 167173 - protein, 68 aa, Triticum aestivum
  Clone ID: PAT_TA_61591.pep
TLRISLTSFPDSKISGYKSKVNKSRSPPLLPIRVHPRKHHPKADLFACQVFFPEHAQPQPRTKRVSKV

SEQ ID NO: 167174 - protein, 125 aa, Triticum aestivum
  Clone ID: PAT_TA_61592.pep
VSKHSFLVMSTPPMLLWTDGASKWSWRRGSPGFGRFRETISQTCSMGIYTNKNKNEATVNGLGRRGWTARRSGAGPPRIHLEHHVFLGVCFNVLLYRVYVFASRRHPCTHQRMHATSPQHTRTHQ

SEQ ID NO: 167175 - protein, 165 aa, Triticum aestivum
  unsure (1)..(165): unsure at all Xaa locations
  Clone ID: PAT_TA_61593.pep
ANPGPPEAVQRMKDLYFAVMRLRKDKNKKYVPNDLYFAVMRLRKDKNKKDEVLFENAFCKATVKQFAEFFRVGGMLNTAVAAVGIFLLHSKYQNSSKMVAPFHISQSIWKGSFDNRHLIRFFSAYADEPLDKKDIVLFGVFDPPATREGAGHYCVVALNIKXSSF

SEQ ID NO: 167176 - protein, 82 aa, Triticum aestivum
  Clone ID: PAT_TA_61594.pep
QTVLLRESYNKGCLLEPNPVYSVRRKMLDLILAGCRGIVQTENAISLVEEDSQGSSQNHTCQVDNMNSMSESESDSSVEPFS

SEQ ID NO: 167177 - protein, 61 aa, Triticum aestivum
  Clone ID: PAT_TA_61595.pep
HGKFNMFLNIRMFAIFLNILSCHGKFVMFLNILSCHVFQQNVALASWNVFEHLNVAMFLTS

SEQ ID NO: 167178 - protein, 59 aa, Triticum aestivum
  Clone ID: PAT_TA_61596.pep
ASKSVFGAYRTENMTMPNPKKFNHAHNYNSHESSYSVASPTSNALLSHQPSSDFHTGAN

SEQ ID NO: 167179 - protein, 117 aa, Triticum aestivum
  Clone ID: PAT_TA_61597.pep
MATKAAAADPAAAAAPPAAAAPAAPAPAVSLDETKAKNVLRQVEFYFSDSNLPRDGFLRKTVEESEDGLVSLALICSFAKMRSHLGLDAAVKEDGVPETTVLAVAKVLRCSVGLRVF

SEQ ID NO: 167180 - protein, 85 aa, Triticum aestivum
  Clone ID: PAT_TA_61598.pep
RLDNALLVFRRFISEGIELRSPVTKDEIVSEVARQLNVNIYPDNLHLVSPLSSLGEFEVPLRLPRDIPRPEGKLQWTLKVKIRRP

SEQ ID NO: 167181 - protein, 63 aa, Triticum aestivum
  Clone ID: PAT_TA_61599.pep
KSTSLFLLLIIIIIITRTETKNYHTTERLLYMIMALLYYFYHTRLEFCDKWFEVIPGNAPVVS

SEQ ID NO: 167182 - protein, 109 aa, Triticum aestivum
  Clone ID: PAT_TA_61600.pep
ATGAVGAWLGAGDGVPRVVARLLWGALWAMYVCVLLCMMLAMAFTAGGVLVGKVVEEPVQVTENLNFDYTKPSPVAFVPVGRLVPPQQRMQLRVLLTLPESDYNRRLEV

SEQ ID NO: 167183 - protein, 124 aa, Triticum aestivum
  Clone ID: PAT_TA_61601.pep
MSRLRALWQASVNATKRAVVWNSEDLFPPSERYIFNFNSKDEVKKWHLYSDSEYGGLSSASLEITDSVSGGDTSSTGVFSGNLSLDMSEGSPWRIRRSGFCGMRSKKFDGYIDLDSYDTIAMKL

SEQ ID NO: 167184 - protein, 65 aa, Triticum aestivum
  Clone ID: PAT_TA_61602.pep
MGNCWFKGSPYFNRVSSNATKSESPKLQSPSERTEKDDSLLPSNPHEGEALRNDSAWKNPLIAFT

SEQ ID NO: 167185 - protein, 61 aa, Triticum aestivum
  Clone ID: PAT_TA_61603.pep
TCSSNSLSLNFSLAAITLFPIVGSDDVRKVHPSPPTWLSHTPKIASTRNRTSNPLSNNKAG

SEQ ID NO: 167186 - protein, 119 aa, Triticum aestivum
  Clone ID: PAT_TA_61604.pep
SGIRKGSGKKKKKKKKKKKKKKKKKKKKKKKKKKKKKKKKKKKGGARFKESNFTYPCLQSNNFFLGAPKLNSLAGFLKRRNWKNLGVTKFNCFEKNPLFSSWGNKKKAPTNCLFKIFPP

SEQ ID NO: 167187 - protein, 90 aa, Triticum aestivum
  Clone ID: PAT_TA_61605.pep
MGSLGPAVSVSMAKASGGTAAVGGQQPERGTFSCGFRMPLHYPRYRKADYEAMPEWRVDCLLREYGLPVAGDVEDKRRFAMGAFLWPSQY

SEQ ID NO: 167188 - protein, 190 aa, Triticum aestivum
  Clone ID: PAT_TA_61606.pep
MHMHALLPRLALLCLAAQQTGLLPVAMARTNLTVGDALTPPGYITSPSGGFAFGFRALDSDPTKFILATWFRLGDDGSSSQPQSVVWFAKKTTMGDTPIATNESVLSVTADGHLTLTDGSGQELWRAPTPSMQRGSVLALSDSGNARFLGGDGDTVLWESFRTRRTRCCPGSPWLRWQGPRSGGIFSSSA

SEQ ID NO: 167189 - protein, 129 aa, Triticum aestivum
  unsure (1)..(129): unsure at all Xaa locations
  Clone ID: PAT_TA_61607.pep
MGAADEHPQHQPSPAPEGEAKRTLVFTYGTLKRGFSNHCLLQDLARAGDAAFVAAAATAEPLPLVCGPYRXPFLLNLPGEHGCQRVRGELYSVTPHGLARLDELEGXLRAHYERLPVFVVVDGGESALV

SEQ ID NO: 167190 - protein, 150 aa, Triticum aestivum
  Clone ID: PAT_TA_61608.pep
MDAASLMGPSSADAPTDGEHRMGTTIVGVCYDGGVVLAADSRTSTGMYVANRASDKISQLTDNVYVCRSGSAADTQVISDYVRYFLHQHTIQLGQPATVKVASNLVRLLAYQNKSMLQAGMIVGGWDKYEGGQIYSVPLGGTNLRQPFPI

SEQ ID NO: 167191 - protein, 75 aa, Triticum aestivum
  Clone ID: PAT_TA_61609.pep
GGRSKGPPQFPGEDPPQPPPVCFCPRIVPPPLFAEGGLCLGFPQNPWGPIFDVAAILASIPSLLGGPNPNFPANF

SEQ ID NO: 167192 - protein, 58 aa, Triticum aestivum
  Clone ID: PAT_TA_61610.pep
HTGQFRSFTSVTSVLSADPLLAAQAHSHMSSKGCAHSVLALALRIPQSQGNITGPRVP

SEQ ID NO: 167193 - protein, 50 aa, Triticum aestivum
  Clone ID: PAT_TA_61611.pep
PTRPAEKAEGLKAALEKDGHAVTGPFVLSRYNPPWTLPPLRTNEVMFPVE

SEQ ID NO: 167194 - protein, 174 aa, Triticum aestivum
  unsure (1)..(174): unsure at all Xaa locations
  Clone ID: PAT_TA_61612.pep
HACNSAAMDNQDTCTEGFRGTDGRLLRRVEASVAQLTQLVSNLLAMHKRLRSIMPLRQRGKNDTAASGAGSELPPWVMDVAGGVEGELARARGRSGGKKAMRVDVVVARDGSGRYRSVXEAVARAPNHSRRKYVIYVKRGVYYENVDVXKKKTNIVLVGEGMGETVITGSRSFS

SEQ ID NO: 167195 - protein, 195 aa, Triticum aestivum
  Clone ID: PAT_TA_61613.pep
LSRPPLVLAPHERRVGDARLARSRAAAPEGRRRPRGGRGRPHRGPPVLVVEEVPAVVEHLEHPGDVGRVVAVVTAGGFVVAALHRDRGGASASRRAAVEVDEAAEGLAGVPAAVEVHGELAPGRQHAAAQKVDDGARQAPQPPAHALGLSSSGLPGDDLDGHLQPIGGVTHSRLALGRWIGTNDTVTPDAWADAW

SEQ ID NO: 167196 - protein, 77 aa, Triticum aestivum
  Clone ID: PAT_TA_61614.pep
SKPVVMGRWRRAFPFSMRLSLILGSAAWHRGRPSRWASNPSAARPSHAWWRRFGRPRRVVCSCILAPAGASIEVSSA

SEQ ID NO: 167197 - protein, 88 aa, Triticum aestivum
  Clone ID: PAT_TA_61615.pep
MSAGSERSNAAYATPAAVLADFSRGSGPSVSGSVSVSGSGRSQAEGGARKKPPFRLAADDTKPVLRDPISRSDPMETEQAVLRLPPFP

SEQ ID NO: 167198 - protein, 122 aa, Triticum aestivum
  Clone ID: PAT_TA_61616.pep
MRNITGGSVSRPNQQRTRTEHPHRSKKRRSSSIKAASKVVLKTSTYPNKRNVAYGTIGSTDPRTKAGGIELGAEFALVRIDEPILDNEELVREGSDCKTIGEAFTSRYLIGWPSAFIREKDG

SEQ ID NO: 167199 - protein, 62 aa, Triticum aestivum
  Clone ID: PAT_TA_61617.pep
LHRPARAMVETVHGPACRTARPRTRTGTCRTGSSPAPPWRARTAPCADRGSSTTVDWWLSGA

SEQ ID NO: 167200 - protein, 89 aa, Triticum aestivum
  Clone ID: PAT_TA_61618.pep
HASAHCVRKKKKKKKKKKKKKKKKKKKKKKKKKKKKKKKKKKKKKKKKKKKKKKKKGGAFFRDSIFIPGGLKIFFFFLGPLNLIFWGGF

SEQ ID NO: 167201 - protein, 150 aa, Triticum aestivum
  Clone ID: PAT_TA_61619.pep
GFPQSSPPQGVYGFQVPPLGGPFGGDIFLGPPPPGIKAADPVKLLVGVKKRFPLRVPPPPLGGGFGAPPFFFFLGGWPTFASLPFFWAGGGELFKPPLLTPPGIFFTKTLFTWVCLPFLLFPFSPFPSRPPPFQGFFPFLFSVTYLGGFY

SEQ ID NO: 167202 - protein, 177 aa, Triticum aestivum
  unsure (1)..(177): unsure at all Xaa locations
  Clone ID: PAT_TA_61620.pep
ARRRVRELRGLQLPLLPVALRCAKDLDLVHCVGDLGHVVFPTDSALKVCDIDGWGGAPLLAILHRQPSTLLCAVPTNSRPAGRRHGVTDRSALRSTTAFRHRPPRGRLCWSLLRPLPGGHTHALLLSRWCPWDPGGITRARPTCGWYPLFVKRSKINHPSPGGGESXXQAEMLKACF

SEQ ID NO: 167203 - protein, 63 aa, Triticum aestivum
  Clone ID: PAT_TA_61621.pep
TSEILYSYYYPILYPWRTKIWTSGGDDGRTRALRSVICTHLYILLTCERRLACSVKKKKKKGC

SEQ ID NO: 167204 - protein, 131 aa, Triticum aestivum
  Clone ID: PAT_TA_61622.pep
FVFPGWGDLFGRAGSCTRCPIRKWWKQRTVMFMRPFLLNVLFSKRLVHAKVIHRGTSKVIAVATTNAEGVRNKIPSLIDDNACRTIGRLIAERSMDADVFAMAYEPKKNERIEGKLGIVIDTIKEYGIIFA

SEQ ID NO: 167205 - protein, 78 aa, Triticum aestivum
  unsure (1)..(78): unsure at all Xaa locations
  Clone ID: PAT_TA_61623.pep
GTMTGVLSAANEKAVELFIDEKISYLDIFKVVEMTCDAHRNELVTXPSLEEGGHYEQKARKFAANLQPSSSGRSPVLA

SEQ ID NO: 167206 - protein, 142 aa, Triticum aestivum
  unsure (1)..(142): unsure at all Xaa locations
  Clone ID: PAT_TA_61624.pep
ISFQLPRWHLHKHLVVSXRSTYLTLFEEHTRERGREGDRVCVIRGEFRWSRAGRWHRCRRSSVNSLHGERRRVVQLVLPPSCPDPVPTSKLADGRGRLRWQLTMVVGGYCIWSGEELEGMGRAKTHAAKSRKKGGQVTSKIG

SEQ ID NO: 167207 - protein, 77 aa, Triticum aestivum
  Clone ID: PAT_TA_61625.pep
TIADIWTIVRLCVNGWRWRCVLGFLYECCFREEKCCEINYIVVRKKLRLCATHLIDHVQVPVKKKKKKEKKKKKSPL

SEQ ID NO: 167208 - protein, 171 aa, Triticum aestivum
  Clone ID: PAT_TA_61626.pep
TIIHWIIEKFVQSRKKNMARRIWQGQKEGGRWRLTQRALAHLQRRPWAHWAWRNGGGRWTETAVAQARALCESTRGRGAVETKQRMQGATVAAGLGDGGVLVVLSGQGGRRSRIQGRGRGRRANAGSSGARCRDDAAAGIHGDGVSGRGIRERGSRRRGREEEARCWPTSQ

SEQ ID NO: 167209 - protein, 104 aa, Triticum aestivum
  unsure (1)..(104): unsure at all Xaa locations
  Clone ID: PAT_TA_61627.pep
DSDGSQLPQTPTRQSREPPPTSPPRINQHLDEMIXXXVDGRSRQLIKSSRGFFFSIFGVRAHAPRHAKVGASGVLSMHVYVSELYIKCVMRPSFWNKIYAPIAQ

SEQ ID NO: 167210 - protein, 121 aa, Triticum aestivum
  unsure (1)..(121): unsure at all Xaa locations
  Clone ID: PAT_TA_61628.pep
ILLRVVRGERCLALVSRLRSRYKIAFLFFRVFPSGEVQALHPRXAGGKKKIFAGWRGVGLXFLCFGLSVCPLVVLFPGLSSFAFFSRSSSLRPCSFLARSFLAGAVVRPVLFLVVFCWLRS

SEQ ID NO: 167211 - protein, 119 aa, Triticum aestivum
  Clone ID: PAT_TA_61629.pep
GGPPPPGGPPSQGGGVGGESPKPGVLGGAKLLFPFGGGAKPPKAGVPLGGGQHPKGFSKEHFSGGIRTGLQAMDFSCSTGDALQCRDPSCPPPQAYQHPNDVATHACSGNNNYQITFCP

SEQ ID NO: 167212 - protein, 94 aa, Triticum aestivum
  unsure (1)..(94): unsure at all Xaa locations
  Clone ID: PAT_TA_61630.pep
KKKSPPXXSSASSAAAWAAAXXPXPPSRCVPACLPXVXXPPXXXPVRGGXRSXXAFXAAVARFSRRLLVLXRLVSVRVCPXXKLCGPXAXPVSL

SEQ ID NO: 167213 - protein, 121 aa, Triticum aestivum
  unsure (1)..(121): unsure at all Xaa locations
  Clone ID: PAT_TA_61631.pep
CGRSFPXGGXXXXXTRXGAXXTREAEARGRTEQAEHTRQGXTEQRNTNGGKRRGSARARERRRRREKTRRGEXNRRRRSQQARPPXXRARPRRPAPGAPAQKQPQQEQPHAAFFLXSPPPP

SEQ ID NO: 167214 - protein, 176 aa, Triticum aestivum
  unsure (1)..(176): unsure at all Xaa locations
  Clone ID: PAT_TA_61632.pep
GGWAPWLLLASVAARLSAPAPGGVWGPRRFRPGSVALRGFRRFPGGSGLLVRXAPRLRRVRGXPXXFXXXLRGPAXGKYQILVAAVAFLVGLFGGSSLCALPAXRVPFLPLGVRLARRLRGGRALALFPPCVRCPWFPLAVSASVVCSSCFPPCFLLALPCSPLWFWPASFWPPLG

SEQ ID NO: 167215 - protein, 101 aa, Triticum aestivum
  unsure (1)..(101): unsure at all Xaa locations
  Clone ID: PAT_TA_61633.pep
VXXVFXFXVPSXGGGGAAKKNIAXLVPVRPFGLGGFVVFLXSAFPXXAASFSPVGAFFXFSVAFLFPLLFAPPVVXXFXGGAGLVLSXAWCSLVXFFXXLF

SEQ ID NO: 167216 - protein, 110 aa, Triticum aestivum
  unsure (1)..(110): unsure at all Xaa locations
  Clone ID: PAT_TA_61634.pep
PLXPPLPXFXPRGGGGEKKKTSSAPAPPAPSPPAASPSRPAWRRRAPGACGLLAAAVWVSGCGWPCCVRVASLAASSCCVVRLCXCWXVXXVGFGXXLGRKCCFLAAAAG

SEQ ID NO: 167217 - protein, 135 aa, Triticum aestivum
  Clone ID: PAT_TA_61635.pep
GGFSPVPAWGQFGTPGGGNGRINAFLRIRGVAKARPGEVIPPKWGKRGGGRKQENGPLGPGGGLGPLGTPAGGGVNSPPGGCRGGQGKEMGFGPPFFPRVVFFFFFPQRDPSFKIPLSQLPPIFGSGLFKGNWGR

SEQ ID NO: 167218 - protein, 47 aa, Triticum aestivum
  Clone ID: PAT_TA_61636.pep
KGRYEEGNWSYRTKENMKVLFYLTRVRGNGEDNGTDTLGGGGGEKKW

SEQ ID NO: 167219 - protein, 153 aa, Triticum aestivum
  unsure (1)..(153): unsure at all Xaa locations
  Clone ID: PAT_TA_61637.pep
NKTDWQQEKDFSFTVRSNSAEIEIILPPNTHQSENSDANQTNAYHSTSHLPACSAADRGSHHPATMRSGQVSSTGRRRSACAGAAASRRRRFFFFHRTXPRXSRKNPXTXPTRKKKNNPRAERHQPPRADGGEEEDQGPEDEEEGGDETRKKG

SEQ ID NO: 167220 - protein, 152 aa, Triticum aestivum
  Clone ID: PAT_TA_61638.pep
NPAPWHTAHTAGAALTAIFQGAVALLAFTRTADFLAELQSYVRDDDGAVILKMVGGLGTAIFVLEWAALALAFSLRRGGAEATARTTSAAPRTGPTPTMSERRASALRAPSPAGAGERRLHPRCVDLVLLLSLFFCASSTVCTVMISDSFVL

SEQ ID NO: 167221 - protein, 109 aa, Triticum aestivum
  Clone ID: PAT_TA_61639.pep
GGVGPPPGRKNPLPFLKQPGGGLGGLKPHLVGGIPGKGGVNIPLALNQGTGFSHVGLAGDQNPFQCLGGGGGVGEKKPPFFMGPPGLNFRLSSFSVSLKKKIVFFLLLL

SEQ ID NO: 167222 - protein, 52 aa, Triticum aestivum
  Clone ID: PAT_TA_61640.pep
KEKKGTKGCIALAYHGDKKLARTKRRGRFRAGLLYWDFKPQPKQGGAIPPPP

SEQ ID NO: 167223 - protein, 138 aa, Triticum aestivum
  Clone ID: PAT_TA_61641.pep
AKSPLRPLPFSAAAYTLPYSTAGHAARRRRLRAVLHHRILPAASAPPEPRNGRGVAAVAKEGERCRGGRPRRPSLGRGRGVPAAGLLAWGEASRRKTIIFKARSLGRMEAASPGSARQHGVGLLRVAPGPGRWNDGGT

SEQ ID NO: 167224 - protein, 175 aa, Triticum aestivum
  unsure (1)..(175): unsure at all Xaa locations
  Clone ID: PAT_TA_61642.pep
KCRPEDKGAKKERLIKRAQAEAEGKTVEAKKPXIVVKYGLNHVTCLIEQSKAQLVVIAHDVDPIELVVWLPALCRKMEVPYCIVKGKCRLGSIVHKQTPSVVRRGTQGKEDNLGFIKIVEPNKSGRRVLIKYVSDGFAGRAHRHQLAGGRPGQIDASGQRELLHARARMIPGSSD

SEQ ID NO: 167225 - protein, 148 aa, Triticum aestivum
  Clone ID: PAT_TA_61643.pep
PPKGPKEWRASGLSHVKNESEAEELEDYADYELVGVFGPGGEETLLPKVVPPQVFFFSPPPVDKALEQLEYGPASVNPFKNGPPGGVNLLFKRKEGGFGLIIPKQGGPVGKAPVNPQGKGPPVAGWGFLSLPPRGSLAVAPFVGLFFP

SEQ ID NO: 167226 - protein, 124 aa, Triticum aestivum
  Clone ID: PAT_TA_61644.pep
WEPTPPGVFPGSIARGTKGFFFEEKTGPKLGGFCWLNPFWGEEGFSFKYFGVLLVEVCPRLFPNDPRINWFFKTVPKPRGVWGLTSAGKKFPGFCGKGPPPPKNMPSRGAPWKGNQTVFLGGGG

SEQ ID NO: 167227 - protein, 88 aa, Triticum aestivum
  unsure (1)..(88): unsure at all Xaa locations
  Clone ID: PAT_TA_61645.pep
LRLRRRRRRLRRPPRRLRRRLLAGVPGGAARWPVFXVAVPFFPCLPXVLSLASRVPXFSLLRVGSGXFWLPLAVPPXPFRVPCSVPVG

SEQ ID NO: 167228 - protein, 154 aa, Triticum aestivum
  Clone ID: PAT_TA_61646.pep
AGRFRRGILFANRLGASKPQVALSANRIRLVPSSTHISLSHAIETKRQSGNCTDAARDPRRQRPSPASLSTAVGFLARAGQMKRKETKKEYRVAQEAAPRVDAAQWEEVELPLATSSLISSAKFWVRPEQEPSFCPTEKRSLILCVCCVTFLGY

SEQ ID NO: 167229 - protein, 121 aa, Triticum aestivum
  Clone ID: PAT_TA_61647.pep
MHSHYPRISKLTPPPVNANEPKGAVCTATTESLGYDRAPMIDKDSYALMNTSTVILVMMDIEFPARNLKRVSRHVIDAKLLLLMGVPDPTDARDYCSGVKAADICVRFPRKERMHLNDVMN

SEQ ID NO: 167230 - protein, 86 aa, Triticum aestivum
  Clone ID: PAT_TA_61648.pep
RELSLLHPFALPEDCLGRNKLYCRVRHHVYSRQDPHGEDDHPCRRRTSTHLTKQADRDQQMYDFTQKMTKTPDVHKITAEEQNPLS

SEQ ID NO: 167231 - protein, 233 aa, Triticum aestivum
  Clone ID: PAT_TA_61649.pep
TTTLVITSPRLKRFVDLRILLPDNGSTDQNDILPFSRLDWAIAGTTVSTQKPDPSGALTSHSTFIQWISSRELGNDAGFMYPQPGEDLTLEKGSMVNPDTGIDTAYEELWHDATPTAVPGEPDVRALVLQTEDEEKGVRGCVVRLGRYAQGLIRVGEEIALERWEWTEGGWKRTVRMGDEELPIEKILEETLDEDDKWMFSGENLESYLKRVARPLQSNTNRQSRKKKKKRPP

SEQ ID NO: 167232 - protein, 110 aa, Triticum aestivum
  unsure (1)..(110): unsure at all Xaa locations
  Clone ID: PAT_TA_61650.pep
AGRVPHSPSLFTPRPGRVASLPPHAPAPPPPPPLPLPLPRRRLPGERAAPPRRXRARGRPWPPSHPLAPAALNSARNVLPPPIHQALIDPSIASPRTPASLPSSPLSASC

SEQ ID NO: 167233 - protein, 169 aa, Triticum aestivum
  unsure (1)..(169): unsure at all Xaa locations
  Clone ID: PAT_TA_61651.pep
AVPVICLTDEESTDPPGSWVDPCGCTLEAHQDCMLSWVTDCERSNKPLQCPVCKDRIQMEGPWDPIVSVTDAVANRFTRASPFMLLSSVTVGAQXSLQMYGXSAMWAXAXRQALVEYVLXHEVWANGDVSRXLMTGXXRLGKALILXXIGPVLLIGQLMAWXANXEFLS

SEQ ID NO: 167234 - protein, 94 aa, Triticum aestivum
  Clone ID: PAT_TA_61652.pep
TDAQEPSTMVFPTPLTLSRNRGLMRAELGLEIAHGGSSGIDRPARRYAMGVHQPDEGKGADFPPLLPIPVCPPSTKSSPRQEEDAASASVSSSA

SEQ ID NO: 167235 - protein, 83 aa, Triticum aestivum
  Clone ID: PAT_TA_61653.pep
ARTVHMLNLTWHCLPADLPTDESFDAFFVESRARDLQPRCGKEGRTRLGEHHNKRRSITKSREADKTPPLNHHASTSPLPQRA

SEQ ID NO: 167236 - protein, 181 aa, Triticum aestivum
  Clone ID: PAT_TA_61654.pep
MEAASAASAATATATMVFVYGTLKRGFPNYPRLAAFDCPFAGAATTAAPASLVIGPYSVPFLLPTPTPSSGRLVSGELYSASPSALADLDLLEGTHLGVYERRRITVVVDGASKEVEAQAYFANASYAEFLWLRCGGEAAEIAEYTMEHAGRYVPPSGRSPGVSGLMDAVRAFLATAPPEN

SEQ ID NO: 167237 - protein, 80 aa, Triticum aestivum
  Clone ID: PAT_TA_61655.pep
MAFLGGSLRVTRSISSRKMTEGKSHGGLGSWPQPPAPVRQLFWRVRRAVLRPKRHAVSFGYDLKSYSQNFDDGLVPAHRL

SEQ ID NO: 167238 - protein, 78 aa, Triticum aestivum
  Clone ID: PAT_TA_61656.pep
MSCCGGNCGCGTACKCGNGCGGCNMYPEAEAAGATLLVSATATHKASSGGMEMAAENGGCDCTQCKCGTSCGCSCCSC

SEQ ID NO: 167239 - protein, 89 aa, Triticum aestivum
  Clone ID: PAT_TA_61657.pep
LGYRYCSATALWSGPFIVDGHPAKAGGLPAHQSWDPRVVPHPVVVEHGTVRWSKAAPLWVYLSLGLPLGRSLGMRWVKHSSRSVVALFV

SEQ ID NO: 167240 - protein, 166 aa, Triticum aestivum
  Clone ID: PAT_TA_61658.pep
QRHNNLVSASFGSIMSSPPPNPSLPLPVTSSEATTTTVAPLLPALGFSAAPSPVVLTPEVFGTLRDLIQAVQEIRLFLAGSYGLHPAVPPITATAPPWLPPHQAPPAALAATAAAAIHRPVLAVMAAAAPGGLRRAAAAAIHHHHRPVLAAVAAAAPGGLRRAHRA

SEQ ID NO: 167241 - protein, 49 aa, Triticum aestivum
  Clone ID: PAT_TA_61659.pep
MADDSSSPASYIRLVQHLIQKCICYDMNTEERLAPLENPPSSCPSSHPL

SEQ ID NO: 167242 - protein, 83 aa, Triticum aestivum
  Clone ID: PAT_TA_61660.pep
MSGNPAGVDNTFRRKFDKEEYLERARQRERDEKDEARRGKDRGPPVQRQPLKHRDYEVDLESRLGNTQVLTPIPPLSHQACIL

SEQ ID NO: 167243 - protein, 79 aa, Triticum aestivum
  Clone ID: PAT_TA_61661.pep
HPSTSTIYLHPFLVSPHAAQNRADIDGAQGGLLPRRAVLPPRLRHHQEQEGSRSRLPPAQSRLHISKEGQKSCLPEDML

SEQ ID NO: 167244 - protein, 94 aa, Triticum aestivum
  unsure (1)..(94): unsure at all Xaa locations
  Clone ID: PAT_TA_61662.pep
PLPIPPSPPSLACAAVGPHQIAPPPPPPSPDRAATAAALNRRRXCPAPAPPPTGDVAATANTFTTAAAHHPDHLRNHRRHPPPPPPAPTTSAAH

SEQ ID NO: 167245 - protein, 156 aa, Triticum aestivum
  Clone ID: PAT_TA_61663.pep
MTTTTTTTRKRPLTVPEMALRVCVIPLALASLWEMATNKQADDTYGEISFSNLSGFKYLVFINAVTAAYSVVSILMSSFKSLARYDWLIFLLDQAAAYLLVTSCSAAAELVYLAREGDREVSWGEVCSYFGWFCGRATVSVALQDAAMLCFTALSL

SEQ ID NO: 167246 - protein, 148 aa, Triticum aestivum
  Clone ID: PAT_TA_61664.pep
SPARAPNERPPSREPRRSSNPSGLSQPSPPAMSSISSRSSGEPCRAPRRRIGPPPPGSSRAVAPRALPRQAAPSSCRRPPGMNAASPRSPSSCACARASRRAPLPPCPQVAAVPAASSTPSFKTGTTRSFFQPRAPEPPSSSSRARAP

SEQ ID NO: 167247 - protein, 171 aa, Triticum aestivum
  unsure (1)..(171): unsure at all Xaa locations
  Clone ID: PAT_TA_61665.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGILSMANAGPNTNGSQFFICTVPCNWLDGKHVVFGEVVEGMDVVKNIEKVGSRSGTCSKQVVIADCXQL

SEQ ID NO: 167248 - protein, 108 aa, Triticum aestivum
  Clone ID: PAT_TA_61666.pep
MAKIQSRGPAAEPLLPPPPYLSPHSPADFHDADDSYVLLVPVRLRRRLRRGCGRGRVAAALAALALLALAFLLWPSDPGVSVARLFFLHASDDARPDVDLNESVALKE

SEQ ID NO: 167249 - protein, 46 aa, Triticum aestivum
  Clone ID: PAT_TA_61667.pep
VLAEVLLEVVVVARPGEAAHEAAVLRLLPWISPFLSSPNYGNPRLG

SEQ ID NO: 167250 - protein, 75 aa, Triticum aestivum; identical to SEQ ID NO: 106874
  Clone ID: PAT_TA_61668.pep

SEQ ID NO: 167251 - protein, 75 aa, Triticum aestivum; identical to SEQ ID NO: 117166
  Clone ID: PAT_TA_61669.pep

SEQ ID NO: 167252 - protein, 121 aa, Triticum aestivum
  unsure (1)..(121): unsure at all Xaa locations
  Clone ID: PAT_TA_61670.pep
MSATKGGDRKKGQTRSMKAXGLQIPGGRIPRYLKKVRYPXRVRSVVPVXLAAGLEKLPAHDMKPAVPTDMDNNMILLIPSLLLFVVTNEQRVLLPASTTRESAAYLVICSLNSLLELHQEG

SEQ ID NO: 167253 - protein, 89 aa, Triticum aestivum
  Clone ID: PAT_TA_61671.pep
MAATASLSAVGGPLSVAGFKKAASFRPLPGVRAGRPAARMTAVRASSASGQEKLTAGLTAGAVAAALGFFFFPPPPPPGLSPSLKNFLF

SEQ ID NO: 167254 - protein, 75 aa, Triticum aestivum; identical to SEQ ID NO: 106874
  Clone ID: PAT_TA_61672.pep

SEQ ID NO: 167255 - protein, 134 aa, Triticum aestivum
  Clone ID: PAT_TA_61673.pep
MLIKLSAPSQLHGFQQASRSTRSSMSRVALVAVFAVLAALAVAEMASGAVTCGDVTSAVAPCMSYATGKASAPSGACCSGVRTLNAKASTPADRKAVCNCLKNLASFFFITATAANIPVKCGVSVSFPISTKPN

SEQ ID NO: 167256 - protein, 75 aa, Triticum aestivum; identical to SEQ ID NO: 106874
  Clone ID: PAT_TA_61674.pep

SEQ ID NO: 167257 - protein, 69 aa, Triticum aestivum
  Clone ID: PAT_TA_61675.pep
PLEAAGRKIQQREHPASSLLTVAASSQSSPSSPRHHPPRKGGCIVEEETEDEETDAREETDAAEARCSP

SEQ ID NO: 167258 - protein, 64 aa, Triticum aestivum
  Clone ID: PAT_TA_61676.pep
GGGSTGAPPSAGRGAFFFSSCLFFFLFLFVFFFFFFLFVFFFVFFFFFFFFEHPDDDNLLWCQQ

SEQ ID NO: 167259 - protein, 155 aa, Triticum aestivum
  unsure (1)..(155): unsure at all Xaa locations
  Clone ID: PAT_TA_61677.pep
TPSTPASSLLTVAASSQSSPSSPRHHPPRKGGCLAAAATADAAPAASAATAAAGARCSPTLRPPPAPPPWSCPPPPTRGAPAGSRRPAGRPAAATAPPASAARPAAAPAAAATEPAPRRPAGXGEHEDEEDNWTSNHXPPPPPSLAAACARPRAR

SEQ ID NO: 167260 - protein, 67 aa, Triticum aestivum
  Clone ID: PAT_TA_61678.pep
LCGEGPRRGVPAREGGQGSGRWRGRPVTCGRAFRPYTNNGGNLWIFFHIFSFYFIFFFFFFFFFFFF

SEQ ID NO: 167261 - protein, 197 aa, Triticum aestivum
  Clone ID: PAT_TA_61679.pep
PSLSSISLLLLPPIPNQGGTRREEGKGREEETTEPSARTRQQAPRSRAGAEMGLTFTKLFSRLFAKKEMRILMAGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAGITDKLGLH

SEQ ID NO: 167262 - protein, 54 aa, Triticum aestivum
  unsure (1)..(54): unsure at all Xaa locations
  Clone ID: PAT_TA_61680.pep
MDATATGAKGKKGAAGRKAGGPRKKSVTRSVKAVLQFPVGRIGRYLXKGRYAQR

SEQ ID NO: 167263 - protein, 104 aa, Triticum aestivum
  Clone ID: PAT_TA_61681.pep
MAALLMRRLAGTYRGRAPLAAAAVGGAAFFYASSNPTVAHMEEKGEDAAAKVALNPEKWLEFKLQEKATVSHDSELFRFSFDPSTKLGLDVASCLVTRAPIGQE

SEQ ID NO: 167264 - protein, 178 aa, Triticum aestivum
  Clone ID: PAT_TA_61682.pep
HRTSRRWPAGEGRAGGLAGLLAEALALQVLPVALAVGEVLGAAHAGAVAAAEARALELEALRQAVPCLRHLGRRRPHLCGDEEDEQQEGGGGHATRERHRSALLHPRRTGPSYYPLLLLRGTVCCLASKANGGEWAPVSCEISGLNRRSVLLNLIAHPDSQPFCTQPYRSNKFIRFQK

SEQ ID NO: 167265 - protein, 179 aa, Triticum aestivum
  unsure (1)..(179): unsure at all Xaa locations
  Clone ID: PAT_TA_61683.pep
MINLFKIKGQKNEEAANSKGGPPVKKQSPGELRLHKDIAELNLPKTTKISFPNGKDDLMNFEATLRPHEGYYVGGTFTFTFQVSPSYPHEAPKVKCKTKVYHPNIDLEGNVCLNILREDWKPVLNINTIIYGLNLLFSQPNDEDPLNHEXAAVLRDNPQKFQRNVQTAMSGGYVDNTHF

SEQ ID NO: 167266 - protein, 144 aa, Triticum aestivum
  Clone ID: PAT_TA_61684.pep
AGRVLEATSDSHRTIAIPIRPVTVPTAVLFEMREGDGSLKPAEDAHTKTDTGSDEPEGLCPKRAPTPPAPGEGDRRTEKSPPHARSASALDVRQPPCGTCAISRSSDPLLPRGGAGAEPPHSEEDDRGAPGSCRQRHRLQKTWT

SEQ ID NO: 167267 - protein, 132 aa, Triticum aestivum
  Clone ID: PAT_TA_61685.pep
GRNLRVLSQLEVGGCVVRRVIGVGTVFLQEQRVGDAVIYSGYICWGYTGGEILGRSLLVSRGGCEGSGRVLARCVLYFWKSVVGGVISVVAVARGYCARLPWRCEKVKVLDSRYVSMKVSAVQYSWQCSVLT

SEQ ID NO: 167268 - protein, 191 aa, Triticum aestivum
  Clone ID: PAT_TA_61686.pep
MSNTLLSSLAEAKLVPGAAASLIPEGFKPSVNLRVSFDGKDVELGNLFRATECKRSPSILFDQEADAPGDATYMLLLVDPDAPTPDDPKFAFWRHWVLPGLRPLGSADAVAQIQPALTEYLGPGPKDDSKPHRYLLLLYRQPSNLDLTKDDVGGEEFTQRRSFDTAKFVEKYDLQLVGVNWFLGAGDGWKE

SEQ ID NO: 167269 - protein, 70 aa, Triticum aestivum
  Clone ID: PAT_TA_61687.pep
PAGSLKKKPKECKKLFIVHLTEREYFAVPRNLKLLAVPLFELYDNVQRYGPVISTIPQQLSRFQFNMVSS

SEQ ID NO: 167270 - protein, 164 aa, Triticum aestivum
  unsure (1)..(164): unsure at all Xaa locations
  Clone ID: PAT_TA_61688.pep
PARSSEKKKKKKKKLKKKKKKNACQISGYALGVAGWGLGLKLGSESKGLTYSTHRNIGIAIFCLATLQVFALFLRPNKKNKYRGYWNAYHHSVGYSVIVLAAVNIFKGLNILKPVTGXKTSYIVILATLAGVALVLEAITWAIVLRRRKRNQAHGGANGTGVQL

SEQ ID NO: 167271 - protein, 144 aa, Triticum aestivum
  Clone ID: PAT_TA_61689.pep
RPVTIFSIPAAPAAQAPKPAGFQQSGPNYFSPVQAQASKPTTSAFSGMGTSNAAPSTPTTMANMKPVTSSSAKPAAAGGDAFGALWGKASGGVKKPETPKAGPALGQLAKEKSSAGIWGAPAAGSSSGSAPPKTGGSAMDDLLG

SEQ ID NO: 167272 - protein, 128 aa, Triticum aestivum
  Clone ID: PAT_TA_61690.pep
MAAMKVVLKLDLHDDKQKQKALKLVSSLHGIDQIAVDTKDDKMTVVGTVDPVHIVGKLRSKLFRTAQILSVGPAKEDKKDDAKKDDGKKEPTPVYPPWYPPPPPYHYHSHPYYHGHSAEEDPSSCVIC

SEQ ID NO: 167273 - protein, 284 aa, Triticum aestivum
  unsure (1)..(284): unsure at all Xaa locations
  Clone ID: PAT_TA_61691.pep
AGRVPDHPKAYGSAAVAFAFTTGILVTLGFKDFYPDLERRFQRKRRANTGGGRRSSVFWGDPVELEDHESLPSSPTFYDGARNGLADGIEATIGNTPLIKVQSLSEATGRTIMAKAEFLNGAGNSPKDHVALNMIREAEAQGLLTPHKGDTIYEGTVGSTGISLATLAHAMGYRAHICMPSDMALEKSDLLLHLGATVERVTPAPITSSDHFVNLARRRAEEHASKANDGSKGFFANQFESEANWKAHFNTTGPEIWGQTNGELDAXFVAGAGTGGTVSGVASI

SEQ ID NO: 167274 - protein, 123 aa, Triticum aestivum; identical to SEQ ID NO: 122909
  Clone ID: PAT_TA_61692.pep

SEQ ID NO: 167275 - protein, 62 aa, Triticum aestivum
  unsure (1)..(62): unsure at all Xaa locations
  Clone ID: PAT_TA_61693.pep
GAFFFFFFLFFFFFFFFFFXIFFFFEKLNYDMTRKKKIKYMIHFPKYSAEITVRQDLRYLDK

SEQ ID NO: 167276 - protein, 60 aa, Triticum aestivum
  Clone ID: PAT_TA_61694.pep
GAFFFFFFLFFFFFFFFFFFFFFVHLPQTLEGLMNDNNISICKIHTFLKAEKHYVNSFRM

SEQ ID NO: 167277 - protein, 47 aa, Triticum aestivum
  Clone ID: PAT_TA_61695.pep
AGRVPPRAASWIKCTDLNKSLYLGYNYSFKFLVFYFPLILTIIYLDM

SEQ ID NO: 167278 - protein, 83 aa, Triticum aestivum
  Clone ID: PAT_TA_61696.pep
AGRVLGKTYKSFTPPAPPPTPPSTEVDIPRPPAGGMATDLNLHAADDVYNIFSSMPYTRCSTESASPSTHTTGTISRRSDRIW

SEQ ID NO: 167279 - protein, 246 aa, Triticum aestivum
  Clone ID: PAT_TA_61697.pep
MTRPTTFYQFASTGANGASLEQIHNAIHWDASCAGQFLATEFSGFDALFWLHHVQVDRLWAYWQAMHPTQSSFTGSYSGGSRYSTPQGTRITQNSPLQPFYRSKGNFHTSETVKSIQSFGYTYAGLEYWHMSQSQLSSSARSTINRLYGSSSNKRGLEERADGTTTRYFVNVQLDVTEVERPAQVNVYISGKLVGGLVVMRQPAEGIVHGSFSADQAADTPQLLASCSPDKVADAVQGYPGRDRQA

SEQ ID NO: 167280 - protein, 81 aa, Triticum aestivum
  Clone ID: PAT_TA_61698.pep
MGSSATMTRAVVVAVLLVQCCNVVLAARLLEGDRGWLHGGVGAAGALIMQVLPSGTPGAGTPNGCTNNPNHPPGGPCNGGR

SEQ ID NO: 167281 - protein, 99 aa, Triticum aestivum
  Clone ID: PAT_TA_61699.pep
VAGMRTRPLGPTPILPSLHRAATTNVTRPFPGSGSGNPYVSISLITYPHRSPHHRTHRTCGCPYIIALRYYDDSTLTLSPIFPILRYCDLLPWITQKQS

SEQ ID NO: 167282 - protein, 57 aa, Triticum aestivum
  unsure (1)..(57): unsure at all Xaa locations
  Clone ID: PAT_TA_61700.pep
AGRASXNALNTNSKESRRLWRDHERRARTPLARGSRVQTKAIRVIASKNQCMTSRSK

SEQ ID NO: 167283 - protein, 153 aa, Triticum aestivum
  Clone ID: PAT_TA_61701.pep
MAVAGGGVVLSLRGPSASAGRLRRVSSSPAVRCGATRERMPAAPPYGVLEEDHYRTLRLQPGASRGEVKKDFHRLALQYHPDVVRRGGGDGRQDDAIDFERINAAYQTVMRNMQEAEATLEYWRRRYGLADEDLDRYRHYLNDDDQDDWFSDF

SEQ ID NO: 167284 - protein, 103 aa, Triticum aestivum
  Clone ID: PAT_TA_61702.pep
LGSGFAIVGRQAEDSGCIITWNCGVLLYYIPTYDSCCACLPFSMCVCVCGWGGQIVKNVIPICSYIYISIYMVNFMPKHDYVSILKHETCSFLLPKKKKKKGP

SEQ ID NO: 167285 - protein, 219 aa, Triticum aestivum
  unsure (1)..(219): unsure at all Xaa locations
  Clone ID: PAT_TA_61703.pep
MSTDKITFLTNWHATPYHAPLYLAQAKGYFKEEGIKVALLEPNDPSDVTEIIGTGKVDLGFKAMIHTLAAKARNFPVQSIGSLLDEPFTGVVYLKDSGITTDFRTLKGKRIGYVGEFGKIQIDELTSHYGMTPEDYTAVRCGMNVSKAIIKGEIDAGIGLENVQMVELEEWLAAQGRPKDDVQMLRIDELAELGCCCFCTILYIGNETFLSENPXXSAR

SEQ ID NO: 167286 - protein, 67 aa, Triticum aestivum
  Clone ID: PAT_TA_61704.pep
RPGFGITKNGITKLGAPPPLDLEKYETDKRIEDEEILKILEQPIARNTGKKKSKPKKKTAKKEGDEE

SEQ ID NO: 167287 - protein, 207 aa, Triticum aestivum
  unsure (1)..(207): unsure at all Xaa locations
  Clone ID: PAT_TA_61705.pep
MSRALFRSMLELRAPSARLLAPSSLLPIRTRAFNTTAPIIEQSFPERHPKNATNPTANQPRPLALKVSHPTPPPKPMEDSVKTLLPFLAAQPDHYITVHVHGFPYLVREGDQVRLPFRMPGVQPGDILRLNRASVLGSRDYTMKGAPHIDERVFECRATVIGTESEPLRIKIKKKRRQRRMRQAKSKHRYXILRISELNIXNGEDIE

SEQ ID NO: 167288 - protein, 101 aa, Triticum aestivum
  Clone ID: PAT_TA_61706.pep
GAFFFFFFPALNLSYIYNIAIIKITISGNPSFPCQVLQARSLLFRFHFHIKNQQKTNSLIRYRLVVEQTNVLLNKGNAQLLSGSKTAESFWLPPRGTEPGR

SEQ ID NO: 167289 - protein, 102 aa, Triticum aestivum
  Clone ID: PAT_TA_61707.pep
GAFFFFFFVGAKGCLLLESNRDYYMLTEEQVGMSTTSFPLIIFFLYFYFCITDEQACASFFSLRMAVERAGSSCRRSRRGRRSSSDAPRSSNTGTAVKQWRL

SEQ ID NO: 167290 - protein, 143 aa, Triticum aestivum
  unsure (1)..(143): unsure at all Xaa locations
  Clone ID: PAT_TA_61708.pep
PAGFPSDCPIFDTLAGKLLAVADKYELPRLRVLCESYLCKQISVKSVATTLALADRHHATELKSVCLKFAAENLSDALMYLXAVIRTDGFDYLKDNCPALQSEILRTVAGCEEECSSGGKSQSVWGQISDGGDTSGRRVRPRV

SEQ ID NO: 167291 - protein, 71 aa, Triticum aestivum
  Clone ID: PAT_TA_61709.pep
MSSTEVASGECKKMSWPEVVGLTIKEAKEIILKDKPDADIIVPVGSAVTEDFRPNRVRIFVGTVAETPHVR

SEQ ID NO: 167292 - protein, 166 aa, Triticum aestivum
  Clone ID: PAT_TA_61710.pep
MEAEAFPIRFTKGIRSYWRRSKYQRVDGATAGRGTRHLVRLGDGGSSDGKAWGVRLGGMFRVRVKAPASAVAAAKAPKRVLGRIRDAYVDAMLGAAKKHSAATHTLPNGPTPEALWQKRVPVRRSRSQAQVRQKADELGQRLVLEMYKSVRASRDLAGMLEASRAR

SEQ ID NO: 167293 - protein, 74 aa, Triticum aestivum
  unsure (1)..(74): unsure at all Xaa locations
  Clone ID: PAT_TA_61711.pep
RPGLDKLGRICLDVLKXNWSPALQIRTILLSIQALLGAPNPDDPLAADVAKSWKEDEQAAIATAKEWTAQYAKP

SEQ ID NO: 167294 - protein, 64 aa, Triticum aestivum
  Clone ID: PAT_TA_61712.pep
MGDGKKSSPGFWSVVGSWFACFRRPAKGKVASAGGRTTTYEYGPADGMVAAARHFSSAHKINFG

SEQ ID NO: 167295 - protein, 217 aa, Triticum aestivum
  Clone ID: PAT_TA_61713.pep
MPSPIVAATVQAAGLSTASNIMAQMIEARQANRPMSLDIIQLLRFVVLTLMTAPPNYHWQAFLERKFPAYPVSKRPNLDRLNDLEMQPSQDAPELKEGYEERLTQINKDREPEFSTRNTLTKWFVDCITAGAIMNTVAFLVIMGLLKGQGGSQIWSNIRTETIPIIVAGYKIWPIASIISFTFIPVHRRIVFLSFIGLLWGIYMSLVAARVRVACTF

SEQ ID NO: 167296 - protein, 80 aa, Triticum aestivum
  Clone ID: PAT_TA_61714.pep
HVGTYIAGTIHVLTYPCSTYCLFVVGVYMYMFGRTRYIYSDIIFQICICMCIIVNPSIIRCKLRPRVVVLVVVCRRRKVE

SEQ ID NO: 167297 - protein, 106 aa, Triticum aestivum
  Clone ID: PAT_TA_61715.pep
AGLAATKPAPNPKQARTPRVKSATCQPASLQRSPTPPRPRPCPPPPPRPWARSPRPPPWRSPVPSSSSPSAASPSPASTTTPLLRTTPRPFVHASPPPPPPQVGRC

SEQ ID NO: 167298 - protein, 73 aa, Triticum aestivum
  Clone ID: PAT_TA_61716.pep
ASRARRRNGVSYGLVMWQCFYGTTSAVTMQSVSLLMIAPRQGQSQPRKLLSPRSRYKERTPSRSCTCSSRRYR

SEQ ID NO: 167299 - protein, 77 aa, Triticum aestivum; identical to SEQ ID NO: 115953
  Clone ID: PAT_TA_61717.pep

SEQ ID NO: 167300 - protein, 74 aa, Triticum aestivum
  Clone ID: PAT_TA_61718.pep
LSPPLASTPARTAIITSRTPTSLKALTWIFQIHTCDATLTTIENYYTENGRRKWLLILDFMSATTRRDLLAMRY

SEQ ID NO: 167301 - protein, 220 aa, Triticum aestivum
  unsure (1)..(220): unsure at all Xaa locations
  Clone ID: PAT_TA_61719.pep
XGPGRGKKNNPTKECYYTSKPLPPLPALPSSTCFDSTKSDTSSTSSASFIFASGQAYKQIKAYDKSLRPQDVVRETVQQKVHSWLSQLPFRPEIAECYRRQTMHSWQKWPTKHKRNQKSEPPIIINSPRMSEDTTIAATDDGETQNGERDSHEAFRKPHIGHDRRRSLDSYHSALLHMEKPFANYTSKFCPTLRRKYPRGLEDEARLGIGVAFVTAKFEA

SEQ ID NO: 167302 - protein, 106 aa, Triticum aestivum
  Clone ID: PAT_TA_61720.pep
MAAPVACAFFFDAEPVGEPGMPALDACALCAKSLARDSDVFMYRGDTPFCSKECRHEQMQLDAVSARQATRRLQRFSAGAESGRAQPGCPCRANRRECLTKKGYYA

SEQ ID NO: 167303 - protein, 155 aa, Triticum aestivum
  unsure (1)..(155): unsure at all Xaa locations
  Clone ID: PAT_TA_61721.pep
ISQGSTSNVPVTRLHTAKSSLLNTTERTPTLCTSRRTRRRPWRETRGTAWSKKPGLSRXGEEGVQRSALRAPDRSWRWDPLRGRRWTKQPRKGAERHASSGRQRXEEGGVGKYEAAPPLARRGAAXESGHVLDAFEDPEDHVVREGRRRRLGHVS

SEQ ID NO: 167304 - protein, 175 aa, Triticum aestivum
  unsure (1)..(175): unsure at all Xaa locations
  Clone ID: PAT_TA_61722.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEXPDAYVRIIGFDNMRQVQCVSFIAFKPPGCEESGKA

SEQ ID NO: 167305 - protein, 75 aa, Triticum aestivum
  Clone ID: PAT_TA_61723.pep
GAFFFFFFLTASFLLLFIPSKKKTVDRRMGNKKDGAKTNSGETKRRRDARRPHYDHGHDTTSPAGWTGDRSQPGR

SEQ ID NO: 167306 - protein, 206 aa, Triticum aestivum
  unsure (1)..(206): unsure at all Xaa locations
  Clone ID: PAT_TA_61724.pep
NAPQIRRTSPMSPTKAARWKNATAASQISGHRRTRPSTSSLIYNIWQSHHKRHWVRGAGHGRGDEXPAAAAGGAQEEEHHRWRHEKQGEHTRINQDLPNYQGHGAVPDAGPEHDEAEECCGEDDADGAGEEMEQGISSGAGGPAACQCPHGRPHQRRRDGRCARSLPGDLLFERHGSHFGCGVEWTGDSVVXCGGWVSNPPPRGPH

SEQ ID NO: 167307 - protein, 96 aa, Triticum aestivum
  unsure (1)..(96): unsure at all Xaa locations
  Clone ID: PAT_TA_61725.pep
MARWAIAIHGGAGVDPNLPEHRQEEGKRVLARCLQVGVDLLRAGATALDVVEAVVRELETDPCFFSGRGSAVTRAGTVEMEASFLDGRXRRCGAAL

SEQ ID NO: 167308 - protein, 94 aa, Triticum aestivum
  Clone ID: PAT_TA_61726.pep
MAWRKKNGGESFSPGASPCRDDEQEKVPRGHVPMVTGCGARVVVPVRLLRDPRIAELLDMAAQQYGYGQPGVLRIPCDAGHFRRIVDGALHRAE

SEQ ID NO: 167309 - protein, 133 aa, Triticum aestivum
  Clone ID: PAT_TA_61727.pep
RPGWGSTSMTVSLYRDCVHPKIPQLAVIGYSESYANLHTSELRAKWLAHFMDGGFRLPSVKAMHRDVLEWEKFMKRYSHGEFRASCIGLLNNWYKDNLCRDMGCNPRRKNELFVVLFDVYGPNDYIDLHPKRG

SEQ ID NO: 167310 - protein, 80 aa, Triticum aestivum
  Clone ID: PAT_TA_61728.pep
GPFFFFFLFFFFFFFFFFFFFFKKCKSLLNLEQIIHISPNKKGQSTEVWSQHNQKAVLKIGNQKAQQIGLNLSHTTKTIW

SEQ ID NO: 167311 - protein, 125 aa, Triticum aestivum
  Clone ID: PAT_TA_61729.pep
RLRRRLRKRQRLWYTYQRLALDTWICRNTNSRHTRCHSRCCRPLRTFVDASSSRCCRPLRAVNRYPVLDECVLCIDVMLGTINRDTCANCWNDWKSRDGHNQIFMEFRTGLPKTLADHYGIMYQV

SEQ ID NO: 167312 - protein, 118 aa, Triticum aestivum
  Clone ID: PAT_TA_61730.pep
PAGLPKKKKKKKKKLTKKKKKKKIYLLRRLLGVRTADGKQAKVAKLAKNEVIMVNIGSTSTGAKVAAIKNDAAKLVLTSPACTNIGEKVALSRRIEKHWRLIGWATIAAGVTLEPSTS

SEQ ID NO: 167313 - protein, 56 aa, Triticum aestivum; identical to SEQ ID NO: 134772
  Clone ID: PAT_TA_61731.pep

SEQ ID NO: 167314 - protein, 193 aa, Triticum aestivum
  unsure (1)..(193): unsure at all Xaa locations
  Clone ID: PAT_TA_61732.pep
VRRSGGSSTSDEXGLLVTQDMXSXPXGXRKPNDAEQAEFQRQLEILVNQHKSYPSITTWVIYNEAWGQRDXSPEGDLTQLVRKLDKARLINSVSGWDDHXYGDFHDNHNYAAPQCGTPFYSRPKTPYDPERIGIAGEYGXIGHNVSIEHLWNVKQAIDSIPETYEIHKDLESYNYPIPVSLFRRHPVSQTWNA

SEQ ID NO: 167315 - protein, 62 aa, Triticum aestivum
  Clone ID: PAT_TA_61733.pep
TIYNTNCTIRHKAWARIDRVQHDGDDTFSESHLATLFLTNETTSLKLLQFSGAILYASFLNP

SEQ ID NO: 167316 - protein, 114 aa, Triticum aestivum
  Clone ID: PAT_TA_61734.pep
MKLVRFLMKLNNETVTIELKNGTTVHGTITGVDISMNTHLKTVKLTMKGKNPVTLDHISVRGNNIRYYILPDSLNLETLLVEDTPRVKSKKPTTGKPMGRGRGRGRGRGRGRGR

SEQ ID NO: 167317 - protein, 147 aa, Triticum aestivum; identical to SEQ ID NO: 122823
  Clone ID: PAT_TA_61735.pep

SEQ ID NO: 167318 - protein, 234 aa, Triticum aestivum
  unsure (1)..(234): unsure at all Xaa locations
  Clone ID: PAT_TA_61736.pep
MSALRILVPVKRVIDYAVKPRVNKSQTGVEKAGVKHSMNPFDELSVEESVRIREKKRAPGGVEDICVISAGPPKAQDVLRTAMAMGADRAIHVELKEGEEIEPLTVAKLLQKAVEQQKSNLVVLGKQSIDDDANQTGQMLAGLLGWPQATQASKVEFGANDEVTVTKEVDGGVETVRAKLPMIITTDLRLNEPRYASLPNIMKAKKKNLQKTKLEDFGLDXSERSETLKVVELR

SEQ ID NO: 167319 - protein, 50 aa, Triticum aestivum
  Clone ID: PAT_TA_61737.pep
GPFFFFFFFFFFFFFFFFFFFFFFFFFFFFFFLARNSETYNHEMGVINRL

SEQ ID NO: 167320 - protein, 107 aa, Triticum aestivum
  Clone ID: PAT_TA_61738.pep
KKPVPVYCFQIIILPSFLPPLFALQYCECSKLIVMDDSQPFDPIQWDHQDLDFLRPQLSGINSRHASSFASPSPSPSSQRPRLPLLQLDDWDRDNAYDEFPPTCIHY

SEQ ID NO: 167321 - protein, 78 aa, Triticum aestivum; identical to SEQ ID NO: 106980
  Clone ID: PAT_TA_61739.pep

SEQ ID NO: 167322 - protein, 199 aa, Triticum aestivum
  unsure (1)..(199): unsure at all Xaa locations
  Clone ID: PAT_TA_61740.pep
MFILSPSLISGAAALFLVAYIITRLSSATAKIPGPFVSNFTSLVLKWQELNANRTXIHELHKRYGPVVRVAPNEVSFTSIAAVKEIYGSGGSGYDKTEFYNLFQVYGKRTMFSTLVKGDHAKRRRMIGDRYANSNVMKAAPLAGIKERSSKFLQHCVESPERTADVFRALHAYAWRLCHASTVPPIWKQLLAGQTGMRR

SEQ ID NO: 167323 - protein, 153 aa, Triticum aestivum
  unsure (1)..(153): unsure at all Xaa locations
  Clone ID: PAT_TA_61741.pep
MRYYFCRPPRYPKQPQKEQNPPPPPPRPRPPLPPRPPPPPPPPPPPPHPPPPTGAPPPPPPPLAPPHPPPPPPPPPPPPAPPPPLPLSPPPPLPVPPPPPPRRPPPPPPPPPPLPPPAPPPACLKPPPPPXPTPHPPPPPPSPPPPPPLSRPP

SEQ ID NO: 167324 - protein, 127 aa, Triticum aestivum
  unsure (1)..(127): unsure at all Xaa locations
  Clone ID: PAT_TA_61742.pep
XXVFKKEQDIELLYPHTQEQEQASLPASSIKTQDGSSCLISEQPAAITHAVRQTAQRSHSRRPLAVASNVRRPMVADAARPAPAADQARLLDGGVVQAETLAAKARQTVELLMGRLAAGASPKGPGH

SEQ ID NO: 167325 - protein, 78 aa, Triticum aestivum
  Clone ID: PAT_TA_61743.pep
MQPRAVYVNYLDLDLGTNELDGDVTSYEKARVSWGDKYFKGNFKRLAAVKTMVDPHDFFRNEQSIPPLPTAKMMIDSI

SEQ ID NO: 167326 - protein, 143 aa, Triticum aestivum
  Clone ID: PAT_TA_61744.pep
MLPKLTFLFVFVTQAVSQQVRIFNKIPQDVNQCVKPCLFRLNNANTDVGGVLDCGTPYKQDCYCATNKDKAKLVSEHIDTCAQASCSAGVESQDASSMRSYYASYCMENGYTADVMTEWYTGTVIAEATKTYDNVWGWSSADP

SEQ ID NO: 167327 - protein, 114 aa, Triticum aestivum
  Clone ID: PAT_TA_61745.pep
YLPHRHTFRSHQAAARRATTPSPRCSRLSSALLHLDGGKRLPCFSVVTAVVDLARPSRVQLPRYLEVTAEPPPSYSCRRPWTPASRCTQHLGLAASLSNIPPHSLWRSDASVMY

SEQ ID NO: 167328 - protein, 273 aa, Triticum aestivum
  unsure (1)..(273): unsure at all Xaa locations
  Clone ID: PAT_TA_61746.pep
MAPERVCLAYSGGLDTSTILRWLVLQGYQVVCFLADCGQEEDFDAVKVKAEKLGAERMIILDVQQELIDELVWPAVQCNAIYEDRYLLGTSLARPVIARAMVKVAKEHNCTILSHGCTGKGNDQVRFELAWKACDPTLKVLAPWRMPEFYNRFAGRADLLKFASEQNIPVSSTPKAPWSMDDNIIHCSYEAGILEQTELEPPKDMWXRTVDPMKAPDEPTPFVIHFEQGVPVKLEVAGKTITGSLEIFKEANEIGRINGIGRVDIVESRFIGL

SEQ ID NO: 167329 - protein, 282 aa, Triticum aestivum
  unsure (1)..(282): unsure at all Xaa locations
  Clone ID: PAT_TA_61747.pep
MTISPLTLRIAMLNADAPVPNVIEQRAPSYGHVFHELLSQSATRVAPGLAVEAEYFDVYHGIYPESLTHFDAIVISGSSASSYEDKGWIKQLDAYIAKVYAEQPRVKIFGSCFGHQIICQSLLREHGVYVEKDPKGMEMGVHTVQLQQDFLKALGSRSSVTDNSTLRLQFIHGDHVKIPEGHSLPPKWLSMGQTEHCAFQGAYEPNHVLTYQGHFEFDSFINTETCKAFAGTYGXGPQFIEAXIEAMDKDDDSKTAADMVMRFFPEGRHAVAGIGGLMSPHW

SEQ ID NO: 167330 - protein, 242 aa, Triticum aestivum
  Clone ID: PAT_TA_61748.pep
MPPLRLAILEADTPQPQTRDRYGGYTGVFTALLEAAAKPKKLSELVSIKGYDVVNELHSYPVIEDIDAILITGSRHTAFDNDPWILKLVEYTKKAIASNRVRVVGVCFGHQIVGRAEGAKCGRSNNGWEVAVTEVDLTAKGKEVFGLDKMRIHQMHRDIVDAFPKNSIPLGSNNICEVQGFYSPGKYITVQGHPEFNEEIISEILFNRHTVGIFTDEVYNDAMKRAPLPHDGVAIAKGFLSF

SEQ ID NO: 167331 - protein, 88 aa, Triticum aestivum
  Clone ID: PAT_TA_61749.pep
AGGIKKKSQLSYSIGVAEPLSIYVDSYGTSEKTSEELVEIIRKNFDLRPGVIVRELNLDQPIYLQTAKNGHFGTNQSFSWEKPKELKF

SEQ ID NO: 167332 - protein, 118 aa, Triticum aestivum
  Clone ID: PAT_TA_61750.pep
MGKRKSSSKPMGPKKKDPLPTTFACLFCNHENSVSVKLDKKAGVGQLDCRVCGQKFQCAVNYLSAAVDVYGEWVDAADAVAKEDTAEPGYGGTSRGGGRGNRTAVEDDYDDQYGDDDY

SEQ ID NO: 167333 - protein, 272 aa, Triticum aestivum
  unsure (1)..(272): unsure at all Xaa locations
  Clone ID: PAT_TA_61751.pep
SSVGCYTDPALVAAPAPDLSPVDAVDQVGHDLSAVDQVGDHVGASPKERHSLTLDQRRALRRWANSQPIRPSHKACIEWFYSQYGQQISQSTVSHSLSPKYSRLDSDNPQLSGSRLRYGNWPDVEKLVLIWFQQVQASGRQPTNEELGDKAKTIFNQLPRYKDENPPEFSPGWIHRFKKRYGLLIRRQRRHGDGGINPAEDIGYLADCIPRFMNLAPDTSPGAIREEVLRVVGIEPQPRMCALVRDEVVRRITGPXTXQPPSLPQPPPMMTH

SEQ ID NO: 167334 - protein, 256 aa, Triticum aestivum
  unsure (1)..(256): unsure at all Xaa locations
  Clone ID: PAT_TA_61752.pep
MFRLSSIITAGLALISSVNAACGDGTPQGVVSGSGSSFTATVNGANVYSGSDYRLAIQTALDRIGTNQRVTVRASGSIGASTIVVTSGKTFEVCGTMNVVYKAGRGAIEAINQNDVKIPYLKMTGNPYFGMRFSGTRNLALGDITMNLSGGLGIRFDRDANWNYGVTMGNIVVTGAGSHAVETFKIDGLTIASVKARDVGESGLLIQESRNVRVGYVEGNXVGAGTGYATLRFANENGKLNNVYTTTNVFVDKSTL

SEQ ID NO: 167335 - protein, 220 aa, Triticum aestivum
  unsure (1)..(220): unsure at all Xaa locations
  Clone ID: PAT_TA_61753.pep
MSRANPPNAAGSRKISFNVSEQYDIQDVVGEGAYGVVCSAIHKPSGQKVAIKKITPFDHSMFCLRTLREMKLLRYFNHENIISILDVQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTQXIDVWSVGCILAEML

SEQ ID NO: 167336 - protein, 148 aa, Triticum aestivum
  Clone ID: PAT_TA_61754.pep
MPPLPTMTHSSSFLLPSPPHPPADATDAENAVSYAVVVLNQRLPRFAPLLWTREKKKKKKKKKKKKKKNNKKKKKKTTFHRQLSCSALGAYAPPPWGVLSQFSGNSRQRRLSDTPSPRYRHLSQHLGRPSRMLLPHDLHGHPELSLAD

SEQ ID NO: 167337 - protein, 214 aa, Triticum aestivum
  Clone ID: PAT_TA_61755.pep
MKPIRLLSLSPTTLPVTVSTNFSAASSLSRQLSVTRFSSRSRFTACAKPPRTRTFATSRPLNAFRLQKSQKRTKDTMTSSATTLKGQPLDKAVLESILRRRMFYTPSFEIYGGVGGLFDYGPPGCALQAAVIDQWRKHFILEEDMLEVDCSVLTPHEVLKTSGHVDKFADWMCKDPKNGEILRADHFVEAILEARLNGDKEARGQKVEEKEEDP

SEQ ID NO: 167338 - protein, 188 aa, Triticum aestivum
  Clone ID: PAT_TA_61756.pep
MSLRAPLRRVAFARPTSSIAVAARSFHSTPRASVRVGQEIPNTDVLLEDSPGNKVNLAEEFKTSNGYIVGVPAAFSGTCSSKHIPSYINHPKLKQAGQVFVVSVNDPFVMKAWSDQLDPAKQTGIRFLGDPTGEFTKALDLGFEAYAVFGGMRGKRYALKVEDGKVSKAYVEPDNTGSAVSMADQVLD

SEQ ID NO: 167339 - protein, 250 aa, Triticum aestivum
  unsure (1)..(250): unsure at all Xaa locations
  Clone ID: PAT_TA_61757.pep
SPLRSFWIRAQPRRGRNATARPRHHASPPPPRSRPASPPHAADTHRLTPSPLDPVVVARNAPLRKCPRRISSPSRAVPLILLDNRCLDPMARGEAPTLSPPSPPSTTCALPRLHVARPRHTWPHLLQPRSGTPQPPTLRRVDRYPATRTSCTSPPFPPAAPCPAHLPAAASPPATARPPSLLPSSYLQLMLPVAAAVAAAPAVARPRPVAPVTXRPPWRAPALSRIHSALTRVGRPHPLYPLEPHTRLAL

SEQ ID NO: 167340 - protein, 91 aa, Triticum aestivum
  Clone ID: PAT_TA_61758.pep
AKPTTRNTPTPKPYAWATQSSALAKVAGMSRRCLKVGFRSSGTEQGTKHNHGCIEAAGFTFRYVLEGCMPHFIVQMNGVNTEILRSTEFKA

SEQ ID NO: 167341 - protein, 235 aa, Triticum aestivum
  unsure (1)..(235): unsure at all Xaa locations
  Clone ID: PAT_TA_61759.pep
MAPRRPLQKLTSPSRSLSLVLHLAGIASFSYNFKFLTEWDVPMSKSYGWHFQFLTIIGLSASLLAFVFGALADLTLSRTLFRVKNYVAILATPMEVVISILYWGIKFIDPKLLMPTEFYIHIIPDVGFHLAPAVFLTPGLLLFSPPWTVPAYGIMAISTTLAFAYWSWVELCFSHNGWYPYPLFELLSTNQRVALFTFAAVLVTVSSSGLKWLYGQVNGYQTTKRGAHXPLKKVQ

SEQ ID NO: 167342 - protein, 101 aa, Triticum aestivum
  Clone ID: PAT_TA_61760.pep
FRRLASTKPNPKHVHSDGNLGGPGGQQPPPQAPGGPEALKRNWPPIAAAAAVLGGGFWIMLPKKGNPPEMTLRSYKDLDSPDGLKELSGRKPNSMGGFRAD

SEQ ID NO: 167343 - protein, 160 aa, Triticum aestivum
  Clone ID: PAT_TA_61761.pep
FPPSFSRALFLLATTTGLLSSLAPQGRSSTMGTDKDVAAGSKLRRPSRRLKTASIRCCIMYVLPTPPRWLTVCMGLWETREADDGRPRYSSLAAELGRQMPGKSRTGRRWLRHLTEGSHPGRGRRGHFSGCRLPRQPVLHCSSIATPNPQDFFPKLSRFL

SEQ ID NO: 167344 - protein, 211 aa, Triticum aestivum
  unsure (1)..(211): unsure at all Xaa locations
  Clone ID: PAT_TA_61762.pep
MAPKGNKYSVILPTYNERKNLPIITWLLNRTFTENNLDWELIIVDDGSPDGTQEVAQQLVKAYSPHVLLKPRAGKLGLGTAYVHGLKFVTGNFVIIMDADFSHHPKFIPQMVALQEKGNYDIVTGTRYAGDGGVFGWDLKRKFVSRGANLFADTVLRPGVSDLTGSFRLYKRAALEKAIATTESKGYSFQMELMVRAKGMXCTVAEVPSLL

SEQ ID NO: 167345 - protein, 161 aa, Triticum aestivum
  unsure (1)..(161): unsure at all Xaa locations
  Clone ID: PAT_TA_61763.pep
MPSPSAPIRVAVPPPYVTSHGAKIARLHMYDWIVLVILLVVDVVLNKIEPFHRFVGSDMLTDLRYPMKDNTVPFWTVPIYGIIGPMIIMTSIYIKRRNVYDLHXAILGLLFSVAITAVLTDAIKGWLPAYDXFTTGVLCQGKARDIKEGHKSFPSGHTFFV

SEQ ID NO: 167346 - protein, 135 aa, Triticum aestivum
  Clone ID: PAT_TA_61764.pep
MTKHQRAAADQAVSLSLSLSLGVVADINKKMRRATAASGDQFVCKTCGRSFPSFQALGGHRTSHLRGRHGLKLALTAGGQCYSVKPKSTDQKPEHRCHICGQGFETGQALGGHMRRHRDEGGAGAARTARAVCLG

SEQ ID NO: 167347 - protein, 97 aa, Triticum aestivum
  Clone ID: PAT_TA_61765.pep
MITGLAKSEEQDEKALRQSLNRLEMLAKQLDSDALRLLEMEMAPFKGDAEARANLQGKMREWLVQNTIRADPMVRDAMGTSLRKRRVDAPAGAKGNR

SEQ ID NO: 167348 - protein, 97 aa, Triticum aestivum
  Clone ID: PAT_TA_61766.pep
MAAAGSSAAWKRWLRPEVYPIFAATGVAVSICAMQLIRNITTNPEVRVTKENRAAGIQENFDEGKRYSQHGFRKFIDRQRPEIMPAINNFFSDPPKY

SEQ ID NO: 167349 - protein, 241 aa, Triticum aestivum
  unsure (1)..(241): unsure at all Xaa locations
  Clone ID: PAT_TA_61767.pep
MPGVGFGTFANEGAKGETYKAVIAALKTGYRHLDCAWFYLNEGEVGQAVRDFLAEDNGVKREDLFICTKVWNHLHEPEEVKWSFENSLKNFCLDYIDLFLVHWPIAAEKGDDYQPKIGPDGKYVIKKDLTENPEPTWRAMEEIYASGKARAIGVSNWTIDGLKQLMAFAKVKPAVNQIEIHPFLPNEDLVKFCLENDILPAAYSPLGSQNQVPTTGETVRSXKTLNEVADRSGXTLAQVLI

SEQ ID NO: 167350 - protein, 200 aa, Triticum aestivum
  Clone ID: PAT_TA_61768.pep
MVIGLLAIAAIPTVTGVGNAVSAQKRQNESMSKEQEKFHLTFMLRQNGKIEEVGQGVLVDKKMYLNLSDAPVQGYRFLGWFFKYPSDEGHLGLVSMVSDDPPALNWIFVDKDTHAVTFGGKKDTIDHVKGPWGWTADEKFLTLKGDHDSFVAVRGDDGKWSVYWDPEGDIEDEIDDEERCQPVRLRRRPQLGMESSYVKK

SEQ ID NO: 167351 - protein, 180 aa, Triticum aestivum
  Clone ID: PAT_TA_61769.pep
MGSGSRAASCLCCPFKCLACGLFSCLCSILVSLLVTAGVLALILYFIFRPQMIAATVDSASLAQFALGTPASPALLQYNLTLAMTVRNPNKRVGLYYDNVEALALYDGQRFGFAPLDPFFQGHQASTGVKPAFGGQQVLEGDVTQSNLRTQLAGGAVEVEVKLNAKLRVKVWAFKVPGPR

SEQ ID NO: 167352 - protein, 230 aa, Triticum aestivum
  Clone ID: PAT_TA_61770.pep
MASRFTPLIRSVIRPACRVARPQSRAAFSLTASRRSDTLMVHRNTEDNNPDIPFKFNAENQKVMAEILKRYPPQYKKAAVMPLLDLGQRQHGFTSISVMNEVARLLEMPPMRVYEVASFYTMYNRTPVGKYFVQICTTTPCQLGGCGSDVIVKAIKEELGIEQGQTTADGLFTILEVECLGACVNAPMIQINDDYYEDLTPASVKDLLKSLRSRPLLLILPHVMFPSLPL

SEQ ID NO: 167353 - protein, 172 aa, Triticum aestivum
  unsure (1)..(172): unsure at all Xaa locations
  Clone ID: PAT_TA_61771.pep
QPPNKSGKKVAPAPFPQGKAGKKAAKNPLLEKRPRNYGIGQDIQPKRNVSRMVKWPEYVRLQRQKKILQMRLKVPPALAQFQHVLDRNTAAQAFKLLNKYRPETKAEKKERLLQEATAVKEGKKKEDVSKKPYTVKYGLNHVVGLIENKKASLVLIPNDVEPIELXVFLPSL

SEQ ID NO: 167354 - protein, 171 aa, Triticum aestivum
  unsure (1)..(171): unsure at all Xaa locations
  Clone ID: PAT_TA_61772.pep
PEKKKASTDWALVHSGRPSQPSVPRALPPXRVXMPARARRCSPSPPPPLAAPRRXSXXXRIMXFPXPPLHPLSTLPPSPSLAPPXSPPDPXAECPRGRPPSIPWPPPPRGLPAVSDRTAVVDYILSFDRRKPGATAASPATSSSSSALLAQTIYWQNRRGSEAKRIYIAAN

SEQ ID NO: 167355 - protein, 142 aa, Triticum aestivum
  Clone ID: PAT_TA_61773.pep
MAGGGKVYSFQEVRKHSQRKDCWLIISGKVYDVTPFMEEHPGGDEVLLACTGKDATADFEDIGHSDAAKELMPQYCIGEVDAATIPAKLAHAVLPAKGAAAAPAPRASAGQGVWLTVLQLALPLLLVAMAFALQNFAKTKTE

SEQ ID NO: 167356 - protein, 170 aa, Triticum aestivum
  Clone ID: PAT_TA_61774.pep
YTDCRLRNSPSNSSFLAWLERERMALAPRSSLSSLVLLMSHGKPQLSAFFSSAATTASPVATAVKPPAAPAGGSPAIDPPAAAASSSGSGSTHSAPLECPSRTFGHVEPEPESEGSCHTLGHETDKISPGATKDQEGPISEGSCGTPQPVSDDPQPGPRKDPRHGVPEDP

SEQ ID NO: 167357 - protein, 118 aa, Triticum aestivum
  Clone ID: PAT_TA_61775.pep
IPEGFGIIVTGAVLFYFFCEASLPWIQPGSRAWELLNENFPGGASFFHWLVNTIFWPVVGIHVVECFFFDKKLQRHGVERFSGQWWLWLTNCFFEGFPAFKRVDGIVARKQDKNGKTQ

SEQ ID NO: 167358 - protein, 112 aa, Triticum aestivum
  Clone ID: PAT_TA_61776.pep
NTVASATSLPKQALGSAFCLPARYIVRSGWRGARRRPARTSRLWRRGRGGSLTGRPSTGASPTRSWSSLSSPRMRFTSLLHRLPYIHTMGGRRRRGRILFRSSAFQVAALYV

SEQ ID NO: 167359 - protein, 135 aa, Triticum aestivum
  Clone ID: PAT_TA_61777.pep
CERTQRRNPGEINQENRVASPAFFSSGWPEHRRMSHGVFTDQSGSKNRKDFSWKRVAKTKRSGWSSLFEQDGSEFRNARRELWDSGERGNQALLTVAWIGLLSIGDRREQQQRERGAMEDLPPPPHCSLAICLVL

SEQ ID NO: 167360 - protein, 169 aa, Triticum aestivum
  unsure (1)..(169): unsure at all Xaa locations
  Clone ID: PAT_TA_61778.pep
MLTAMQHMDSSAYASSPSASPWQQLLTAQRGHLLPYDYEGLTSVPAAAHAPAAHQQHRPARRVARRRPRPSRRLPTTYISADPAEFRRMVHQVTGADELLLPPVQQQAEWPLLPKLAARAAPSSXGGALLLPTLDTSSFLLGGCRARPSTARTGAMPAPTTPDGSFPLD

SEQ ID NO: 167361 - protein, 203 aa, Triticum aestivum
  unsure (1)..(203): unsure at all Xaa locations
  Clone ID: PAT_TA_61779.pep
ADXTLLVCSGHSLIITKINLEVQEDRVEQARRRLDAGPPRFLSRLPPLNLPPQPPSQELPPLLSAPRPGAVAASRRQPRAPPDRPQRPTRRPAVGGLLPPDHRLLRRPLLVPPGVILAVVKVVVIRIHAAVGVVVVGVEAAERFVAGHGRLIAPVRAGDWRRGVARALIMEARTTSVACAFAPLGASCLTVSSFPSRGATEQR

SEQ ID NO: 167362 - protein, 192 aa, Triticum aestivum
  unsure (1)..(192): unsure at all Xaa locations
  Clone ID: PAT_TA_61780.pep
MATTEKKPHAVLVPFPAQGHVTPMMKLAKVLAXGFHVTFVNTEYNQRRLVRSRGPGAVAGLPGFRFATIPDGIPTSHADADSRQDPTSLCYYTMTTCLPHFKSLLHDLNAAVGAPPVSCVVGDGVMSFCVDAAAELGVPCALLWTASACGFMGYRNFRFLLDEDLTPLKCMHAMRAQVSTMIVHTCNVDLSR

SEQ ID NO: 167363 - protein, 204 aa, Triticum aestivum
  Clone ID: PAT_TA_61781.pep
MGNPEKLMAQIFDLKFTSKSLQRQARKCEKEEKEQKLKVKKAIEKGNVDGARIYAENAIRKRTEHMNYLRLASRLDAVVARLDTQAKMQAIGKSMGSIVKSLDSSLATGNLQKMSETMDSFERQFVNMEVQAEFMEGAMAGSTSLSTPETEVNSLMQQVADDYGLEVSVGLPQAAAHAIPAAKDKEKVDEDDLTRRLAELKARG

SEQ ID NO: 167364 - protein, 173 aa, Triticum aestivum
  Clone ID: PAT_TA_61782.pep
GYLLAAPFPSHSTPLTHSPFSSPDWKTAGQIMASRGGGGPEQLGRELGLEDACVYAHEMWQASGANAGSTPTRAGGWGRRRAGEAGEARPFGSEHGTTTNGGGPEEGGLSESRRPPRRRLLPPTSSDARPPGVDDAIVHRGALQGDCFSRRPRPMRGRLEATTPSCATVPSTA

SEQ ID NO: 167365 - protein, 94 aa, Triticum aestivum
  Clone ID: PAT_TA_61783.pep
HLSPILQKTTPRVVKPRVSRTKGHLSKRTAFVREVVKEVAGLAPYERRVIELLRNSKDKRARKLAKKRLGTFGRAKAKVDELQRVIAESRRAGH

SEQ ID NO: 167366 - protein, 156 aa, Triticum aestivum
  Clone ID: PAT_TA_61784.pep
YKLYITSHGPRGLEYISSNTNESVEATISEYRHELNKLAFRRLAQKQHRSKRQGLLPGSLLTTLGHRCLSSGIRHPRGSSSRRRWQRSQWLRHLVPLQTPTGLRQGRRSSSHYRSRGIAPAGVQRCARARLEAAVLAMATTEHVVSNFLRRLQSQH

SEQ ID NO: 167367 - protein, 127 aa, Triticum aestivum
  Clone ID: PAT_TA_61785.pep
KQHRRFNHGRIQLARRSSQRTTERRKATSLTGGDHELDRGINLLSRGKPGRGTGTPRSAARDHPSSPQHGQPRPRMPRGRRRRRAAEGSHGEKKRQRRRPWRAPRHKWPSGSGAAGDLVSGGNTNGK

SEQ ID NO: 167368 - protein, 192 aa, Triticum aestivum
  unsure (1)..(192): unsure at all Xaa locations
  Clone ID: PAT_TA_61786.pep
MGSTGAARAMPVQELAGALGTPDVPAPYVVRTHKDQQLAAAVVAPVPVIDHGRLLRKDHSADETAKLRSAIESWGLFMVSNHGVDAAVIESMRAASREFFRQPLEEKQRYSNLICDEQFQSEGYGNDRVSSPDQTRDWTDRLYLKVQPEDERRIALWPAHPENFRDVLHQFTKKCGQLKNDLLRAMXEAGGA

SEQ ID NO: 167369 - protein, 125 aa, Triticum aestivum; identical to SEQ ID NO: 141498
  Clone ID: PAT_TA_61787.pep

SEQ ID NO: 167370 - protein, 136 aa, Triticum aestivum
  Clone ID: PAT_TA_61788.pep
MSDTTLVNGPDALEEKLGRLSKKPGVKASIVLDRATGAILKTSGQVDALQTSKSRTTSTATTFSNETPALEENETQGVEQFAAIVWNYVNSSGNLVQELDGEDEVKLLRLRTRKQELVIVPDPKYLLVVVHDTPPA

SEQ ID NO: 167371 - protein, 94 aa, Triticum aestivum
  Clone ID: PAT_TA_61789.pep
MSSQITDESLREAIKERLEAAHVEVTDMSGGCGQAFNSVIVSSQFQGLNSLKRHRLVNAALKEEIAIIHAWTAKCQTPEEYAKTKEAADAPAQA

SEQ ID NO: 167372 - protein, 49 aa, Triticum aestivum
  Clone ID: PAT_TA_61790.pep
FWPYRSLEWPTFSICNCSDIFFTFRSMLDFLYIYDMRFFYEKKKKKRPL

SEQ ID NO: 167373 - protein, 241 aa, Triticum aestivum
  unsure (1)..(241): unsure at all Xaa locations
  Clone ID: PAT_TA_61791.pep
MLFKPSFLIFSLFSLGTVAWDAPNYSGFTKVWQDTFAGSGGTLPDTSRWNIITGYLNVNAELEVYTSSTRNVQRSGGDTLQLVPWRDASAQNGWTSGRIESKYVFTPQAGKVTRTEANIRFGTCSTNNKQGIWPAFWMLGNILRNGGSWPSCGEIDAMETVNGQLTGHGTVHCXVYPGGICNEGTGIGNTIGIPDQSWHTWXVEFNRAKSSWRDETITXFMNGQQXHQISGARINDQNVWN

SEQ ID NO: 167374 - protein, 95 aa, Triticum aestivum
  Clone ID: PAT_TA_61792.pep
ISPLRTKSSGLYRHWRIWGCTRSVTKKGIYISSRQACLPRQGESHPDTGAVFGLRIFTAHQSGPWPTGRTAEGPLVQDSLSGGGRRTTHRTRTGR

SEQ ID NO: 167375 - protein, 52 aa, Triticum aestivum
  Clone ID: PAT_TA_61793.pep
PAGSKKLANFLISSKSGSKVDLMLYLIKTEFTHIYLLPPKKKKEKKKKKRPL

SEQ ID NO: 167376 - protein, 109 aa, Triticum aestivum
  Clone ID: PAT_TA_61794.pep
RKRPSSSRQRWALHCGAESSSSGIYACWLLSWTGNVVDLLLLSPYNQRRLVSHVGFLLGRLANELLHVFLSVLVLVDIGAAVQWCPLGVLLEQSHGMDEVALVSAENGR

SEQ ID NO: 167377 - protein, 207 aa, Triticum aestivum
  Clone ID: PAT_TA_61795.pep
MEHPSSANLPAHKKPDTYFKPHDVLDDTAKAAVVGGLSGLFLSSVKNAMAKHNVGILSVFTRGSAMIGIGAAAPAAYVFASRTSMNLREKDDSFSAALGGFALGAVLGLPTKRMPIVMGLGGGLAAFQGMFHYLGGRYDSFKREGDEFERKEIVRRSTRLPIEQTISGIGEGRGIRPPGYDERRAERLSQKYGVEINPIKATVEGSQ

SEQ ID NO: 167378 - protein, 119 aa, Triticum aestivum
  Clone ID: PAT_TA_61796.pep
PPRLSCARRCSLVLVATDESKSTLTLHQLTCPHRPIPHSILPRRRRCRRRPGGDEAKLRTGHLCVEDTDLEQSTKNSEEAILSDLSLLGLDWDEGPRIREEGLPRKEDVTWKMILYLLC

SEQ ID NO: 167379 - protein, 84 aa, Triticum aestivum
  Clone ID: PAT_TA_61797.pep
MADKLRTQQELERLQAKYIGTGHPDTTSWEFRTNIQRDTYSSIAGHRPLLSYIALAENEPVAKIRAQMIRKMVQPCGPPPPRED

SEQ ID NO: 167380 - protein, 53 aa, Triticum aestivum
  Clone ID: PAT_TA_61798.pep
VGIRSVAMSRILGTHRLHSLLLPKCYLGTHRESKHLYLKISFGIKKKKKKKGP

SEQ ID NO: 167381 - protein, 106 aa, Triticum aestivum
  Clone ID: PAT_TA_61799.pep
AGRVSEKNCNALLLKVNQIGTLTESIQAAKDSYADGWGVMVSHRSGETEDVTIADIAVGLRAGEIKTGAPARSERLAKLNQILRIEEELGDQAIYPGKDFRKSVNL

SEQ ID NO: 167382 - protein, 74 aa, Triticum aestivum
  Clone ID: PAT_TA_61800.pep
MYVEVFNRGVIPLAYSIRKRNSRTGLPFTYYDGIYLLWTYFTKPESVDALQMKLNADDDVIRSTSFKVRKRRVY

SEQ ID NO: 167383 - protein, 54 aa, Triticum aestivum
  unsure (1)..(54): unsure at all Xaa locations
  Clone ID: PAT_TA_61801.pep
RGLFFFFFLWRFGALRXLLDTLFRVSEFAFFLIAFTNDYKYFFFTLNEMSSLRL

SEQ ID NO: 167384 - protein, 180 aa, Triticum aestivum
  Clone ID: PAT_TA_61802.pep
AGRVGIISSAFCSACLWIVGAYVKIGHPATIIAEGKDLSPSTAAGGKAATAMIMIYSVFWSFGLNGIPWIVSAEIFPGALRTLTGTYAACVQWLTQFAITKALPYIFKSFGYGTWFFFACWMMIATIWAFFFLPETKGKTLEEMDVMFGYVHDRAPAESDDMGGKLGAKASVTEHREDSV

SEQ ID NO: 167385 - protein, 161 aa, Triticum aestivum
  Clone ID: PAT_TA_61803.pep
RGLFFFFFSTDSVFVTSTTEEASATTTSVSEPAGEAIILQINRIRRLSKRDTTFVGNDNPSDCTFASAFRLDNGKLLDNGVPIYYAGGERQELAANGQPPADAITTTFSVIGGKLAWENEAFDEAGFCYLESDGKIYITFGSSVGCEPVSLTVIKVPGPAG

SEQ ID NO: 167386 - protein, 179 aa, Triticum aestivum
  Clone ID: PAT_TA_61804.pep
TQDIVKVNEHFDSLRKGWNDVNTYWNDVDYAILLSFLLVGKSSTEICKKMFDHFANLRVEYAQRNTDLNRSRAGAALLTLLTGGLAAPVTIPMMMGAGDAAMTMSANDRYLWGERNNMCKEHMTRHKELEAIIELKDIEINVTKPVTLPPALESSWLADDGLVRRVHTNMNIHTRIFYH

SEQ ID NO: 167387 - protein, 74 aa, Triticum aestivum
  Clone ID: PAT_TA_61805.pep
EGIYYFSAISRWPTAQQTGRHDDAASNNERKQKQFRTGARRTNKKRHILGALGYLLTFIIIVLQHLRQKFEWHS

SEQ ID NO: 167388 - protein, 110 aa, Triticum aestivum; identical to SEQ ID NO: 138623
  Clone ID: PAT_TA_61806.pep

SEQ ID NO: 167389 - protein, 155 aa, Triticum aestivum
  unsure (1)..(155): unsure at all Xaa locations
  Clone ID: PAT_TA_61807.pep
WRFETTQPKKNQVTRQSCRXVMYCWSVCSTVHCAKFPTSLMSLGQTITYLSPANATFCELLAPVMASKYLEPISSTVVPPIALPTICPTSSACVTIPSRIASCIKSNKLCWETPRRTRFFIAKSLPFRILISYFFSSVLLYRVLTPISCPRLAMV

SEQ ID NO: 167390 - protein, 139 aa, Triticum aestivum
  Clone ID: PAT_TA_61808.pep
AGRACDPANHLPHYTNQILCYYPIATMFPTMNLFTLVLAIPAVLAAPATEARTAGKQVLACACANAAGQTKIDGYCQYIAGSNVNLDGQSYCFPAATWSEYMDTRFTADFCPGYYPGFPKPVCKTVTVCPTIGDYQDIC

SEQ ID NO: 167391 - protein, 170 aa, Triticum aestivum
  Clone ID: PAT_TA_61809.pep
PAGFAKIPLELKKKKKKNARPVPSAAARSRSGGAAPPTPEPAEPSLAPAPTAPVQVRLVEDPHRVAARSGSNLNASWLGLRNACRESLRRAGGSGGEADAPTTIVQGAMQDVLPHHPLLHSDGGLGQGRNWITRPPPDRAQPQQRRATSASSCRRCFTRAEVIVWFFFLL

SEQ ID NO: 167392 - protein, 99 aa, Triticum aestivum
  Clone ID: PAT_TA_61810.pep
PAGFRKTLPPSPLSLRLPASPWPIDFFGYSLELSLTDPESPSSCLLALNNCYFPAKKKLLVLTREPLLVLTSLQDGISAVVDCFPSLGSPREGRRRCAI

SEQ ID NO: 167393 - protein, 64 aa, Triticum aestivum
  unsure (1)..(64): unsure at all Xaa locations
  Clone ID: PAT_TA_61811.pep
TGKYRTRFRASLRKXXXKMXIXXXXKYTCTFCGKVTXKRQXXXIWXXKXXKXTXAGXXYTXATP

SEQ ID NO: 167394 - protein, 190 aa, Triticum aestivum; identical to SEQ ID NO: 141335
  Clone ID: PAT_TA_61812.pep

SEQ ID NO: 167395 - protein, 93 aa, Triticum aestivum
  Clone ID: PAT_TA_61813.pep
AGRARRTEVTPTQVLLAWAQVGGHSVIPKSVTPKRIAQNFQEIDLSESDIKEVEEVGKQQRRYNVPYVANKPRWNVNIFGDEAEKPATHQVII

SEQ ID NO: 167396 - protein, 248 aa, Triticum aestivum
  unsure (1)..(248): unsure at all Xaa locations
  Clone ID: PAT_TA_61814.pep
MMRYIKLLRPRLQTYTVLPSIWNFARPAPLSRVRSRFGHPVNTNLSVSHINAFSSASMEYPSYSNSVICPALDIAPANAPPDLFASELSFFASHPWTASLLSAPDTIPFLPSCRNPQSSAHDQLFGNSLNNARGLTHFLSYFRAPSVEVAKDPSHNITEIVVLVSVGEGVSGYPGIVHGGIVTALLDESMGTIFDLNGTLGKDARAFKTSNVTGGIDVXFLKHVPTDSVLCITAIAEXIDGRKPQLVR

SEQ ID NO: 167397 - protein, 72 aa, Triticum aestivum
  Clone ID: PAT_TA_61815.pep
IDRWMDQWMDRLLTMLSGAAHAWHQPTKPPARTMHQTTLYGCQLTTQPNPRQWNGGGWRHHSVSPPRPWVSE

SEQ ID NO: 167398 - protein, 132 aa, Triticum aestivum
  Clone ID: PAT_TA_61816.pep
IYRSNERTVMPLHTSIQTYNESIIFHDWCTTTVSKQLRPSNASSYPVRRCVIVSPQNPGFFRAYASSALGAAAASFIEPADTCGLIALEVIINMPYSSRGAAQKTTAVRNLSMAMDRVDAPIRHLRPPFAAR

SEQ ID NO: 167399 - protein, 183 aa, Triticum aestivum
  Clone ID: PAT_TA_61817.pep
RPGLVAFATVLYEDFVAAMLPRVRRENQYCRPNSQSTGAGLRDTLLMFGRNKNSMMKVAAAIKAATSEMDLCYYMQGNRYVLWNFQNIFPSPKTGKCTGTVEFRGGNQFLNTTGTLAWVAFVMGFITLAIEEDLISKFTLFTTSEDPKFQARIESWWKRIRSSAKASKLSRYLPSEYTSMHTR

SEQ ID NO: 167400 - protein, 70 aa, Triticum aestivum
  Clone ID: PAT_TA_61818.pep
MCNSLLCRRQSMYLRLKRKKKKKKKKKKKKKKKKKKKKKKKKKKKKKKKKKKKKKKKKKKKKRAPKATPP

SEQ ID NO: 167401 - protein, 84 aa, Triticum aestivum
  Clone ID: PAT_TA_61819.pep
ISALSRAPYPPLYPSDQIVPSPSIEIKINQTWQHPRRLLHQLRAPIARYCIGSVLVPKNQWACRRGTLRYRKVNLNRPARAPHR

SEQ ID NO: 167402 - protein, 179 aa, Triticum aestivum
  Clone ID: PAT_TA_61820.pep
AGRVRKHPNTNNMSHAKDTTTPDPKGKGKEVADPAPKSILKSTQDASANISQHVNFSWEANTITRIPADNRGRRLPTGKENRRERLYYNLEKNRVVANNSSVECGAYVTQDDTWDEWEMISRPGQEDATSEVGGEITSCREVMNLPGDDRAASILSEPFENTCTRLQRQLQRDFETDLK

SEQ ID NO: 167403 - protein, 139 aa, Triticum aestivum
  Clone ID: PAT_TA_61821.pep
AGRSGNNTSTSLLYQTKKLQFKMAAFKHFAQAQSKFEIPPLSGGNTFIGDIHSTPDDAAKPITSGLFRVNKGEPLTYTYKYDETKIILEGNFVLEDSTGQKVEAKAGDIFFIPNGATITFSSPDTGLAFYSGARKFNDL

SEQ ID NO: 167404 - protein, 76 aa, Triticum aestivum
  Clone ID: PAT_TA_61822.pep
MGFVFGTVNIFRYGAGPNGIMRTLGQYMAGSGATFGFFMSIGSVIRSDTDPKLHDMYMRAQRRPIMLMANPAWRKS

SEQ ID NO: 167405 - protein, 103 aa, Triticum aestivum
  unsure (1)..(103): unsure at all Xaa locations
  Clone ID: PAT_TA_61823.pep
GMMPEGHCISSLYAFGEVLVADDRESESRLADELGPASACSARRICISHGCVQRMLSETXAAGDILVVLSDRERDRGGSLIRVCVSLERQLVEEDGHDPEPAG

SEQ ID NO: 167406 - protein, 60 aa, Triticum aestivum
  Clone ID: PAT_TA_61824.pep
TFIQKKKKKKNLGWGEPATERKAHYFQFLLYATAVLSLVRFFGFLWFLGRTGIMCCFSRN

SEQ ID NO: 167407 - protein, 70 aa, Triticum aestivum
  unsure (1)..(70): unsure at all Xaa locations
  Clone ID: PAT_TA_61825.pep
ARLLRRHQALPQVPLFFTYFVLVSFWFFLWFFVILLVSCSDXVTXYPXLXXCQHTVSLSCEIKMVLIYPK

SEQ ID NO: 167408 - protein, 167 aa, Triticum aestivum
  Clone ID: PAT_TA_61826.pep
IVTQQNGVPKHTSILQPIYITEAQIHSTRRRNSKEKLKQSKPSRPSGSGKQDAATASLDALRSSTAAPTAPVAASTTAAAAAGAITSVAGAAAAAPALAAASLGPPVVGAAERRDGHDGDRAHEDEEQTHYGAGRALHGAGCGGGEASRRGEIQRPHHFSCWRLRLL

SEQ ID NO: 167409 - protein, 128 aa, Triticum aestivum
  Clone ID: PAT_TA_61827.pep
PFFPGKKPVGPEAPFSPHVRDFMDPPWRFVFPGSLGLDDPNVNPFVPDEAPPPLPGIPFEPLLVFFPEDDFLLKEPALWFPPELRATGYPGEIEIFESKGVGPPFHFDQLGSGEGVRLQEPLVEFLKK

SEQ ID NO: 167410 - protein, 98 aa, Triticum aestivum
  unsure (1)..(98): unsure at all Xaa locations
  Clone ID: PAT_TA_61828.pep
PLNTSSREESEGXXXXXXXXXAMRQGGGGGGGDGVSPGNVPVCYYGAGGRVSATLERRVRAAEVLLRCAACRLVAVLPGFPCDWQVIHIFSPPPSPAT

SEQ ID NO: 167411 - protein, 165 aa, Triticum aestivum
  Clone ID: PAT_TA_61829.pep
AGLAGHPQTPSITLASLDSSLEAQRERRAWRRPGKLFTLEEVAKHSSKDDCWLVIGGKVYNVTKFLDDHPGGDDVLLSSTAKDATDDFEDVGHSTTARAMMDEYYVGEIDATTIPTKVKYTPPKQPHYNQDKTPEFVIKILQFLVPLAILGLAVAVRIYTKAESV

SEQ ID NO: 167412 - protein, 263 aa, Triticum aestivum
  unsure (1)..(263): unsure at all Xaa locations
  Clone ID: PAT_TA_61830.pep
PPPPPPPPPPRPPPRPAPSPARPAPRPPPPPGPAPPRPPPPRPPPPPPPPPPRAGTPPARPPRRPRRPPPPPPAPPRPPPPPRAPPRPRAPPPGGAPPTPAPRPPAPPPGTXPPPPPPPAAGRPPPPAPPPRPPPPPPPPPPPPPPPPPRGRAGDKXXXTPPPPPRXPKXPPPPEAAGRGPGGGEAPPPQPPPTPPHPPXTPPSPDRDXDFFLXPPPLRPAAPFFPFPVATVAEASMTXXXXPPPPPAAALVVRRGFGEWPDV

SEQ ID NO: 167413 - protein, 93 aa, Triticum aestivum
  Clone ID: PAT_TA_61831.pep
MPMRKEVLLVAMMLALVVAAPGGARAACEVGQLTVCMPAITTGAKPSGACCGNLRAQQACFCQYAKDPSLARYITSPHARETLVSCGLAVPHC

SEQ ID NO: 167414 - protein, 159 aa, Triticum aestivum
  unsure (1)..(159): unsure at all Xaa locations
  Clone ID: PAT_TA_61832.pep
PHRRSILTQTLASGSDGPHEADGAQIXTGGKAPRKQLATKAARKSAPATGGVKKPHRFRPGTVALREIRKYQKSTELLIRKLPFQRLVGEIAQDFKTDLRFQSSAVSALQEAAEAYLVGLFEDTNLCAIHAKRVTIMPKDIQLARRIRGERAQDFGCRR

SEQ ID NO: 167415 - protein, 138 aa, Triticum aestivum
  Clone ID: PAT_TA_61833.pep
KKKKNQTLSYKDLTTQTTQFYSTINIINNRLHLNSYKQTTTTHSLTTATMSSPYTVQIHQSTKEPSISSSYSYSSGSYSSSTSTTPRSLSPGEYREYGADKHTTQVAKSGRNLVINHNKVSYEKDSPAPTYAGAYTRT

SEQ ID NO: 167416 - protein, 119 aa, Triticum aestivum
  Clone ID: PAT_TA_61834.pep
ASHGTLSVAPRAPSIVAPFSVVYTMLAASSLAARLPSFLPACSTVGVGPTLAIAASVRRPLGVVLEVLLYSYDMFWVSVECSSAPCLHKVMYEIRRRYNRRNDRPPAALDLPLFRKTSA

SEQ ID NO: 167417 - protein, 53 aa, Triticum aestivum
  Clone ID: PAT_TA_61835.pep
PLNTSSREESEGCHEARRGRRRRRRGEPRQCPGVLLRRGRARVGHPGAAAARR

SEQ ID NO: 167418 - protein, 181 aa, Triticum aestivum
  Clone ID: PAT_TA_61836.pep
WSEKIFSLPLPSRTPLKHQQPSKAWGPLVPWEQIQMPSDAKILFMRSFNERQITLVVYESAQDNCPYFLLRTFHMGTPWFSLRGAHELVVDRNGSCLQFWRWSESDRCTKRWATLCFLTWEEMVLVYCCFLSFKTRDSQTLPMAANEDLSLWGERKLFQARIVDDNFMHSPIAHEDFAPQG

SEQ ID NO: 167419 - protein, 129 aa, Triticum aestivum
  unsure (1)..(129): unsure at all Xaa locations
  Clone ID: PAT_TA_61837.pep
DGGGGDPGGAAADGSCGAGFGHAAQHAGGKKVADASPHGCRLGRVYAGLPPSRRPLPVPSYFSAPPPAVAPLLPPPPPPPPPXPPPAPPPPPPSPLPPPPPPPPPXPAPPPPPPPHPPPPPLLSPPPSP

SEQ ID NO: 167420 - protein, 78 aa, Triticum aestivum
  unsure (1)..(78): unsure at all Xaa locations
  Clone ID: PAT_TA_61838.pep
VRAGPAPEGRRAPGGPSAGSARAIGRGRDERPMVGGRRIAARAWLAWLCFGVRRRAGEWEGXWWSVGAPRPAGPRAXR

SEQ ID NO: 167421 - protein, 99 aa, Triticum aestivum
  Clone ID: PAT_TA_61839.pep
CHLLFFIPHLSFSPLTNRQQRHGYPPPSATRSRQARSSVSTQLRLRAATRHDGQPLAWGDGLAVRHHTPCPLAFALHAPTRPCYEWRPVPGDWHRGEAC

SEQ ID NO: 167422 - protein, 200 aa, Triticum aestivum
  unsure (1)..(200): unsure at all Xaa locations
  Clone ID: PAT_TA_61840.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSGTIDNVKAKIQDKEGIPPDQQRLIFAGKQLEDGRTLADYNIQKESTLHLVLRLRGGMQILVKTLTGKTITLEVESSDTNDNVKSKIQDKXEGIPPDQQRLIFAG

SEQ ID NO: 167423 - protein, 116 aa, Triticum aestivum
  Clone ID: PAT_TA_61841.pep
MADRVYPAAKPTPPPPMANGGGGPAAPKPQMYQRPIYRPQGQAKSRRGRSCRCSLCCCFCWALLVVVLLALVAAAAGGAFYVLYRPQRPSFTVSSVRLSTFNLSSSTIAPVLTDSI

SEQ ID NO: 167424 - protein, 173 aa, Triticum aestivum
  Clone ID: PAT_TA_61842.pep
GDAPYKLRLNRFGDMTADEFRRAYASSRVSHHRMFSRKEGDGGFMHGSARDVPPSVDWRQKGAVTAVKDQGQCGSCWAFSTIAAVEGVNAIRTKNLTSLSEQQLVDCDTKSNAGCNGGLMDYAFQYIAKHGGVAAEDAYPYKARQASSCNKKPSAVVTIDGYEDVPANDETVS

SEQ ID NO: 167425 - protein, 64 aa, Triticum aestivum
  Clone ID: PAT_TA_61843.pep
SSCPWCFSPPWLVRLWCLLRGRRLFSALGPSVLLLLRGGVRCSPWVVGAVGVGCWLVPPAGLAA

SEQ ID NO: 167426 - protein, 252 aa, Triticum aestivum
  unsure (1)..(252): unsure at all Xaa locations
  Clone ID: PAT_TA_61844.pep
HPIRSIQSSPPTISPGNLRSERSEGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYXIQKESTLH

SEQ ID NO: 167427 - protein, 38 aa, Triticum aestivum
  unsure (1)..(38): unsure at all Xaa locations
  Clone ID: PAT_TA_61845.pep
MADVDVDPEVSAAGPKKRTFRKFSYRXVDLDVLMECIM

SEQ ID NO: 167428 - protein, 128 aa, Triticum aestivum
  Clone ID: PAT_TA_61846.pep
VCFGTPAWAATVGASSSPLWEPHRRAPLPPGPEGQPRVVASGAACTDASRGLRRRLSLLRRVASRLGAAFAGAEAVVCSVRSGRASRHARVRWASPRSSFRRPRAEAAPPHHGWCVGGRCLLNMCTCK

SEQ ID NO: 167429 - protein, 122 aa, Triticum aestivum; identical to SEQ ID NO: 132374
  Clone ID: PAT_TA_61847.pep

SEQ ID NO: 167430 - protein, 75 aa, Triticum aestivum; identical to SEQ ID NO: 106874
  Clone ID: PAT_TA_61848.pep

SEQ ID NO: 167431 - protein, 54 aa, Triticum aestivum
  unsure (1)..(54): unsure at all Xaa locations
  Clone ID: PAT_TA_61849.pep
NLIIKIIFNTYFYXIFFFLINIKNSINHNSTRNTTARHQHQACGHRHDQDNCYS

SEQ ID NO: 167432 - protein, 133 aa, Triticum aestivum
  Clone ID: PAT_TA_61850.pep
MRTAAAAAEAHQSRLLYELGALLLTILRSPLGPGEEPRQVTAAGVASMMLGASMALMLCGSVTFMLGFFLMPWVVGLACVFLFVGFLTNLSGIWRAILCWAAACSSSSPIRTPPHVRDPLFSASSPRGTDCIS

SEQ ID NO: 167433 - protein, 54 aa, Triticum aestivum
  Clone ID: PAT_TA_61851.pep
SSSSHPPGPRCGVLHAPSCLTSPQPSPSQTCSASAAGTGSSKQNSIRICNSITM

SEQ ID NO: 167434 - protein, 90 aa, Triticum aestivum
  unsure (1)..(90): unsure at all Xaa locations
  Clone ID: PAT_TA_61852.pep
MAIKRTKAEKKIAYDQKLCQLLEEYTKVLIAVADNVGSKQLQEIRKGLRXDSIVLMXKNTLIRRCIKVYSEKTGNKDFLEFRNLLVGNVG

SEQ ID NO: 167435 - protein, 157 aa, Triticum aestivum
  unsure (1)..(157): unsure at all Xaa locations
  Clone ID: PAT_TA_61853.pep
MAASTTMALSSPAIKLAGASYALGGGRVTMRKAAPKAAASNSPWYGPDRVLYLGPLSGEPPSYLSGEFPGDYGWDTAGLSADPETFAKNRELEVIHCRWDMLGALGCVFPELLARNGVKFCEVVCFKXDYHILSEGGLQYLGNPXLLHAHNILDIWS

SEQ ID NO: 167436 - protein, 207 aa, Triticum aestivum
  Clone ID: PAT_TA_61854.pep
LQPLLTHPTAHPFATAPRLRPSMRRAAAPPTLHAPPHHHAELHADLHAHLDGLETDVHPRLADLDAGSHTILSHREQAWLHDVGIGLDGLDANQILLQLGLHAQLHLRHTLTRGCKYAAGAGKRTSCAIWDDGTPACTQALDRRTQSSECCTLASEDSRCTTGSIANSACIANSKYVLCFLTFMEIKSFVLSMYKLLAACIGYISTI

SEQ ID NO: 167437 - protein, 101 aa, Triticum aestivum
  Clone ID: PAT_TA_61855.pep
EKKNSVYPLPMALLKNNPGVLCLAALLVISATFLSCDASYGIRDGEGFNKFCVGWDQACKDPVNGIPSQCQIYCRDNGFVLEKGKCAPDSGKPNRMCFCYK

SEQ ID NO: 167438 - protein, 174 aa, Triticum aestivum
  Clone ID: PAT_TA_61856.pep
KNKKIGGLGAPFPGKLAHIFAPHYAPLLNPCGGVGVFVGWGYPFCCSQGPQRPPRRWPFFSLSFFALFSPGFFPRKTLKLGGPLFGFRGFPFWAPPGPQKTFFKGVGSLFCGRPWGPLGALCFFFFFFFFFFFFFFFFFFFFFFFFFFFFFFFFFFFFFFFFFFWISRGPAGPS

SEQ ID NO: 167439 - protein, 85 aa, Triticum aestivum
  Clone ID: PAT_TA_61857.pep
GRSRRPAGFFPGYRPQFYMRTTDVTGNVTNIMNDKDEEAKMCMPGDRIKMVVELIQPVACEQGMRFAIREGGKTVGAGVINNIIQ

SEQ ID NO: 167440 - protein, 139 aa, Triticum aestivum
  Clone ID: PAT_TA_61858.pep
MAPKAEKKPAPEKTPAGKKPAAEKRPAAGKTASKEGGEKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 167441 - protein, 46 aa, Triticum aestivum
  Clone ID: PAT_TA_61859.pep
NVLRYLQHISVIDSQHRLNYTFGSLLVAAIYILYHDCSVKKRTNIE

SEQ ID NO: 167442 - protein, 88 aa, Triticum aestivum
  Clone ID: PAT_TA_61860.pep
FRKKKYIEDKKEKKSAYAPAPSSSWPAGQYRRSFFIFHRSIAARTVPHCGAVAVCTKLTKVTSTRSSLHFNRARAGSILLPGFFTTPM

SEQ ID NO: 167443 - protein, 81 aa, Triticum aestivum
  Clone ID: PAT_TA_61861.pep
KYIQFLTSRGIISSDRSKPRPHPPPPPDVQTLSRTSMPSTSTLMMNSQTLTTNPPVRIRTRTQYLHIMMGTAAMFSPANMP

SEQ ID NO: 167444 - protein, 191 aa, Triticum aestivum
  Clone ID: PAT_TA_61862.pep
ASSLAVRHEEGRLELDLLVPGIEESGGRAAKILSLRLPIDRAGGRGRRGWETRAARRWQERAGVVDEVEVLPHLGEDPLVGPVGVDGGEAVGRVDHHVVHHARAVVVHPHRHDHRHLLQLAPAAAAGVHVLLLLLVRAAAVLLVAVHPDMPYLQVRHGACPVAVAPFRQGEEQDDCHEKLDAPLPPHSHVL

SEQ ID NO: 167445 - protein, 81 aa, Triticum aestivum
  Clone ID: PAT_TA_61863.pep
FSTTLELLKDVKHSGAKVTIETCPHYLAFSAEEVPDGDTRFKCSPPIRDAANKDNLWEALLDGHIDMLSSDHSPSTPDLKL

SEQ ID NO: 167446 - protein, 171 aa, Triticum aestivum
  Clone ID: PAT_TA_61864.pep
MANPREFFDMTVGGAPAERIEMELYKDAGPRTEENFRALSTGEKGVGKSGKPLHYKGSAFHRVIPDFMCQGGDFTRRNGTGGESIYDEKFADEKFVHKHTKPGILSMGNAGPNTNGSQLFICTVPCNWLDGKHVVFGEVVKGMDVVKNIEKVGSRSGTCSKQVVIADCGQL

SEQ ID NO: 167447 - protein, 96 aa, Triticum aestivum
  Clone ID: PAT_TA_61865.pep
GPGERNRHPRPQSMLPVRLRRGSLVPLSGNFPPNGYFSQILFNLEPASETGSVIPALCLLKAEKGGELGIPGFARIPYARAFWLFCFFSPPTPCAR

SEQ ID NO: 167448 - protein, 171 aa, Triticum aestivum; identical to SEQ ID NO: 141856
  Clone ID: PAT_TA_61866.pep

SEQ ID NO: 167449 - protein, 75 aa, Triticum aestivum; identical to SEQ ID NO: 106874
  Clone ID: PAT_TA_61867.pep

SEQ ID NO: 167450 - protein, 80 aa, Triticum aestivum
  Clone ID: PAT_TA_61868.pep
RSNQQTHQTNKRFHTPAVSGSGPVATVPTHVAAVRPAASTRLARSMSPWKVAGGLKEERGHGGRRSEEDRSRSRRERRLG

SEQ ID NO: 167451 - protein, 176 aa, Triticum aestivum
  Clone ID: PAT_TA_61869.pep
MITMRAQLAPALLLLLLTVAAAPPVSAMTAEEETKEKLLQGAHKEDLANKLSIASVDPDAYAAEQKLVGPDSKKHAAKDVVDNTSYIMGVVPEKKPESKSDEKKLKEEAKVIAQVKGQMNYEDAVAEKNAKEEKKSKLKGDISEDDDAEKKEKKSKNKDGDKEEDKEKKSKNKDDD

SEQ ID NO: 167452 - protein, 232 aa, Triticum aestivum
  unsure (1)..(232): unsure at all Xaa locations
  Clone ID: PAT_TA_61870.pep
MDAGALQLAAAAVAIVVVAALVCRWFLVACAVGVRKQRPRLPPGSTGLPLIGETLRLISAYKTPNPEPFIDERVARHGGVFTTHIFGERTVFSADPAFNRLLLAAEGRAVSCSYPSSITTLLGAHSLLLKRGTAHKRLHSLTLTRLGRPASQPLLAHIERLVLATMXQWEPTATVRLLDEAXKITFNLTVKQLVSIEPGPWTESLRREYVKLIDGFFSIPFLSPHSSPSPTT

SEQ ID NO: 167453 - protein, 219 aa, Triticum aestivum
  Clone ID: PAT_TA_61871.pep
RGGRARKNKKKKKKKKKKKKKKKKKKKKKKKKKKKKKKKKKKKKKRAPRAPGGRPTGTPPQIKFLGARGPKRTKWKPKGDPPFKILRGKPGKRGKKGRKKRKGGGAKGVGKGRGHLGENPHPRRVKGPLKGGARGNFSGKGGGNPNWLIFQKTSKKEPPQEKKTRKKAPKKWKREKLGFSNFPGPPYPLFGGIWPPGFGPPKNAGERKKGEKSVGGTRG

SEQ ID NO: 167454 - protein, 185 aa, Triticum aestivum
  unsure (1)..(185): unsure at all Xaa locations
  Clone ID: PAT_TA_61872.pep
MQIFVKTLTGNTITLEVESSDTIHNVKAXKIQDKEGIPPHHQRXLIFAGKQVEXAAPXSDYNIQKESTLHLVLRLRGGAKESKKKTYTKPRKQKHXHKKVXFAELQFYEVDYDTGXATRLRKERPFADCGAGNLLANHFDRHYXGKRGLTYDYNHNAYRGIAIALLFYLSRIELLYMWSLVALET

SEQ ID NO: 167455 - protein, 139 aa, Triticum aestivum
  Clone ID: PAT_TA_61873.pep
LSSKPKVLPLHQSFPAPRSAHLVVCPPVPSGNFGVVLLGRGSGASGSLVTTPGWRPLRGGLDLLIPFLGPFTEPLVRRVVLGLGHLRCRKRRLVFVFLFFFFGLIRFYDFFFFFFFFFFFFFFFLKTNFSSQRKDRDEN

SEQ ID NO: 167456 - protein, 105 aa, Triticum aestivum
  unsure (1)..(105): unsure at all Xaa locations
  Clone ID: PAT_TA_61874.pep
SAPASSCSSILSLLSFLPSPPPTAKAGCLGGGGNCACGAVCKWGNGGAGCKMFPDVEATXALRMVCHRRHKASSSGFEMAAAEAGGCDCTTCECGTACGSSCCSC

SEQ ID NO: 167457 - protein, 122 aa, Triticum aestivum
  Clone ID: PAT_TA_61875.pep
RLWSCALRLSEYGDSILQQLIHLVDVVHHDLFLDVASGAVASIALGPASNTEEAIGADAVDAHVGTELVEAVRGSRFLCVVCVAMGQCLGPIGVLVQPAHRDSLVSGSRTIITISLYWDSIC

SEQ ID NO: 167458 - protein, 126 aa, Triticum aestivum
  Clone ID: PAT_TA_61876.pep
MFALRLGVAVARGGGEAGGDGGVVHGVVEALRLHHPHPQLPRLLLRQHPEPPRPCCTSSSLLLRRRLSVDVVGLARPTQQRCPPLPVGAAEPRPAGGRGSARAEPAGARRRGAGGERGRGPRRHRH

SEQ ID NO: 167459 - protein, 56 aa, Triticum aestivum
  unsure (1)..(56): unsure at all Xaa locations
  Clone ID: PAT_TA_61877.pep
MCCDVIDSEISAGREKRRSRWLGIDSIATDXAMRQMIEDVNGQYLNGRYIIVNEAE

SEQ ID NO: 167460 - protein, 90 aa, Triticum aestivum
  Clone ID: PAT_TA_61878.pep
MLFISEAPTQPRTSCCGGNCGCDTACKCGNGCGGCNMYPEAEAAGDTLLVSDTATHKASSGGMEMAAENGGCGCTQRKCGTSCGCSCCSC

SEQ ID NO: 167461 - protein, 120 aa, Triticum aestivum
  Clone ID: PAT_TA_61879.pep
GRSEKARRWWGSPGLRRRSATAHPAFWMTPTPYIFIGFTLMMGIIAVALLVLVCTHREPSGSSRRGSAAEEASARGMAPLDREPKVVVSMPGDDLPSFLASARPFAFPDVVEPPRQADVA

SEQ ID NO: 167462 - protein, 64 aa, Triticum aestivum
  Clone ID: PAT_TA_61880.pep
AMPELKVRKTNPSSVSHENSAIAGAAADPCWCCYRRKPRPPRGVAEKKKKKFFFFFFFFFFFFF

SEQ ID NO: 167463 - protein, 133 aa, Triticum aestivum
  Clone ID: PAT_TA_61881.pep
MEAMRKKEATATACSEDNRKGVHGVSMNGLYDPWNPAYPPRDPSPCDADMAAHIASVKEWMDKTQAILANSRATNIIIPDRTPQFVNDVLFDILPALVPILEKDNVRSFLRFFNENGRAMSWGFIITPETLTR

SEQ ID NO: 167464 - protein, 54 aa, Triticum aestivum
  unsure (1)..(54): unsure at all Xaa locations
  Clone ID: PAT_TA_61882.pep
SQTKMHYVCASLYRLGFIKCSNICNISMYLFVDFEKLKQLSMNFPISFDRKXSS

SEQ ID NO: 167465 - protein, 101 aa, Triticum aestivum
  Clone ID: PAT_TA_61883.pep
MSGRGKGGKGLGKGGAKRHRKGLRDNIQGITKPAIRRLERRGGVKRISGFFYEETRGGLKIFLKNVIRYAVPYTEHALRKTVTAMKALHAFQHHVRTFKGF

SEQ ID NO: 167466 - protein, 75 aa, Triticum aestivum; identical to SEQ ID NO: 106874
  Clone ID: PAT_TA_61884.pep

SEQ ID NO: 167467 - protein, 128 aa, Triticum aestivum
  Clone ID: PAT_TA_61885.pep
MAAATATATAADDEARLLRLEEQAEHGGGGAWEYLSLARRLRARRPAPVLRLGLSLLNDASARSRLASEQWTLYEQVAVPAMFCHRLDVAQACIGVLSTQFPASVRVWSLEALMFPAKGDCAESARAY

SEQ ID NO: 167468 - protein, 62 aa, Triticum aestivum
  Clone ID: PAT_TA_61886.pep
WLSKPCRPCLHGAAKMILDWTCSCCVREMLPVLQQKFNCLFPPILEQLCSFIEFSDSFSNKI

SEQ ID NO: 167469 - protein, 92 aa, Triticum aestivum
  Clone ID: PAT_TA_61887.pep
LLALLHETRICTLGTWEGSHTSIQRRKTSPSYIFPVRVIVPRHSWNRAVLRSFIKNTYLFFFFFFFFFFFFFFIFFFFFFFFFVFPGPAGPS

SEQ ID NO: 167470 - protein, 55 aa, Triticum aestivum
  Clone ID: PAT_TA_61888.pep
SNSRFLTSKITVSFAENNRRHTTHPISPTEDKPLMVNLPLPVKRKCWWHMKPARS

SEQ ID NO: 167471 - protein, 161 aa, Triticum aestivum
  Clone ID: PAT_TA_61889.pep
KKKKKKRSTPASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 167472 - protein, 119 aa, Triticum aestivum
  Clone ID: PAT_TA_61890.pep
TGNREAPKPKKGNMFHPENSGGPSQGGSLLKGLFNRGYFGKWANICSSSHFSEKFSVPPPFAGHLGSSRMVFPPIKPPRCPAPYIFPPSLSSLPSSSPFPVLPCKLLMGGCLSRSALNL

SEQ ID NO: 167473 - protein, 78 aa, Triticum aestivum
  unsure (1)..(78): unsure at all Xaa locations
  Clone ID: PAT_TA_61891.pep
MGGDNAHNSKMATHRNHQKLNHDKDSQVDANKKAMXIHGKICMHTCICTTSEAKCNEHAXEAKHPKRDLVHRFPHLKQ

SEQ ID NO: 167474 - protein, 159 aa, Triticum aestivum
  Clone ID: PAT_TA_61892.pep
ANPGRGRPRSRGMDSEGRFGVFPKFGGDNFEGQPSLLWIPLPTSRVSDGGKCPQVGQSKGFCSFWLGQCEDPPPLVLIIGGDDGFGQDIRGSDRGGGGGTETSLTGHLAPPPVPGQAFLNQKIAYMHFFFFFFFFLFFFSYVFFFFCYNFFFFFPLFGI

SEQ ID NO: 167475 - protein, 215 aa, Triticum aestivum
  Clone ID: PAT_TA_61893.pep
ISWFLSPSASLSNLQSELAQSTHAGADTGTSTMAAPPAERSFDVIVVGAGIIGSCAAHAVASRGASVLLLERFDLLHQRGSSHGESRTTRPTYTRPQYPPMVRLAHRLWHEAERDAGYTVLTPTPHLDLGPRDAPAFVAAMANGGATELAPAGDASRPAWAEAFRVPEGWAAATSGPAGVIKATKAMVMFQTLAAKMGAVVRDRRGGRRPQARRR

SEQ ID NO: 167476 - protein, 72 aa, Triticum aestivum
  Clone ID: PAT_TA_61894.pep
IFSLGRIRGGRPVYLTVENPSHGAVRCGSTLESRVRRFPLSQWEKLRKTVCTLICDMWITYFFSVDMADGIW

SEQ ID NO: 167477 - protein, 171 aa, Triticum aestivum; identical to SEQ ID NO: 141856
  Clone ID: PAT_TA_61895.pep

SEQ ID NO: 167478 - protein, 265 aa, Triticum aestivum
  unsure (1)..(265): unsure at all Xaa locations
  Clone ID: PAT_TA_61896.pep
FSQSPSRRRRHQQQRGRDGGRGRGPGGGGGAGXQEAKRAAAAAYDYEADPRWADYWSNVLVPPHLAARPDVVAHFRRKFYQRFIDRDLVVEPMSTTGSTQPSRPDIRSSPSASTESVRARNSGSSSRSAAPPPAAPQAGAASPLRFDAKTIHFSVNAWVLVVAGLGMLPILPKHLADRACKLSLLGTVLSSGYSLYSTYGKPRELNMAAIQGWLQSVLGAKDFIHLMFSLLLVTSQLHLKIAALPVFCWALDHVARFLRRNFSRS

SEQ ID NO: 167479 - protein, 198 aa, Triticum aestivum
  Clone ID: PAT_TA_61897.pep
MRFLRGWLLLPTQSSVPGPVPFRSLGFSSSGEEEGMADVEYRCFVGGLAWATDDQSLQNAFSKYGDVIDSKIITDRETGRSRGFGFVTFASDEAMRQAIEAMNGQDLDGRNITVNEAQSRRSGGGGGGGFGGGGGGYGGQRREGGGGGGYGGGGGGYGGGRSGGGGGYGSRDGGGYGGGGGGGYGGSRGGSGGGNWRE

SEQ ID NO: 167480 - protein, 121 aa, Triticum aestivum
  Clone ID: PAT_TA_61898.pep
AYADRRIFTCIKSCLKTDPTNQITTTTEKKRARPDGYPIRQYYMKQLLDWSEGKQTAGVMRWMDRSALDGLDLVPRLLAEVADDPDALEHRHLHLHGPLLHLPLEPSHLSSLPFSSLLFLV

SEQ ID NO: 167481 - protein, 122 aa, Triticum aestivum
  unsure (1)..(122): unsure at all Xaa locations
  Clone ID: PAT_TA_61899.pep
MSRGWKGGERQFAKARGQSPTVTGLRQTFHAITKPEIRNLGSIRDYKRIXSLFIYQETPGDLKTFLKNVIRNPATXDRHPHGKPVTPRDAGYALKRLGPTLYVFVVGDPSVRWLTLLFLAEF

SEQ ID NO: 167482 - protein, 59 aa, Triticum aestivum
  Clone ID: PAT_TA_61900.pep
GGKAKPLKQAKVAEKDYDENDLAYLHKKKDEQKALKELKVKAGQKGALGGSVLQKSGKK

SEQ ID NO: 167483 - protein, 171 aa, Triticum aestivum; identical to SEQ ID NO: 167247
  unsure (1)..(171): unsure at all Xaa locations
  Clone ID: PAT_TA_61901.pep

SEQ ID NO: 167484 - protein, 83 aa, Triticum aestivum
  Clone ID: PAT_TA_61902.pep
SFLCTEATAEFIFSCFSLHGEIRKSFLQKKTEVGHQYEQDKCTAFDWSASDADWQIRRTFLLGFALIYFRLNRKIGASPFCFI

SEQ ID NO: 167485 - protein, 158 aa, Triticum aestivum
  Clone ID: PAT_TA_61903.pep
FSEEQFAGTFEGRRPCYFNTGVMVLDLARWRRAGYTRRIERWMEIQKSPPGRIYELGSLPPFLLVFAGQVAAIEHRWNQHGLGGDNILGSCRDLHPGPVSLLHWSGSGKPWARLGGGRPCPLDALWARFDLYGPDAVEPYRQPTARTQTTTTTKILFL

SEQ ID NO: 167486 - protein, 126 aa, Triticum aestivum
  unsure (1)..(126): unsure at all Xaa locations
  Clone ID: PAT_TA_61904.pep
MSRIFLDKATWMWDVIVLDVLSSRDTLNARNITTTDAVDAIKDPPXTPLPSRPXNLLPKIPPAFHNCCMMTGFALPGKIGAATLFNRXVTLPFLGDSSPGLLMSPSLEVFGEHAAYPLCHCLQRIA

SEQ ID NO: 167487 - protein, 116 aa, Triticum aestivum
  unsure (1)..(116): unsure at all Xaa locations
  Clone ID: PAT_TA_61905.pep
EGHCYLNMYQDDRDTTRYGLPVASCTRRWRSVHRWCDPCIQIIWTATQDLKLCYMYNCIXCHYSKYXFPLWHHNARPPTRKIKTTYWLTRSILFVRVTPYSTALCVLACNSLKIIE

SEQ ID NO: 167488 - protein, 219 aa, Triticum aestivum
  unsure (1)..(219): unsure at all Xaa locations
  Clone ID: PAT_TA_61906.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLXEVESSDTIDNVKAKIQDKEGIPPDQQRLIFAGKQLEDGRTLPDYNIQKEST

SEQ ID NO: 167489 - protein, 67 aa, Triticum aestivum
  unsure (1)..(67): unsure at all Xaa locations
  Clone ID: PAT_TA_61907.pep
EKNFFVFWFLLFRSFWVRLGFFFFFFFFIFFFFFFLFFFFFFFFFFFFFFFFFFFXFCIPGPGRPLE

SEQ ID NO: 167490 - protein, 60 aa, Triticum aestivum
  Clone ID: PAT_TA_61908.pep
CTCPTVLSSVRPRDNVVRKPGSQFQMLLRKSGTSLFPVYHGRCMSLKTEMCCGESLKMCL

SEQ ID NO: 167491 - protein, 102 aa, Triticum aestivum; identical to SEQ ID NO: 124553
  Clone ID: PAT_TA_61909.pep

SEQ ID NO: 167492 - protein, 139 aa, Triticum aestivum; identical to SEQ ID NO: 109909
  unsure (1)..(139): unsure at all Xaa locations
  Clone ID: PAT_TA_61910.pep

SEQ ID NO: 167493 - protein, 195 aa, Triticum aestivum
  Clone ID: PAT_TA_61911.pep
MRNQKSRVQECKVEHIDLIPGMPDDVAVDCLARVPHASFRSMRGVCRGWNSAATAPDFALARAEAGANEDLVYLLQFGNPAAADADGVAPENAQAYGVSVYNVTTGEWRREGAAPPVPMFAQCAAVGSRLAVLGGWDPKTFEPVADVHVLDASTGVWRRGAPMRSARPFFACAEADGKIYVAGGHHKLKNALKTA

SEQ ID NO: 167494 - protein, 78 aa, Triticum aestivum; identical to SEQ ID NO: 106977
  Clone ID: PAT_TA_61912.pep

SEQ ID NO: 167495 - protein, 75 aa, Triticum aestivum; identical to SEQ ID NO: 106874
  Clone ID: PAT_TA_61913.pep

SEQ ID NO: 167496 - protein, 128 aa, Triticum aestivum
  Clone ID: PAT_TA_61914.pep
GDPQGWEFWEKLPPGGPFKPVGLPTEPKKGGVFKGKGNKKGGGAMVPRGGFFIQGKGPGGGPFEKRGGDLKDPFGKKRVTGFFGAPKRGPHLGSGPLLPPPPRPFVREPLAGNAPKEIFGGGGFFRGK

SEQ ID NO: 167497 - protein, 78 aa, Triticum aestivum; identical to SEQ ID NO: 106962
  Clone ID: PAT_TA_61915.pep

SEQ ID NO: 167498 - protein, 84 aa, Triticum aestivum
  unsure (1)..(84): unsure at all Xaa locations
  Clone ID: PAT_TA_61916.pep
MAGRKGGERKKEVTRSVKVGLQFPVGRIGRFLKXGRYAQRVGSGDPVYLVAVLEYLAAEGLELVGNTNYDNKEYAHRDEQAADG

SEQ ID NO: 167499 - protein, 75 aa, Triticum aestivum; identical to SEQ ID NO: 106874
  Clone ID: PAT_TA_61917.pep

SEQ ID NO: 167500 - protein, 97 aa, Triticum aestivum
  unsure (1)..(97): unsure at all Xaa locations
  Clone ID: PAT_TA_61918.pep
MKGTKVAEILILQSALVMGDLXQVNADYFPKCCNNCRSFSGDEDCHDRHHMXTTGWSMCPEVSTRPKMWRCTDMKSTENSACIEIWKNDCSCQGAMV

SEQ ID NO: 167501 - protein, 119 aa, Triticum aestivum
  Clone ID: PAT_TA_61919.pep
TQKGKKNNKKKVSMSCDKSRSKAMTMVAKANGVSSVGITGDSKDMLEVVGNGVDPVCLVGCLRKKYHDVHLVKVEEVKDDKKKDEKKEDPPPYWYHHPYGPYPPHMVVCDEPTTPCAIM

SEQ ID NO: 167502 - protein, 118 aa, Triticum aestivum
  Clone ID: PAT_TA_61920.pep
LSSFCREIFTQDYQEPTNFNHNTIYRHIIKRMSDKREARASNTHLLHHRRRDKGHQCRGHQGQRGHAGGRANVRRWSGGRGRRHEVLCGRRGKEDGHGQEQHGDSCSHHDSRVHDLAL

SEQ ID NO: 167503 - protein, 250 aa, Triticum aestivum
  unsure (1)..(250): unsure at all Xaa locations
  Clone ID: PAT_TA_61921.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKGEEIKNGRLAMFSMFGFFVQAIVTGKGPLENLXXTLXRPV

SEQ ID NO: 167504 - protein, 78 aa, Triticum aestivum; identical to SEQ ID NO: 106976
  Clone ID: PAT_TA_61922.pep

SEQ ID NO: 167505 - protein, 218 aa, Triticum aestivum
  unsure (1)..(218): unsure at all Xaa locations
  Clone ID: PAT_TA_61923.pep
MAALTASIATSSAFAAKPRLARPPARLSVSCSASSGDNNTPSLSASIKTFSAALELSSVLLSSAATSPPPAAADIDGLTPCKESKGFAKREKQSVKKLNSSLKKYAPDSAPALGIQATIEKTKRRLENYGKFGLLCGSDGLPHLIVSGDQRRLGASSSPHGVLFLYIAGXSSDHVRRYLIVGSGENKTVMPKIVIGVQLADRIMPRGYIWCRLAYREI

SEQ ID NO: 167506 - protein, 168 aa, Triticum aestivum; identical to SEQ ID NO: 124110
  Clone ID: PAT_TA_61924.pep

SEQ ID NO: 167507 - protein, 227 aa, Triticum aestivum
  Clone ID: PAT_TA_61925.pep
MAAQSLLFAAAAPLFQAPASARPFQSLRIVCTPEGATAAARALVVADATKKAVAVLKGTSQVEGVVTLTQEDDGPTTVNVRITGLAPGLHGFHLHEFGDTTNGCISTGPHFNPNGLTHSAPEDEVRHAGDLGNIVANAEGVLSFNCGGLGVAETTIVDSQIPLTGPNAVVGRAFVVHELEDDLGKGGHELSLSTGNAGGRLHVGVVGLTPLVAGFHLWFCISSHTGF

SEQ ID NO: 167508 - protein, 127 aa, Triticum aestivum; identical to SEQ ID NO: 124219
  Clone ID: PAT_TA_61926.pep

SEQ ID NO: 167509 - protein, 95 aa, Triticum aestivum
  Clone ID: PAT_TA_61927.pep
LLESLKLFRMLVQNLSAFFLKTKQFVDTDKESLSDQLMSLSLKRKIHHSLAVPWRRITYRCLIRPPMQKGPNHLSLSMLEAIRASGADRSRNIAW

SEQ ID NO: 167510 - protein, 78 aa, Triticum aestivum; identical to SEQ ID NO: 106966
  Clone ID: PAT_TA_61928.pep

SEQ ID NO: 167511 - protein, 151 aa, Triticum aestivum
  Clone ID: PAT_TA_61929.pep
MAAHGKPKPKPPGAPAPPPPPPPPPTAAEAKKGFMRRMFPFLLAVNAFVGAYVLVRTYYKDSPAKTADSASATATASTSSAAAAAESTDPPVATPAKVLPPIPEDEQRRVYKWMLEEKRKVRPRDAAEKKRLDDDKALLKQIIRADTLPVL

SEQ ID NO: 167512 - protein, 156 aa, Triticum aestivum
  Clone ID: PAT_TA_61930.pep
TKKTPASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 167513 - protein, 271 aa, Triticum aestivum
  Clone ID: PAT_TA_61931.pep
HIRSDPIQSSPPTISPGNLRSERSEGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLPSPVVSKLLMELLLS

SEQ ID NO: 167514 - protein, 171 aa, Triticum aestivum; identical to SEQ ID NO: 141856
  Clone ID: PAT_TA_61932.pep

SEQ ID NO: 167515 - protein, 74 aa, Triticum aestivum
  Clone ID: PAT_TA_61933.pep
MSGLEELKKKLQPLLFDDSDKGGVSTRVPFPEDTCDSYVVSDGGTINLLSRSFGEYNINEHGFHHPRTGPEEPD

SEQ ID NO: 167516 - protein, 91 aa, Triticum aestivum
  Clone ID: PAT_TA_61934.pep
MQKCRSVPHEHAAAAYYGCGGGYDYEDVSRGTAVKSYSFNGPSAGEDPEAKRRRRVASYNVFASQARIKSSVRGSFKWLKSKLSDVRYGGL

SEQ ID NO: 167517 - protein, 103 aa, Triticum aestivum; identical to SEQ ID NO: 107316
  Clone ID: PAT_TA_61935.pep

SEQ ID NO: 167518 - protein, 110 aa, Triticum aestivum
  unsure (1)..(110): unsure at all Xaa locations
  Clone ID: PAT_TA_61936.pep
MPNSTSTARKGRRSAWPAARPXXXPRXXPXPGPXRXXTTPRRPPRTRRRRXPTPPRTTRRPTTRPRRGPPKDRRQPPGQRATTDTRPTTTTTTTREPESKAERKGPNEAD

SEQ ID NO: 167519 - protein, 116 aa, Triticum aestivum
  unsure (1)..(116): unsure at all Xaa locations
  Clone ID: PAT_TA_61937.pep
THSQGGXLAAAATAGAAPAASAATAAAGARCSPTWRPPPARPPWPCPPPPTRGAPEGTKXPTGRPVAATAPPASAAPRAAAPAAPATEPPHKRPTGRGEHHDEXRRTKESSSPPPP

SEQ ID NO: 167520 - protein, 54 aa, Triticum aestivum
  Clone ID: PAT_TA_61938.pep
GPRPAPPSGFWLRALAISALLECWPVRCSACSPSRVWKLLKGGSKVGVRWCRAA

SEQ ID NO: 167521 - protein, 125 aa, Triticum aestivum
  Clone ID: PAT_TA_61939.pep
PQKKKNPPQKPTHTPKQKINPPPNPLFPQRGAQKKNNPNKEPPKKYKLDPTNLSKLQKGREKKPQPIFFTPPQKKTAPRGENHPPHRIGGATTPLTGGYIPQKGGRQHSFLIHTPSQKNTSQKGQ

SEQ ID NO: 167522 - protein, 187 aa, Triticum aestivum
  Clone ID: PAT_TA_61940.pep
MVFGSGFPYKLDRPSIYSMNLAVILLTLKKKKKKKKKKKKKKKKKKKKKKKKKKKKKKKKKKKKKKKKKKKKKKKKKKKKRGPKDPKGAKKKEKPPKKNFLGKRGKKKKKGNQKGDPPIKKGGEKAEKRGKKKKKKAKGGGQKGGEKGGNTLGKKPKTPGLKRPQKGGKKGNLFGKKKAGKTRMVNI

SEQ ID NO: 167523 - protein, 91 aa, Triticum aestivum
  unsure (1)..(91): unsure at all Xaa locations
  Clone ID: PAT_TA_61941.pep
DHNPKSPTKSPPLLSRGTTSTSHRTWTXSATGAGAKAKKGAAGRKAGGPRKKSVTRSVKXAGLQFPXRXRIGRYPSRRARYAQARRERGGP

SEQ ID NO: 167524 - protein, 150 aa, Triticum aestivum
  Clone ID: PAT_TA_61942.pep
SVICCSDGNSSKLHTVSYVNVEALASTYMHSVVLIIWVLFIEQIIYQCHRYDHCVIDSLECIHVDGFIHSCTMTIGTGEVCAMGNTQTGWYEEAVFGQGGKYAARKSASSSMPAHCDGWPASSGQTLCRHGIMPLQHLQPAAATISSSAH

SEQ ID NO: 167525 - protein, 79 aa, Triticum aestivum
  Clone ID: PAT_TA_61943.pep
PPKRLEDGLMFARRAAPGSPSGAFFWPFFELGESPVIDNSGTPSSQGTSYEHFKMHAAGNRQPPVYFPLLFRVCLFLFW

SEQ ID NO: 167526 - protein, 83 aa, Triticum aestivum
  Clone ID: PAT_TA_61944.pep
ASITNVLHVENNLSRRKLSPGRIQDYSRNYLLILLCSRHHISFHQVMQQLKIHKDVVSPWARLFASLVASSGTVGSLGTNNIS

SEQ ID NO: 167527 - protein, 156 aa, Triticum aestivum
  unsure (1)..(156): unsure at all Xaa locations
  Clone ID: PAT_TA_61945.pep
MDVSGTGACAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPXVLLPKRTAEKEAKEPKKTTKSPKKATKA

SEQ ID NO: 167528 - protein, 170 aa, Triticum aestivum
  Clone ID: PAT_TA_61946.pep
SSRNKESPNNPNVGGQIKAGAYTGSGMWAGARSDRQLTHPSQPASIHPIRGGSVPAGADQPGVGPAHVFRRVSHHLLRSFLALHRPRQAPTLLLPCRSGRRALAPRCLPATHALPLLPAPSYSPTPSALPRDGEVVVVAGPQGQRGEVVRVEKETAGQDRWILMSSWAGR

SEQ ID NO: 167529 - protein, 73 aa, Triticum aestivum
  unsure (1)..(73): unsure at all Xaa locations
  Clone ID: PAT_TA_61947.pep
CNCGSXCSCGSDCKCGKMYPDLTEQGSAAAQVAAVVVLGVAPENKAGQFEVVAGQSGEGCSCGDNCKCNPCNW

SEQ ID NO: 167530 - protein, 46 aa, Triticum aestivum
  unsure (1)..(46): unsure at all Xaa locations
  Clone ID: PAT_TA_61948.pep
TDRFFHILNGGKIKWGFRVIPSPRELINQSQSKNKKNXKNRRIHPC

SEQ ID NO: 167531 - protein, 140 aa, Triticum aestivum
  unsure (1)..(140): unsure at all Xaa locations
  Clone ID: PAT_TA_61949.pep
MATVPAPAAETAASTARTVKDVNPHELVKAYSAHLKRSGKMELPQWDDIVMTARFKELPPSDDDWNNIRAASTATKHHLTQGIGIGGFQKIYGVRQKNGSRPPRFWHSSGACALKXIANMCTTMPIQDVCPKAARIITSH

SEQ ID NO: 167532 - protein, 127 aa, Triticum aestivum
  Clone ID: PAT_TA_61950.pep
PPKSPLTAPEKSPYTGCAHIFPTSSTFPFPNPHIKLLWFFCLPHPAHFPYYPPNTLTWGLPSCLSLHLLRPPPSKYKSWAPFSLPIPPFAPPGPLFFFFFFMFNNSSSLFIPLSPFFFFPFFCYFFF

SEQ ID NO: 167533 - protein, 48 aa, Triticum aestivum
  Clone ID: PAT_TA_61951.pep
GRSRRRAGALSPRHHLSTSPKMQRLQRAGERLTGGPTPRRVTTLQLQT

SEQ ID NO: 167534 - protein, 111 aa, Triticum aestivum
  unsure (1)..(111): unsure at all Xaa locations
  Clone ID: PAT_TA_61952.pep
GNNLLTNYKAGAMSLAKALVDKEDDMANHETFDPIEGHKLPTYKFHIAQQIMTRCDFIRDLDXMHRAFREICSEPGFDKHLELTIERIAAIESLGRTRELVTNFVQRLDVR

SEQ ID NO: 167535 - protein, 91 aa, Triticum aestivum
  Clone ID: PAT_TA_61953.pep
RHLLLLEIFLGSQIWRIVCHCGSGCSCGSDCKCGKMYPDLTEQGSAAAQVAAVVVLGVAPENKAGQFEVVAGQFGEGCSCGDNCKCNPCNC

SEQ ID NO: 167536 - protein, 130 aa, Triticum aestivum
  Clone ID: PAT_TA_61954.pep
GAGRKPPSSACARCSTPPSRTRRSASGGSPCPGTRWRRSTSAGAGWRSGSARSPSTRTWPSTWSPTPTRRRLAPGTPSPASRTTTTMMTTAMAGGSATRPGGPSAAPGARQGGGASTTGCRPARRRWLSR

SEQ ID NO: 167537 - protein, 108 aa, Triticum aestivum
  unsure (1)..(108): unsure at all Xaa locations
  Clone ID: PAT_TA_61955.pep
ESRSASLPKTRSXXPPXPPPPPPQLCRPPRDPTPARAPXPXRAGXPPPATATXTXPASAATTRRPSPRKKQQPNTEDKKRPRKDAGEPQRTTTPQAERRPPAPRAETQ

SEQ ID NO: 167538 - protein, 95 aa, Triticum aestivum
  Clone ID: PAT_TA_61956.pep
SFLLISEGCVEMNSKHAITIAILLAMSVTSLPFVAARRLPELNHGLPERKVLAISTPVKGAKERMYARDEKIIIGLPNTMILPRPPSPSCKAKAC

SEQ ID NO: 167539 - protein, 121 aa, Triticum aestivum
  Clone ID: PAT_TA_61957.pep
NQTREEGHLFHPHTGVELAALDAGAKCAAREKTTAEKGTDKKKPAPKNDHTRPGDSQTEEEPRQHGSEERQPTTNKGDPREAPRPKPPDDPPNNRIQTKNGKKNGSNEDHPTEHQNGKTHQ

SEQ ID NO: 167540 - protein, 128 aa, Triticum aestivum
  Clone ID: PAT_TA_61958.pep
YIQWPSPLAVVLRVSLSITHGLTLTIFSAKMTRTATLSTLLLLPLAFLLLLPVPVPAPRGTICTSQIIRNTISPCDREGCLFWVAYAQIGCPTGAVCDWNGVCSRHDCNFTLCKNYGNHPAAATTLLP

SEQ ID NO: 167541 - protein, 146 aa, Triticum aestivum
  Clone ID: PAT_TA_61959.pep
MDPMDIVGKSKEDVSLPKSTMTKIIKEMLPPDVRVARDTQDLLVECCVEFINLLSSESNDVCSRDDKKTIAPEHVMMFLGKSCTSGARAKQTTSSPPSMSLQNEGDADHGRRISLVVLFVKKIECATVVTVVKVIDWYLVWCVVQR

SEQ ID NO: 167542 - protein, 75 aa, Triticum aestivum
  Clone ID: PAT_TA_61960.pep
SQKKKKKKKKKKKKKKKKKKKKKKKKLNKIPPNEQKKKHPRNSEEKKRGPGPRCTLCSRQRTWSSPSAALTSFPT

SEQ ID NO: 167543 - protein, 144 aa, Triticum aestivum
  Clone ID: PAT_TA_61961.pep
NKNSAASFTPIHACKRARATNATLPPPPPLLHHHSSSNLERTNEQRHTTPRQSVVEVVGEEGDDERDGGGHGGGGRSAAGGGARGAAGGAGGAGGRLGGEHRGRRGSDNKSGEEHLLHLHRLGTYGRRGGGRAGEKASARLRLS

SEQ ID NO: 167544 - protein, 126 aa, Triticum aestivum
  unsure (1)..(126): unsure at all Xaa locations
  Clone ID: PAT_TA_61962.pep
MAAKMDMFEKTLMVTTITLEXVEFSRPIHNPKVTIHHKEGIPPKQKRLIFLXNHVEDGRXLDDYHIKHMSPHSTLEILLRVDAIIRKTKSYTLPCKQKXHYYKMVKLGALLFYEVNNATANVTKIM

SEQ ID NO: 167545 - protein, 81 aa, Triticum aestivum
  Clone ID: PAT_TA_61963.pep
KRGGLSSRKHNYSPGANNSEPPGPSKQGQRAAPTRSGCWSWSRPGTPGLLPVLQKHPPKKRLWCPGCRGTPLGSPGLPGPP

SEQ ID NO: 167546 - protein, 97 aa, Triticum aestivum
  unsure (1)..(97): unsure at all Xaa locations
  Clone ID: PAT_TA_61964.pep
QEGRGDAAAVWPRKTARAREGAGSEGTAGETTPARKRRTRDNKRPQQDPPAGNSGAPHDNNXTHRNADKRGPDDTPREGGTDKPTPQNTEENPNKPP

SEQ ID NO: 167547 - protein, 119 aa, Triticum aestivum
  unsure (1)..(119): unsure at all Xaa locations
  Clone ID: PAT_TA_61965.pep
PPKARXNSKXXAAAEDPAAAEQXXAGREATAARASGQEDXKHAPSEANXTGRAXPTSKEGSPGEQGQNGRARSTPDRKIACRCLKSLATSIKPINMGKDSGGPAKSGVSVTFPISMRTN

SEQ ID NO: 167548 - protein, 147 aa, Triticum aestivum
  unsure (1)..(147): unsure at all Xaa locations
  Clone ID: PAT_TA_61966.pep
TETARXISRDXRHKRXATGAKRANXRKKRXXEAXRQGANTRKGPKRXHTXRTRGXNHKXRAXRXDTGNNAGGPEGPTRKTRGXADAHHPXNNEXDRTNTPTKSADDQGEAATXRQRNEXHDGQATGRRRQKAPGRQGGEPRREARRP

SEQ ID NO: 167549 - protein, 106 aa, Triticum aestivum
  unsure (1)..(106): unsure at all Xaa locations
  Clone ID: PAT_TA_61967.pep
MQIFVKTLTGKTITLEVESSDTIDNVKAKIQDKEGIPPDQQRLIFSGKQLEDGRTLADYNIHKESTLHLVLRLRGGVMNXQNNTYSKLMKXNDKHNKVILAALHFY

SEQ ID NO: 167550 - protein, 108 aa, Triticum aestivum
  Clone ID: PAT_TA_61968.pep
SASFPIGVEFVDSWHDLGVSSRAPSIMSSVLWRSAMPSSMLLSSLSADFTIFFLLTSGFTVIFRSSLKAQTPTSSCCPCAQRLHLGPHPLPGHRSCGEDSSSPPEVAE

SEQ ID NO: 167551 - protein, 259 aa, Triticum aestivum
  Clone ID: PAT_TA_61969.pep
LTLFSFLGLSHGSREQPATSFFPVECTGQRGRLARAGCRWRRGGEQEDGPSGWGRRGPAAARGVRAGTPGAGQQSGTRARRRPGATSQLGMQRRRPSELWGRLAGEAEDAGVASGDWARGARASRLAGCDEELRAGRVASRQTRWGSRRSAGSAEAAADGSDPTVWSSRRDETEPAASGAGPSAGTASTRGGGAGEAGPTAGRRGGARRVFGRRYCAATRRWRGRAGWVDACPVGRGMRDGGQRLRAQVPLMELNAALC

SEQ ID NO: 167552 - protein, 110 aa, Triticum aestivum
  unsure (1)..(110): unsure at all Xaa locations
  Clone ID: PAT_TA_61970.pep
CGGNCGCGDGCKSXNSCGASKMFPNVDATDGAAGMCMSTASHKESSAEYDNDGLDRSLRLHHLKALHRLLMLLAVPANETPPKMPIDKGDHNDDMDKQTSTIITTSPPPS

SEQ ID NO: 167553 - protein, 197 aa, Triticum aestivum
  Clone ID: PAT_TA_61971.pep
MSSHFSHGGISSTSSSPASSFSAALGATPPAAPAIAADITAQFDISEYLFEEGAFAATLPPVVSVPAVGAAAASSATAVTARSAESAAAAERPRTERIAFRTRTEIEILDDGYKWRKYGKKSVKNSPNPRNYYRCSTEGCSVKKRVERDRDDPAYVVTTYEGTHSHVSPSTVYYASQDAASGRFFVAGTHPPPGSLN

SEQ ID NO: 167554 - protein, 131 aa, Triticum aestivum
  unsure (1)..(131): unsure at all Xaa locations
  Clone ID: PAT_TA_61972.pep
RSSRXGPGDTHPXCRRRVIPPRGSXGSXXXXPPXTXRFHPGRPGRRGPRAADADGPXGARRREPRGARAPAPPRRGRERRRPRGGGTRRRTGATRXQTGRTGETETGXTRPPGAKXPTRKPPQRRATGRRG

SEQ ID NO: 167555 - protein, 113 aa, Triticum aestivum
  Clone ID: PAT_TA_61973.pep
LASFPRRHPPRKGGCLAAAATAGAAPAASAATAAAGARCSPTWRTPPAPPPWSCPPPPTRGAPEGSRRPGRPAAATAPPASAVPRAVAPAAAATEPAPIRSAGRGEHEDEEDK

SEQ ID NO: 167556 - protein, 136 aa, Triticum aestivum
  Clone ID: PAT_TA_61974.pep
LSAQASAAAPPSGLSFLLRSKMKFIAAYLLVYLSGNPSPSAEDLTSILDAAGCEIDNEKMELMLAQVNGKDITDLLAAGRDKFAVLPSAARGVDVSAAAPAAVGAARTHAAESNKEHNVVDNEDSDDASCLFTLFD

SEQ ID NO: 167557 - protein, 143 aa, Triticum aestivum
  unsure (1)..(143): unsure at all Xaa locations
  Clone ID: PAT_TA_61975.pep
IAAVSSPRLHSPLPPPPPPQPPCESISRVGEXRTPWTCPSTTSSPRTSHPPSAAVAAATRPRARALAPRRGDPHPPAAASRLAPPPALPPRPTTNSTSSPRRRRFLHMLPSRPMPMPTPRRWPWWRRHTARYTGTKLYISDLD

SEQ ID NO: 167558 - protein, 90 aa, Triticum aestivum
  Clone ID: PAT_TA_61976.pep
RYRQQITARACVQPTGHLIPGDNNNNHFLKSSFQRCIISILKCLKSQYRFDKFLPLQAKSNGKITTYERVLPNTFLHCSSFVSGHTLNSE

SEQ ID NO: 167559 - protein, 83 aa, Triticum aestivum
  Clone ID: PAT_TA_61977.pep
LSLPSSSCGPPDPKISSDPPPPPLQPPPRRALAPATADPSARSPPLTPPPSYSRPSPPPVALIVASGSRALRPCCSVWVLRNT

SEQ ID NO: 167560 - protein, 127 aa, Triticum aestivum; identical to SEQ ID NO: 124219
  Clone ID: PAT_TA_61978.pep

SEQ ID NO: 167561 - protein, 106 aa, Triticum aestivum
  unsure (1)..(106): unsure at all Xaa locations
  Clone ID: PAT_TA_61979.pep
SAAAGARCSPTLRPPPAPPPWSCPPPPTRGAPAGSRRPAGRPAAATAPPASAARPAAAPAAAATEPAPRRPAGXGEHEDEEDNWTSNHXPPPPPSLAAACARLRAR

SEQ ID NO: 167562 - protein, 133 aa, Triticum aestivum
  Clone ID: PAT_TA_61980.pep
VKVGDGPDPAAGEHGLPRAPPPRPPGAGQAQRRPRQPEQRRHRRRPRRAPRGRRDRGVRRAAGRCRSGQAGGSGGRGGGEEEEDEEAGGRGEEETGSGGEEEEAGGGRGEKEAGGGRGEKEAGGGRREKEAGG

SEQ ID NO: 167563 - protein, 76 aa, Triticum aestivum
  Clone ID: PAT_TA_61981.pep
LASTMPLSTSTSAMPMPMNMYNGQTQQGVPSLNVPTLQREDERTLYMLWEHKSYNMKQEMMSLRESMIRLIIIKTI

SEQ ID NO: 167564 - protein, 185 aa, Triticum aestivum
  unsure (1)..(185): unsure at all Xaa locations
  Clone ID: PAT_TA_61982.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTXXGGFEAGISKDGQTREHALLAFTLGVKQMICCCNKMDATTPKYSKARYEEIVKEVSSYEEGRLQP

SEQ ID NO: 167565 - protein, 121 aa, Triticum aestivum
  Clone ID: PAT_TA_61983.pep
MSLVRFFDTLAMDSWNPFGTIFGTTASSGTDAWLASDTTAFADTYIETRETADAYVFSARLPAGVTKEEVKVEVEEDGKVLVIAGERCLRREAKREARHHIERSVATFFGRFHLPDDAVLG

SEQ ID NO: 167566 - protein, 189 aa, Triticum aestivum
  Clone ID: PAT_TA_61984.pep
MRAYFYDGLPGDQRLPHNSGKPVSVDDLMNIGVYYYHLPELEQVDNLSKEREYKNRDEITVSPQAMGDIYETKVKSFFAEHLHEDEEIRYILGGRGYFDVRSKDDDWVRVLLEKNDLLILPPGIYHRFTTDESNFVHAMRLFKEDPKWTPLNRGPDVDKNEHRQEYVKQFIGESTESTTLPVQLKSQQA

SEQ ID NO: 167567 - protein, 231 aa, Triticum aestivum
  Clone ID: PAT_TA_61985.pep
MSRGGRGGGRGGRGGGRGGWPNVPWDTGDEPDARPSELFPPYLVPTPRELASHEKSAVQHLLLLRHQIHSSPLYTSKRTALHDPTAPRKHYGQAQKNAVFGIKSKASVDPFTAVPTYSHKFAREERALPDWSNRPVCRELFPSELYETIDAATTNRADMPGGYKRRKLELSSVSALPSTEEAFGMAGDVEDEMQGRNLLERLQALKERDGDAGDLEDEGMEEEEQDEVYDD

SEQ ID NO: 167568 - protein, 231 aa, Triticum aestivum
  Clone ID: PAT_TA_61986.pep
MANPPPIVLDGGTGFLKVGYAAQNFPEHQYPSIVGRPILRSEEQTDSDLVIKDIMCGDEAAAARTMLQISYPMENGIVKKWDDMEHLWDYTFYEKLKVDPQGQKILLTEPPMNPLKNREKMCEVMFDRYGFGGVYVAIQAVLALYAQGLSSGVVVDSGDGVTHIVPVYESVVLNHLTKRLDVAGRDVTRNLIKLLLRRGYALNRTADFETVRQIREKLCYVSYDLELDKRL

SEQ ID NO: 167569 - protein, 103 aa, Triticum aestivum; identical to SEQ ID NO: 107316
  Clone ID: PAT_TA_61987.pep

SEQ ID NO: 167570 - protein, 163 aa, Triticum aestivum
  Clone ID: PAT_TA_61988.pep
SRRPPPGSPTKGEQPRYPTSSRSLLPCGDTPITVALRPFTTTSSGRSTIELSDVHRFSAQTPAIRGSPPKLPSSPPQHHLLRPKDVPNLPPAHRCAPGRRHGLHPVANTDCSDYFSSGKLAPRAPPTRVLILEHLLKPPWSNEFVQRPALNKQPSSLIDFLAC

SEQ ID NO: 167571 - protein, 119 aa, Triticum aestivum
  unsure (1)..(119): unsure at all Xaa locations
  Clone ID: PAT_TA_61989.pep
MAAAAATSVRGCGPASASSVGLSPRRAVQRSSFLPPLPRRASSARALRAAVADAPHRGLELLFXVRHEAGPLEAVIGGDGGDEVEEAVGEERVEGWMPQSIAEIVRHVGEAPFLVHLFS

SEQ ID NO: 167572 - protein, 140 aa, Triticum aestivum; identical to SEQ ID NO: 112847
  Clone ID: PAT_TA_61990.pep

SEQ ID NO: 167573 - protein, 228 aa, Triticum aestivum
  unsure (1)..(228): unsure at all Xaa locations
  Clone ID: PAT_TA_61991.pep
FLQESLEVPWTYVHNKAEEYINTNTNTTAITTPTSSLPAQQTQTNIPVLNCKDPYREPGYLYIPADINGTNQYKKTQWVPFSDNLLEAEAPDYAVYPAAGEVIFNATEPEPEFVKHSSTPRQWLPEAIAESVRRKKAINANADTNVDAYAPMKNDGDFGWLWGRRIILFSDSVDRFMMQFFCSEFKHNMKQPKAHTIASCSIPEFNLTFVHWHFAGSMTYRPDWWXDG

SEQ ID NO: 167574 - protein, 129 aa, Triticum aestivum
  unsure (1)..(129): unsure at all Xaa locations
  Clone ID: PAT_TA_61992.pep
LQAQKFITAYSAFLKRQGKLPIPGWVDTVKTGPAKELPPQDIDWFYVRAASIARHVYLRKTVGVGRLRKVHGTAKNRGSRPSKHVDASGSVDRKVMQSLEXKIGVLEQDEXEKGWXRITQXGQRDLDRI

SEQ ID NO: 167575 - protein, 243 aa, Triticum aestivum
  Clone ID: PAT_TA_61993.pep
NLKCRSFEILTTSGVVVWSRTYTAINPSIINNFIADTFIEEKSGAIALSDSRSASTNPPYKSDQHTLKWTLVKELGIIFVAVYRSLLHLSWVDKLVDNIKTIFVKLYGEQLTKPHTTLVECHAFDEYFDVQIEELDQTSTKVPSTTITAGAIPLEEEIIPRNIGDEPPVAPGLTYRGRHLNGPQDALSADESTPALTPNGSRPGTPSNHILSAKGGPIAKISRRARKAKNQTSAPASSGDEAP

SEQ ID NO: 167576 - protein, 171 aa, Triticum aestivum
  Clone ID: PAT_TA_61994.pep
MTNPRVFFDMTVGGAPAGRIVMELYKDAVPRTGDNFRALCTGEKGGGKSGKPLHYEGSSFHRVIPDFMCQGGDFTKGNGTGGESIYGEKFADEKFVHKHTKPGILSMDNAGPNTNGSQFFICTVPCNWLDGKHVVFGEGVEGMDVVENIEKVGSRSVTCSKQVVIADCGQL

SEQ ID NO: 167577 - protein, 79 aa, Triticum aestivum
  Clone ID: PAT_TA_61995.pep
MRQRQEWVGDWVRSNDTLVRALPILVGGASLLAVLLNRAVSGIAAVSDASSSQSRSDIITLTLSVSFILSPTRTPVFLP

SEQ ID NO: 167578 - protein, 163 aa, Triticum aestivum
  Clone ID: PAT_TA_61996.pep
MASLKAVKPTGLDGKAKEPTKVSATKGPAKLSATATKPAAAKGGIKNVESKLRQPKKRVSTPSSTFNNLSTAGADEMMVPVSRYGHGQCLYFFLTKQRQHRIQGKLPGPARIEERDTGDVRGRPGRPLCLSTSRPGGTVRGRHQRFSDQVRGCRLAVVHAERF

SEQ ID NO: 167579 - protein, 123 aa, Triticum aestivum
  Clone ID: PAT_TA_61997.pep
PSASNFQDKLEFHGSNTDDDGKRYPRNQTFRTLTLSLDIAVVYGAACNTFIGSSFRTEMFRSAVGWCAPATAASYIMAETAAPCQWCHLEGSVRCDTARRSMTGEQLFSSMRSRSFSLAFSTP

SEQ ID NO: 167580 - protein, 78 aa, Triticum aestivum
  Clone ID: PAT_TA_61998.pep
GPRSTETPRSRSPARTRRPPAVSPIRSEPPPTSSSLWLSSGYRTWTSTPRHRATRASPRRLGITGELCLLRIPVSMWT

SEQ ID NO: 167581 - protein, 142 aa, Triticum aestivum
  Clone ID: PAT_TA_61999.pep
VAYIYTVASMMPPADEIPAVSRNFFLPPAIGATSTLDAKKIQTTKLLQDAHMLQQLEQSYHIDQFLNNPSPIDETTITFADNITQALGDALRSTPYEYPSSDAPTFKRPHRRPKRLSRHNTAFCRRKLGVSQVEALLPMWHD

SEQ ID NO: 167582 - protein, 60 aa, Triticum aestivum
  Clone ID: PAT_TA_62000.pep
MDRLWICGTLFSREYIDGVKEFMNFTQAKFSEDEEILCPCRQCLNHKYWHQAIVNKHILT

SEQ ID NO: 167583 - protein, 174 aa, Triticum aestivum; identical to SEQ ID NO: 138445
  Clone ID: PAT_TA_62001.pep

SEQ ID NO: 167584 - protein, 182 aa, Triticum aestivum
  Clone ID: PAT_TA_62002.pep
MAHGKRSRQQAESTSVSLLDLDSGDMARILLLFSGHHQHHAHYGPSSPERVFECKTCSRRFPTFQALGGHRASHKKPRLADGAGAEPPKPKVHGCSICGLEFAVGQALGGHMRRHRAVAAAGPGVGLGLSLGLGPNEDGNKKAAAAAELALDLNEPALEEEPADRAMLGLAVGFPVVGDFRR

SEQ ID NO: 167585 - protein, 163 aa, Triticum aestivum
  Clone ID: PAT_TA_62003.pep
MKRSSSGTRLQRKRPPRLTVSKNRLGKDAAEPDAGSFGDRLDFCKANLFTGRGAEGGEGAEVPAVPQEMIMHRINSKMAHKSYQLGQQLSLRWTTGAGPRIGCVRDYPPELQFRSLEQVSLSPRAGAGPPRLGATPRQRSPCTPSPLGAPVTPAGPLLQHGAA

SEQ ID NO: 167586 - protein, 147 aa, Triticum aestivum
  Clone ID: PAT_TA_62004.pep
PLGRATLPHDLLAAAAHAGTLVAAATAHAGTLVVVAVVSGSTSSSASSPPWSTPSSTPPPPTTGTPSPTADLASSSTSSGGSRSSSSGVIDMDYCGLVGIMLFNHSEADFVVKPGDRAEHMIVQVIATPEVAEVKDLDAIVWREGVL

SEQ ID NO: 167587 - protein, 182 aa, Triticum aestivum
  Clone ID: PAT_TA_62005.pep
MASIARSSLLRQTAMASRLATAAIPATRSTSMPSIRTQLKGVAAFHNTTRRSAILPPGPQRIEGGINEPAPVPEPSSTHGSYHWTFERFLAAGLVPLTVAPFAAGSLNPTLDAILCSVLLLHSHMGFQQVVIDYIPSRTYPGLRKTFNWLLNIATVLVGVGLYEFETNDVGITEAVRRVWKA

SEQ ID NO: 167588 - protein, 178 aa, Triticum aestivum
  unsure (1)..(178): unsure at all Xaa locations
  Clone ID: PAT_TA_62006.pep
MVVMAMHPQAALLLTLILLLLATGDGSLAVGTPSAIIRTTCATVDRAGGEVGYDTCVGLLSADPAAAAAKDARQLAVVATNLTVANVTSTVLVLKDLVKNLGDCLRYYRDMNKTLEAALGDLRAXRVQAASDKLLDASHLPDDCDILLFQGSAKDPMSKETPTPICCPDWHTPLLTCS

SEQ ID NO: 167589 - protein, 84 aa, Triticum aestivum
  Clone ID: PAT_TA_62007.pep
IHQVCLPAQPRHKVFVLGNHLGLITCISSFLQGICSDLTFYFWKALCSSSDTSHTLFCTRTRRRSPKTSSFVCLFLLSAQGREI

SEQ ID NO: 167590 - protein, 83 aa, Triticum aestivum
  Clone ID: PAT_TA_62008.pep
VSGSSFLLLPCNGGSGGAVWHWLQKTPTVFKGVSFMIAMEQENRHATKAKMVMRRYAAGKMLLANWKGCNQIQSTTWQWSLNI

SEQ ID NO: 167591 - protein, 168 aa, Triticum aestivum
  Clone ID: PAT_TA_62009.pep
MAAGTAWAGCHLARLPHIPISVSIPVAGAGASSRRRRPGLAAAAGAAAAAATDGRVLGRRPVEDVYKVRVVRGAAAQERVEALRAMETWSTWRTGGRCRLAWDWQVDQLVYIVAGEVRVLPAGATTGEEYMHFVAGELVRYPKWPEADLHFDGPYEERYRFLAYGDDN

SEQ ID NO: 167592 - protein, 68 aa, Triticum aestivum
  Clone ID: PAT_TA_62010.pep
ISGGEETYKDSPSNGERSGRSPRRQAVLALNTYLRQYRVGDMVSIKANGAVHKGMPFKVYHGKTGVIY

SEQ ID NO: 167593 - protein, 212 aa, Triticum aestivum
  Clone ID: PAT_TA_62011.pep
MAASTAVSCLCLLLVAAVTFSVAAAAPAPAPPPPFRTVYAFGDSFTDTGNTHSTTGPYSYGYVSNPPYGATFFHRSTNRYSDGRLVVDFLATDALALPSFLPPYLSLAAPNASSKSSKYYGANFAVAGATAIEHDFFAKNNLSIDITPQSIMTELGWFDAHLKTRQAKKEEIGEALYWVGEIGANDYAYSFMGADSIPPERIRNMVVDRFTT

SEQ ID NO: 167594 - protein, 101 aa, Triticum aestivum
  Clone ID: PAT_TA_62012.pep
MEKGSGAAAGSSARPPPMPQFDEFPFEGKKPVKNPFVPIGALVTAGVLTAGLVSFRYGNSRLGQKLMRARVVAQGVTVALMVGSAYYYGDQIKLFKKGSSP

SEQ ID NO: 167595 - protein, 180 aa, Triticum aestivum
  unsure (1)..(180): unsure at all Xaa locations
  Clone ID: PAT_TA_62013.pep
LLHSRLVAVHAVACHAAPARSRPPRAASDRGRPCPRLRLRLHGGAPRRLPPPSRRAQAPPRGFYAQGQNVERPARVGRPGGAGGHAVRGAPGGGAGRGGRGGGAAGRPAAALGRARRRRRVPQRRRDRPRLPGRAPRRAXGSSIDFMLQSSLHCKVPNGAIDITSLFINLNALMDAPHFV

SEQ ID NO: 167596 - protein, 176 aa, Triticum aestivum
  Clone ID: PAT_TA_62014.pep
ILFGQRKSSSLPRHTRFSVSKTLSARARHGQSSSRQRGQSSGSGGGGQSSSGGGGGSTSSSKQRARSSGGGGGSSSKQRGQFSGAASSSGCSGGGSGGCCCSGCRCSAGAAPQGRQGLCVLVLCVHLGRAALLCSDDSADIEAMESRLESTNVPYVMISGASTSLELINDLPGGFL

SEQ ID NO: 167597 - protein, 80 aa, Triticum aestivum
  Clone ID: PAT_TA_62015.pep
HIWHYVVILHTNVVSLQATTLIDALLHVIYTHNITANNNGDELAEDYEVLQPLPTPRLCFSLLANLEQSSFVYSLVSNPL

SEQ ID NO: 167598 - protein, 178 aa, Triticum aestivum
  unsure (1)..(178): unsure at all Xaa locations
  Clone ID: PAT_TA_62016.pep
GVXIYIYIXHIHNFFIKKGRNTQQKMEVQIFFQIWPSTLPGAILFCIHHIKRRRALADHQSDFIAMAFLWPLIWQTALVEVFAAAAWIGGDSVGGHIQARRRPAIGSAGSRDKDDNIGVADKPGEAGRSGMGRRHPDPSGSGWIPTNLKENGGSKVSSGDAMGARPPLLQGEAEREMR

SEQ ID NO: 167599 - protein, 256 aa, Triticum aestivum
  Clone ID: PAT_TA_62017.pep
MFASRRAFFAARRQAPLISNRSIVPALRSYSVDADITQQNPSEDITEGNQEDAAAKPKYARTTAAKPSTATKPAPVRASTAAKPATPAATRAATTSSFPPKSGSKLANPHTPVSVSKSTLSESSETDVESTHDINWETSWFGLGVKPVTLEQNEVLSRPIDVEDVEVKPDGIVYLPEVKYRRRLNEAFGPMGWGMVHRGDVVVGQNIVTREYALIVNGRIVSQSQGVNNFFSPRGVPAAIEGAKSNALMRCCKDLG

SEQ ID NO: 167600 - protein, 221 aa, Triticum aestivum
  Clone ID: PAT_TA_62018.pep
MDFLQRLARFLDRPLFPWKKLIMGFSVGQYLFESFLTLRQYRVLQKTSPPAVLSKEVSQEVFDKSQAYGRAKAKFEIINGLYSQVQNIAFMHFDVLPKLWSWTGDLLLKWAPARFTGEISHTIVFVLTFTVISQLLRLPSSIYQTFVLEEKFGFNKQTPKLFITDMVKTQALTLVLAPPFLAGFLKIIQKTGNQFFYYLWLFFIALQVFMITIYPVAILPL

SEQ ID NO: 167601 - protein, 98 aa, Triticum aestivum
  unsure (1)..(98): unsure at all Xaa locations
  Clone ID: PAT_TA_62019.pep
MVDPSNSEMLTQGRRVAFFFEHMPAHYAFGPHEDDAIIKHRLLTRIPTTRGEPPLKKLQKKFMSFATEVDKDADNTSDCERLHKAXFLLDINTFGRCL

SEQ ID NO: 167602 - protein, 156 aa, Triticum aestivum
  Clone ID: PAT_TA_62020.pep
QSSTPASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 167603 - protein, 172 aa, Triticum aestivum
  Clone ID: PAT_TA_62021.pep
APCGSPSPLPWDLNQQLPSPSRLPRIAIAITTPLQLPSPTTGAAPHRHTLLQQHKSCGPLPLPASELRQSSSHGIGAPHLFSIADDRCCLPPPPFRQQQYGGSILYLLLRRTAAANTPSLLQLSYILGDHNKVIRSGEGLQGDHNSHGEQDGWEARYQVADGSIQLVLCVVG

SEQ ID NO: 167604 - protein, 204 aa, Triticum aestivum
  Clone ID: PAT_TA_62022.pep
MGFPVGYSELLLPKQLLHLLLLLGYLRRFLLWAFDAVGLGDLLDLGDEHLAQEHARADHAAAAHHALLLQHRRPEFRPVTAMVIEEVLPVVRFDELEAAACVDGDCAVCLSGIGGGDEVRRLSNCRHAFHRGCLDRWMEHDQRTCPLCRALLIPDEMAGALWATAAGVPDASDFDFFYLGASAPATPTLLRPHELLLTGLGGYQ

SEQ ID NO: 167605 - protein, 215 aa, Triticum aestivum
  unsure (1)..(215): unsure at all Xaa locations
  Clone ID: PAT_TA_62023.pep
MSDTVYPEVLWAQRSSESDVSKNFIYLTISVPDVSKDNISLDLQPTKLNFTGTSSTLKKKYHVELELWGEIDPAESKINHTSKNVEIKLQKKELKEEYWPRLLKDSKRVHFLKTDFDKWVDEDEQNEAPEDDFSQFGGMGGGMPDMXGMGGGMGGMGGMGGDFGGIDFSKLXGGAGXPGAEGEMDXDEGDDDMPALEGDDXKDAAPAAAATEKED

SEQ ID NO: 167606 - protein, 120 aa, Triticum aestivum
  Clone ID: PAT_TA_62024.pep
LVASSPSRSPPPPPSPPPPRTRSGSHPPRTRARRRWLLHLQATPSPRSPSPRSRRSPRSSSTYSSSPLRSRRRPRPGRRPKRRVGPSPHRVATDLVLLEEEEQEGRTQPPQSPPSRASST

SEQ ID NO: 167607 - protein, 75 aa, Triticum aestivum
  Clone ID: PAT_TA_62025.pep
MASKRILKELKDLQRDPPTSCSAGPVAEDMFHWQATIMGPSESPYAGGVFLVTIHFPPDYPFKPPKVCSRVYATI

SEQ ID NO: 167608 - protein, 148 aa, Triticum aestivum
  unsure (1)..(148): unsure at all Xaa locations
  Clone ID: PAT_TA_62026.pep
MASRTSAACLLALLVASTFLAGDACNSCKHHTPPPASPSPPPPAPATPTPCPPPPSSGGTGYCPTDTLKLGACANVLGLVSAGVGTAPSVVGDNRCSLLGXLADLEAAVCLCTALKANVLGIVLNIPIKLSLLLNYCGKTAPKGFQCA

SEQ ID NO: 167609 - protein, 237 aa, Triticum aestivum
  unsure (1)..(237): unsure at all Xaa locations
  Clone ID: PAT_TA_62027.pep
MSAVNRTLRTATKQLRFQSPRGLRVAAPLVARSALAARSSLPASHGAAFSTSATKFSGAPDMSSAPREYDPEIKDIADYVANKTIDSELAFDTARWILLDTLGCGLEGLRFKECSKLLGPIVXPGTVVPNGPKVPGTPFQLDPVNAAFNIGAMIRWLDFNDCWLAAEWGHPSDNLGAILAVADWINRTNKAGGNLAGGKTFXVKDVLEXMIKAHEIQGCLALLTPXTRSVFDHVVLV

SEQ ID NO: 167610 - protein, 168 aa, Triticum aestivum
  unsure (1)..(168): unsure at all Xaa locations
  Clone ID: PAT_TA_62028.pep
SETPSPATSSRHPTRRGPHGTARTRHRRSCSSWPRGCGCSCRTTARWRTAAHSVPVRGPTVRAAVPCPWDAAAAVVPVPLLPAAAADGRALPLRSEPEIPATLRKVEQLRFRSSRRSKNEILKRERRRRMGTWKGGDDARGRGGGAACGVEAPTTRFFFFFFFVFSRX

SEQ ID NO: 167611 - protein, 178 aa, Triticum aestivum
  unsure (1)..(178): unsure at all Xaa locations
  Clone ID: PAT_TA_62029.pep
MARPTHAVVALLAVVLALASGAASQAPAAGPAAPAGDCGSALTGLTGCLPYISPGAAQGKPPKECCAGVKAALASPASVACLCDAFGXVYGIPMNLTRAKGLPAACGGNPAALSNCRLKLPGGAPNGAPTEAPTPTSGSTPATVSPSPEKSAATRSPVTAATLLLAAVLAPLLSYYYL

SEQ ID NO: 167612 - protein, 252 aa, Triticum aestivum
  unsure (1)..(252): unsure at all Xaa locations
  Clone ID: PAT_TA_62030.pep
MAAMFSQNPLMNGPNYSFSEAPKTNHGEFREHRFNPYTDNGGSTLAIAGADFTIMAGDTRHTSGYSINSRMSPKVFRIGGTTASQEDATLVLSVVGFAADGEALRDHLDTICKIYRYRHGKPMSVNACAKRLSTVLYGKRFFPYYSHAMLGGLDEEGRGAVYSYDPVGSYEREQCRAGGAAGSLIMPFLDNQVNFKNQYIPGSGEGHELKERERRPLTRTEVETVVKDXAFDGAVERHIEVGDNLKCSLSLR

SEQ ID NO: 167613 - protein, 75 aa, Triticum aestivum; identical to SEQ ID NO: 117166
  Clone ID: PAT_TA_62031.pep

SEQ ID NO: 167614 - protein, 185 aa, Triticum aestivum
  unsure (1)..(185): unsure at all Xaa locations
  Clone ID: PAT_TA_62032.pep
MSSRPHNEEPLPLLSAEERDRDMKGELDVEGDAGRAEPPKNNNLEHEYSIPSTVKFAWLGTYFFFSLLLTLYNKLVLGMFHFPWLLTFLHASFASMGTYAMMQMGYFKLSRLGRRENLALVAFSALFTANIAVSNLSLAMVSVPFYQXMRMLCPIFTILIYRVYYXRTYSYMTYLSLLPSSSVLP

SEQ ID NO: 167615 - protein, 289 aa, Triticum aestivum
  unsure (1)..(289): unsure at all Xaa locations
  Clone ID: PAT_TA_62033.pep
SDYWTGASVIIIIVTILTMAPEKRSAEFVFTHYDASASGWPAGWSFFVGLLQGAYVLTGYGMVASMCEEVQNPEREVPKAIVLSVAAAGVTGIIYLIPILFVLPDVKMLLSVANSQPIGTLFKVVTGSAAGGFGLLFLILGILMFAGIGALTAASRCTYAFARDGAIPGYKLWSKVNTRFDMPVNALILSTIVDCILGCIYFGSTAAFNSFTGVATICLASSYGVPVGVXLLRGRKIVKHSPFXLCKFGPLXHXICVVWIIFLIVIFCMPVSLPVDAVTMNYASGVFAG

SEQ ID NO: 167616 - protein, 86 aa, Triticum aestivum
  unsure (1)..(86): unsure at all Xaa locations
  Clone ID: PAT_TA_62034.pep
IALRPPQGGARFRGRGGDRGGRYGGGGDLRERXGGDSLAFSNEGPPNEDHIAFKSQNVWEGDAVIKVLHDKVHHLKGGIFLFLPPP

SEQ ID NO: 167617 - protein, 92 aa, Triticum aestivum
  Clone ID: PAT_TA_62035.pep
MPRRGWRGLLSSRHSASTPPKSSAERSRRQGGEEGAAEALAGDCVCVSGKEETSEARAGARSAMRTATAAMCTDIVAGEEDGGGGGRVVMNV

SEQ ID NO: 167618 - protein, 105 aa, Triticum aestivum
  Clone ID: PAT_TA_62036.pep
STEVIIQQGSEEVCPVCHRRHQVVSPMRIRHGGPWRLSLSQVVILLEGGRLMSLLGEEVVVLASVTPGKQRHRSHQSVGNIGCLPIGGHPRMVGGLYQEERGECV

SEQ ID NO: 167619 - protein, 77 aa, Triticum aestivum
  Clone ID: PAT_TA_62037.pep
MQEAVAVRGAMRDHNHPSTPIAVPTDHSPYIEPESRDHPLLAWDITNPEQPRRDGIGSRPYAWRPDRPTRHAHCVPQ

SEQ ID NO: 167620 - protein, 141 aa, Triticum aestivum
  Clone ID: PAT_TA_62038.pep
VVGCSYVTHEHEHHTSSRRTRVPSRLSVAGCVTCRRPRLPPQHAGEPRLVLPLFRLLSYLISLSASPCNNGGRAPMASPEDTFHPPFSFKFVGIRPDPDGSGCRRPIPDLPALPGSSASPMSSSSSRDPALPMAGLLLAWM

SEQ ID NO: 167621 - protein, 228 aa, Triticum aestivum
  unsure (1)..(228): unsure at all Xaa locations
  Clone ID: PAT_TA_62039.pep
GGGDGEKGGLKRNCRREGVEGRTGGKEGEKRGRGEGGGGGDKVDRWGVRGRRGGGEERGREGKRRLGVGEDKGGRMXGGGGVRGDQADPLHQGMQLRLVCSCCMEYLLVLSPKEEYQHMRHKTGTNKMQVIFKPTSDRALRTNYYSRPHANCLPGRSRTLEAPPPPRNKASLASKSLRRRWRRPNLGGQRRRGATAGPSLTSSSLSSNPHPSLSPSAIGQVPALVVLQ

SEQ ID NO: 167622 - protein, 61 aa, Triticum aestivum
  Clone ID: PAT_TA_62040.pep
WGGGGRYSTPSGSTDLAITNPSSPELMVTADPCPPDTSGVPREEGGVGERPFRVVPPNEGD

SEQ ID NO: 167623 - protein, 173 aa, Triticum aestivum
  unsure (1)..(173): unsure at all Xaa locations
  Clone ID: PAT_TA_62041.pep
SLQVPDVSHVPRLTMNLFSASQLTDSGCRVILDVDSCTVQDRHTKVVVGASPRRLDSQGLWELDWLHVPSAATTLASTSAFAASATRSFQKWHHRLGHLCGSRLSSLVRRGLLGPVSGDVSLXCQGCRLGKQVQLPYPTSESVSQRPFDLVHSDVWGPAPFASKGGHRYYIIF

SEQ ID NO: 167624 - protein, 80 aa, Triticum aestivum
  Clone ID: PAT_TA_62042.pep
QVQYMLCVDVPTYYMSFICSRSSYLCVMVVHDDTYVYCIIVNPSMAPSYNANSGLPKVMLVAVCHHRKLEVLQSNYQLIF

SEQ ID NO: 167625 - protein, 95 aa, Triticum aestivum
  Clone ID: PAT_TA_62043.pep
LDTLVGRRVSIKIILLSSKLTRTSRLHLTTCGLETSLINDQLAREVSLVFWQEVRARGACRALSCRLVLARVSCFCCESRSLFQALVFLMRSLIL

SEQ ID NO: 167626 - protein, 139 aa, Triticum aestivum
  Clone ID: PAT_TA_62044.pep
RLPFDSVHAHAVLGLLLPPFQGFRAPRLWQRPRPQPSYQAEPAPTPTLSILLPTVRIGRVLVLDNGGCQYVDGGCSEASVRSFNPRPIAPQVIYLNNGAFIILQELFTYLKFLMQRSGVILLLKNNNFTYLKCNPFNRL

SEQ ID NO: 167627 - protein, 136 aa, Triticum aestivum
  Clone ID: PAT_TA_62045.pep
MEEFDEADVLWPDHQEDEEPVKVQDRQQQQRVSPAIKPHDKIEAARRPAGSSSAPMVIPVAPRPPMMMDYGSWARRYHSDGVGGASFVAPHVMTARRRCASSEERSVCVGQGRTLKGRDLLYVRTAVLRLTGFLET

SEQ ID NO: 167628 - protein, 177 aa, Triticum aestivum
  Clone ID: PAT_TA_62046.pep
MGNSLRCCLACMLPCGALDVVRVVHLSGHVDEFTCPLIASDVLAAHPSHALTAAGSAGAARRIVIVSPDSELKRGRIYFLIPTACSAPAAELKRPKQQQQQQGHGACQSKTKRRHGHGHRKGGTAVAAAASTAEQDNYLRELLSEKRESGHRRRRSSSARASVWRPRLESIAEEPSD

SEQ ID NO: 167629 - protein, 151 aa, Triticum aestivum
  Clone ID: PAT_TA_62047.pep
MVATKSGELRALFASLDQDSDGRVSAAELRGCMRATLGEDVPAEEAEALVASADADGDGLLCEAEFLELAQQAAWASAEDEDNEQRTRALREAFGMYEMEGQGCITPASLGRMLGRLGTERGAGECRAMICRFDLDGDGVLSFDEFKIMLS

SEQ ID NO: 167630 - protein, 133 aa, Triticum aestivum
  Clone ID: PAT_TA_62048.pep
MAAASPEFFKPADAFSPRLHLLAAGAGAEASDGDDGYYRCCRTLAGAGTGCLGQAATCPPAPRKPRAQPDAACRKRLFGVEVISLLFDDLDAIFRPSPPPPCDDHHNNKQQRQRSRRALGRLAAGRSSRAGLN

SEQ ID NO: 167631 - protein, 59 aa, Triticum aestivum
  Clone ID: PAT_TA_62049.pep
DVNNYTTTMWTFRCIRPDYRTLDSLAGVAQCHLTPESVLLRPHRLDFSANIGRIHTESH

SEQ ID NO: 167632 - protein, 44 aa, Triticum aestivum
  Clone ID: PAT_TA_62050.pep
MPASTWQNIDEFTKEDLVMKRLWEKANMERHIAEARRGSKQRRR

SEQ ID NO: 167633 - protein, 240 aa, Triticum aestivum
  unsure (1)..(240): unsure at all Xaa locations
  Clone ID: PAT_TA_62051.pep
NYQDNYQDNHRISIFSHSTTSHSQIIHITSYTMGNSGSKFNTSQLSAEELQDIPNVIRMAYQNSWKKYACFTSMNISLGPPDAEPMYTISFTKGLYGDIVLHKGPTPESPAIATSSRIKQYHDDYLITLPTGKGIHEETLRRPKGLKGRFWFGCLVGNGSEQRVERFEWRRSRGAEVKSVGQSKWGGYKLVRLGSTNTKEEYSSSEEDFPEGSSASGEGYTSDGKEIVXVWGMPIAGRHV

SEQ ID NO: 167634 - protein, 201 aa, Triticum aestivum
  unsure (1)..(201): unsure at all Xaa locations
  Clone ID: PAT_TA_62052.pep
NCRTHPQRPNPSLASPLPPLDLISLVPAQRRHSGEELLVPIPSLPAAAAAAAPSRRRRARSPSSRAPPPSRNHAPSPLRSASPGRAALPDLLRPWPCRPAPPSLLXAPVPRRREFVPEPYAPRPRPHLLCETCIAAPLLHAPVPGPPRPPPRLPSAIALSAPSSGEEPLNPSPSAPTPASAAPSPRAGPTTKSHRQRWPSS

SEQ ID NO: 167635 - protein, 180 aa, Triticum aestivum
  Clone ID: PAT_TA_62053.pep
VQVLPVDSHYPLISVVRANTAVTAPNPSVAQPRAHAHQALDGRAAMHLHRAARNANCAYPGAWTPDPKLQQAPADLHRCAVKLPLSMHRSGKTAAFLGAGLDFARWRPLAAARRVGMVSTLGSGLLIISCGAASFLFLPSKASRSTFKHVKVYLSTFRMDIFPFQRILMIAMNQTRNASR

SEQ ID NO: 167636 - protein, 64 aa, Triticum aestivum
  Clone ID: PAT_TA_62054.pep
NTLDPRAGSLVCSAPDRCSNIVAKNITVGVPSKKPPVYDCYNLDESTLDITCQDPTTDRDMTNG

SEQ ID NO: 167637 - protein, 125 aa, Triticum aestivum
  Clone ID: PAT_TA_62055.pep
MARGTMVPTLLVLLLAIFCAITVVHSKEWNVGRQDGWFFSISNWGDDKPIKVGDVLVFKYKAIAHNVVQVSEEDYDACTVSRPSPTYRSGNDHIKVTSSGRFFFICYVKTPLHCESGMKIAITVQ

SEQ ID NO: 167638 - protein, 100 aa, Triticum aestivum
  Clone ID: PAT_TA_62056.pep
GVKRPSAVVFPASQHPVLWVPHPEDSLFGAASSAAAASLLAAPAAEGSCRVTAAAAAAYERTPRLFAAASWPAILDDEMKTRAAIDSSHATEADVLLGCI

SEQ ID NO: 167639 - protein, 120 aa, Triticum aestivum
  Clone ID: PAT_TA_62057.pep
MTSSGAGSSGDPPPGGRWPTNLGTLETHELIRLGLMVSPGCRLPKAFKITADGYPMRGGGAAPEELRRHSGGRWNPVGRHAFWDGKDFWSVVAERRRAARQWGSALHTECPLLPPPPPLP

SEQ ID NO: 167640 - protein, 181 aa, Triticum aestivum
  Clone ID: PAT_TA_62058.pep
MDAQAAVTRDAVGLDDPLVALTLVSIYAAAPTPPPKPWRPSPPTPPPSQPASATRRRLNDSATGQRRRASNEPPSDDDDAAADGLPPPFPWATERPARHDPLDSLLRRGVTSVEGETRCRRCNRTSTVAYELAPKFQEVRQFVVANRHSFDDRAPDAWMNPVLLDCAACGEKRCVWPVIAA

SEQ ID NO: 167641 - protein, 222 aa, Triticum aestivum
  unsure (1)..(222): unsure at all Xaa locations
  Clone ID: PAT_TA_62059.pep
MGRELQKKKARSGRQTARHXNRSKNILNPRGNXAIAKSWNKKETLSHNYRRLGLVDRLKAPAGGTXKHVGATTTSGYANDPFAIATIENAVVSEESVXRDADGKIIRIIGSDKANPLNDPLNDLDEGSDAEDKPAEERGGIADNADDEETTDVVEEVLEQAKHADLPKKRHHSAREIDCVHKLVAKHGDDTGAMSSDRKLNPMQQTSANIAKRLRKMQEESQ

SEQ ID NO: 167642 - protein, 221 aa, Triticum aestivum
  Clone ID: PAT_TA_62060.pep
CVLSWSCKYRNFLVLSWHSFPYLLCLFDWRADYTAAPAASYSPHGAAAGDEELPSPSSAESGGSGGTPRKRYRGVRQRPWGKWAAEIRDPHKAARVWLGTFDDAEAAARAYDAAALGFCGSRAKLNFPESATIPPPQQPPHAPALAMPPPQQPPHAPALAMPPPQRPEALLESQALLGGQAYSHYARFLRPSTGGSTSGGPRTPAPPLIYSFRGGASYPLQ

SEQ ID NO: 167643 - protein, 95 aa, Triticum aestivum
  Clone ID: PAT_TA_62061.pep
AILRLPRSISSSAPFHSSVMAMQDHPSPCGRHPQILLDRNCLVGQLENSTTAKTKNSKGHHLELSFKADRSRGWLLLPFRFGFWFGSGPRVASLV

SEQ ID NO: 167644 - protein, 210 aa, Triticum aestivum
  unsure (1)..(210): unsure at all Xaa locations
  Clone ID: PAT_TA_62062.pep
MTTLLDALRQTTQVDCDTLDANVAHQLGPFVDCTSNQAIAFSEISRPLAGEPLLHYDALVKDAIEKARGALKEFQGSATFEEFVVQILMVKLQLLIVPNVTGYVHIQTNPKLSYSTDGTMSDAHRIVNIFKALAPEFDTKRVCIKIPATWEGLQACRALEVEGIATLATTMFCMEQATLAADAQCTYIAPYVNELKVHFEAGYVDEHXAF

SEQ ID NO: 167645 - protein, 206 aa, Triticum aestivum
  unsure (1)..(206): unsure at all Xaa locations
  Clone ID: PAT_TA_62063.pep
MVLRESQVYGPITAYGKDATMCIFVFHTTIPGYPNARFPCVSLFIEIYQAAGTVTRFAPKISRAGLSSMPLLHHTTNFTGPEDLKYDVDDTDXGSNTISKRPVXSYDADINDTVDYLLXLPLAQDASGSTRMCLGGHLAVRAALDPHISACVCDLGTDIHSHTLGLYYALYSSSTASDNSNRTLDLFHKFKRPYCHDLWSVGHPRP

SEQ ID NO: 167646 - protein, 70 aa, Triticum aestivum; identical to SEQ ID NO: 141639
  Clone ID: PAT_TA_62064.pep

SEQ ID NO: 167647 - protein, 280 aa, Triticum aestivum
  Clone ID: PAT_TA_62065.pep
ISTNTNNNTKSHHSSSVSPRSGSGGSGSGGGGGGGGGTTNQACAACKYQRRKCNPDCPLAPYFPADQQRRFLNAHRLFGVSNILKTLRRLKPELCDSAMQTLIYQAEMRAMDPVGGCCRMIIDLEHTSELLSAELAALQQHLDMCRQAAASGVAGGDVMDGPCADLEVTSSNHQQEQLLLHADQDHHQALYIGQEGADPVIQNGADHDDSRQPQYHGGQQHQQQQLYDYFYYEATGAGSDEAGRKPVAAASTLTSTSCSISITTPAARVMIITRWDHWSR

SEQ ID NO: 167648 - protein, 160 aa, Triticum aestivum
  Clone ID: PAT_TA_62066.pep
MRREGRQRGWVRVYDRELVDPEGKRRAAHVVDADGQAVVVANGGYVRASRRPTNHSKPGGSRALDALCRKALRALDEEEEAPPPQPAARYGYSPGWWPPSFSSSRYGAVAQKQQAQVQPARSGGKASSKAGPGRNFKHGKISKTYYLDEDEIDYLYNYDS

SEQ ID NO: 167649 - protein, 93 aa, Triticum aestivum
  Clone ID: PAT_TA_62067.pep
MAMRKEVLLAAMMLALLVAAPGGALAACEVGQLTVCMPAITTGAKPSGACCANLRAQQACFCQYAKDPSLGAYIRSPHARDTLVSCSLAVPHC

SEQ ID NO: 167650 - protein, 48 aa, Triticum aestivum
  Clone ID: PAT_TA_62068.pep
DPRWQARWEEHRTFRTSDASRPKGYILGMFPYPRFGSNRCLTVICEWG

SEQ ID NO: 167651 - protein, 118 aa, Triticum aestivum
  Clone ID: PAT_TA_62069.pep
RTPPLSSLSFLSSPPTASSSLPPPAGPASPTRPPAVTSPSTSSPQTSTATSRASSRSLARTSRPLTATSGCARASSSTTTRTMSRSTASARRSPLRSTLLLPTLVTPMFPSSRLLLIP

SEQ ID NO: 167652 - protein, 129 aa, Triticum aestivum
  Clone ID: PAT_TA_62070.pep
SASVCLIHLLAQPNQKFEKNTLPKCFTHLKTTPATCSKTWTMTLAHKFVETRMGRWCGVQFAWCEEDIMLYLAFHDKAFCMTSSSWHSERDEPGQVSFRRTACHVLALLRARAHVFDLVSLDSAGISGR

SEQ ID NO: 167653 - protein, 207 aa, Triticum aestivum
  unsure (1)..(207): unsure at all Xaa locations
  Clone ID: PAT_TA_62071.pep
MEVKVLSSRLVKPAYKAGAPATEYIPLSVFDTVTYQIQMAIIYAFAPPAPSTAAIEKGLAAVLSQYRAFAGKVGESPDGAPAVVLNDRGAXXVEASVDADLVDMAPAKPTPALLKLHPDLDAEHQEVVLLQLTRFRCGSLAVGFTSKHVVADGHATSNFLVAWGRATRGLPMGLPPVHHQKDLFQPRSSPVRPEHDHRSREYHRASP

SEQ ID NO: 167654 - protein, 255 aa, Triticum aestivum
  unsure (1)..(255): unsure at all Xaa locations
  Clone ID: PAT_TA_62072.pep
NPIRSIQSSPPTISPGNLRSERSEGSLVLLLKMQIFVKTLTGKTITLEVESSDTIDNVKAKIQDKEGIPPDQQRLIFAGKQLEDGRTLADYNIQKEXTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADXNIQKESTLHLVL

SEQ ID NO: 167655 - protein, 51 aa, Triticum aestivum
  Clone ID: PAT_TA_62073.pep
MEEPLDEKDLERKLKKEQKAKKEEEKKLKAKQKEEARLQVQSASDGANKSV

SEQ ID NO: 167656 - protein, 149 aa, Triticum aestivum
  Clone ID: PAT_TA_62074.pep
MAPKTEKKPAAKKPAEEEPAAEKAPAAKKPKAEKRLPAGKSAAGKDGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 167657 - protein, 127 aa, Triticum aestivum
  Clone ID: PAT_TA_62075.pep
QAKSCCVGDDRMAEPSRVIHIRNVGHEISETDLLQVVQPFGAVAKLVMLRTKNQALVQMEDLSASISAIQYYTTIQPSVRGRNVYLQYSSHQELTTDQSSHGRNPDQVHNYPAALWVLYSISTIAFL

SEQ ID NO: 167658 - protein, 273 aa, Triticum aestivum
  unsure (1)..(273): unsure at all Xaa locations
  Clone ID: PAT_TA_62076.pep
MTDTFSREEVRSHTSDESLWCIIDSTVYDLTDFVDAHPGGETVLRQVAGQDATTAFYNLHRHEVLTKYKDLAVGTIEGEKAQVITPQPGDLSQVPYAEPLWLAEPFRSPYYKDSHRELRRKLREFVDSELYEEAQECEATGRYISQKMIDRMSELGILHMRLGPGKHLHGVNLMXGAVKGEEFDYFHDLIVSQELARAMARGFADGNMAGMTISLTAVLNFAXTRPGKNKIANEVFSGKEEICLAITXXFAXGFDVAGLRTTAEKTPDGQHYI

SEQ ID NO: 167659 - protein, 193 aa, Triticum aestivum
  unsure (1)..(193): unsure at all Xaa locations
  Clone ID: PAT_TA_62077.pep
MAPVKVFGSAAFTNVARVLVCLCIXQPFGEIPAFQDGDLVLFESRAIAKYVLRKHRTDEVDMLRESNPEEAATVDVWAEVXHQYSKAVAPIVYECIVYPTAYGIPTNQKVVDESVEKLKKVLEVYEGRLSKQEYLAGSFISVADLNHFPFTLRFMETPYASVFDSFPSVKAWWEKLMLRPSMKKVSADMQRKV

SEQ ID NO: 167660 - protein, 151 aa, Triticum aestivum
  Clone ID: PAT_TA_62078.pep
MSDFDEGDVAGAGGDDAMYEDEEINDYYDPEPADDGENQQENQDDNIINSGDPSAIANAVKGGDRLLKDKKIPESERTTTPYMTKYERARILGTRALQISMNAPVLVDLEGETDPLQIAIKEMREKKIPLIVRRYMPDGYYEDWTCEELLQ

SEQ ID NO: 167661 - protein, 203 aa, Triticum aestivum
  Clone ID: PAT_TA_62079.pep
MRQAEGEPHRYLYKDVSNPDDIAIVVSPMRRTLQTAMLSMDWLVERGVKIEGNADWQENSDKPCDTGSLIPSVSKDFPQVNFSTVDPVWPDKKSSAGRHYAHTKQSILARGKRALEDLHKRPEKLIFVVSHAGFLRLGVVGYWFYNSDYRVFDFETERNADGGLRVVQQKRTLTGGLGLSWEDPVALGGDLPEEDPETDPSAF

SEQ ID NO: 167662 - protein, 72 aa, Triticum aestivum
  Clone ID: PAT_TA_62080.pep
LKSARATSRCSPSRLEGFLVAGGDFLFNLQQPGEDEQSNSEFLPVRTIIELDQLDNGQTHKGCRSLQDDAAA

SEQ ID NO: 167663 - protein, 148 aa, Triticum aestivum
  Clone ID: PAT_TA_62081.pep
MTMAARLMLVAALLCAAAAAATAQQATNVRATYHYYRPAQNNWDLGAPAVSAYCATWDASKPLSWRSKYGWTAFCGPAGAHGQAACGKCLRVTNPATGAQVTARIVDQCANGGLDLDWDTVFTKIDTNGVGYQQGHLNVNYQFVDCRD

SEQ ID NO: 167664 - protein, 128 aa, Triticum aestivum
  unsure (1)..(128): unsure at all Xaa locations
  Clone ID: PAT_TA_62082.pep
GKKXXXKKKKKKKKKKKKKKKKKKKKKKKKKKKKKKKKRGANAVFQNAAPKTLGPGNLPKLQRFKSALEGPIAGLEKNPEDQNIYGVLFSFGKNHGSFSPNIPKLLPKKYCCCTDSFCLRGSFKFGIY

SEQ ID NO: 167665 - protein, 187 aa, Triticum aestivum
  Clone ID: PAT_TA_62083.pep
MVQDFEQSAAAMDSSSGWAVAPAVSTAAPTMPIGGILTMTGIFLVFLTFALALIFLQYYFNTSVRTAPRGRPRGVRGVAAGGVDPELLRSLPVTVYRAGPKGSTDDVGVECAVCLTELEDGEEARFLPRCGHGFHTECVDMWLASHTSCPLCRATVGKPDASQALTPTSLPSLPPEPMNYAGNLPAM

SEQ ID NO: 167666 - protein, 124 aa, Triticum aestivum
  unsure (1)..(124): unsure at all Xaa locations
  Clone ID: PAT_TA_62084.pep
MSTGPTSSPGGGGGVVAQRTGGHASKGSLSGKIQVQGSNANITHTINEDERTEFTRHINAVLAGDSDIDSRLPFPTDTFEMFDECKDGLVLAKLINDSVPDTIXDERVLNIPGRKXKLHAFHMS

SEQ ID NO: 167667 - protein, 88 aa, Triticum aestivum
  Clone ID: PAT_TA_62085.pep
HRGSIQPTFAGFVDTDISSGKISLRSLIDRSVVESFGAGGRTCILSRVYPSMAIGKDAHLHVFNNGVTDIKVSKLTAWEMKKPMMNGA

SEQ ID NO: 167668 - protein, 77 aa, Triticum aestivum
  Clone ID: PAT_TA_62086.pep
FLYICPDSALPLQLSRFLEMRKITLALRTAHHSHFRVGLRCRHGGMSIWMACVTPNSLKWFFSSLHFYIIAIKHFIS

SEQ ID NO: 167669 - protein, 248 aa, Triticum aestivum
  Clone ID: PAT_TA_62087.pep
MAARLHHFLLLAALLLLIGGASSAGDVVAAGNGKVRMELYYESLCPDSFEFMVDSLARVFKDGLLDAADLTLVPYGNAKVDAHGAITCQHGPDECLLNTVEACAIDAWPDVNVHFGFINCMEELAMEYKHQEWQSCFQKQGLHPKPVMECYKSEHGHKLSLRYGRQTDALLPRHTSVPWVVVDGKPLYDNFGDFVAYICKAYKGRPPKICQHKQPGRDHPAVQQAAEAGHRVGYTPAISCSMMRRRQD

SEQ ID NO: 167670 - protein, 75 aa, Triticum aestivum
  Clone ID: PAT_TA_62088.pep
VRGKVSNKYTRQNNSESMAGSKTSPYCDFKPGCALAIDTEVTSSYKTSLAWRYRRVQYGKINLRSDERPLSCSDR

SEQ ID NO: 167671 - protein, 115 aa, Triticum aestivum
  unsure (1)..(115): unsure at all Xaa locations
  Clone ID: PAT_TA_62089.pep
MQIFVKTLTGKTITLEVESSDTIDNVKGKIQDKEGIPPEQQRLIFPGKQLEDGRNPPEXHIQKEAPPPPGLGLGGGMENFXGKPSPGKTIPLEVESPATFHKARAKIQNKEGFPP

SEQ ID NO: 167672 - protein, 114 aa, Triticum aestivum
  Clone ID: PAT_TA_62090.pep
MAKLAKAKEIVASASVVVFSKSYCPFCVQVKKLLTQLGASFKAVEMDTESDGTEIQSALAEWTGQRTVPNVFINGKHIGGCDDTIALNKGGKLVALLTEAGAISGSSSKTTVTA

SEQ ID NO: 167673 - protein, 95 aa, Triticum aestivum
  Clone ID: PAT_TA_62091.pep
SQTQTKLSNQASCGLKRKLIASQPHLSGTGPAAAAAVEDAHGCTLPAAAHESQFFLLILSSSPILLFLFFTVELLAAPCWLILCRTFSCRTCTCA

SEQ ID NO: 167674 - protein, 139 aa, Triticum aestivum
  unsure (1)..(139): unsure at all Xaa locations
  Clone ID: PAT_TA_62092.pep
HKPDTTIASTHAHHGCFPSRPSNTTAPPRRSRPSTWTTTSXRRRRARGTAGSCTARRRAAGAPPSRRARTPARSTGPAPAAAGRRRRRGSRPGAPAPARAAXAARAAPRRPAAAAAAPAAAGPGTAPPAPAPPPPATRR

SEQ ID NO: 167675 - protein, 139 aa, Triticum aestivum
  Clone ID: PAT_TA_62093.pep
NKIMPPPLQENTADLYRRINQPKNKHIPGETAAQEPHPYVHTCKYHTRFAGSISSSFSFFCSFLSLFVVFACQWPLKTCIHFLRWSLDHSWLGVDTRDRPLLPSLGRRIHRPCKTRRRPMPGVISESRSSPSWTGLGEK

SEQ ID NO: 167676 - protein, 212 aa, Triticum aestivum
  unsure (1)..(212): unsure at all Xaa locations
  Clone ID: PAT_TA_62094.pep
MAPFGTLYSFMPNGRVFKILAAAKLNNLNIEVPPYQHFVTNKSIEFLTKFPAGKVPAFEGADGFCLAESDAIARYVSQSGPYAGQLLGEDAVTSAKIQQWISFFADEVYPAVLDLVMWRVGMGQFDQSTETKALAQLEYALTVLEKHLSAATQLVGSRLTLADLTGAXPLLWXFMHVXDGPMRKQXPNVLTWYLSTIENDDVXEVFGEPNLI

SEQ ID NO: 167677 - protein, 114 aa, Triticum aestivum
  Clone ID: PAT_TA_62095.pep
LQCREVHKHGSNKGGDNARREIIIKLLAAFLRQRRIAQSQLHEVDRRLPPSLPPQKQASRRQQQQRAARLAAAGRRRVAAGCSSSSPPPPPPPLAPGSLAGSSRRSGHAQRGFV

SEQ ID NO: 167678 - protein, 206 aa, Triticum aestivum
  Clone ID: PAT_TA_62096.pep
SSTTTLQCLSLLHRTLLFGAPSQDTICLFDVDGTLTPARLDASPEILAVLQRLRSKCAVGFVGGSDFAKQQEQLGKPAGQPVTALFDFCFSENGLTALKLGEPLDSNTFIKFIGEEQYKELANFVLHYIADLDIPVKRGTFIEFRNGMINISPVGRNASTQERNDFEKYDKDAKVREKFVAVLKERFGHLGLTFSIGGQISFDVFP

SEQ ID NO: 167679 - protein, 67 aa, Triticum aestivum
  Clone ID: PAT_TA_62097.pep
RRYGAFLFFFFESEQSIAIFIICQDNIFNCKKRKPILSSSPRETRIGPSASTQDVQCCVEWIRDHIR

SEQ ID NO: 167680 - protein, 66 aa, Triticum aestivum
  Clone ID: PAT_TA_62098.pep
LTSTLLISQYGIVTKRATIATSYTAKELSFPLPSKRNTHLLGSSSNSSDAKFSRTRPASVVSDRGR

SEQ ID NO: 167681 - protein, 209 aa, Triticum aestivum
  Clone ID: PAT_TA_62099.pep
RAARGPAGAGEMQKKEKKKKKNLKKKKKKKKKKKKKKKKKKKKKKKKKKKKKKKKKKKMAPSAPKGRPPGTPSPKKFFWGGGPKTQKWGPKRGPPVLKLGGKAAERGKKGGGKTPRAGPFGGAKGGGARGSENPKRGGKMGPKGAPKGGFLGKRGGETPIGNFSKNREKGCPPLEKIPGKWFHNFWKTKNWVFTFPGAPVFLFWRVLPP

SEQ ID NO: 167682 - protein, 35 aa, Triticum aestivum
  Clone ID: PAT_TA_62100.pep
YLLPLMVYGLRILCCNNITIGSHVSNSSSRTEFDP

SEQ ID NO: 167683 - protein, 62 aa, Triticum aestivum
  Clone ID: PAT_TA_62101.pep
ALPAPNNFWHSILIVSPVTVKVSSDSPRIVHQNFRTMADHNGVKKSILELICGCFSSSGTKD

SEQ ID NO: 167684 - protein, 75 aa, Triticum aestivum; identical to SEQ ID NO: 106874
  Clone ID: PAT_TA_62102.pep

SEQ ID NO: 167685 - protein, 59 aa, Triticum aestivum
  Clone ID: PAT_TA_62103.pep
GKLRFFLLLIGGQGGVKGFRFFFFFFFFFFFFFFFFFFFFFFFFFFFLVLSRSIARKDK

SEQ ID NO: 167686 - protein, 172 aa, Triticum aestivum
  unsure (1)..(172): unsure at all Xaa locations
  Clone ID: PAT_TA_62104.pep
AAASMFLFLAAITAITMALIPYVNNDCAYAAGALATPINNAGILCTEEKCTLDAPANKRSDTLWXRAGCNFMGNSASWHTADWRLTMSCTLSGXDDDDPETELTIRNRQXFYNISGIEGFILTLTFSCSNASKLNVTILYIXPDAYLFPXCDDAKNRYCRRDCMSYHATYCT

SEQ ID NO: 167687 - protein, 158 aa, Triticum aestivum
  Clone ID: PAT_TA_62105.pep
MKKVVLKLDVHDDRHKAKALKAVSGLHGIDQLGVDMKDQKMTIVGTVDPVAVVGKLRKLFPGVQIVSVGPAKEEKKDDKKDAGGDKKPAGDKKEGDKKDGDKKDGDKKDGGDKKQQEAKPPMSVYPHYAYAHYAYPPPPPPRYVVHSAEEDPNSCVIC

SEQ ID NO: 167688 - protein, 61 aa, Triticum aestivum
  Clone ID: PAT_TA_62106.pep
IILDGLSWLPFLSSFSLRQVSCQEVPPTVDFILCLSTPQTDDDDKASAQIGPTCGLIRNPT

SEQ ID NO: 167689 - protein, 94 aa, Triticum aestivum
  Clone ID: PAT_TA_62107.pep
IYAGPAYQVDLAKQVKKAVGDSVLVSAVGGIKTGHLAEEVLQSGIDVVRAGRWFQQNPGLVRAFANELGVEVKMANQINWSFKGRGKNGHKKSP

SEQ ID NO: 167690 - protein, 111 aa, Triticum aestivum
  Clone ID: PAT_TA_62108.pep
GRSSRRAGHMFAQLGHRSRTPPTQESVRHRSCKNGVTSHRHGLPPRHSHAHLHRVAVEAGSDVAPSTSSESCQGFLSALFSAVGSADGFVQNKAFQRKSYGMRGLNLELCY

SEQ ID NO: 167691 - protein, 252 aa, Triticum aestivum
  unsure (1)..(252): unsure at all Xaa locations
  Clone ID: PAT_TA_62109.pep
MSASYWQSTQCRFWTFTKEQLATMRQKLEEDNAELVRMFPLPQQRHLNIYFNQQLIRLAKRLTIRQQSMATAQVYMKRFYSKVEIRRTNPYLVIATAIYLACKIEESPQHIRLIVTEARQMWGDLVAIDTSKLGECEFFMISEMRSQLIVYQPYRTVVALRSELGLQEDEVQLARSVINDHFMTDLPLLYPPHVIAMVAMLXLALVLRPNNSGPGQNPSGAAAAAGLAAAQXALMRAQGQQTFRGRATDAAT

SEQ ID NO: 167692 - protein, 161 aa, Triticum aestivum
  Clone ID: PAT_TA_62110.pep
MTTSRVDPADALQLAAITFDWGDSLDTKDWARLEAILAPELVVDYAEVTGQSWDAMPAKDFIAMVSAPTFVGDPLVDSQHFIGGSKYEVVSTDRVVGKHQLRAAHQRYTGADKTTVEAKGHCHALMQHTYVKIDGEWKLAGLKPKVYWTEFDFDKIFKSSS

SEQ ID NO: 167693 - protein, 98 aa, Triticum aestivum
  Clone ID: PAT_TA_62111.pep
AARAAGAGIRAHSHPISPFPSPLGFSTMVVRLTRSLLLSRGSALHVRRYRFLRPDADGGSRLPPCAGLVPRSAALGVGEEVRDADRELVAAGLGPELE

SEQ ID NO: 167694 - protein, 205 aa, Triticum aestivum
  unsure (1)..(205): unsure at all Xaa locations
  Clone ID: PAT_TA_62112.pep
HYLLLRSLSCGGRRRADGGVGRLCATQHLFAPSTSPTPPELPHPSSSSPRSCGVVSANLLVWWALGTMAAAHLLLIHTNDELRALANIFGTSMVELKTLDALRTAPEMYQTLHTLVRGRNWACDELPILQGFSELARNVENLRLLFQSMLPNVMPYPVLEGNGSILHTIAHIRLQGAEIQRAKKTFKFXGWRAPTASSQAWQIII

SEQ ID NO: 167695 - protein, 102 aa, Triticum aestivum
  Clone ID: PAT_TA_62113.pep
SACMPKLRTWFIDRSCPQLQRHAYLTIGNFTGCLLYQPAGSSGAAVAAEWWGGRSRGTCGALTQGSAPVDPLLDDLLLEDLLSSEISNAYLARPPSMARSNI

SEQ ID NO: 167696 - protein, 74 aa, Triticum aestivum
  Clone ID: PAT_TA_62114.pep
TWCYLLFLLAKHGVLGCLVPSYDELQTLLPTLFDQSYEKLLQGLRMKKCTKNPIFFLYIFIIYIQLLGLWLFYL

SEQ ID NO: 167697 - protein, 118 aa, Triticum aestivum
  Clone ID: PAT_TA_62115.pep
IYYITWGAARPRTTWRRGRGARRCTRARGLRRRRCRRPASRSPCGCAPASCALCMRPLVGIPEAGTPTPASAVPSWTAASPVGGRGHQRPRPTWQASHPCCARSHAHTRRLVYIIQYI

SEQ ID NO: 167698 - protein, 84 aa, Triticum aestivum
  Clone ID: PAT_TA_62116.pep
ILSENNIIDFFLSVTGIDYCQGNPTNIHTSLLEIIHLNMVSANSNRSESIYGFLLSTTRQYGNPLRFYDLRALTMRCFGGWYFA

SEQ ID NO: 167699 - protein, 158 aa, Triticum aestivum
  Clone ID: PAT_TA_62117.pep
SYTGTLRPPEGPGAEAGAQKPPLVAAAPPPPPCRPPLSRQGRRRAAGPSWHVVLTINHHLSSTGVYPSIILQVRSSRTRPVRAGVTSGDPAGRDVDGSTSQAIGVAQDGGRKPSVASGLRSSVNLILLFKILDTYRWTTRLLTASLAVRVGRACVSTL

SEQ ID NO: 167700 - protein, 56 aa, Triticum aestivum
  unsure (1)..(56): unsure at all Xaa locations
  Clone ID: PAT_TA_62118.pep
RMHTSMIIWSLLGKHQGLWEAGESPAALFDILSGFILVNLECSMFLTSVAPKKTSX

SEQ ID NO: 167701 - protein, 118 aa, Triticum aestivum
  Clone ID: PAT_TA_62119.pep
FSGACYMIVVISFFDFILFTSFFFTVTALMITFLDYFQRVPWQTKLVDTFQSGCGPRWAANRIDRLSGARPIRLFSARSKVLHRVTTIYTGPGRYLEGFSQERKKRSRLHFYFYTSGT

SEQ ID NO: 167702 - protein, 112 aa, Triticum aestivum
  Clone ID: PAT_TA_62120.pep
FYSPFRTLFRRRRFEPPPNQQQSTGGAAMARTKQTARKSTGGKAPRKQLATKAARKSAPTTGGVKKPHRYRPGTVALREIRKYQKSTELLIRKMPFQRLVREIAQDFQKDLR

SEQ ID NO: 167703 - protein, 54 aa, Triticum aestivum
  Clone ID: PAT_TA_62121.pep
QRSRSVAMAKIDEDGPCEFSLAGDGVAFARSRSCAVSAGRASGQRGRAAHVPVS

SEQ ID NO: 167704 - protein, 73 aa, Triticum aestivum
  Clone ID: PAT_TA_62122.pep
AAGDEAVTSGGGGDEKKHSGFNQRPTIVVAAMRCAAHVATHEARARSGRGFQPARSDGAADAGAMGRGSWCWP

SEQ ID NO: 167705 - protein, 265 aa, Triticum aestivum
  unsure (1)..(265): unsure at all Xaa locations
  Clone ID: PAT_TA_62123.pep
MAAAPVVVPRMKLGSQGLEVSAQGLGCMGMSAAYGERKPDQDMIALLRHAVAAGVTFLDTSDIYGPHTNELLLGKVGYLLTTATRRVPWLLASCHSHADVXPARVLRAIKQALQGGVREQVQLATKFGITATWEVHGDPAYVRAACEGSLARLGVDCIDLYYQHRIDKNVPVEITMGEIKKLVQEGKVKYVGLSEASASTIRRAHAVHPITAVQLEWSLWSRDVEEDIIPTCRXLGIGIVAYSHLGRSXLSSGPXLVDTLPEDDF

SEQ ID NO: 167706 - protein, 82 aa, Triticum aestivum
  Clone ID: PAT_TA_62124.pep
RVRVHVRFATSSRSGWMLRCWQGDDGRTKNSLCKAGALLLRASHWFQLGPLRCFSSNLVELAGLVSGMVDKSTFGYDRASLA

SEQ ID NO: 167707 - protein, 58 aa, Triticum aestivum
  Clone ID: PAT_TA_62125.pep
GESNICTDEATPFDTPVLYTCSLVWAMSIFPGQRLNATNILESMTWYFEGDDAPNSSA

SEQ ID NO: 167708 - protein, 171 aa, Triticum aestivum
  Clone ID: PAT_TA_62126.pep
CTPELTETIGVVKAYTTRVGQGAFKTEDTGEIGTKLQEIGREWGTSTGRRRRCGWLDLVVVKYSASINYYSALNLTKLDVLDTFETIKIAIAYKVDGEELDHYPADLDLLERAEVVYHEMPGWQKPTTGAKTFYDLPKQAREYIEYIEKFIGVKVKWIGTGPDREAMIARA

SEQ ID NO: 167709 - protein, 49 aa, Triticum aestivum
  Clone ID: PAT_TA_62127.pep
LRKNCSLMLKFICIHHFCIPKTINMNHHPRSLSLPHTIMTKRKQNRFQR

SEQ ID NO: 167710 - protein, 232 aa, Triticum aestivum
  unsure (1)..(232): unsure at all Xaa locations
  Clone ID: PAT_TA_62128.pep
MSKPVVLEDVTGGSVNATHLCVLVHGLWGNPSHLRNVAKSLRDNYSEDELYILLAKQNSGNHTYDGIETGGERVCAEIQQELKDIEKKGGKITKLSIAGYSLGGLVSRYAVGLLYAXGVLDDLECMNFTTFATPHLGVRTPLKGWLSNIYNVLGARTLSMSGRQLFTIDSFRNTNRPLLAVLADPNSIFMSGLKKIQRPTLYANIVNDPSVVHYTSGINKXDPYTDLXHVKL

SEQ ID NO: 167711 - protein, 44 aa, Triticum aestivum
  Clone ID: PAT_TA_62129.pep
SSQIRKIEASREIAATLSSNPNVAYLPGGSGKQGGQYLLSVGRA

SEQ ID NO: 167712 - protein, 130 aa, Triticum aestivum
  Clone ID: PAT_TA_62130.pep
MAEKKVVVKLDVHDDRQKQKAMQVVSTLHGIDHIAVDMKDQKMTVIGTVDPVVLVERLRSKFPTAQMLTVGPAKEEKKDAAKKEGEKKEGDKKEGEKSKPVVYPPPYWYPPPPYHHACSGEEDPNSCIIS

SEQ ID NO: 167713 - protein, 92 aa, Triticum aestivum
  Clone ID: PAT_TA_62131.pep
MTRAQQTISLALLVSSLYLALFLELIPLPPLIQEQIVPVLPFWALVSFGAYLLFRLGFGILTFNDVPNAHKELTAEIEQAKVELRKLGVTVD

SEQ ID NO: 167714 - protein, 99 aa, Triticum aestivum
  Clone ID: PAT_TA_62132.pep
ARLKLLCVSYSGTGLLRDHGVMALFKVSQIYHNRSLSSTPGLPGTSESREPLSPSPDLGVVCLATLMSETPWFGHFTDLVALETLKFPTWMRQRWHGCI

SEQ ID NO: 167715 - protein, 229 aa, Triticum aestivum
  unsure (1)..(229): unsure at all Xaa locations
  Clone ID: PAT_TA_62133.pep
MKILTKEEEEAHYSAVLKGGFIGGSLGLTVGLGGVFLASRRYPAFRGLTLPFRTFLVTSAGTFGAIINADRWSMDFQKKQNPMNFYEDQTQRAQQIVRENQTAMERFMEYGKENRYSIVFVSWLASMGVAFAMVSRSPMNTANKVVQARVYAQGLTLAVLIISAIFEVNDAKKGEGRWQTVMVVDPNDPEHKRLIEKKIXKEEYEGQGLWKDMVAAEERRLGEKSKPRE

SEQ ID NO: 167716 - protein, 101 aa, Triticum aestivum
  unsure (1)..(101): unsure at all Xaa locations
  Clone ID: PAT_TA_62134.pep
MASHAGRLLLLLALDAALVCRSAKGAWCVCRTDLPDATLQRTLDYACGSAADCKXIQPNAACFAPDTVKEHCSYAVNSYYQRSGQKSLGCVFSGTAVVSSV

SEQ ID NO: 167717 - protein, 188 aa, Triticum aestivum
  Clone ID: PAT_TA_62135.pep
FSLTHRQYPIQPIAIMLATPTLSNFDKPSLPSSEGGDPALAARLQPLYSRFLTDLDLQPEYRRHESEKLMEEVLKFAKSTGVPHDLNSHSYQSLMVGYTYADNCLPYHDIEVKGYVAIYTWLATICDDAEALGIIDDVQLFEQRFILGEEQTTVLLRGFVDQLKLTYKLYHPPVAKLILCSSLNLLTS

SEQ ID NO: 167718 - protein, 73 aa, Triticum aestivum
  Clone ID: PAT_TA_62136.pep
LGPPPPPQKNWLGGRFPEGARGGAGGPFFVLLFLFFFFFFFFFFFFFFFFFFFFFFFFFFFFFFFFFFFSHLK

SEQ ID NO: 167719 - protein, 144 aa, Triticum aestivum
  unsure (1)..(144): unsure at all Xaa locations
  Clone ID: PAT_TA_62137.pep
MAPKAAEKKPVAAAEKTPAGKKPKAEKRAPASKEAGGEGKTRGRKKGSKGQKGVETYKIYIFQVVQEVDPHIGISSQGMVIMDFFLHDIFQKLXGSSARFAPSTKKPPFPSRRFKTSFGFFFPGRFAKKAFSKGTKAAPKSPPS

SEQ ID NO: 167720 - protein, 136 aa, Triticum aestivum
  Clone ID: PAT_TA_62138.pep
NVTSMHISFTLDNSECMIRTIISLHVEDDETATEPKKKRSNRLPNAVKLTADYSNDSLNQAHLLYLNSSMAHTLKLKLRRILFRPNFQPLIPFLPGEELTVVATTGSDPLLSATVFCQSMKLLHPLKLILSSALKA

SEQ ID NO: 167721 - protein, 109 aa, Triticum aestivum
  unsure (1)..(109): unsure at all Xaa locations
  Clone ID: PAT_TA_62139.pep
MSHVEIASLYTDLILADYGIEMTADKFQTLIXVANVKEVEAIWTSIFTKVLEGKDVKDLLVNVGSDXAVMPLPLGGAAAAGDAEEAAPEDVKDEENEESDEDMGFSIFD

SEQ ID NO: 167722 - protein, 207 aa, Triticum aestivum
  Clone ID: PAT_TA_62140.pep
LSHPAPSHLAGKSPPTDRSEGHLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLKLRGGMQIFVKTLTGETITLEVESSDTIDNVK

SEQ ID NO: 167723 - protein, 69 aa, Triticum aestivum
  Clone ID: PAT_TA_62141.pep
SYSLRPKILVQEMNESRCILVLYTSICIHFFDKYFQTEGVFLSQKITCNKSRTLLSNPVSVFSFWRIKE

SEQ ID NO: 167724 - protein, 54 aa, Triticum aestivum
  Clone ID: PAT_TA_62142.pep
SYQGGLDMGVLSHMNADFFPKCCNNCKFFSEAYVCDQIDHMSSRALLREARGGE

SEQ ID NO: 167725 - protein, 172 aa, Triticum aestivum
  Clone ID: PAT_TA_62143.pep
MLSHSLSVESRSEAVLSLQGQRPYQAGDRAARSQLDRAGGSSHSQIRRASASEGALCTCRRNLVFAVTARSGEDKQARRDPGWGMGGRTGAWDGGEEEERRASLAPVTRCGGKDASGTARSTSVAQRKERRESRGNASRQTEGGETCSRVCTRGCRLAETADTCVPARPHSE

SEQ ID NO: 167726 - protein, 69 aa, Triticum aestivum
  Clone ID: PAT_TA_62144.pep
MASSATMARTVVVALLLTQFCDVVLAARLLEGGGAWLQGGVGAAGALIMHILPGGSPGAGAPNGCTNNG

SEQ ID NO: 167727 - protein, 153 aa, Triticum aestivum
  Clone ID: PAT_TA_62145.pep
MAAAARRALLLLLAAAAVVLLAAPPASAARPCGRAQTLLISFSSFSRPNPDPDDPSPLTTTDNTVLRVRNLDPHRFFFFNQNHLQNNSPDKSQPADATPETDLRDIKHRIKKSKDDNKANNAEVTKSQNSQAGKDAVQKASKDPKIDGDGGNP

SEQ ID NO: 167728 - protein, 89 aa, Triticum aestivum; identical to SEQ ID NO: 130083
  Clone ID: PAT_TA_62146.pep

SEQ ID NO: 167729 - protein, 258 aa, Triticum aestivum
  unsure (1)..(258): unsure at all Xaa locations
  Clone ID: PAT_TA_62147.pep
MDIRLLTNADLPLIQHANLENLPENYFLKYYLYHALSWPQLSYVAVDVSRPKKDPYEYPKIVGYVLAKMEEEPSDGIPHGHITSLSVMRTHRRLGIAEKLMRQSQLAMVETFQAKYVSLHVRVSNAAARHLYENTLGFTNEKTESKYYADGEDAFCMRLDLGDIKKQVDETLAAEEADAADEGDAVGEVGRDPEAGKDKEDGEGRKMKVAVGRGLXVGSLVEKMSRTKQVKRGKMKSHGTICSNRRIDKRGLSPDEHI

SEQ ID NO: 167730 - protein, 112 aa, Triticum aestivum
  Clone ID: PAT_TA_62148.pep
SSRAGARRKAVVGRGRFSDGERAASRHAGESWADDGEWEEASSTSDDDHHRRHHHHDGSEEHLSEVTIRITKRQLHELMERKTPGGLCSSTRQLLANIMDSGEVLHHDVHQE

SEQ ID NO: 167731 - protein, 193 aa, Triticum aestivum
  Clone ID: PAT_TA_62149.pep
MLTSVGRAAARRVQTSRISAPTSVSAQLIGRQNAVAAALPIRSFTASTWSSSPTASDKKPAKKTTTTTTKKAAGTTTTTKSKAKATETKSKDKATKAKAKAKPKSKAVEEKPKKLKKEVDPEKLKKLEIKEVKKWTLKDKLPTLPASSWILFISENRGSSTGAGGITQQTAAIAEKFRQLSQSELEDLTPEPL

SEQ ID NO: 167732 - protein, 206 aa, Triticum aestivum
  unsure (1)..(206): unsure at all Xaa locations
  Clone ID: PAT_TA_62150.pep
MAPLYKKTLVLGASSGIGEALAAKLIATGTKVIVVGRRRDNLESFVSKHGHENARAVVFDVTNLSAINEFAERIIKSDPDLDSVVLNSGIQRGFDFCNPESMDLSVLGDELTTNYTSAVYLTAAFIPHLKKQASGHLIYVSATLGLIPSMVRTPNYNASKSALHTFILNVRQQLVDGGAGHVRMVEVFXPAVQTELHDEKHQPDLV

SEQ ID NO: 167733 - protein, 83 aa, Triticum aestivum
  Clone ID: PAT_TA_62151.pep
GRSRRPAGVTRLGLAREPYHVPLSRLSGNRCRKLTGARTTTPQHSAGGFQIQLALGALKSAGEKKKCVDSSRNCPGVLASERE

SEQ ID NO: 167734 - protein, 221 aa, Triticum aestivum
  Clone ID: PAT_TA_62152.pep
MGSCASRSPASVVAAGSGRAVATKTAKVIGLDGSMAQYVALVTARQALVDAARAWSFLCSSDELRLDAPARALAEDEALQPGCFYFVLPVSMLRRPLSGQEMTALAVRASSALAVASGISSPTRGKNGAALAGANGKRRKVAARVAPLAHDDDVAERDGGWDQHLAYGKYGGVPKRVLAAGDVAAGKARRGDGYGGRRSSRHRRRRAGAQRLSAILEADDL

SEQ ID NO: 167735 - protein, 74 aa, Triticum aestivum
  Clone ID: PAT_TA_62153.pep
MSAIRYTLWYYSPTKIPRSTLPKERIGYLGLRTMYSFTPTTAPQRKPDQTSTTQSSSTTSAEWGVATTESRISV

SEQ ID NO: 167736 - protein, 113 aa, Triticum aestivum
  Clone ID: PAT_TA_62154.pep
LASVQLVDPELGYDTDPETKRTIDCVAEVAFQCLQMDRDLRPSIKEVVEILTCVRNRDCHVKSMKKQASQKEDADFLTDGLQFSSDTVIHRFHSQSTNHSGASNASGLSNMKC

SEQ ID NO: 167737 - protein, 92 aa, Triticum aestivum
  Clone ID: PAT_TA_62155.pep
FQKNSVCVKPVGRGRSVRVRFVHTTYVLQLLVAAENEMVCGRRRGPCDVPSSCMHACTHCQVPAMSLPACFFVCCCYLYKMTPFCWNRISAF

SEQ ID NO: 167738 - protein, 139 aa, Triticum aestivum
  Clone ID: PAT_TA_62156.pep
IDPTISTSNLLLSSSSPAPASRSREGGSMEVERPVSMMPGLADGFFTEADLAAADQLVQLSVSGGAEATSPTSSTRSVQSVNNTEAAGRKGGCDDGAPWLDRRARKRYRRVAELYHATRPLKRTDAGGKRRREEITGNR

SEQ ID NO: 167739 - protein, 35 aa, Triticum aestivum
  Clone ID: PAT_TA_62157.pep
MANTYPVVSAEYQEDVEKARQKLRALITHKNSTPL

SEQ ID NO: 167740 - protein, 140 aa, Triticum aestivum
  Clone ID: PAT_TA_62158.pep
LFDTTTRLGREEEKEGMDADLEVADQGGGSGSCRPGRRVWTSPARMVALDARGRGCSMTRMAASDAQLGPRRGWQRSPRPMPPDVNPQLLTATLSFSLSLLVVLKHTSETYTHWCSIYTPHTHTRGELVVVLLSSLADPE

SEQ ID NO: 167741 - protein, 98 aa, Triticum aestivum
  Clone ID: PAT_TA_62159.pep
THMLIMKGGGGGRSTSAAPCGLRPWRPGLVAAAAEAVEAALAGLIAAETTQRREHARVEASLLLVALLRVLVVGHALRWRRVVVHLAAGRLGSSPLSG

SEQ ID NO: 167742 - protein, 110 aa, Triticum aestivum
  Clone ID: PAT_TA_62160.pep
GPHPRALRLRAGFIIFLMSQIHAAPTMERRNNTSGSMDNYHTWRREVWQESSLVINHGHHHRCSTACPRACRQSPPCVVDDVSANPLVASAVRVLHVSPRVRGKDPLLQS

SEQ ID NO: 167743 - protein, 130 aa, Triticum aestivum
  Clone ID: PAT_TA_62161.pep
KRMSNKLKRQEPATLIKPPPASQRKNSLLQPSIYCIIAAARRDTSAEDTKASAETLAAAPASGAGAGAEEGAMKSCADAEAKKTATARSSTPTRGAITTLRCSLRACESMGGWGRRGVSNMGAPRWDARK

SEQ ID NO: 167744 - protein, 57 aa, Triticum aestivum
  Clone ID: PAT_TA_62162.pep
SPLVMSYMAKSQKQTPLRRPDIFYQVCTFIIMGIREVFHGHRLLSIQYIPIIASVFI

SEQ ID NO: 167745 - protein, 226 aa, Triticum aestivum
  unsure (1)..(226): unsure at all Xaa locations
  Clone ID: PAT_TA_62163.pep
MATAASSSRVAAVAEQEDKNEPARPLAIPHPHAHPAASDADEAAQTATGWRSTQYLRRKRRCLLCCGGCCVATAVIVGILILALSLTVGWXXDPRLTMNGVSFAALRAGPGTGLADPVAANATLTADVSIENPNIASFRFSSSATEVYLGGRTVSVAYVPGGRVGAHGSVRMNVTVDILGDRLSGAVNATGLLLGQAYDLTTYTEMGGTVKVLRIYKKDLEIRMNC

SEQ ID NO: 167746 - protein, 119 aa, Triticum aestivum
  Clone ID: PAT_TA_62164.pep
SYHFKLVIHPPDVRRARPVSVCLQHSLTTNPSIRSTKKTYMASSATMARAVVMAVLLMQCCNVVLAARLLEGDGGWLRGGVGAAGALIMQVLPRGGGSAGAPNGCTNNPKHPPGGKCHG

SEQ ID NO: 167747 - protein, 112 aa, Triticum aestivum
  unsure (1)..(112): unsure at all Xaa locations
  Clone ID: PAT_TA_62165.pep
FHHELNKESIYHASLGTAARVDACEQTGRDRAENIETNLELLVKTGEXQLGFHTGVEKMDKSKEKLIILTNYWTPMRKRQIDDYPLVTEITVFCSLVHNDELGTACVKDYPF

SEQ ID NO: 167748 - protein, 45 aa, Triticum aestivum
  unsure (1)..(45): unsure at all Xaa locations
  Clone ID: PAT_TA_62166.pep
LVGVYMYISLKKSREKKTKNQALSPNKNXMRNXRSSNXRPXRLER

SEQ ID NO: 167749 - protein, 163 aa, Triticum aestivum
  Clone ID: PAT_TA_62167.pep
TSPPAQPGERRTIESHRAYGKMQIFVKTLTGKTITLEVESSDTIDNVKAKIQDKEGIPPDQQRLIFAGKQLEDGRTLADYNIQKESTLHLVLRLRGGSRGQYPKNLEPNLRILAQKYNENKLVCRRCYARLPLRATNCRKKKCGHNNQIREKKRFMSKFGSDS

SEQ ID NO: 167750 - protein, 118 aa, Triticum aestivum
  Clone ID: PAT_TA_62168.pep
SLSVIGLRDCRAREDAATQLSPPPCSASCHPHVTAVNRRWPCRSWWKVWSTCTLRYSSEPRRLPSFAASELCRLWIAAGLIPEAYVLDDGLLACLVLPHLPNICLSTHFKWTTTYRCL

SEQ ID NO: 167751 - protein, 187 aa, Triticum aestivum
  Clone ID: PAT_TA_62169.pep
KKKKKKKKKKKKKKKKKKKKKKKKKKKKKKKKKKKKKAKKKKKRAPRAPRGRKTKTIPQKNFFGAKGPKKKKPKPKRDPPIKNLTEKPAKRGKKERKKSKRGGPKGLEKEKGNLAQKHQTPPLKSPQKGPARGNFSEKGAGNPNLLIFKKKSKKEPPQKKKTRKKAQKKLKKKKYGFSTFPGPPNPL

SEQ ID NO: 167752 - protein, 68 aa, Triticum aestivum
  Clone ID: PAT_TA_62170.pep
MAVVELKVGMHCDRCIKSIKKAIKTIDDMESYQLEKETNKVTVTGNITAEEVVKALQKIGKTVTYWGE

SEQ ID NO: 167753 - protein, 169 aa, Triticum aestivum
  Clone ID: PAT_TA_62171.pep
QPQHASSRQAVTANMNGLFAPRRLAFSINRSARVLHLGQRYGCFNQHWQSRFQPKQQNMNLTRSYGTLPDASKINKVIDAELARRGDFRRADEISDPEFNELYLQKFSHFETARPTKAKAKAKAKTKAKAKAKAKAKAKETKGAPIPAEPEKESSWTRFFIQYASRLLR

SEQ ID NO: 167754 - protein, 136 aa, Triticum aestivum
  Clone ID: PAT_TA_62172.pep
MVSSMKHCRDQAQEEPLSLSLSLGAMADRTKKQRRGVAAGEFVCKTCSRAFPSFQALGGHRTSHLRGHNGLALGLAAGSDQPGTKKTTDQKQAHQCHVCGLEFEMGQALGGHMRRHREQEAATTAQAPPVLLQLFV

SEQ ID NO: 167755 - protein, 79 aa, Triticum aestivum
  unsure (1)..(79): unsure at all Xaa locations
  Clone ID: PAT_TA_62173.pep
MDASAAGAVAKAKKYVVARKLGGGPRNKAVARSVKAGLQFPAGRIGRFLQKGXYPQRLIMGLPFYLAFVLEYLDVELLE

SEQ ID NO: 167756 - protein, 205 aa, Triticum aestivum
  unsure (1)..(205): unsure at all Xaa locations
  Clone ID: PAT_TA_62174.pep
MDAASESAVTCVDFWANGFGMRARIALRELGAAFEYVEEDLVRRMNPIHRSVPILIHRGRPVCXPLNILEHIQSQKKKKTSLSTSTRFWADFVDHKVFPTQTRFLKSKEKDAAKEELVEQLKRLEEVLSDKGYFSGDEFGFLDIVLIPFSSMFRGYEQHGGFDLEVECPNLMRWVKRCKERESVREVLPDEAKMYDLHKEWYGIE

SEQ ID NO: 167757 - protein, 98 aa, Triticum aestivum
  Clone ID: PAT_TA_62175.pep
MAAAASSSAWKARWLRPEAYPIFAATGVAVGICVMQLVRNITTNPEVRVTKENRAAGVLDNHDEGRRYARHPFRRFIDGKSAEIMPGINSFFTAPPKN

SEQ ID NO: 167758 - protein, 166 aa, Triticum aestivum; identical to SEQ ID NO: 107506
  Clone ID: PAT_TA_62176.pep

SEQ ID NO: 167759 - protein, 120 aa, Triticum aestivum
  unsure (1)..(120): unsure at all Xaa locations
  Clone ID: PAT_TA_62177.pep
YAFISLLASDLSFXKKKKKKKKKKKKKKQGTSSRRPRAVSWIKCMDLLFKKLNKFLYLGYNYYFTFLVLLFSFDYDYYYCYLFRHGVLIPFLIYIYRPRVYIYSRPVPKKLVVHCKRAYT

SEQ ID NO: 167760 - protein, 90 aa, Triticum aestivum
  unsure (1)..(90): unsure at all Xaa locations
  Clone ID: PAT_TA_62178.pep
RRGXLLDYGLPLHQQRRRVGLLYHSLPLHCWPKLSTGRTAEDQRHRRSILQLTEASRTQVKHAHTRCEDAHVVRLVVVLLLLDCFGANLS

SEQ ID NO: 167761 - protein, 74 aa, Triticum aestivum
  Clone ID: PAT_TA_62179.pep
MSSLQLLQLTEHGRNLFSSRRRTLAVVSGALLAGGTLAYAQSGRRRKHREENHSNDGNVHSRSKENISQNGVDG

SEQ ID NO: 167762 - protein, 71 aa, Triticum aestivum
  Clone ID: PAT_TA_62180.pep
LCSFAQIISPGMVSLDTSLSAAALCAIQASTSIRLDLAANSFPPSPGLFTHAYMTHLARLLPTTRRPLLPN

SEQ ID NO: 167763 - protein, 251 aa, Triticum aestivum
  Clone ID: PAT_TA_62181.pep
MDSPLPQPRRRRPVVLIASCALILLATALLLPRAPAVPPLTPAVRLDPRVARRSGNEVLWQLPPGPPRAAVFVAPGCTIRATDFFDASPGCPRCAGLPEERRFTREALRRGYAVLAVSSRAECWSLDAASASGDGSELAAVGSVIEWWVKEQHPELGGLPLVGIGASSGGYFLSALAARVRFSSVAIVIAEGVFAAMEEIPPGYPPALFVHMPRDADRAQMVAASIDKLKSKHVDVREIQCDAFAVSAEFL

SEQ ID NO: 167764 - protein, 93 aa, Triticum aestivum
  Clone ID: PAT_TA_62182.pep
MDKVLAFSILSASPADIALGTGANGSWARLSWRGRKLQVDDRAGAEHQGKQGGLPREAEQRHDKGKSQSPSTLPPRFAPEFDGIDCFETIVCH

SEQ ID NO: 167765 - protein, 82 aa, Triticum aestivum
  unsure (1)..(82): unsure at all Xaa locations
  Clone ID: PAT_TA_62183.pep
GEHYAAARPDXPAELFRFVASRKVRYDLACDVGARRGQVAVSLAKVYKSVEGRDXSVQCLGYSRELPDVRYVYSHLTCCSTD

SEQ ID NO: 167766 - protein, 90 aa, Triticum aestivum
  Clone ID: PAT_TA_62184.pep
MSHTRMLYFQAHHPHAHFQDNHASVMKNEAAVGANHVQAPKKQVRFQDNHANPIKKDDVNTDVDSVASDFIKRKHMSWALQKSTTMYPSS

SEQ ID NO: 167767 - protein, 111 aa, Triticum aestivum
  Clone ID: PAT_TA_62185.pep
NLKQKMVIRVHMTCDKCRSKAMGLVASVYGVERVEIQGDDRDQLAVVGDGVDAANLTACLRKVGNADLLTVEAVVPEAKPAPASETTEAPWYPSYYSWPAGAYSHCYPYSM

SEQ ID NO: 167768 - protein, 74 aa, Triticum aestivum
  Clone ID: PAT_TA_62186.pep
HYRSPAGPGREYGFRHQGAIAIPCRVDRFVHVERLIDRDLGAHGHQLVDLDCGAATAHGHGHIHLPRFVGCFRA

SEQ ID NO: 167769 - protein, 69 aa, Triticum aestivum
  unsure (1)..(69): unsure at all Xaa locations
  Clone ID: PAT_TA_62187.pep
LPSLATTHSQGGCLECGGNCGCGAGCKCGNGCGGCKMFPDVDATAGPAAXAIPTASHHAPLAPNLHPPP

SEQ ID NO: 167770 - protein, 151 aa, Triticum aestivum
  Clone ID: PAT_TA_62188.pep
MGRMHSNGKGMSSSVIPYKREAPTWVKTSAPDVEEIIVRAAKKGQLPSQIGALLRDGYGIPLSKAVTGAKIVRLLKARGLAPEMPEDLYFLIKKAVAIRKHLERNRSDVDAKFRLILVESRVHRLTRYYRLTKKMPAAWKYESTTASTLVA

SEQ ID NO: 167771 - protein, 124 aa, Triticum aestivum
  Clone ID: PAT_TA_62189.pep
SRGEALDRAAAAAAKMVRAMGIAAAKGFIAGSMHYTPSGVVCLAFAFVAAVAIVAVAVFGCAGHKSSGGKKPRRGHGGSYWAAGAGAGAGVYVGDSGVSTGGGGCGGGGGGGGGCGGGGGGGGC

SEQ ID NO: 167772 - protein, 93 aa, Triticum aestivum
  Clone ID: PAT_TA_62190.pep
STDLDELTLMEMCEMAYVPYAAARAPPYRFVMYEKVEVGTSSERMMSSSSMATCSLKAPSSSRTRGPIYQSADAWLIRTDFPETVLAVVTDNF

SEQ ID NO: 167773 - protein, 92 aa, Triticum aestivum
  Clone ID: PAT_TA_62191.pep
IHTNTQSLCKNLCSMAPLTITLIFRMWHVLEGRPNLADDPENNAPYELILSGLHLMLMALRTGVSSLHLAPQSNGLHCLVHHYFSLGCCCRC

SEQ ID NO: 167774 - protein, 41 aa, Triticum aestivum
  Clone ID: PAT_TA_62192.pep
ICPSLSFIVVVDSRYISSLSKPCIMMPCQEIRPSEALKHIV

SEQ ID NO: 167775 - protein, 129 aa, Triticum aestivum
  Clone ID: PAT_TA_62193.pep
TTSHNHQTIPSTWSDPKIQELLAKPRSDLTEYEIAQLEEYEFSAGPLSILQTAVRSHVQVLISIRNNRKLLARVKAFDRHCNMVLENVKEMWTETPRLAGGKKGRPVNKDRFISKMFLRGDSVILVLLS

SEQ ID NO: 167776 - protein, 162 aa, Triticum aestivum
  Clone ID: PAT_TA_62194.pep
ITRDAYPAPAQHPLLRLNPHDCVPFLDEIFADGQEAKLERLPSPRLMNTHMPHTLLPESVIAGCKVAYVCRDPKDMVVSLWHFLRRRQPELPFAELFEHVCDGAVAVGPIWDHVLSYWRASLARSDRVLFLRYEDLLLDTGKHVRRLAEFMGRPFSPPDEGA

SEQ ID NO: 167777 - protein, 106 aa, Triticum aestivum
  Clone ID: PAT_TA_62195.pep
MTDETPSQTAKSAEDRKAASALENLDAADSPSTPQNVDADAANKAIKSLGSSKASASAASHKNVKVDAADVALLVEELELPKPKATELLKGNEGDAVKAMRAFIKA

SEQ ID NO: 167778 - protein, 78 aa, Triticum aestivum; identical to SEQ ID NO: 106977
  Clone ID: PAT_TA_62196.pep

SEQ ID NO: 167779 - protein, 203 aa, Triticum aestivum
  Clone ID: PAT_TA_62197.pep
ERGEVRGSEGGQPAMSSAEASVARGGEEERCRYKGVRRRRWGKWVSEIRVPGTRERLWLGSYATPEAAAVAHDTAVYFLRGGSLSGNGAAGLNFPERAAAAYGVFSVAPLSPRSVQSVASDAGMAADAQLVAARDGVPRQHYAEARAGAGTAQGGANAELQHDGAYAYTYTGDGGDTTGGGGGTSREQLVSGELSVDDMEILM

SEQ ID NO: 167780 - protein, 103 aa, Triticum aestivum; identical to SEQ ID NO: 107316
  Clone ID: PAT_TA_62198.pep

SEQ ID NO: 167781 - protein, 259 aa, Triticum aestivum
  unsure (1)..(259): unsure at all Xaa locations
  Clone ID: PAT_TA_62199.pep
VPQLVLAPPGWIRGELRIMAPPPTASGPVDIHRSRGQRGCSPMRKRRSSSSYHSSLRPHAHTTSSPRTSRCCSSHCSTTVVGILPNPTQCQGGAALTTCNCIVQCHGGGGSSCLVRPKVEPGLGPMKREHNDEAAFDDEAAMKWAWEDWAWTKMERQHRALEEIAARRRGCDEGGGVVPDDSDDEVSSPAKPIHQGDPGQGSTRDGCVKXXXKRAGDGVELWRVQRVLQPVGAXIFLLLFSRLLLCFYMETNCEPXKYR

SEQ ID NO: 167782 - protein, 283 aa, Triticum aestivum
  unsure (1)..(283): unsure at all Xaa locations
  Clone ID: PAT_TA_62200.pep
PGRGIALAFAAFVLATPMYKRRMPAGTPLKSLCQVVAAACKKISVNVPAEAGHLYEVSDKIDSPQPKIAHTSDFKFLDKAAIVTESDMEERPEAATSWKLCTVTQVEELKILLRLLPVWITSVVVSSAFSQMNTTFVQQGSAMEMTILSVPVPAASLASFEVICVMTWVLLYTKVIVPALRSFSSSGDGEPSQLQRMGAGRLLMALTMAVAALVEMKRLXQHFFLAGGEVFCYIAQLEFFFGEAPDTMNSMCTSLALLAIALGSYRSSFIYAIVEAFTATGDS

SEQ ID NO: 167783 - protein, 183 aa, Triticum aestivum
  unsure (1)..(183): unsure at all Xaa locations
  Clone ID: PAT_TA_62201.pep
CNLGGCSVLGSLWQRTQNSXPGTGCPSDGGRIFAGERIGRDWRRNLGGQRRRTKPPPGGPRARPRGLAVAVARQREIVPPFDLPPRLVKSRPPPSPRRRRSPARGQTGLTQTRQRKEETAASVRPSSRPRPEISPPVPSVTGAEPAVRSRGRPRRRGGLSLSGQIVCFGLVDGAPLPSCWAFG

SEQ ID NO: 167784 - protein, 108 aa, Triticum aestivum
  Clone ID: PAT_TA_62202.pep
DTGGPLAVLCRVLGHRCGFLQPMCIAFANCGCSSRSGRLRTETLHTSEAVGARCSSGFRYAVLRVCIATHIGRRTAMVHRCISYLLGQENRSPSAGDVVGSKDVTVLV

SEQ ID NO: 167785 - protein, 149 aa, Triticum aestivum
  Clone ID: PAT_TA_62203.pep
AKKTEINQKNASTDVKFRIYPPIIRDTTVLVTNQLQVDSVLPSLEKGNGIKRLRESTTLLRVYVRMTYLALKTTDGRVRYPRPSILLPSRKLQGKPASAGEASRALHASSRLGLGLGEDILRHKPPMLVPVSSDSRPISKPNATCPGDV

SEQ ID NO: 167786 - protein, 77 aa, Triticum aestivum
  Clone ID: PAT_TA_62204.pep
QLPVTKYCIVLYIALCELRRWQIIASFRSSLFFSSRKDRRHASPDRRVLSSPLEGACLQPGCSMSYATFRTRVKCKK

SEQ ID NO: 167787 - protein, 109 aa, Triticum aestivum
  Clone ID: PAT_TA_62205.pep
PEPDPTQRLIDIVQSQLGKKDDWMELGLGVAARTTRHERTAQGLQCNAKTPLSLSLSVYTFPLSSLLLVCLLLCIYTQDLQILPSREMTMTDTSSWYRRRSPCGISISS

SEQ ID NO: 167788 - protein, 111 aa, Triticum aestivum
  Clone ID: PAT_TA_62206.pep
GEKVYRAASIQKLSGFRFGPVYKIAIQSKIKFGKARVLIEAKNSPNSTGPPDDDRLNPAEEDLERLLLHLTPKRAPLLACFICSSISLSEQNVCQSLVPGIAQLACTRNPV

SEQ ID NO: 167789 - protein, 79 aa, Triticum aestivum
  Clone ID: PAT_TA_62207.pep
RADPYVWRQRMAGLLMSSCRRLRPVSGHHRRVYSRPPRTSAGAPPPARSWCHQPHRTLTLYTRGDAREERAPRRRIHEV

SEQ ID NO: 167790 - protein, 121 aa, Triticum aestivum
  Clone ID: PAT_TA_62208.pep
FQQSLLSHLLFNSPAPHSSTKKPTNLHRQDRCQLFDSCIARSIFDRRGAGIGSPMTSAQPWRSMFCCVRGAAEVVGTDDERPSPPSTPRRRRGESYDPADALPRAEGVPALSVHPGVYLHA

SEQ ID NO: 167791 - protein, 103 aa, Triticum aestivum; identical to SEQ ID NO: 107316
  Clone ID: PAT_TA_62209.pep

SEQ ID NO: 167792 - protein, 159 aa, Triticum aestivum
  Clone ID: PAT_TA_62210.pep
SQIAAAPDLQEHTTTRAADPQSPMARTKQTARKSTGGKAPRKQLATKAARKSAPATGGVKKPHRFRPGTVALREIRKYQKSTELLIRKLPFQRLVREIAQDFKNDLRFQASAGSALQEGAEAYLVGLVQDTNLGAIHGKGGTIMAQGIQVGRRIRGERG

SEQ ID NO: 167793 - protein, 219 aa, Triticum aestivum
  Clone ID: PAT_TA_62211.pep
HKYKCIADACSAYLRSIETKSCVLYVYLFFCMYVQSANQRTRTRGQKSPTNQATNPILESITRVYLLGSPKNTRWNFEPERTYAGRAAALDLGHLRAVDVWAVGAARGARPAAQLLHVQPPERLDHGRRAARGRQRGPSGGRPVGATQRPRLAEHRQQHERCHDHQQSGPHPPHGGHVVNLSFLATLLLLCLFSLCNKCVRLGRWVWQCVQATCMLYEV

SEQ ID NO: 167794 - protein, 239 aa, Triticum aestivum
  unsure (1)..(239): unsure at all Xaa locations
  Clone ID: PAT_TA_62212.pep
MSAPRGRLAGKNAVITGAGGGIGLETSILFAKEGASILMSDISQPALEKAAAKVKQLVPDAPRVEILKVDVSKESEVQAMIESLDSWGGIDVLFNNAGIMHAQDDDAVNTPENIWDLTQNINVKGVWFGCKHAVLSLRRNKKSKASIINTASVVALVGAATPQLAYTASKGAVLALTRELAMVHAREGFRFNNLCPAPLNTPLLQDWLGDDQAKRHRREVHFPMGRFGEAIEXAHAVVF

SEQ ID NO: 167795 - protein, 111 aa, Triticum aestivum
  Clone ID: PAT_TA_62213.pep
YPLSGVLVSCLPAVPIVSYEICDHVAAPAESILNRMCSGACFVKLRTVDDGSFSWMMISRTFLASLKTGTVHVGYHNPLLLAGHVQCPAGHACGVLVVSLPTCLCADERTV

SEQ ID NO: 167796 - protein, 73 aa, Triticum aestivum
  Clone ID: PAT_TA_62214.pep
AELTLPPAYREFRILLAMKEAIVLCRLSVTRSLRLHATSVLRPVDKQAFHQVDTSRVSYKLTITILESRNYPI

SEQ ID NO: 167797 - protein, 110 aa, Triticum aestivum
  unsure (1)..(110): unsure at all Xaa locations
  Clone ID: PAT_TA_62215.pep
AANAKNRTNPVSDYICYDPLSGVLVSNFPHPYWTAIMPHTLIATELXISGPMTGXALIIYAGTSMRYSLGDTPKNYLIFHXQFVYGGAPLTPGYRNLNYHYCRAKPIMSS

SEQ ID NO: 167798 - protein, 228 aa, Triticum aestivum
  Clone ID: PAT_TA_62216.pep
MAKEKDSGVLNSMELVRKVSPARPTTLHDIPDKLLKIILLYLLASPHWLVRAAATCKRWRRIVVERHFFMCDIPATNPSSLVAGHYHNHTSPVNGRRLIFVPSSSALAVNSRHFSLDFLPGGDSGSWEIVDSHHTLLLLVKKKTGWRRCFPDLLVCEPITRRCQLIPRVEKMKYHPCIGVFLDMHGRRGAITWNGHATDTMSRFRVICVLYHEFKVSGNIGTAKGFVF

SEQ ID NO: 167799 - protein, 91 aa, Triticum aestivum
  Clone ID: PAT_TA_62217.pep
TGGGHWLLFAVAGFEGEAFAGQLGRPWITSRPNREQPMDYEPAKICSLCGRKAARWISWSPANLDARTIRACLTSTDSSRLLLLGDLRDKV

SEQ ID NO: 167800 - protein, 166 aa, Triticum aestivum
  Clone ID: PAT_TA_62218.pep
MATPLSPTIIVMTLLLAPLAMLSSAHEDHHHTPTQAPSPAHHLGHFSPAPSPHHHHGPALAPAPAHGRHRHHHHAPAPSPIHHHHHKAPTPSPIHHHHHHAPAPSQIHHHHHHAPAPTPIHRHHHAPAPLPIHHHHHAPAPSPIHHHRHHAPAPSLVHLDADKVDT

SEQ ID NO: 167801 - protein, 183 aa, Triticum aestivum
  Clone ID: PAT_TA_62219.pep
MAANAGAGAGGSKIRNAKLVLLGDVGTGKSSLVLRFVKGQFVEFQESTIGAAFFSQTLAVNDETVKFEIWDTAGQERYHSLAPMYYRGAAAAIVVYDITNAASFTRAKKWVQELQAQGNPNTVMALAGNKADMLEARQVPVEEATTYAQENGLFFIETSAKTAINVNDVFYELAKRLLAGQQA

SEQ ID NO: 167802 - protein, 42 aa, Triticum aestivum
  Clone ID: PAT_TA_62220.pep
PPLPPPKTLAFPRAAPAVAPSSPGKVDGEMVKFNIVYPQRSL

SEQ ID NO: 167803 - protein, 83 aa, Triticum aestivum
  Clone ID: PAT_TA_62221.pep
RTARDFYNIIVSKENVIAWSCIRCLISLKRARSIWVRMSSLRISPRRRTDIFDMVSGSGSSLRSWRHRSPALALHRSLRHRSR

SEQ ID NO: 167804 - protein, 123 aa, Triticum aestivum
  Clone ID: PAT_TA_62222.pep
VNRVKEIGLLILVEFESSLERVDLDLVHFSNPRRGIDFLAQVFSPLFWGINKANKVCFGGIPSSGAFVFGNQSGGGPFPFSSFRFHHGVSCYGNAVLELQVASQAYRACHEQRRETRIFQEER

SEQ ID NO: 167805 - protein, 190 aa, Triticum aestivum
  Clone ID: PAT_TA_62223.pep
YRTTPEYATAARTCVDNITDIISSVPYQLGWFSNRRELLERANLSAFGCGEEDALKGLPGYFLTWPLTCVQGQDYTTDAQRAWVKGRLQFIGSHLGVRYAHVLRQLNIRVPSMVIRRDGLMAHPYSGGYHFEKLLASQNAPAMARYTLNSNPPHHGLPKERAHPQKHELVNKGSGSMDNQKKVAPGLVPL

SEQ ID NO: 167806 - protein, 234 aa, Triticum aestivum
  Clone ID: PAT_TA_62224.pep
LSLSDPFLSRGFIPVKKCIRLPGQWLAAGEDSAAKTSSRQRRGATSRQGRQPSTKSPITSSSSCSSASALPSPSSEPPSPVSAGSALSRTPHSWPGSAPSTQPTSPVTTTSSTGPTARSCRPTGTTRCSCQTPRLPTPSTDATSPSISSRNAMAPRPGSSPTAAAASSSFTGREQTGRGSFASRTSSSASRSRDGTRGSPTRRRCVATCASARSCSTAAPSTRRVAATACQTSG

SEQ ID NO: 167807 - protein, 209 aa, Triticum aestivum
  unsure (1)..(209): unsure at all Xaa locations
  Clone ID: PAT_TA_62225.pep
MAARAIVVLVSLILAVVAGGASAQLSSGFYSRSCPGMLKAVRSALRPAIARERRVGASIVRLFFHDCFVQGCDASLLLDDAPGLSGEKNAKPNKNSVRGFDVIDAIKTAVEKECPGVVSCADILAIAAEESVVLLGGPSWEVKMGRRDSTTASFNGAENNIPPPTSGLANLTSLFAAQGLSQKDMVALSGAHTIXQARCTFLPEHIYND

SEQ ID NO: 167808 - protein, 174 aa, Triticum aestivum; identical to SEQ ID NO: 138445
  Clone ID: PAT_TA_62226.pep

SEQ ID NO: 167809 - protein, 88 aa, Triticum aestivum
  Clone ID: PAT_TA_62227.pep
ELSSKNPCLLIMHVLNKSANELFCNDSTTLYTVHSYDHSELDDMNNCLGACKLQKRIQLSCSPHTHLQASITTLTRAPTTLICPMSPT

SEQ ID NO: 167810 - protein, 258 aa, Triticum aestivum
  unsure (1)..(258): unsure at all Xaa locations
  Clone ID: PAT_TA_62228.pep
MTEHLPNKQKGRERDRIKRTKDGVTQLPRKKFYRQRAHANPFSDHMLEYPKSPDHMDWSPYFPHYVQEGTSEDSSKPPRLTKDVEIVDIGCGFGGLTVALAPKMPDTLTLGLEIRTQVAGYVQERIKALRSQNSDNMYQNVACIRANTMKFLPNFFRKAQLSKIFICFPDPHFKARKHKARIVSTTLNSEYAYALRPGGIVYTITDVEDLHLWMVQHLEAHPAFERISKEEEEADECVHVMSTETEESKKVTRNNXDK

SEQ ID NO: 167811 - protein, 153 aa, Triticum aestivum
  Clone ID: PAT_TA_62229.pep
ACRAEVTEKEREGRRNFSGVEAEQSSMGLCCGRSDVKVLPKNNSLASSPSPSVIDSRDGANNKQPQGVKKEGKDKKRSSLDRPAMASPRLPFHCSTRPNVIEFADFQNKSAYSIQSCRLSYYLTPGLASLVPLKISFVLCPARTVLFMDGRVI

SEQ ID NO: 167812 - protein, 103 aa, Triticum aestivum
  unsure (1)..(103): unsure at all Xaa locations
  Clone ID: PAT_TA_62230.pep
MSGRGKGGKGLGKGGAKRHRKVLRDNIQGITKPEIRRLARRGGVKXISGLIYEETRGVLKIFLENVIRDAVTYTEHARRKTVTAMDVVYALKRQGRTLYGFGG

SEQ ID NO: 167813 - protein, 129 aa, Triticum aestivum
  unsure (1)..(129): unsure at all Xaa locations
  Clone ID: PAT_TA_62231.pep
MASEKDAALAPVPNDNPTIFDKIIKKEIPSTVVYEDEKVLAFRDINPQAPTHIVIIPKVKDGLTGLSKAEERHVEILGCXLYAAKVIAKQEGLEDGYRIVINDGPSGCQSVYHIHVHLLGGRQMNWPPG

SEQ ID NO: 167814 - protein, 95 aa, Triticum aestivum
  Clone ID: PAT_TA_62232.pep
KRQEITFYLLNSTISFQIRGKPRNQQQKETMTLFIVRQFISCNAGRSSPHHTWLPPKLLPSCFCIKHWLFVEVGHRPRALYPHMRHDIDRVADDI

SEQ ID NO: 167815 - protein, 173 aa, Triticum aestivum
  Clone ID: PAT_TA_62233.pep
MQIERPRAKIMSSRVDESELRKVFQMFDKNGDGQITKKELGELLKNLGIYIADDEMDATMAKIDTNGDGCIDVEEFGLLYRSILDEGDGPNGGNMGDEEEEMREAFSVFDQNGDGYITIEELRSVLASLGLKQGRTVEECRQMINKVDANGDGRVDFKEFSQMMRGGAANHED
